United States Patent 7,745,391 (HUMAN THROMBOSPONDIN POLYPEPTIDE) - sequence listing, part 48

SEQ ID NO: 128817 - DNA, 302 bp, Homo sapiens
caagtcaccaatgttgcctaaagactaacccatggaaacttttcagttcttacttgacttgtccacagttatccactgttactactttccccacccatcccccagtttttaaagactctcttcccctgacagccttgtctccgctctctcctgtcttctttggcctccactccagctgcctctcttggctcttggttgtacctttttcccttacccattatctcaatgttggtattccttggagtcttctcattctatccattttcagtgggcagttgcttctacttccattgctccaaatg

SEQ ID NO: 128818 - DNA, 276 bp, Homo sapiens
ttgaccgcctgtgataccagggaggtcttgatcacattccattcatagagagggaaacaggatggagaacctagatatcttacccataatcacacagcccagggggcgggcagagctggggttaaactaaagccatctgacttggggcttgctgtcttctttccaattgatttacattcatatataggtaatatttatacctagaatccctatgcatagagtagttgtgtgtacatgcttcgtatatcatcattcactccatcaaatatttattga

SEQ ID NO: 128819 - DNA, 295 bp, Homo sapiens
atgtgaattctactactctcctcagggtatgagagagagaaggcgacagcaagaggaaccggagggagatcagaacagctggtgaagccggagttagtgttggagaggctgggcatgcaggcagggaccagatcaagcagacgcttggacattctgctgaagattttagagtttattcctagttaagagcactggagtcattgacgatgttacccagaggattaagatgagacctttggaaaatcacctggcgtcatatggcgaatgcatggcagggaacagagtggagagggga

SEQ ID NO: 128820 - DNA, 298 bp, Homo sapiens
gctgtgggcctctgcacatgcgttcaggcagccgagagagagaaggcgacagcaagaggaaccggagggagatcagaacagctggtgaagccggagttagtgttggagaggctgggcatgcaggcagggaccagatcaagcagacgcttggacattctgctgaagattttagagtttattcctagttaagagcactggagtcattgacgatgttacccagaggattaagatgagacctttggaaaatcacctggcgtcatatggcgaatgcatggcagggaacagagtggagagggga

SEQ ID NO: 128821 - DNA, 282 bp, Homo sapiens
gatcttccaatcataagtagtataatggcagctgtggacaaaacttcagacaagtgactaaggagacatctagcagctgttcagttttctccaaactctgtctgagaaaatacaatacccaatctatttccaattagcctttcttttttatttttcagcagaccccctgaagcccttgagaactgagattcctaaagttcaagttactgaggggctggagtgggaagggaaaatgtctaacaggggtagatagagggatgcaggaggtaggggcttggagag

SEQ ID NO: 128822 - DNA, 844 bp, Homo sapiens
gctagatgctttgaaagacaaaaatcaattaatataagacctaactcctaacaaaagatacggataatcacaagtcagatggctttgattcctaaattcatctcgggttgtaattaaaagacttttaaattagcactaaattattcaaatcaagtaattaatctggttttttagacttgaaattcaatcagcatttcctatgaaatttaaaattaaaaacttttttttttgaggtggagtcttgctctgtcacccagttggagtgcagtggcgtgatctcggctcactgcatgctcagcctcctgggttcacgccattctcctgcctcagcctcccaagtagctgggactacaaggcgcctgccaccacgcccagctaattttattttttgtatttttaatagagacagggtttcaccgtgttagccaagatggtctcgatctccttacttcgtgatccgcctgcctgggcctcccaaagtgctgggattacaggcatgagccactgcgcccagccaaaaacatttttaatagaaatttaaatataactaccagtaaaatgttgtatgactcagtttactactccatgtgataccactgagcagtgtttccagaaatgtgtcaccactggcaatacctgagataacattaggaagcatgagacatgatttcatgttcatggatatggcattaattagcattgaatcacataacgacaaagttatttcctcctaaacaacatttaatctttgtgattatctcaaggaggacctctcagtttggtgttgtctctaaatttctctaatttttcattttgccaaggtagagcagacccctgtaaaaag

SEQ ID NO: 128823 - DNA, 265 bp, Homo sapiens
cttggtcttactttttaagggaaataatttctagtgcttacatattatggaatactaggggcaatttaaagtcatgctgacagagtttatactgacatgcaacaatgcttaaaacatactaagcaaaaacaaaggcaagacaaaaacttggaaagatccactgtgttaagatgcttaacaaaaagggctctaaggaaacattctaaaatattagtagtaattttctctggatgctggaataataagtggtttttaaaactactta

SEQ ID NO: 128824 - DNA, 234 bp, Homo sapiens
ctgggctggggaagacgggctgggctggggaagagggagcatggccaaacaaaggtttggaaagctaaaggaaaagggaccagatcccctgggattatgagcagcaggagtaaagagcggcaagccatggctgctccacagaagagagggagggaggccagggcagagctcccagctgcctgttggatgcaccgagtggaggccccacccgcagtcattcactccttgaagcag

SEQ ID NO: 128825 - DNA, 340 bp, Homo sapiens
gtaagacatcaaaaatgaggacaagtgggtgagtagtatatgaaaattccctgtacaatttttacttttctatcaacctaaaattactccaaaattaaaagtttatttaaaaagacaacaataacaaaaaaaacacaatcatttagataatctctattatcttttccaaatcgccattttgtgacttaataagggtaacacataataacagtggctaatatttaatgggcacttatcacatgtcaggctctgttctaagggctttatatgtattaactcatttaatcctcacaacaagataagtaattttcttattattattttatggatgaggcaacag

SEQ ID NO: 128826 - DNA, 207 bp, Homo sapiens
attttaaactatatttttgacattatcaccgatgatagatttttgaaaactccttgacatctttagtatttcgtaaattatgggttttagcttctgcctctcattttgttagtggtattaattaatctttataatagccctttaccacatttcttgcagaaatttttttattaactttgatttcattcactcttaatacaaatttat

SEQ ID NO: 128827 - DNA, 205 bp, Homo sapiens
taacaacttgagcttatttgctaagtaaagtttttcatttatgctttatgctgcttgactcagaagactgaattgggaagttccttaaaattaaaagctctcataaatttcttcaagggtggttacaaaaaaattattgactggctaaactacaacagccaaaaggaaggtcaattgtcaatcttgcataaaagtttatttcttg

SEQ ID NO: 128828 - DNA, 391 bp, Homo sapiens
caccccccaacacccccccgcaaggaagacccctcattgcccaccaatgtcctctttctggcgtccctcacattcctggccgagaccctccgttcagtcacgccatgaggtcagggccacggatgccattgtctgctggaagccagtgcagcacttggagcttagaagatgcacacaactctttgttaaagaacaaagaaatgggagaaactttttaaaagaaaataaacagagagaaagagggtgagacgaagactgtggctgaggctttgttttcaggccgaaagcaggacactcagctcattctcaatgaaacttcaacatcgataattcaaatgtcttagaaattgtacattggaaggggaaataaaatgatttttcagctctttta

SEQ ID NO: 128829 - DNA, 619 bp, Homo sapiens
attcgtggctcatgcctgtaatctcagaactttgggagaccgaggcgggcagatcaccttaggtcggaagttcgagaccagcctgaccaacatggagaaaccccgtctctactgaaaatacaaaattagctgggtgtggtggcacatgcctgtaatcccagctactcaggaggctgaggcaggagaatcacttaaacacaggaggaggaggttgcagtgagccgagatcgcgccattgcactccagcctgggcaacaagagcaaaactctgtctcaaaaaacaaaacaaaataaaaaagaaagggtatttaacatctcaggcttgggcacaagtgatcgcaacactcaacctgcctgccataccataagcatgcattaaactttctattgcatttaacagtacttacattgtgcccttcccaaaagatagaaagaaatggattctcctaggaatggcttcaaatttgtcatatgtgaaaaaagaaaataaagtctgtaatttaaacattatatatacacacacacatgcatatctacttgctatatttaaaaatctagttagaaatgaaaatatgtcaatgaccctatcattttgaacaagtaaacataaaatggaata

SEQ ID NO: 128830 - DNA, 243 bp, Homo sapiens
ttcattgtgttttgctttttccaaagcttaaaagtttcaagccaagtgtttttctggagttattcaaatgcttgtgataattcttattgttttcttgggtgacaaaatctttcctgcccactactcttacaccaaggtttttctatctacaattaagaatataattatgaggccaggcacagtgcctcacacctataatcccagcattttgggaggccaaggcacaaggatcacttgagccca

SEQ ID NO: 128831 - DNA, 462 bp, Homo sapiens
gaaggaacacctttaggaaaggataactagaagccatcattttagcatatggtattttagaatatcccccacgtccataaccccagatgaacacggaggaactctcataccacggacagagaggacctactggctcaccggacaccagctgtcttggcctaagcccgactgtgagaaacacacgatctttcagaaaggatatgtacaggtgtgcatgtgtgcacagacaagtgtgtgccagagagggtggaagagagagggaatagtcagaaataggtcaaaggcaactgcaggttcataggttcaagcttatatttcctttctacattgtagaatcagactaacgagaaaggagggccataagttttggaacaagacagatttgtttttgatcacagctcaactgtttaattactttgttactttgaacaagttgactcccccattcccagcttaatcatc

SEQ ID NO: 128832 - DNA, 634 bp, Homo sapiens
gcagtgaagcccctgccccccaactcacacacagggagctgtggtcacagtcggaccacttggcagccatcataagacttgaaatggggggtttgaagccattgcttgtgaattagcatgtttttctctcttttgcctttgtgaaaaccaacttcctgtgcagccgcttgtgttttaaaaccctgaaaaaggggggccagctctcagcccttgtccaccgctggttcctaggaccgttatgaattaaagattacagccgttaaaaagagatcgtctttaaacaagcgcagttctctctcctcatgccccctgagtggagaagtttttgtgtatagcgagtccaaaacaaacagagatgttcttgagagatgtggggagcaggggccgagacagcaggagagcgagggcagcagagggacagtgggggagagccggggaactgtagttttgaattgttggcctcctgtctgcatgctcagagaagcagggccgcgtggagtgcccagcggaacctgctcatgctgatttgctgcgtcaccttgggaaaacgttggctttgctcctccgcagcacgcacacaggcacaggcacacacacgttcccatcccagctggtgcccgcgtgtgggtgttag

SEQ ID NO: 128833 - DNA, 175 bp, Homo sapiens
gtcctataatattccactgaggctgaaaatgctaagagactccacggttaaaaacaacctttctcaagttgcattaatgttcctaggctctaggttccttcaaatgagagaaacaaatatttcatttgttttcggattataatttccctcaactccgtgtgttatttgtttccta

SEQ ID NO: 128834 - DNA, 137 bp, Homo sapiens
attgcactccagcctgggtaagaagatctcaaaaaaagaaagtgtcatcatctactagattggaaatatcagatattcttgagtctttcttctccctcatatacagttagtcatccagttcttcaaaatctcgttga

SEQ ID NO: 128835 - DNA, 796 bp, Homo sapiens
atagctcttaaaaaatgaatataatgtcctaagtataacaggaaagagaaatataaggaaagtaatttgcaataaaatcatgctttttcttctcctatttctagtattggtggcacagattgtaccagactaacctactagcaggtaataaatattgtaagcctcttaggcaaaacagcatctcccagtattcagctcttgccatccctctgagctaagcctttctcccctgtggcacttagtactgagtgacattctggttttttaattgttggcttcctcctctgctaagaagctccatgagggaaaggaatgttttctgtttcattcagctctgtatcctcagcacccagaacagtgcctggactatagcagttgcccagttaagcagatgtaccttttacttcttgttctctgattcatcagcaggaagagcctatgaaaggtctcccttatcagcccatcactgagccagatattccctctggttagtctcttgcccttgttcctctctgctggatgagatgatgtagcagctgaagactctccacctataactgtatcgtgccacattcagatttttagaatgcccctcttgatctggccatatctacattaaatgctattttcttcaagcagtgagacaaagctgagagacgataggtttaaagattggttacaaattctgatgaagactggtccttgaagtctttgggctgttacatggccctttggaagcaataggtcatcactgtgaacaacttctgtaggtactggtttccatacgaagggaata

SEQ ID NO: 128836 - DNA, 116 bp, Homo sapiens
aaatattcacctgctcaacctctcaagttagttaatgattcctttaagtgaggtgcctagagctagggtcagtagagttggcttttgacaatcaccaagttaacatttgcagtttc

SEQ ID NO: 128837 - DNA, 347 bp, Homo sapiens
tcagtaggaacggtgacctggagaagatcaccataatccctacccctgaatggttggtgttggtagtggtgggttgttcagtgccttcattattctcagattcttaaagtatttgagaatattaaaaatgcggctgagctctgtggctcatgtctgtaatcccagcactttgggaggctgaagcggttggatcacgaggtcaggagttcaagagcagcctggccaacatggtgaaaccccatctctactaaaaatacaaaaattagctgggcgtggtggtggcgcgcctgtagtcccagctactcgggaggctaaggcaggagaattgcttgaaccaggaggcagag

SEQ ID NO: 128838 - DNA, 198 bp, Homo sapiens
cctttcattcatgtgttcaacaaaccttacagaggcccagtgataggccaggaagtgtgctgacactgcagacaggtcagtgagtggagcagatactgtaccctgacactgttcctctgtccccgcccttgctgagcacctgtcacactaaatgtcatcacacaccacttttatgttactcttcttcttaataacatt

SEQ ID NO: 128839 - DNA, 375 bp, Homo sapiens
ccaagtggtgtcacctatgtgtgtcctcagggttgtcacaatgcaattatccttgtaatgtgtttattagcatatgtgcctggccaccacttggtcctcaataaaatgcagttgtgaaggaagaacagacgtttatacatttggggctcaagaagtgggcctcagatagcttcaaaaccatcttcagctgggcacggtgtcttatgcctgtaatcccagaactatgggaggccgaggcaggtggatcacctgaggtcaggagttcaagaccaatctggccaacatagtgaaaccccatctctattaaaaatacaaaaattagctgggtatggtggcatgcacctgtaatcccagctacttgggaggctgaggcag

SEQ ID NO: 128840 - DNA, 523 bp, Homo sapiens
caggaagcaaagtctgtgaaatagtgacatgccgcttaggtaggcacagctacttaaaagtgccctgtaaggcttgaattgagcagttagaagacctgagtctgggtgagatttctgggggagtgattgtagagaagaaaggaatgaagaatgaagaaaacagaggtgggagaattagaaaactccttggaattcaaagaaagagaatccttcaaaaaggggatcatcagcttcagagaactgcagatagacaagatgaacatcactggacaatgtagattcactggaactcgaggttgaagatgattaaaccgaatggatgatataaaagtggaagcagtgggtggagaacagaagtttggcagagaaacgaaggagaggagcagggtagtgtacggatggaacaacttcaccaaggttttttgtttctagggcagaggaggctttttttttttttttctttagacagagtcttgccctgttgccacgctggagtgcagtggcagaatctcggctcactgca

SEQ ID NO: 128841 - DNA, 371 bp, Homo sapiens
gaaacgtcatttaaaaattggtctgtcttatgaagccacttaataaaatagtctttaaaataagaaaaattggctgggtgcggtggctcaaggctgtaatcccagcactttgggagggcgaggcaggcggatcgcctgaggtcaggagttcaagaccagcctggccaacatggtgaaaccccgtctctactaaaaataccaaaattagccaggcatggtggctcatgcctgtaatctcagctccttgggaggctgaggcaggagaattgcttgaacctgggaggcggaagttgcagtgagccgaaattgcgccactgcattccagcctgggcagcagagaaagactccatctaaaaaaaaagaaagaaaga

SEQ ID NO: 128842 - DNA, 426 bp, Homo sapiens
gtagctgggactacaggcacatgccaccacgcctggctaattttttgtatttttagtagagacagggtttcaccatgttagccaggatggtctcgatctcctatatcttataaactcattctagatcccatgtccagggaattccaagaactaagacattcagctcactctccttgctctgactgggattttttaaaaaatcaaatgctaaatatattgttagcatggctggcagcatctcgtatcgatccattagtgttatatcatgaatctttcattatactaacattttgtctttctgaaagactgtcaactatgatttcatcatcaaaatcaccatcagctgtagagctatgcaaatgagaattcatctgcatgcttttggcctaaatggaatttgatggagacctaattaaaatgagagaa

SEQ ID NO: 128843 - DNA, 700 bp, Homo sapiens
gtcctttatatgtaaagagagatggactttgctttagtaggactttctagaacatgcttatctgcatggtttggtggcgctctctcactttgtggacaagatgaaggtctggtgcctaagctggggtttctcaaggatggagttgttgaccatctgagaaaatgttttcctgtgcccacataccgtaggggagggctgccatttcaacagggctaacccacagccatcaacagtggcttctatcagctttttgtaactgttcctctgacggaaagctccagggcagctgcatcatttccttcctcttacatttgtgctcaaggctcaccctggtcaagaagcctggctgcatttcccagaggttcttttatcagccagtagaacctatgaccttgtaccctccgtgttgcccttgctgtcagtcggctcttgtttatccttccatcttttctttgtgaaatatcactcagagatttgtccataggagtgctgaaagagcttcctccatttatgtcttgactgcttcgtattccataaaaaaatagtttgtttaaccagtctcctagatagaggtttcctttatttgtaatcttttgctttcacaatgttgcattgaatgcttctgtattttcatcacgatgcgcacctgtcagtataggataaactcctagaggtggaactactgggtcaaaggggatgt

SEQ ID NO: 128844 - DNA, 228 bp, Homo sapiens
gtagatgcatgatgatctaagggctcaaagactgtgaggccacctgctcagtcttagggaagcatagactttctcaagtgtcaattgagcagcagtgctgggtcatggacagacatgtcagtgggagtcacagcgcctggtacccctcccagtccctcactaatgagttgactggctggctcaccctgggttcattacctggaatgtgcaactgctgggccctttcca

SEQ ID NO: 128845 - DNA, 757 bp, Homo sapiens
atgttaatgaaatcatacatttttttgtgtctggattccttggcacagcaaatttttctttttatgttcattcacgtatttgcagtagttcactcctttttattgctaattagtattggttgccaaaatttatcattatttattcattccccatttaatggacatttagttgcttctcattttttcacaaatataaatatatgaacattcttggatagattgccaaatgattttccaaagggttggtgccattttacattcgaacaagcaatgtatatggattcacttgctgtaaatctttgccaacatttggtatgctggcctctgtagccattctagtgctagttttctctcctagtcttaacttaggatttctgattacttatgttgagtatctttgcatgtgctcttggccaaccacatcttttgcaaagtatttaaatcttttgttcatctattcttattgagttacaggggttctttattttggagacaattcttttatcagatattgcttttaagactattttctcttcagtctgtggcttccctttctaatttctttgcctttgtgtgtgtgtgtctgtgtgtggtatttttttgtacagacaaaaaaaggtgttgtccaggctggtcttgaactcccaggctcaagtgaccctcctgcttcagcttcccaaagtgctgggattacagtcgtgagccactgcacctggtcccttgccagtttcttaacagtacctcttgagaagcagat

SEQ ID NO: 128846 - DNA, 436 bp, Homo sapiens
ttaacaatggagcaaagaggggtcacagggacaagataaaaataaacagaaagcaccggattgatgcaacaggtacatgtagtttgtcttgttgatgagtcactggtctgagaaatctgtttaggtttggcaggaagcccgtgaacaggctgcagcttaattgtccttccactgtggttgctcccattgtgagcttcaggctctttatttttaaaaagtctgggtgatcacaatcctcctggatgagatcatatggggactgtattgctgacccatccaaccagaatgcccttttacagttcctggctatcaaactcccactcatcctccagtgcagttcaagtgtctctctttatgggaagccattcccgttagcctggtcagaaataatgactctttattttgtgtcctgctctattaacatttgcaagtccct

SEQ ID NO: 128847 - DNA, 336 bp, Homo sapiens
aaggaaataagaactgaaagacacgtttttgggaaatgtcatctgagtagggattgatatcatcaagacaggtcaggagtcgtgacagagagaaagggaggtcctgagccatgagctaaaagcttcaagaaatggcagggagtgatgggaggattgaggctgatttttgcaccttctgttacttggctgagaccaaggcgcctcttcctggggaggtggctgagctctttctagcaggccctgaaatctccagaactttggtcccagctgcctaagcaccccagtccctgcccccgtggcagccattgtcagatgttcctgccagccctgagagct

SEQ ID NO: 128848 - DNA, 116 bp, Homo sapiens
ccggcatgacagactcggtctcagaaaagaaaacactacaaagacacaaagaaaatatacagactggatatggtagctcacccctataaccccagtgttatgggaggctgaggcaa

SEQ ID NO: 128849 - DNA, 600 bp, Homo sapiens
gctggtcttgaactcccaacctcaagtgatctgcctgccttggcctcccaaagtgctgggattacaggtgtgagccactgtgcatggccagattaccagatatttattgagtgcctgtattatatggcaatataaagtttttggtttttgccttcatggagcatagagtcaagggagtaatgcagacagagagctgaaaccatgtgatttctcctcaggtaggtatagattctctgaggatagagaccatttctctttttttcatggttctttatttgccccagaggaatgggcactttgggattccttcttgactggcaagatgattaacccgatgtttactgacaagccctccttgtggtagggcttagtactatgttctttatctaagtgttttctttacttttctttctttcttttttttttttttgggacaaagtctcgctctgtaggccaggctggagtgcagtggcatgatctcggctcaccgcaacctccgcctcctgggttcaagtgattctcctgcctcagcctcccgagtagctgggattacaggcactcaccacttcacccggctaattttttgtatttttagtagag

SEQ ID NO: 128850 - DNA, 417 bp, Homo sapiens
ttgggctctcaacacattttaattttcataaaaccctctttaagtaggtcatgtaacttctttttaacagtacctgaagccacccccactgaatggtagagatctcctggggttccagagcatctgagttcatcaagggtgatggtctctcccagctggctgttaaccagcactctttttctctcctctccatcaactgggacatattcctagagcagagaaatctatttttaagtgcgatgagatatttattgactggcttcattgtctcaaaatacttgccttagcctttccttatgcctgggcaaattctgacaccaaatggttgttttctgcagctaggccttagcatacatcctgcaatgactttcttacaaaaagtggtaaaaacaacttaaagcacagctgtactaagag

SEQ ID NO: 128851 - DNA, 398 bp, Homo sapiens
aaatcaacttatgcctcatgtctctacccttctcagagcccttctgaagctccccagtatcctcaggagaaaagccaagggcgttggtgtggttcaccaggccctgtgaagctcctgcctccctccccttctcacttaccctccaaatctcagggcctttgcacaggcagttcctccttcccagaatgctctcttctcttccctcctctcctttctcctgagtcatgcccgctcatccttccagtctcagctcagacatcacttctggagaccctctttcctgagcccctacatgagctcaggtgtcccccatgcccattttctctcctggtgtcctgtacttttgcaccagagcacttaaaaccatttgtaattatcctattaacttgtgtgttcag

SEQ ID NO: 128852 - DNA, 453 bp, Homo sapiens
gatggatcctccacggacgacgacgtctgtcgagagtacaatgaagcctagttgagccgcgtggatttatgctcagaccgcaccgtcctcaaagtcgttctagacttgtaaaacccctagtgatctttccttttcatcttatctgaagagttgctaatgtttctttaagatgactgtgtcctctttttcttcatacaatgacttgtcacttcagtcctgaacaaatattgtctgatatattagcatatcagtggcttagaaaaatataaaggtaaaatgtactagagctgaacaatatagatcccctagtcactcacttttaattacatttggatggattattcattgccatggaaactctctacccttaccaaaatttttaggcaaggatctcctccaagtttcacagttctgtgtcttaaagacatttcttgttctatttatgagtttaga

SEQ ID NO: 128853 - DNA, 582 bp, Homo sapiens
ggatgaataaactgttatctgacattgctggacagggtgctagaaataaatgcagtttttctccttgagattcactgacttgggttttcatttgttggggtggggggtgtggattaaagagcagaaagctgaaggcagagagggtatgatggtgtaacctgcaggttaagaggatacagatattttaaaagatggtactttgggacaaagtgcttttccattgtttcaggggtcagactgatcctcagcaaagctgacagagcccatccttagtggatgccactgtaatattaacactcatttggagcagatgtgactaaaagcatgaaacattgaacaaacagctgccacagatccagtgccattgcataagcgcttatgttctattaatgcagtggattgctgaggccagtagggcagacgttattccccacagttctttagcagatgggccaaacacaatggctcttcagagaagtgctgccctgttgaagcaattcctccatcttatgtaagattctaatgcaaaatcatctacccattaaaaaagatgtattaaggtcagattatgctttgtcaaga

SEQ ID NO: 128854 - DNA, 523 bp, Homo sapiens
ttttagagactgctgagctgaagttttgctgaattctcaaaacactaaactgcctgtgttccctctcggctttcattttctaattggaaccaggcacagtattgtaacagagaactgcaattaattttctaaaatagtggcaacttgcacagtataataactttggttgtaaccaagtgaaagcataataacaaaaatacaaaattactgatgaaaccagaaagagtcatataccacattcttcctttagtttgtatctcagtaagtgctgtgttacttaggaataggggcagaagcctgcaactgggcagggaggttcagggacatgaggacgaagctagggcattttgagctagaaagcaagaataaggattagtgctttcaacactggaattaacatggaccacccccccacctcccaataagtggggattgtaggcacataagtggtttagtaagaagtggaaaaggtttttctgtggagttcgagttccatcggctcccatccgggctatcctgccac

SEQ ID NO: 128855 - DNA, 490 bp, Homo sapiens
gtggggaaggttcagaggggactgagcctgagcagtaggagggactaaagcagttctgtgtggcccgtgtcccaaggagaaggggagagggaagatggggccagagggtcggcaggggcatgtgctgggacctggtgggcaatggtgaggagcctgtgttttcttctaggggtgagcaaagggttgggcgggggcatgaggacctgattctgctttttaatctgccttcagctgctgcattgagaatagatcaggggcgggcagagtagcagcagggagacctgtgaggaggctgccacagatgccagtgcaagggctgaggggcctgtagctcgtggttgccatggcgatagagagctgtgggtggatgccaggaatgtacaggcgggtcttgctggaatgggcttcttcaggggcagggctgctggctgtgtgttcttcaaggcaggtggacctgtgactgcagcccccacaggtggagaggtgggtg

SEQ ID NO: 128856 - DNA, 256 bp, Homo sapiens
ccaccacaaacaatggaggccagaagacatcaggatagcattttcaaaatgctgaagaaaaaaaaactgtcaaataagaattctatagccagcaaaactatccttcaaaaatcaaggtggagaagggcacagtaactcatgcctgtaatcccagcactttgagaagcccaggtacgaagataacttgaggccaggagtttgagaccagcctgggcaacacagcgagatccccatcactaaagaaaaattttaaatt

SEQ ID NO: 128857 - DNA, 279 bp, Homo sapiens
tgaagaggattccgcagaggagactgggttgaggagcttgggatggggaggttaccctggattatccaggggggccagtgtcatcacaggggtccctaccagggacagagggaggtgggagagtctgagtctgaggaggagatgtgcggaggcagagagccgccttgcaattcccggctttaagatggaggaaggagccaccagccaaggaatgcaggcagccttggagaacgggcaaggatactccttctcctctggaggctccagaaggagccagcc

SEQ ID NO: 128858 - DNA, 462 bp, Homo sapiens
ttggttattttatcaaaagaacttccgggccgggtgcagtggctcacgcctgtaatctcagcacattgggaggctgaggcgggtggatcatgagctcaggagtttgcggccagcctggccaataatgaaaccctgtctctactaaaaatacaaaaattagctgtgcgtggtggcgcgcacctgtagtctcagttactcgggaagctgaggcagaagaatcacttgaacccaggagacggaggttgtggtgagctgagatcacaccactacactccagcctgggtgacggagcaagactctgtctcaaaaaaaagaagttctctgtcctgtctgagatgatcggcagcattgtttatccctgtagccctggtactctttattgatagtagagattttactccaattaggtactttttaaaggtaatttctatgaaaatctctataaaaatgcttattaaaaaa

SEQ ID NO: 128859 - DNA, 519 bp, Homo sapiens
tgagggcgagtctagagaataccccgcggcccacagacagtgggcggacagagcatcaaaaactgactctttcacagctctgcaggccagaagtcagaaatcaaggcatgagcatgactggctatttctggaggctctgaggggccctggttccatgcctgtctcctagaaccttgtggttcccagcaatccttaccgttcctgagcttggaaggctacattgctataatctctgcctgtgtctacacgtgatgacattctcccaggatgtctccatgtcaacagtctctctcagctaggtcttataaagatgcctctctttgaatttagggcccaacctaaatccaggatgggcccatctccagatccctaatggattatatctgccaaggacctttttctacataaggtcccattcacaagttccagggagtaggttgtgaacagatctttctggaggacacaattcaacccaccacagcgagtgtttgcatttccatattctgcactgggaggctg

SEQ ID NO: 128860 - DNA, 610 bp, Homo sapiens
ttgaaaaaaattcctattactttcttgcttttttaaacagaagatagggcatagtacttaacttttttggcaacttgtttcattgttatgtataccagttgttactctggactgtaaatagaaatacctctatagactactgaaaattgtagtagttttgtacccaaataactagcccctgagttttaataatttcctctcccttttcttactgttcagctgtcagctttcacattaagctactgtcattatgcttgtccctcataacgtctcattattgccatctccaccactccctcttctcatttgctctcctaaactgcttccaacatggaaagcagatcatcaaactcattagagctgtataaagtgaatagattacaagtgagggcgggaggcattaaatgtgcagttccgtagtgttaagtacattcacactgttgtgcaaccaaccaatctccagaacgcttttcattttgcaaaactgatgacatgctctcttttgattcttaacaatttccttttttttctcagccgttctctcagttattgcaatgactagacaaggacctttgaatgtgtcgccataatgcagtaaaagtagtcaagt

SEQ ID NO: 128861 - DNA, 372 bp, Homo sapiens
cttttgtagaactgactttcagtgaactggttttcttggaatttgacagagagccattttcaagtgaacactggtctttaaaagtgtttcttttagtgttggcaagttcaaaaaaatttccacctacacacacagaggaaaaggccatgtgaagacagagtagagaatgattcgaagatgctagccttgaagactagagcgacgcagccgcaacacaagcgatgccagcacccaccagaggttgggagaggcaaggaatggattctcccctacagcctctggagggagcacagccctgccaacatggcccagtgatactgatttcagatttctggcctccagcactgtcagataataaatttccattgtttt

SEQ ID NO: 128862 - DNA, 247 bp, Homo sapiens
tttatcagagccccagtttttaaaatgtttaatagccagatgtgctgtttgccaggcttagaagttggtacttctgtgaatgaaaaggtgtgactgagtcacataaactggtattcagctagccagtcatcagtttattccatattcaagggaaaaccaaggactgtttttcctctttatactttgaagatgatggcatttaaaattcaagtaattggggctgggtgtggtggcccacatgtgaaat

SEQ ID NO: 128863 - DNA, 757 bp, Homo sapiens
aatggcccaggttccattcacagtcctcttctctccgttaccaacactggtgactcccaaatttctaattcaagcctggacttctgccctaaactcgacaactgtattcaacatctccacttggatgcgtaatagacatctcaaacttcactacccaaaacttcattcttcacctttaccacgcctcccaaaggcttcatccctacgtttcccatattgcagttgctggcacctccaaatcttccagttgcttaggccaaaaaccttataatcatccatgatctcacacgcttaccctctacatccaatcagcaggttgtactggctctaccttaaataaatacccagaatccaaccacctcttgccatctccattccttccacatgattcaggttaccatcggctctcacctcgattattctaagagcctcctaactggtctccctctctcacccagtccctctctatacctaacagagaagctagtaatactttttctttgtaacttttaagttcaagggtacaagtgcaggttacataggtaaacttctatcttgggggtttgttgtacagattatttcatcacctaggtattaaactggtaagaacagatactacacttgatcttagccaaaagacagagacgcaatcactcaggtattaagcaatcacccaggtaatcactaggtattaaacctagtacccattagttactgttcctgagctctccctcctcctacttcttccaccttctga

SEQ ID NO: 128864 - DNA, 333 bp, Homo sapiens
actgctggctggctgtgggctgggcagctgacttcctcttgctggaatgagtctggccatccctaaacagggggactttggtctgattcagtcattcagtcaacaaatatttcccaaaagcctagtaagtgcctggtgtgtgtactggagatacagcagtgaatgacacaaagtcactctcctggtggatagcaaaaataagcaaacatagcaaaatagaggcctaggctggggaaaacagtgggggtgtgccaacaatcacttttataaccattccatgattttgcttgggtaatcccttttaatggtgaacttcaggtcacaacagtaact

SEQ ID NO: 128865 - DNA, 708 bp, Homo sapiens
ccacacggccctcctgcattccacacacctgctcagcaggacagcttttagctcttcaagaagctcccaagtcttccagagtgagttatcattcagatcagaccatcccaaaggtaccaccgaattcagtgggaacaacttcatcatgtaaaacacagtcacaagcaaatagaaatttggacttttttcaaataggtatgaaggaggcagtaattattagatatcgatagtgatgtgactttgaaataaaaattttctgcttctcacagtctgttcctgctgctacaacaaaataccttaccctggatgatttataaacaacagaaatttattgctcacagttctggaggctgagaggtccaggattaaggcaccagcagattctgtgtctggcaagcgtgtgttgctcatagatggagccttctgtgtcctcacatgagggaaggggcaaggcacctctcttcagcctcccgttctcatgacttaatcacccctaaaggccctatctcttaatactatcacattggggtttagtttccaacatatgaatttgggccagggtgagggaaacaccattaatactttttctagctgctagattcattttaaaactctcctgagtccgggcacggtggctcatgcctgtaatcccagcattttgggaggccgaggcaggcggatcacgaggtcaggcgttcgagaccagcc

SEQ ID NO: 128866 - DNA, 800 bp, Homo sapiens
gcattgataggtttttttttaaataacaactagaccaagagaaagggagagtagtgataaatgtccatgttttcgagttgaaaagtaacaatcagtgtattacaacagatggatttgatgtcaaattacaaatgctgagaacgttatatgtaactgacttgccagagtaattatacaaggcaaagaaaggaaaggcatctaaataggaagggaaggggtgagattgtctgtgttttagactccacaaaaaacccattacagctgataaacactatattcaataaagttgagagttacaaaattaacattggcttctatacaccaatgacaaactgttatctgaaaaataaggtaattccatttataatagcaacaaaacaaatatataagtaaatcaaagagcaaggagtaattttaatgaaggatgtgaacgatttgtatactgaaaattatagcacattgatgaaagaaattgaaagtgacaaatagaaaaagtcctatatcaattgaaaaaattaatattgtcaaaatttcaatgctactcaaagcattctacagattaaatgcaaccgctgtcaaattccaatgtcattcttcacagaaatagaaaaattagtcctaaaatctgaatggaaccacaaaagatgctgaaaaacgaaagcaatctttagcaaaaagaacaaacctggaggcatcagactacctaatctttgacaaagcaaacaagaaaatgggaaaggacaccctattcaacatatgctgctggtataattggcaagccacatgcagaaaaatgaagc

SEQ ID NO: 128867 - DNA, 507 bp, Homo sapiens
cttcgacggtgttctgtataatgtggggcatcctttttcattcagaaactagagactgcaattataaaactagcaactaacactcattcacaatgactttatcacgtgactggtgaacaacaattaaacctaggctgctttatcttccataaagttattctaccctaatttagagaaaataattaatagggctatgctttgttttcctcaatcattttcctaaattaatataaagagggtgacagttatgctatatataggcagattgataaatgcagagcaatagattggtaggtagatgatataaatatggccatcgttaaaacatactatttaatagaatgtttggttttgccaaatgaagcaatgcatatgaaagtattcattcatatcttattttgttgtcatttctattctgttcttgtgttttgtttaattaatacagtaaaatacagtgttccaattgaacaatacttcagatgctaaacaattatttgtatttgtgta

SEQ ID NO: 128868 - DNA, 372 bp, Homo sapiens
cacaaattaccaaaagtaactccaaaggaaacagaaaatgtgaatagacctataacaagtaaagagaatgaatctgtaattggtaaactttctacaaagaaaagcccagagccagatggcttccctggtgaattctaccaaacatttaaagaataattagcaccaaccctttcaaaatcttccaaaaagtggaacaggagacaacacttctaaatgcattccataaggccaataatatcattataccaaacttagaaagatagatcacaacaaaaaaataccttcagataaaaatcccttatgaatgtggatgtaaataagaactacaatgagatacaactttatacccactaagatggctataattttttt

SEQ ID NO: 128869 - DNA, 452 bp, Homo sapiens
gatctatagagctacctgctgttgtgattgtgcgtgacgggtgtgatctgctgtggacggcattagatttgccgtgacaggctgtggataggatgtggatttgccatggacaggcatgtggataggcatgtggatgttgccgtggacaggcatgtggataggcctgttgatgttgccgtggacagggatgtggattctgccatggacaggagtgtggatcatgctgtcgtggacagggatgtggatgatgctgccgtgagtaggggtgtagatactgccatggactggggtgtggatactgccatggacacgggtgttggataatgctgcacaggctacgggttgtggatgatgttcccatggaccggggtgtggatactgctgtggacaggggtgtggctgatgctgccgcggacagggggtggatgctgctgtagataggggtatggctc

SEQ ID NO: 128870 - DNA, 215 bp, Homo sapiens
aagaaaggcagcatgggacagtaggaacaggcgtttttttccttgtggtcacttttcttccaagtttaagggctctcggctcctcactggaggaaaaattctcaagtcagaactgcaaaccaggaacaaaggttgttctcatattcaagaactcagcaagggtaattatggttgacactaaagcaggcaagattctagttgggcacaatgaagat

SEQ ID NO: 128871 - DNA, 157 bp, Homo sapiens
aagtcctttaagaatttaaatgtgaagatagaggtcatacatgatatacattaagatgaaagtaattaagagctagcattctctggggacctgctaagtactaggggttgggccaagtgttttacaaacattatcactcgaatccccacaacccttg

SEQ ID NO: 128872 - DNA, 715 bp, Homo sapiens
tgataaattttgtatcctatattcataaagaatagtgatctttagttttcttttcttgcaaaggtcttttttaggttttggtatcagggcaatgctggccattttagttcaggagtgtttccttattttctcttttctgatagagtttatgtagaattagacacacaaatgctattattccttctttaagcagtggtaaaatttattagtgaagctatttgtacctggaaattttaataagaccattaaataaaggtaggcaaacaaccaagaatataacaggtaggcaaacaaccaagaatataatgagataaagacaggagtaaaaagcgtcagatagaaagtgaatgaattggaagagaggcaaagcaaatctaacatttgtaaaactgaagaagaggaagagggagggaaggagaagaagaagacaatgaagatgaagaagatgatactgaggaagaaggaggaggaggaagcaaaggaggagaaagagaagaagatttactaccacccatggaccggaactaatattaaaactatatttcaagaaagaagaataaatgaaagcatatttgaagaagaagaaaaataaaacaatgaaacaggtctaatacttaaaactatatttcaagaaaactttctggaaataagagaaaaccttaatctaaatattgaaatggcccatgatatgcctggaacaatggaatggaataat

SEQ ID NO: 128873 - DNA, 198 bp, Homo sapiens
tatatgccaaacaatgtgttggcctttagagaaattatagtattacatggagattcctgagatgtgctgtcttttgcagtccataaggaccataaggaaagagccgggagtagagggcggtgaaatgggccctagggaaagaagagcagttagtgtaaaaactgggagaatctctggggaggtataagcagttcagat

SEQ ID NO: 128874 - DNA, 155 bp, Homo sapiens
cgcatgggccagcgtgtactaattcctcatggtcaactgtgttgtccccactgtccccaccggctgtactcaagggctctgtctcacctgaaggcaccgcagcgactccttgggccggtggtgtcaaacctttacccctgccccccagagagccg

SEQ ID NO: 128875 - DNA, 794 bp, Homo sapiens
gaaaccagcctgggcaacatggcgagactctgtctcttaaaaaaaaaaaaagctctacatttctgttaccaggaaggaggcacctaaaggtctgttttttgttttttgggttttttttagggctgtattttaaaagtatctcttgagtgtcagtgaaaatatgtgaactcagtactacctgaactctgatttggggtttgaggaattggtacttcaggagttaaattaagccatggcatctgagacaggctcacgttgaaactgtgctttgtcggtaatctgtccatacaattctagtgtgattggcatcaaaggtaaaccctgatagaaggagtaagacagtatgtgccaacatacgatgtcaggaacttgttggggctcagaaaatgatactccaaaatatggttctttgacaaactaaggaagcagcctcaagttctatgccaaagcacaggatgaggctgttccttgaagttcctttatctgcctagaaaccagacccaccaaaaggaatacaattgcctttgatcccctcctcaaaatttcattaaccagagaagcctgaaacttgtatgacagaggaaaagactaaaaattaaatatcacacctagagagctcagaggaactttgcccagactattgtctgttctcagatcccattcagtttccaaagagaattatttactaaccattgtctgtgtactgggcccattcattcttcctaaaaatcatttactgcccttcaaaatggcgtcatttccctcatgtccccttcccctgtgaagaagggtat

SEQ ID NO: 128876 - DNA, 348 bp, Homo sapiens
tacagcgagtcagtttccattcagggctctgagttgagttgaaatttttctcaactaaattgcatagatttattatttcttatgagcatcatgacattttacaaatgtagctggaaagtccattttaaatgacatggagtcaacccctcagttgcagaggtatctcaactcgggtaagagagtgccccggagggagatgagtagcaagcctcagtaatgggatgaggcaggaaacgcaaccatccccgagtgctccccacgatgagagaagggtcctcttggcacctagaacagccttcggccaggtcagctgggtgagggagacacacactgagatggctggggttc

SEQ ID NO: 128877 - DNA, 325 bp, Homo sapiens
acaatccttactttactgcagagaaagatataatactagacgtcttcaagttcagaggtacaatacaatgattcaggaaatatttccttaacattgggtagccttaaatattgtaatggaacaacaagagcacatataagtttgtaattgaatgagaagttattgccatgtaattgactaacaggtgtatgttatggtaatgagtttgaatcatattcagttgaattataaaagtcagcactagtctcagaaaccagtctagtgatgttacagtgcagaagacacctcctttcctaccatacttacattgatacatatggcctca

SEQ ID NO: 128878 - DNA, 720 bp, Homo sapiens
agttaattaagaccacattatttacttgtgtacacgtgaagcctatgggaccaataattaatttcatctcagaaaggcaaaacagatttaaataagagaaagagaaaagaggaaagagaaagaaaaagcctggattgttttaaatagcaaacagcttccattttttattgtttgagatagtaaactactggttagcaggcccctctcagaaaggccagcccatgctctgccctggagagaatggatgtgtcacatacagattctctaggagagctgggcatctaactgtggtggatacatgacaggctttctctctactgttgtcatcaggtttctgtgttagtgtttatatttcattgtaccaggaatacatcatcaaccttatcaatatccctcaggatagaattataaatccttactgaaagattatgggatctaataaatggagagatataaaatgttcatgaatgggaagtcttaatgtcatgaggatgccaatttccccacaaattaatccacatatctagcataaccagaatgattttgaagaagaaaaggatgagtgttgctctatttgttacaaagctataagaattaaaacagtgtgatattagaacgtagatagacaaatagaacaacatagataactaaagaacctataaatagacacatataaaaaagaacttggtatatcacagatgtgctgttagagataattgg

SEQ ID NO: 128879 - DNA, 444 bp, Homo sapiens
ggttagattggtggggggaggcttgcttgggagataggggaacattgctccaaggaatcattcctaacccttgttagaactctgtgtcttcctggagctccaccatggttcctgagagaaggagctaaggagcatcccctagctgagggctttctactctctgacagacaactttcttctttagtcttatgacttgggcttgtagaaggcacttgaggtcattaaagtgaacccaaaacaaccatattctgcttcctctgcttgaagtcttgatctaggcaccttggcacctacagcagggagtgtccccccaaatgatgcccttggcacaaaaggcacgactttagctatgaacaatttcgcttctccagatttctcagatgtaaacacttttcagtccctccccctaagtcctattgtcattgtgccccatgagagtagaaa

SEQ ID NO: 128880 - DNA, 222 bp, Homo sapiens
ccagattccttagtgtggttcttcatggtttgatcttgtgtgtgtctctctgagggatgacagacgataaacaaaataagctacataaggataaaaccctttctgtttttggtactctctccagtgcctggcatttaatagatataaataggtggctgctctgtgctacccatctttttttttttttttttttttttttttttttttttttttttgacgcgg

SEQ ID NO: 128881 - DNA, 761 bp, Homo sapiens
tggtcccaatctcctgacctcgtgatccgcctgcctcgggctcccagtgtgttgggattacaggcgtgagccaccgcgcctggcctatgtacaacatttaacctctaagccccacccccgaattccttgagcaatgactcatcttgtttctctgggcaccttggcttcatgagtcagtctcagatttgggtagagacgtagtcatttaaatcctctcctaggacagtctttgatagccaaaacttccctgtcaattcctgacacccagaaattaacttctagttaaaaatggctcttaaaacaccctgaccatgtgttcttctctggcagccagtgcagccctgcacacttaactgtgccaagagagtgtcagcatcagtgaaaacctcccaggcctgcgggagctcagggcagggctgctttgcacatagccagtttatatgcttagtgactccccgtgaacttggctgaatgccagagattccaaatttatttgattattcaggagaacagccatggtatgagtctgtattttctttcaatacagtgaggagtgttaaaatacttttcctgagacccttctattgaggctgtaaccccagattgtttatatcaccgcctgttatgaaattcctgtatctatgcttcagccagactctcctcctgccacaaaatgcctcttatctgggccttgcccctgccctgtgtttagacagtgctgcccacctatctaaatccactcagactctttcatactatcc

SEQ ID NO: 128882 - DNA, 389 bp, Homo sapiens
  misc_feature (347)..(347): n is a, c, g, or t
cgtgagccaccatgcccggccccactctgtatttttttgagatacaatttaaaagttacaagcttataatgctgccacctatttcaactcataattttgatgttctacaggataaaaaggataagactatgaataaagaaatgaaatctttttggcatcatctccttgtggtaaacaacacctcattttttttttaactatcatatctgcccctcttgcaaaaagatctaaagcaacttactaagatacctacaagataaaattataaaaaataagtatttgagaagtcttggcaaaaaagaatctaagaggaaaacaattttaagattcacagtgtcacaaatacnatgtaccaaatcaattaaggaactagaaaaagagataagaat

SEQ ID NO: 128883 - DNA, 527 bp, Homo sapiens
gacactagggctccctgcctgcctgcccacacctgcaaatgtctggtgaaaaacaatgttagtatgccccagactgcttcctgggaaacaggaaggagtggaacaaaagttaacctcctagagtacctttcagcaggctcaggcagtacttcagtgtgaggttccctgtgcaattcactcactcagaatttcaaagttctttctgtatcaactcaacagatacaccattttttttctattttagtcgctgccataataactattttagttacccagtgagagaatatatattagtgaaacaaataaaagtattgacttttctgtatcagttgaatgatctctctctgtgtgtgtgtgtgtgcatgcacgcgtgtgtgtgtaagagagagaaagggagagagaaattgatgccacactttgactcatattggtagctatggcttttctctgtgatactctaaatatttgtcttcaatgtgttgtaattcctgtggactttcatacaatatttttgatgcccagtatgt

SEQ ID NO: 128884 - DNA, 569 bp, Homo sapiens
catggtcttccagcactttgggaggccgggatgggtggatcaccagaggacagcagtttgagaccagcctggccaacatgtcgaaaccccatctctactaaaaatacaaaaattagccagtaatcccagctactcgggaggctgaggcatgaggattgcttgaacctgggaggcggaggttgcgatgagccaagatcgtgtcactgcactccagcctgggcaacagaaaaagactctgtctcaataaataaataaataaataaataaataaataaataaataaaataaaataaaaaagataatgactacatcttggaactgtaatacagagtgtaaatatgtcatgactatttatctgcaaaaaattctattttcatataattttctgctctctgctattattatgcccaggatttgctagttaggtgtttcctaatatttacactcaagttcctatttttagcctgatatgacatcataaatgcagatggttaaacatttttaaaaacagtatgatgaaattttaatcaaagcatcagaaatttagtaatctgatgtgaaaaccatca

SEQ ID NO: 128885 - DNA, 276 bp, Homo sapiens
gaatgccatctatactgcaagtgatacagagattgtactgatcactttctacactcaaaagtatataatcaggtagagttaataaaataaaaacaaatctgaaatgtaaaacaaaaaaataccctgggaagttacatagcaaaggaggaaggaattacagccctggtaatgtgggacaacacagtgtgcaaattatttaacacaaagcctaaacaagacacattattattatagcatgttttagggaaataattcttgttgttgaactgcaagtac

SEQ ID NO: 128886 - DNA, 410 bp, Homo sapiens
gttgggtatgacatataatcacttttacagtgtgaactggaataatctaggagagcagtaaaaggaagtgaaatgccagtggagggctgagtttgcatacagttgtccctctttatctgtggcaaatgcattccatgttgtgttaattcaatagctattaataagatagaacaaatataacaatatactataataaaagttatatgaattggtctctctttctcagaatatctcattgtaggtaatatttccagactgtagttgactgtggggtaactgaaaccttgaaaagcaaaactgcagacaagagagatctactgtttgtgaagggaattcatggggtggagatgggggagacagaatttgtgatgaggcatggaaaggtgggaatggcatgccatacattatag

SEQ ID NO: 128887 - DNA, 622 bp, Homo sapiens
ctatagctgccatagatagtgattcctctgatggatctggatgaagtaaataaaaaacctgatggaaatgattccccattctagatatcattaagaatgttcatgcttcatgggatgaggtcaaaatatcaacatgaacgcaagtttagaagaactggattccaaccctcatgcatgacttcaaggggttcaacacatcagtggaggaagtagctgcagacgggatggcaacaacaagagaaccagaattagaagtggagcctgcagatgtgactgaattgctgcaatctcatgatcaaaattgaacaaatgaagagctgcttcttatggatgagcttgagatagaatctacttctggtaaacacattgggaacattgttgaaatgacaaggatttcgaatattaatattacaaaaacttagttgataaagaccagtaggaagtctaaaatgtagcctgggccttttagactcgtgatggcatgcaaaatacgctcaacccacgaagccctctagcttagaacagagcaattcatcaaacagccaaacaatcctggggtgctacacccgaggtgcaatttggccactgctctcttcgcatgtccagcccatctcttccaatt

SEQ ID NO: 128888 - DNA, 357 bp, Homo sapiens
cattgtttgaaataaaataagccaagcacagaaagacacatatcgtatgttctcactcacatgtgggagctaaaaaaggtggatctcgtgaaaatagaggtagattagtggttaccaaaggccaggaaggaaagggggaaggagtggaggatgaaagtggaaaaaaaagaatatacgtgtttttattaccactgaaatgtatgctttgaaactgtaaagatggcaaattatacatgaatattttaccttcataaaaaataaatgtaaaaagtaaaatacaaaactataaaacatgtaaaagatagcataagagaaaatccagatgactttgggctgagcaatgactttttaaatgca

SEQ ID NO: 128889 - DNA, 383 bp, Homo sapiens
attgacaagaatgcagggcctgtctcagttaagtgatgtcatcagttctcattagcctcttcatagtctcttgaaaagcataaagaaaattacctctggcacagaaaaggcttttaaaccaaccttttcacagtatgtctcaaactgaacatccacttaagtgtataattacaaaaaagaaagggtatgctagatatgttgacacaggatctctaaatgtagctgaaggagttactattatcttcaaaggcaaaacatctttcttaggcttacaagacaaactatgtagtggagtagacaggaaagcaaatcactaagagattatctccctctaagtcttctttctctttttcttttcttttttctttctcttctttttcttt

SEQ ID NO: 128890 - DNA, 242 bp, Homo sapiens
gcctgctgctcagggattgaagccactggtcacctgtcagggcaagcagaatacactccaacaacaagttcacacaaaaccagggtggccttgagatcagaatatggcagcctgcattgagggccactggacgccactaccacacatagtcggcagcaaggaagccacatgtccaggggacggagacagacacggccactcaatctttttttttttttgagacagggtcttgctctgttacc

SEQ ID NO: 128891 - DNA, 529 bp, Homo sapiens
aggctatgaccctttcaaaaggaaacacagatgtgaatctgggattcaaacctaggtctgactataaagctcatgcatgtacttttaaccaagccttccaggaggcagcagagggagtgaaatcaataatgccaaataaatgtaagttatcatcatcattccttagggcgaagtacaggaaggagatgcatctagagggactctgtacgatctgctggacctgggactcatggggaaaagggtgagaagattggcagtggtgaagagaagacatgaaatggagaaatgcaatcagatatttctcagaggacctgtgcccagatatagcaggttccaatggatgaaagaatttcctgatggggcaaactgcattatcccccaagcagttttgaggactagacctacagcagcctaagttctgaaactcattctcactaaattggacaataactgcatcgatctgtgattttatgagaaaaacaaggtgctagaagcttaaaacataggtagactgataaaagcaatactc

SEQ ID NO: 128892 - DNA, 493 bp, Homo sapiens
ttgtctagtgtctagaggtcccagactcggcaccgttcatgtgttgtatgcttccatgtatatgaaatgtcccaaagagccaaatctatagacagaaagattagcgttgcttaggctgggagggctggaatgggggaaggtgatagctaaaaggtatacggttctttttgggttgggattacaggcgtgagccaccatgctgggctattttgactttttaatagccattctgacttgaatgagatggtatctcactatggttttgatttgcacttctctaatgatcggcgatattaagctttttttcatatgcttgttggctgcatatatgtcttcttttgaaaactgtctgttcttgctctttgactactttttgttttttcctatacatttgttttagttccttataggtgctggatattagatctttgtcagatgcatagtttacaaatattttctcccattctgtaggctgtctgcttactctgttgat

SEQ ID NO: 128893 - DNA, 346 bp, Homo sapiens
agttcttgggcaatatccactatcttctaatttggggtataagaaatcaaatagaatggtaaattttattatgtctgcagaattggattaacaaaagcatagtttagaccatgtagttcttatgctcctgaaattctaacttattctttatcttaaaaaacttaagaaataaagcaaacagttttctcattggagcctttcaccaatgtcaaattaagcatcagagaatttgatagggttgaacactcctgctcccattttcactctgttagctgagtattttctccccacatttccacttctaagatcatatctttctgattgccttcttgagccatcaagagca

SEQ ID NO: 128894 - DNA, 640 bp, Homo sapiens
ggaccgggaaagctgagacactgctgggctggggccgccatagccctgggaacggagtatattctagtgaaaggagaccaggtgactggcatagtgacagctaaatctggagatatattcagagttgatgttggagggagtgagccagtttctttgtcttacttggcatttgaaggtgcaactaaaagaaacagaccaaatgtgcaggttggagatctcatctatggccaatttgtggttgctaataaagacatggaaccagagatggtctgtattgacagctatggatgagccaatggaaggaatgtcattggacaggatggtctgctttttaaagtgactgggcttcattagaaagctgttagctccagatcatgaaatcaaacaggaagtgggaaaactctatccactgaagatagtatttggaatgaatggaagagtatgggttaagggaaaaaccgtccagcagactttaattttggcaaatgttttagaagcttgtgaacacatgacattagatcaaagaaaacaaatctccagattggcagaaagttgatataggtggacttttttaatgggtccgttgagccaagaaaccatgggtttcctggggaaaacttttttcaggtgaacttctccc

SEQ ID NO: 128895 - DNA, 339 bp, Homo sapiens
agccccctccatcttcttagaagggcgctaatcccatcatgggagcctcaccttcatgacctcgtctatacctaattacttcccaaaggccccacttcccaatgcattgaaggttagggattcaatatacaaattttaggcaggtttcggggatgcagaaattcagcccatagcatccaacagctagacaaagaagagatattggttctttggttttccctagaagaaagaaatgtcttctaccatcccccagctgattttatttcttgtcccactgcccagtcctcaggcacatgccagcggcaatcacaggcaaaggctctgagattcattcaacct

SEQ ID NO: 128896 - DNA, 766 bp, Homo sapiens
acaaacaaagatatgctgtaaaaggaatgcatgaagtgcttgaaaaacactttttggccaggtactacaatggctcacacttatacctagcactttgggaggctaagacgggatgactgtttgaggccaggagtttgagaccagcctcagcaacatagcaagacccggtctctacaaaacagaaaacaaaaacactttttaaatgtaggggtaatgggcctcccctcttttattatattgaatgagatttacaaaacataaaaaccattttgtgcagccgccatctctgtttagttccaaaacattttcatcactccaaaagaaaaaaaaaaaaaaaaaaaaaaaaatgtgtgttgggcgcgcgcccgctgggccccgcgcgagagagagagttttttagagaaccatcgcgtgtgggggcgcgcgcgggccccccagtgagaggtaaggcgtgaaccagtgtggctcaaatgagcgtgtgttcccccaagaggagaaaccggcgggcaagagaacaaaagtgcgcgcgtggggaggctttctctctaccccaaatatatatagaaaagagcgccgcgcgggggggcaaacagcgcgagagcgttttctgtttgaaacaacaatttctcgcaagagatggggaggcttcgctgagagggggcctacaatctcaagcgcgggggagatctctattatatacaaccggggggggtgcttctccaagggcgaaggacggcgccgaaattcttccaaattttttaggccc

SEQ ID NO: 128897 - DNA, 791 bp, Homo sapiens
ggattacaggcgtgagccaccacacccggcctcatttattttttataacaaataatttaatgcctattgattatcctgaagtaaggttaataggtgagtctttaactacattagaatctgacgttacagtgaaataactgagtacctatacctacttacaataaataagttggacttaaaagaaataagatcagaagaactttcattttcctatactatttatagatatgggtagataccagaatgaaaactgttagaatgagtaaaagcagaattatttgcatataagagaaagggggaaataattttgtttgatgtagggataacataagacaaattacatactttccacatggaaaaataaaaatagtatcacatagtcactagtgagtttgacctaattatagtgtcaaaataattcccagttagaggccctgacaggagacaaggaagtgaggaaatctcacagaaaacctggtggcatttacattcagcccctagtacttaaatgtcccctggagaaaatactccttaataggcaatgagtaataaaggatagattagaaaaagaaacaggaatagatgtgtggtagacttcaggggacattaaaaaaaaaagaaaaaaaaattttggggggcgggcagaaaaattttaaaacatttgttgggggggcccatagttagtaaatggccaggtttccaagaaatctggtcaaaggttggtttcccaaaaaagcgggggacaggtttgaaaccacgggtggggtctcggtttaaagaggccgggaccg

SEQ ID NO: 128898 - DNA, 226 bp, Homo sapiens
tctcacaagtgcttctcaaactatagtgttgtataagaagcacctgttaaagcacaaattgctgagcaaagccccagagagcctgattcattacacctgaggtgaggtccaagtatttccattttaataggatcccaggtgatgtcgacagtaccactgtgcagaccatcctttgagtggcactggggctatcacgcccagatgactagggatttaaagggtggca

SEQ ID NO: 128899 - DNA, 173 bp, Homo sapiens
tttgatctgtgttctagtatagaatggaaatagtcatgtgccagtgaaaaaaataactcaatctcatcagctgaatattttcaggaaattttttttgcaggtgggtggtagctggtaaaataaattatttgattttagagtagaagatagttttttttttttttgagatggag

SEQ ID NO: 128900 - DNA, 278 bp, Homo sapiens
cctcggtgagaaaaagttttagtcttaatgactgttacattatttaaataccaagtgtttgaggttaggcatattgcctcacttttttcctttgaatctgaccctgattttaggttgtaattaaagtttattgaacttttagtcaacatccgcacacgtaaatgctgataccaatacataagctgacaaccacttcactagctacaagcgcagtgctttagatgtgctgttaggttatcaagcagtggttagcatcaggttttgcacagcacaactct

SEQ ID NO: 128901 - DNA, 101 bp, Homo sapiens
atgaggcaccatttgtccccattggaatggctgatttcatagcaattgttgcatatgggttatacaagctgaaaagcagggggaatactaaaatatacctt

SEQ ID NO: 128902 - DNA, 695 bp, Homo sapiens
gatgagcaggagaaggggctggaggaaactcttggaatgatgatgtaactgttaattatctcaatcatgatgatggtttcatggacgtttacatatgacaaactgaccgaattatttactttaagcatatccagttttttgtatattagttatacctcaatatataaaggtgtggtttttaaagtttcatgaaaaattaaacatttaaagttcactttttctctaccaaggtctattagataacttaggatagttgttaatttaggcataactccagacattttgtgtgctgattaatatattttaaaattctaggccacgcgtggtggctcacacctgtaatcccagcactttgggaggccaaggcgggcagatcacgagttcaggagatcgtagccatgcttgctaacatgatgaaaccccgtctctactaaaaaaaaaacacaacaaagaacaacaaaacaaattgttgtgggcgcacacactgggacgcttggaagaaaagttttctacgaaccatctgcgtttggggcggccggcgccccaagagtggtcgccgtccacatttgccaatagcgtgttccccagagaaacacctggcccaagcacacaagcgcggggtttcctccccaataaaaacgccggggaaaccggcggttggaacaaccccaaggggtcggagcatacggggctca

SEQ ID NO: 128903 - DNA, 704 bp, Homo sapiens
tgcggtggttcatgcctgtaatcccagcactttgggaggccaaggcgggtggatcacgaggtcaggagatcgagaccatcctggctaacaaggtgaaaccctgcctctactaaaaatacaaaaaattagccaggcgtggtggcgggcgcctgtagtcccagctactcaggaggctgaggcaggacaatggtgtgaacccgggaggtggagctggcagtgagccgaccatgccactgcacttcagcctgggcgacagagcgagactccatctccaaaaagaaaaaaataataataataagaaatcagtaacaaaattattcataaaagaagaaatcacaatggaaattttaaaatatttttaattggtaatgaaaatgtaatatcaaaatttgtgagatgcagtttaagctatgcttacaggaccatttatagctttaaaatgcatatttacaagaaggaaagttgaaaaataacactatcatcctttattttcagtagctaaagatggcaaatcaaacccaaagtagtacaaaggaggaaataatgtaaacaagaacaaaactcaatgaaataaaaagcattaagagaaaattaagccaaaagctggctgtttgagaatattaataattaataacccttagcagaaataatcaagaaaagacagaaattccaattttagaaaaattaaaagggggggcatcagt

SEQ ID NO: 128904 - DNA, 555 bp, Homo sapiens
  misc_feature (555)..(555): n is a, c, g, or t
ccatcctaaaggccattcatttgtttaatgaatatttcttgagcatttactgcatgccaaaatctatttgaggtagtgggaatacagctgtgaacaaaaataaagacaaatccttgccttcctggcacttatattttgggaaatagaaaacttaaatttttgaaaataggtcaggcgtggtggctcacgtctgtaattccagcactttgggaggcagaggtgggtggatcacttgaggtcagaagttcgagaccagcctgaccaacatggtgaaactccatctctactgaaaatacaaaaaaaaaaaaaaaaaaaaaaaaacttttgttgggccgcgctttcgaggcccttcagaaaagcgtttttataaaacaatttcgtttggggcgccggggccccattgtggttaatgtagaacattgggccattagcgggtccctaagagagactcctgcgccaacagacactctggggctgggtttctctaccataataaaaaaaccgcccgggggagcaccagaggcgttttttgggaacaacttccacgacggaatn

SEQ ID NO: 128905 - DNA, 657 bp, Homo sapiens
ggagatgaccagagagcaagacacacacagaattatcaggacaggccaggtcaaaaaatatcctacttgtccagattctgcttcagtagactggttttatttcttgcatttatttgaagcacactctatttgcactgcaggcccttttggcaagattttgaaatcctttccctcaaggaggaattttgctggatgcaattccacagtaaacagatcttgtggaattttaaaacatacaaccttgtcaataggagctgaaggcaggaggactaaagtggctttacacatagtccttcactttgggttaccacattgggtgcagcaactcgaaggcagggtcacctgggaggggcagagcactgcctagacctccactgtcccagagcaaagactctgtgtgactggtctacagcaagggagggaagggtacgtgaaggagctagaaaatgctctcaaaataaattttgggttcaggagatacttttaaaccgttcatacacagagaaccccaagagacttgagaacataatcattaactattttgataattaaataaaacctttaaaggacagcatgaagagtttctccatggcaaatgtgagggatttcccccaggactattccagccgcagaggttgcaggggcggggctggtcca

SEQ ID NO: 128906 - DNA, 587 bp, Homo sapiens
acataagtaggagtttaaggagagtctcctggccaccccacctcctttcccaaccagaccatggccctgaaatctctccttcacaggcactctaaagcccacactgggagtccagaagcaaaaactcactagaagcagctaagttgatatctacatgactacagaaaagtcactttgcctctctgaatctcagtttgctcatctatgaaatggaaccagcaggaactagggcagtaaatcattattcacacaaactccatttctctgtttgtaaaatgagtaggctgtgcaagacttgtttcagttgatttcccagcactgaattaagcacggaggaccgagaggtaaataaaaaaccatctcttctgcctcggctctcgtgttaccaaggtttcttccaccctcattttctctggcttaggacgtgttttcccatcattggaaaaaaagagtccacagtacatttatgaacctcaaataatgcatgactcaagaaaggggacattattggctccatcatagaacataactgtgcattccccaggatgtgtgggagggacggcatgaggtagggaggtagagtcatg

SEQ ID NO: 128907 - DNA, 149 bp, Homo sapiens
ggtagatcgagccggtacctacttttcacagggagtaaatgtaagtcaacatgctcaacacagagacctttccctcttctcacaacctgctcctgaaagcgagttggagaataaaaggttgttaaataattgtacaagttctgaggaaa

SEQ ID NO: 128908 - DNA, 290 bp, Homo sapiens
acttcgtgtggcggaggcagcatttatgaccttctacagtgaggtgaaacaaatagagaagagagacttggttctaacgtgaaaaaatcagattgaaagactgacctgtcctggttcctcttacttcagtttcaccccatttgaggttcttcagatcctgaagttacagatgaagaaataaaaaagcggcagttatccatcttggtgcatcctgacaaaaatcaagatgatgctgacagagcacaaaaggcttttgaggctgtggacaaagcttacaagttgctactaga

SEQ ID NO: 128909 - DNA, 714 bp, Homo sapiens
gaagaaacaggtcgaattatagaattgactaattaggtacgtctgggacacagctaccaaggtaacagactccctaaaaagataaaatccagcctgtagcttgcctgatcaaaatctttcaatggatgctttagctaaatggtcagatgcccaaggttagtaaatatcatcattttccatttgctcttccctcggctagaaacctctttccaagtcttcaggtgcccagtcgctatccacagctcggttcaggcatcatcactccctggaaaacttggctcttaattcgggtgccgaccaagtcctccggggtccgcaaaggctggcatcccaccaccaacgcgcgtgactagggtcttctgttttgcgcgtcttccagttccactgagggccgagactttgtctttgcggccccagtacttgcttagttccgagagtgcggtttgcactcagtaagtagccacttactgagtccaatcgattattggaaacctaatttttcatcactgcttctcccacaagaagctctaggactgactcctcaaagaccaaaactggaattagcaatcccgctgtttacccggaggcccggtcaaatgtcttaaatctgggaggattcctcctgggaaattccagtaagggcgcggagcaggtcaggaaggaggttactttttgggtctttatcgtctatgatgggagaaaaggagaaatgaa

SEQ ID NO: 128910 - DNA, 574 bp, Homo sapiens
gtggctgaaattatgtatttttaacaagggtcctaggtgattctcatgcagcccttggtcccacaaggtttgagaaccagtgacttagagaacaaaggcagctgggagattaaagtttgaggaagcatccagaaaccaggaggttttggggaggaatataggacacttctcattttgtcccctccacccatcttccacagcccagaagcagcccccctgtcatttcctgcatcctgtctacaccatggcttagagcctcaaaccctctgctcttcatatgcaaaggggagctgcttttggaattaggaaaactctttcctctcctaataaagcttgctaacgtacagttcaaaatcaagcaactacttccttgttctggatggcacctactgtcttcctcagaggcaccttcaggagcacccactggtgccattgattccgcgggtgcgggaaaattacagggaacacgatctatggagcatgaaacagacatacattggtttcacgtttcagaaatattatctttgctgtgcactttttcgtcctcgtgtttctttccatgtgagcagcattt

SEQ ID NO: 128911 - DNA, 727 bp, Homo sapiens
gtccagagcaagaacatgaaagaaacccaactagtaactgtcgaagttgtcagtctgattagaaaagcaagaggtcatctgattgagttcacagattaaggactggctttgctttgaatcctgaaatcttgcctcttttagtctttactgtgtgatcttgggtagattgctcaaatttgctcaattttaattcctttgtgtgtgggactagagtaatattagaaccgaatgcaaagactttgaatggaaattgtgtgaactaagtttataaagcacctagaacacttgctgctactggtaagcccacaagtggctgctatttggggctattatttttgagcaaatatggttttaataacatgccctctggtctctattgtctttgttcacattaggaattagtagctgtagtttcagtccgctgaagtttcactgctctttatttttttttctaaacagacaggtgaaattcactttctaatccagtttcaaaacaataagcctcagggagaggatgggtcacttgagcccactctgcttaaaattcttctgagataagacattcaaaagaggaaattatcctgtcagtagcaatatctctgaagtaaaagatatcctacagatttactttgaaatctgtagatgtgcattctgcctgagatctgaggtttatgatgagaagaatgttttgatggactagccaaacagaataacagaatgttaggta

SEQ ID NO: 128912 - DNA, 136 bp, Homo sapiens
aattttttattggacatgcatgtccattaagctggatggaaatgcttacatgagtcaaaatgtgagtgaatgtctcaacagaagcatgtcataaatactagatgcctgaactttaccccagaacaaattatttaga

SEQ ID NO: 128913 - DNA, 366 bp, Homo sapiens
ggtaaccgcaccaggccttcctcagaagcagtgttgctgctgccggttcacctggtgcatgagccgctgacccaccagaggcgccaccaaaccctggagtgttacagttgcctttcctctcgagtagcacaccacaaacagcacagacacaccgcacactgatatttttacagttcagttagactttgacacttacacgttcagatagcaacacagatgctgctgctgaggagacaggtgtcagcaccttttcctgccctctccagaggcgagggcccatgagccccagcacacagaagcccaggctttcttcatagcaacccctggccaagatttcttgggtctctcgccatggaggcggtgttc

SEQ ID NO: 128914 - DNA, 181 bp, Homo sapiens
tgagactgtgccgttgtactctagcctgggcaacaagagccatctcaaaaaaagaagcaagccagatctttggggtgctgtgatggcaaatcccccagcgctggcctctcaggttctcttgcgggattagtgtttgttgaataataagcaatacaccctgacccagcgagccaaagcaaac

SEQ ID NO: 128915 - DNA, 521 bp, Homo sapiens
agggcctaggacatcacaaccccaccctgctccatcttgacctcagtttccccatcactggaaccaaacatgagctcaggctcatgtccccgcaagtccccagtcacccaccgtaactgagtgggatggagacggaggggttcgttttggggggcaccttgagaggccagacatgaccaggcccttcacgtacagcggggctgttccccaacctcccacctgggacagaggctggtggtgatgccccagtttggccttcttcacaccaggagtcacacagatctggtgtccagcccctgccccatcacttacagctgtgcggctttgtgtaagcaccttgacctctctgagcccgaggccactgatgcgtggaatgggaataagtcatcactaagtggacttcagagtctgcagcggcgccctagatcacagcggctctgagaaggactcagaaactgtgaaggacgtgcacctgggaggaatcccagctaccagggccgggctcgccttccctgagcacg

SEQ ID NO: 128916 - DNA, 324 bp, Homo sapiens
taaaataaactttataatctttctttgacagaataagacatttaatctccaaggtaggttaaattgtccagtgctacagaaaataaagacagtcagagccagcatttgaatacagatcactctaaattcatatttcccctttccacctagcactgcctctccagcaaatctgttttctagctcaaaacggtagttcgacattcagattaaccacctgaatatttagaatggcagtccttaataaacaatgaaaatccaactcagttgaatcaccagtctcttcataaagcgacacaagataatattaataaaatattcaccaag

SEQ ID NO: 128917 - DNA, 813 bp, Homo sapiens
gcctgttgtggggtgggggaggggggagggatagcattaggagatatacctaatgttaaatgacgagttaatgggtgcagcacaccaacatggcacatgtatacatatttaactaacctgcacgttgtgcacatgtaccctaaaacttaaagtataatttaaaacaaggaagaaaaaaaattagtgtgttttgtgatttttaactatgaggtacttattttcctttaaatttcaattgtaggatttctttatgtcctaaggtgaaggtaggtaattccagggatttgcttgtttcactaatgtacctaggctcactacttgtttgcgacctcaaaattatctatgtagtattcatttgaccagtcaattaatgtgaaatagaatttcatctctgtgtgttggtaggcttaggtttaaaatttctcaagtgagtgagatcattgaaaatggtagaggaagaaactccaaaactgcattcatccattaaagaaaaaatggtcagaataaaatattttggaagacaaattataatttaggaattacaacaagaaagggaacacttaatttttaaaaggcaccaaatttcagtgagagagcattatggcattttaacttattgtctaccatcctacactacctagctggtaggctgccataggggcagctgcttgttttcctgttgtggcttgctaggagccagagaggcaatttggacgctgttctcacataaatgtggttttgtgttttgatctgtctgaaagctcccagaggggttagctcagaattgtggttttttgtttgtttgttttgttt

SEQ ID NO: 128918 - DNA, 298 bp, Homo sapiens
ccatccacccacccacccaatcaaccatccatccatccatctttccatccatctatgtatatttatgtattttaaggaatttcctcatacaattgtggagtctgaaatctgcaaggcaggtggcagcctggagacctaaggagagctgcagttggagtcccagggcctctgctagcagaattccttcttgcttggggaggtccatcttggttttcttaagaccttcaactgattgaatgaggcccacctgcattttggagagccacctgcttccccaaagtccactgattgaaatgtt

SEQ ID NO: 128919 - DNA, 411 bp, Homo sapiens
tgacaatgaaattccatttataaacaaagccttggcctacccaaggctgcctcagacagcagtaatgctggtgctgaaaactggcaactgggctggtgagttccgtgtatctgaattagtcaccgccattgaaaagtcggaatggttaacataaagatcccggtttccagtcaggcatggctcgtctgaggtccagcagtacctgccctttagaggtgcatagcttgtgcttctccagctgcagtctcctggctgactttccttgtttagggacctactcagtcaggcaggcacttgtggcctgaggcaagaactgtagtagtgggggcagggatggggggcatggccagaagggatgagagggaacatggaattgttgaaaaatcctagctctaaacctgacagatatgg

SEQ ID NO: 128920 - DNA, 491 bp, Homo sapiens
ttccccctacgctgggttcagtggggtccttccccctacgctggcttcagtggggtccttccccctacgctggcttcagtggggtccttccccctacgctgggttcagtggggtccttccccctacgctggcttcagtggggtccttccccctacaccgagttgagaggggtccttccccctacgctgggttcagtggggtccttccccctacaccgagttgagaagggtccccctacaattcctgtgccgtaggagtctgaccttattaccttatattgggaacagggtccttgcagatgtaacctagtcaagatgaggcctacctggatcaggggtctctgtaaggagaaggaactttagactcagatgcacagaggagcgggccgttaggagacaggcagaggtgggggcctcaagcccgggcccaccaaagcctgtgggagcccccagagagagcgtcaggcagggtcaggttgccagagagagcgt

SEQ ID NO: 128921 - DNA, 397 bp, Homo sapiens
ctgaatttttctgctctggccacccacatatgcatgcatggattcagcccgggtcagacaagtctctctttatccccaagtactgctgaacccttccccttcaactccaaaggaaagacttaacagaggtgaagtctaaaaccatgtgagatggtgctccttagaagcagctgattggatcagggatggattcatgattcttgaatcagaccaatcagattcttgagaatttggcacaagaaattcaaagaagttaggctgtgatccatgaattggaaggttccttagactcagattgggatagccttttggggatcatgtgtacccaagggcagagtatttacaaagaagtgtgtgtgtgtgtgtgtgtgtgtgtgtgtgtgtgtgtgtgaaagag

SEQ ID NO: 128922 - DNA, 1035 bp, Homo sapiens
tgattatgggcaagaaatatattgcttggctacatggtggctcatgcctgtaatcccagcagatttgggaggctgggactacaggcacatgccaccacacctggctaatcatttgtattcttagtagagacagggtttcaccgtgttagccaggatggtctctatcccccgacctcagctgatccacccgcctcgcctcccaaagtgttgggattacaggcttgagctaccgcccccggcccaggttccctttatttaagagacagccctaggtaactggcctaccctagagggcagaatctcccaccagcacccaggccctcaggacctccctcaccaggtaggggagacagcagcttctaattaccttgttctgtctcttggagattggggaaaagctcttgttcctgtcctggcctgagggagtttggaaggaggcggagaacaacatttcacaccctgagcccatgacgctgtgacaccgatgacccctccccaccaaggacagtttcccatgatctatttctgtgctcttgtgtgactagtgaggccaatttaggctcaacaggttctaccacaattcagatactatttccacataggcaagctgggtctgactctcacctagcaattttcacaattccttaagtaacacaagtgaacacacatcacgtagtggttgagagcaagggctctggagtgagaggacgctggggttcaattcaggcactccccttcctagggcaagacacagggcaccaccctgcgctccatgcaggcatctgtaaactggcaggcagaacagcacccaacacccagggtagttaggctcgggagaatgtacgcggaggagcttggcacagggccaagcacacctgaagaggataccaaaaattaccaaggccattaagtccactgggaaaagccagttaggctccccaaaacagctgctttcaagacccagaactctgaaggaggctgtgagcagctttccctgagctgatctgtcctcctaccatctgggacactgctacg

SEQ ID NO: 128923 - DNA, 288 bp, Homo sapiens
atcaggaggggagggttgcagatgttgtgttttctggggacaggggctggactcgggagttcctcccctatcagcacaggctgttcctaccatctgctccccacaaaggagaaggcaaagcaaggttgtcatccccagcggggacttcctgcagccagtccggtcagcgaccccaggccatttcgagttctctttcatgactttattcagattgctgctgacttcctgtccaccaggcctgtagcctcttctgcggcacacgcagggacccctgaatcacccattgca

SEQ ID NO: 128924 - DNA, 243 bp, Homo sapiens
ggaggcggagtttgcagtgagccaagatcacgccactggactccagcctgggcgacagagcaagactccatctcaaaaaacaaaacaaaacaaaaaccttgcttggtatgtttcagcctgttgtacttattctccttgtcaaagctcaaattgtccctcttttagccattgcactccggccacactgtctcttttaaaactgtttcttacatcatgatgtgtgagaacttcgcagccattgca

SEQ ID NO: 128925 - DNA, 648 bp, Homo sapiens
caagtagctaggactacatgtgtgcgtctacatacctggctaatttttaaatgtttttatagagatagggtctcactatattgcccaggctggtcttgaactccttggcttcaagtgaccctcttaccttggcctcccaaaatgctgagattacaggtataagccactccactcagcctgcttcaaattttaaaactgaatttctagttttattttattgtcataaagggataaaattcacatagtttcccttttaggaagattttttaaagttctttatggtctttggtttgtgattccatgcttctagtgggggaatccagtaactattttctagaaacaaattcatagtttaaagaataaatttggggctcggtgtggtggctcatgactgtaatcccaacactttgggaggccgaggcaggcagatcatttgaggtcaggagttcaagacaagcttgaccaacacggtgaaaccccatctctgccaaaaagacaaaaaattagctgggcatagtggcacgtgcctgtaattccagctactcgggaggctgaggtaggagaatcacttgaacccaggaggcagagattgcagtgagccgagatcatgccactgcactccagcctgggcaacagagcgagactgtc

SEQ ID NO: 128926 - DNA, 435 bp, Homo sapiens
tgctcacaaacagggaagtgcacctttgggtccttctgcagtatcattaactccttcttggttaattggaccaaggaggagtggatccaggaggaatgcctctggtctacctgctccaggatataactagcaggacagggacagcccccaaaaggagagatgaagactcttcccctttgaatttctcaagctgcagtgtagaatcactaccacactagggaaaccaggagagcagtacccagatcaaaatttggagctccattcctggtcactttagtttaaggtccaaactcagtacagatttccagaaaccgaatggctaggttcatacaatcacagaagcttaaaactggacacaagcttatctaatttaatcccatactgtaaaagaaacactgaggccagagggaaataatctgtcctaagtcacataac

SEQ ID NO: 128927 - DNA, 759 bp, Homo sapiens
ttgtgggtccctggggctcttcctcactcaccctttccctgtggtagtgagcttccactgcctctgcgccagttccaggtgggtggctgctctgcttcattcctctctgttctccatgggtcccgttgcttctgttacgagtcccaatgcgttctcgtggatgatccatttgaagaactagtgtttactagccattctgtttcttcttcatgagagcagagcgcactacctgcttctagtcagccatctttattctctactattatatcccacttttattatttttgatatgaatacatatatttttttattgtggtaaaaagcatataacataaaatttaccattttattcatttttaagtgtagagttcagtactgttaagtatattcactttttcgtgaaataaatataaaggtataaattttaaatttaatgtttttttctacttattcactgagttgaattattatctgaattagttttatcattgattctttgaaattttccagatatactattattattaaccacatttatatctgtatttcttctgtcttccctgattgcatttgaataatacctctaatataatgttaaattagagcagaaatagtgggcatttttgtcttgatcttattgaaaatgcttttagtatttctccattcaattagacactggatttaggactaaggtatgagtattttattatgttaaaaatatcgcttatttcttactatcttggatgtctttttacattt

SEQ ID NO: 128928 - DNA, 191 bp, Homo sapiens
tgtgcattttactgtgttaactatacacctgtcacatatgtgtacatttgtagtggtagacacagcagtccaagaaaccgtacccagccgaggaactgagaggaaccatacccagctgagaggaaagctgcgctgcccaaaattaagccaatgaacaacccctgttttatttaatcggcacacactccaaa

SEQ ID NO: 128929 - DNA, 364 bp, Homo sapiens
agctgggactagaggtgcacaccaccacgcctgactgatttttgtgtttttgtagagatggggttttgctgtgttgcccagtctggtctcagcctcccaaagtcttgggattacaggtgtgagtcaccacgcccagccaactttttctcttaaggctccagttttcttcttagagttgggcccctcccacgaagaaagcacactgccaccccttcatcggatttgaaccctacattttgaaaggaaagcagtgccctcctgctgagttaacaaggcttatttaaatgtttttcttccaaatatcagagcagaacagattctttgtcttccagtggaactatccacatggggcagaagtagttgg

SEQ ID NO: 128930 - DNA, 705 bp, Homo sapiens
cagtatccattatgaagatagatgtaaaaattctcaacaaactactaacaaaccaaatccagcaacttacctaaaagattgtaccccatgaccaaatgggatgtatcccattttcaaagtatgaaaatcaatcaatataatacaccatattaatagaaaaaatgaacaaaaacaatgtgattatctggatgctgaaaaagcatctgacaaaattcaacattctttcatgataaaaatattcaacaaactaggaatagaagggaactttcttaacctgaaaagggcatctatgaaaaagttatagttaatatcatattcaatggagaaagactgaaaaccttccccctaagatcaggaataaaataaagacttccactcctgccatttctattctagctggggcaattatataagataatgaaataaaactcatgtagattgaaaaggaagttgtaaaactatttctgtttgcggatgacatgattttgtgtgtagaaaattctaaggaacacacacacactcatacacaactattagggctaataaacgagttcagcagagcttcagggtaaaagataaatgtacaaaaattgtttctatacaccaacaatgtacaatcaaagaatgaaattaaggaaacaagtttatgtacaaaagcatcaaaaagaataggatacttaggaatacatttaacaaaagaagtgt

SEQ ID NO: 128931 - DNA, 295 bp, Homo sapiens
tgtttagcctctttgctagtggatctcaaccctggctgtacatgaaaataatctggggagaattttaaactcccagtgaataagatgcatgcagatcatttaaaccagactctctggggaagagccccaggcataattgattctaaagctcccctgtgactcaaatgtgcaaagttaaaaacctctgctctcaataaaaagtttccctttaagagtggggaccctcagccaggcgtagcggctcacacctgtaatcccagcattttgggaggctgaggtgggcggatcacctgag

SEQ ID NO: 128932 - DNA, 400 bp, Homo sapiens
tgacagtgtcttaataagccagccttaaaagtgacgtaacatcatttctgccttatttcattggtcacgacggacaacccgatgtggaaggagacatcacaaggacaggaatactgggaagcaggtattgttggtggctgtctcggacgctggttctcatagaagtagatgtattattttagtacaataagtgcagacgatcagctagcaggatgtggtttttgcttgtcctgcctctgatttccgatctaaattgccactctcctcccaatatccctttcactgcaatttcccttccaatttgtgcctttatagggccctctcctcctacacacaattttttaaagtgcatttactcagccagctaacaaacattttagcacctaccctgcacagctag

SEQ ID NO: 128933 - DNA, 309 bp, Homo sapiens
aatgaagaaaagagcaatcaagacccaaaaaatctgcctctcctcagctcaagaggaagaaggccagcctgctgttgccctctgtccctgcattccacagcaccaggctcttccctcacatccctctcctcacattcttaccttatatgattgaggccaaatatgcaaagccccgtcccccagccatgtacacagtagctgctggctgaggacactgctgccaacgccacaggccccagcgaacagccctgactcttatgtgatgatctgcttttgggtcctgtcactatctgcgcacacattatggag

SEQ ID NO: 128934 - DNA, 793 bp, Homo sapiens
acaaaacaaaaacaagcaaacaaaaaataccagagcaagtactgtgtgaacatgtggaagtccatgccctaatagagttgcaattttttattcttcttctatagtggtggcttggtttgtgtacctatttttctgcatttgtattggaaaaggtttcttttaagacattttccaaaagtggagaggaatatgtgtgttcaggaagggctttcaaaaaactgtatatctaaataaagctcaaacggtgaaatcctgtcacattttcacaatgatgcttaaaagataattgagtaaaccaggttgttaatctccttaatacctgaaagaggacacactgaaactgaaactgtgacatcctgctaggtgagttcaggttctgaacctaggaaatcctcataggagaaaccacatttaaacaaagatgggactttctctgagagccaaaaccagataaatgtagaatactgaaatccttgttggacattaagtaaacaaagataatgatacctaaattaatcctctcttgtgcttatgaaacatatgcactgtaaaataggcataccaggaggaaatagatacattaatcatcatttacttatgatacaaattatttattttgacaatttataacgtttaaaaaagttttttaaagatctagagaaaggtgatatagtaaacattcaactctgtaagaacatgggaggtcagtgaaggctacatcccaatcaatatttggctctaagtacctcttcccatttttcctatgtatcacctatttctgtttcggaatatg

SEQ ID NO: 128935 - DNA, 682 bp, Homo sapiens
ggaacatgatctacagtttgggagtgtaaggtgaagctgtgtaattaagaattcttaaagattgaatatttttgttctgagtcactttctacttgtcagattctcacattcaggttgatacattctcttctgtgtactcttgagttattgtaccctttttgtagcaatatattctgcaagacggggtttcagcaggttggtcagactggtctcgaactcctgacctcgtgatccacacgcctcggcctccccaaagtgttgggattacaggcatgagcactgcgcccggccaacctaggcgatgtctcaaacaagcagaagcctactatatgttttgcactgtaattttctttttttccctgtctcttgcagatattgagggatgcataataattttcttacagatctgttacagggtctttgaggaagtactatatttattcctctttttatcttcctcagtattttacacaattactagattgaatttgaatgtgataatattttgaacttgaaattgttgttctatcaacttatctaagatttcacaaaaaggtaatgtaaagaaagctgtatgagcaaaggatcagtatttgaaagggaaaaacctgtcagtttcagaagatgagacagaagatgaagctttctaaaagttatatattttgccttttttgagaaggta

SEQ ID NO: 128936 - DNA, 323 bp, Homo sapiens
attaaaaataatagcctaggcgtgatggtgcatgcttgtaatcccagctaccgggaggcagaggttgcagtgagccgagccaagatcacaccactgcactccagcctggtgacagagtaagactccgtctcgaaaaagaaaaaaagaacggttgtcctgatcattcccctggtgattctgcccgtttagagtcaagttcattgataatcaaaggggcaggctaccagggaagtttcaagccttctgggtactgagatggccccttcccatctttagtgtcattgcctagattccttaagttctgataggaactgtttggtgaa

SEQ ID NO: 128937 - DNA, 549 bp, Homo sapiens
ggcacagtttagggaatgtgagagcctcctgataatcatggaagagttgttttacccgggttctgattggtcattaccacatccagtcactgtggtgagcgagaatgacctgagtcaaatgcctatcactaagttcatctgggggctggagggagggttgcagagagtcagccccacccagtccacgtggttgctatacatgggaagaagtagaatgactgactacagtattcatgaaaacaggatggtttcatacttattttatatctcaactagtacccaaaagtattatatacatagagcatatatcacaatgtgcatttttcctcatttcattaagggagatggaaggttctgttagggaaagtttaggaataagatgattaaagtgagataaatcagaaatatttaataaggacctcagtgaagctgaagaaacagactcagtagaagtagagccataaggaagaagtacgtggtgaaaacggggcattagaaatgagtgctgaataagctgcagttaagaagctgctctgatacctagttcac

SEQ ID NO: 128938 - DNA, 991 bp, Homo sapiens
gaggacatgtggatgccgaggaatgggagccgcaacaagcctggagggactgttgtgaccttgctgcccgtgtgtgctgcgggtgccaccctgcccatgtgtgctggtggctggtgctgggttaggtgctttgtggacctcgccagggagtgtgggaagtctgggggcagctccacatgatggctgctgtgctggctgaagcagtggtgcctctttgagctctcgggcatgccggaagttttggaaacgctacccggccgtcttccgagctccgctgctggtggtggagttggcatctcatttcgcaggcgggagctggggatcgttcacgtgttactctgagatgaggccttcgccctgcacaaatgctgtcactcacatgtttccccccagcaggagtttgtttaccatgtcctctgtgcagggacgctgttgggctcccaggtcaggtgtgcaaagctgttggacccaatgccttttttttaggatagttttttggggtaatgtcctcttaccctaaaatgcagttcttagaaaatataatttatgtttccaaaagaaaagaaaatgtaatttataacttatagttattagactgccctagctgtagagaatgaatgtgatagtattgtgtaataagacaacacatttcaacatggtgatggttagccgtgaaaaagccggacgtcccacctggtgtgttgcgtcctggtgaccggggggcggtccctgcagatggacccaggtgtgacactgggagttcagcccccagctggtgatggaatattacagaatggtgagcagttcctaatgaactttcacataaagcaaagtataattttttctagacttatgtaatagttgaattcatggaaaattcaagtcatagtaagaccgtgcaaaaatgttttgtgtgtaaacgttgaatagagtaagattctgagttcagagagttagaagcatgttttccactcatgaagttctggttcat

SEQ ID NO: 128939 - DNA, 1297 bp, Homo sapiens
ggaagctggtgggaaggcatctggcttgtggcctctgatggctgagcctttgtcctgtccacagggtggaggcagcctcacccagccatccaagccggtggtcagtgctgaggctgggtgggggagcctccgatggacccaggagtgggaggctgctcctaatggcagttgagccccctgcagccttttgcagtgtccagatgaagcccacagagaccctcctccatgtacacacagctgtgagggtagcaggagttggtgttgaagggagagcccagccacgctcaggtccccaccacacatggcctggggggctccgcccttggctgagctggagggcttggggtcaggaccaagggtgggtccaccctgcttggaaagaagctgtcctggcttttggagtcagcgggggaggggcactgcccgggagctggtgtcttgttggaaggggcagctgggagtagggagcagccgagccacaggctgcccacggcatcgtcccctgcctcgggtcagggggccccttgactggaggacctcacaaccctgggggtgtccatggcctgttcctgggagctgcaccctcatcagattctctgtagggggagaagtcatatcttttcctcacccatcacaagcttcatggctgagacctgttagaaacaaaatgcttcctcggtgccacaaagaaatagcactcaaacattaattttctcagcaaggcaatttttacttctatagaagggtgcgactcgcggatggagcaatggtgagagcgcacctggacaagggaggggaaggggttcttattcctgacacaggtagcctctacggctgtgtcattcccctgttgggtggggttggactgcacactctaaggtaattctgattgactattttaaagagagcaggggtgtgacccagagtggtggggtgagtagtttggcaggaaggacaggaacaggtagctaaagatgacttaggtcagagcaggtgaccaggggccgggtgcgatggctcacgcctgtaatcccagcactttgggaggccgaggcgggtggatcatgaggtcaggagatcgagaccatcttggcaaacgtggtgaaaccccgtctctactaaaaatacaaaaaaaattagccaggcgtggtggcgggcacctgtagtcccagctactcgggaggctgaggcaggagaatggcaggaacccggggggcggagcttgcagtgagcggacatcgcaccactgcactccagcctgggcaacagagcgagactccatctcaaaaaaaaaaaa

SEQ ID NO: 128940 - DNA, 276 bp, Homo sapiens
ctggggaaattctgatagggagagtaggtctgggtcattctaatttatttgtggctctggtagcaaagagaactcaaaggcagtatatctctatagctgatgagatttcactggggccgacaccacctgttctgtgcacactcacttctcggttagacctggctaggttttctgctgtgcttgtttttagctttgtaaccagcagtaatcacattggtctttgggattttcatgtttcaggttttacagatgatgcaaaagcattagttttcaaag

SEQ ID NO: 128941 - DNA, 486 bp, Homo sapiens
ggaaccatttctaggtagtctgattccagaagctgagcttaaccatcacatataatgctttccagaaggatggttaggtacatttctgctatacttaatcctgttaacagtgtggttttttttttttttaccaagtttgaacgttttgctcccttgtactgttatatgcttttgaagctgttttattaatttgtcagctgaatgatcccatttcgtatagtcggatggtcatgaaaagaatgtgaaatagacaattgcatttttattattgaaatattgcctacgcctcccttccctaacataaatgtatttcttcagtgcgggattacagcaacattaattctcttagtttgactgtcttgggagatctggtgaacattcagaatattagaggaaaaccagatgaaacttttttataaactaaaacctccagatttatctaagaaaggccaatccattgtatgtgctatcattgtaagttgcaca

SEQ ID NO: 128942 - DNA, 386 bp, Homo sapiens
tcaacactaagaaaagttatgagaaatttgttttaagactgctaagtagggtgaccaattgtcagggtttgctggggattcagggatttctgaggatttaagacttcagtgctaaaactgggaacatcccaggcaaaccaggaccaactggttactctactgctaagccaaataaatttttctgtgaaaagctgtggtatattgaagtttaaagcatgtgagaactgatgctgcagcttctttcgtttgactggtttatcctaatttgggggaaaaaacagaggaatgccatattcttaattgtatgaggaaaaaaaattgttagtacaatgggaggggctgcagagatgtgtatgccaaatatattatacatatatatacacaca

SEQ ID NO: 128943 - DNA, 289 bp, Homo sapiens
cctcgaaaacagacaagtaagtaccaacgatgatagatattgtcacagacacctgctccccaggggccttgtgaatttggagggttctctgctaagctcacatggctctaggaggtgctggtgggagtcttcattaccatatgccagcccttcaggccaactgcctttaaggaccgggacccaggtgacctgggttaagtccccatcctgcccccagctggctgtgactttgggccattgtcttggctgtctcagcttcacttccctttctgcactttgaaggagggaa

SEQ ID NO: 128944 - DNA, 267 bp, Homo sapiens
ttctactctcttctttccttcttttacggctctcatttccatcctatcatgttttcatgattatcctgtcttctcttttcactccctttagaccttcatggtgagtggcaagaaccagggattagaataaagtctttatcacttattagcaatgtgacttggataaattcacctctctgagtctcagtttcttgacctgcaaatgggaatagtgctttctctctaacagggattatgtgagtaacaaataagataatacatgtaaaa

SEQ ID NO: 128945 - DNA, 259 bp, Homo sapiens
cagaaagttggctacaaatccaaagcttaagaaatgaaaacatgtaatttaaagtaaatatatttaacggaatttattttcttatatttctaaagagggaactggggctcttgtaaggtgattttcttttcttcttttttttttttttttcgggcgtgggcatgcgggcttgggaatatgagaaaaccataaaacataggaattgggcgccaggaagggtgtgtgcaggaaatcgtcagcatttggcgatgccagacgt

SEQ ID NO: 128946 - DNA, 478 bp, Homo sapiens
cagtggggagatctcagctctctgcagcctcaacctcccggactcaagcgatcctcccacctcagcctcctgagtagctgggactacaggtgtgtaccatcacacctggctactttttgtattttcggtagagatggggtttcgccttgttgcccaggctgaccaactgatttttgacaaaggtgcaaaacaaattgattggaggaaggacagtcttcaacaaatggtgctggagcaaagggaaattcataggcaaaaaagcaaacaaaaaaacccaagcctgaacctcagatcttatacaaaattaactcaaactgtactgtggacttaaatgtaaaatgtaaaactatgcaattttagaagtaaacgagaaaaccttcaggacctacagctcagtcaagagttcttggacctgagatcaaaagcacaatccataaagaaaaaaattgataaatttgacttaaaagtttttgctcca

SEQ ID NO: 128947 - DNA, 417 bp, Homo sapiens
attttttttctggatataaagattattctaaaatgtatatggaaaggcaaaggaactggaatagctgaacaatttttaactagaagaaaaaagcgtaaggaatactactcatttcactacctattgtgggcttactttacagtaatagacagtcttcaacaaatggtgctggagcaaagggaaattcataggcaaaaaagcaaacaaaaaaacccaagcctgaacctcagatcttatacaaaattaactcaaactgtactgtggacttaaatgtaaaatgtaaaactatgcaattttagaagtaaacgagaaaaccttcaggacctacagctcagtcaagagttcttggacctgagatcaaaagcacaatccataaagaaaaaaattgataaatttgacttaaaagtttttgctcca

SEQ ID NO: 128948 - DNA, 447 bp, Homo sapiens
gcagctgggattacaggtgtgcgccaccatggcaagctaagttttgtacttttttctgagacggagtctcactgtgttgcccaggctggagtgcagtggtgcggtcttggctcactgcaacctccgctgcccgggttcaagcgattctcctgcctcagcctcctgagtagctgggattacaggcacctgccaccatgcctggctaatttttgtatttttagtagagacagggttttgccatgttggccaggctggtctcgaactcctgaccacaggtgatcccccacctcggcctcccaaagtgctaggattacaggcatgagccaccacgcctggccaaggctatctttttttaacaacaggtgtgtcccccacattggtgtgaggaacgccttcctaggggcagtcttgaagtggatttagatggttactctggtctcagtaaag

SEQ ID NO: 128949 - DNA, 661 bp, Homo sapiens
caaatatggctcaccagactacaccttgaggacagtcatgctggctcctttgcacaatgggccagctgacttgtgattgagtggggcttaagggcagtctcctccctccaagcgtatttgttttcttacagatttagcctcccagcggaacatggcaaacacaagacatcaacctctacagttcttcgcaggtctcaaactctggggtggagacctgttgggcaaaggttggtttgcagatgcttccacaaaccatgagctcatgggcagggtctgtgccctttcggctttatatgcaaaccacccagcgcaatgtttggcaaactgcttgaactaataaactaaaccacaaagccaaatgtttgggttacttggccgggcgcagtggctcatgcctgtaatcccagcactttgggaggccgaggcgggcggatcacaaggtcaggagtttgagaccagcctggccaatatggtgaaaccctgtcgctataaaaatacaaaaattagccgagtatggtggctagtgtctgtaatcccagctactcgggaggctgaggcgggtggatcacttgaggtcagaagttcaagaccagcctgaccaacatcgtgaaatgccgtctttacaaaaaaaatacaaaaattaactggattgtaggatgct

SEQ ID NO: 128950 - DNA, 170 bp, Homo sapiens
gcctcctgcctacagggccttctagaagcttcccaggaagctgcttgtgctcattcctctcccacatactccggattggacataggtgctgtggtgctcctatcgcccgtgaaggcccggcttactccctaaatgcagtggatgcaggaaggcatggtgagctaggccag

SEQ ID NO: 128951 - DNA, 184 bp, Homo sapiens
gaccttctgggctcaagtgatactcctgccttaacctcccttgtagctgagaccacaggcatgcaccaccacacttggctaattttttaatttaattttattattctttctagacagggtctggctctatcacccagactgaagtgcagtagtgtgatcttagctcacaacaacctcctcctcc

SEQ ID NO: 128952 - DNA, 713 bp, Homo sapiens
aatgggcaaccagcagtcctcggggctgctctgcctatggagtagacattcttttattcttttactttcttaataaacttgctttcactttactttatggactcaccttgaatcctttcttgtgagagatccaagaaccctctcttggggtctcttggattgggagcccttttctggtgacatagctatttattttttattttttaagtttttgtagatgagttctcactacgttgctcaggctggtcttgaactcctgggctcaagccatccttatgcctcggcctcccagcgtgctggtattgcaggtataaaccaccatacccagccctcctgggtatgactaaagatctgtatgatctgttagtgccccttgttcagataccccatatagacttctctctatttacataaacttttccctttcctggggatgtgctttctctcctccatttgcctagcaagctcagattttgatcaccagataactttgagtgaagattctttaaccatctttctcttctctcttattctactgccctgtttgtatatctctcttgtaacaattttctaatcttactgtcttctctcacacagtatgaacccaaataattgttgaataaaaaaataaatgaatgaacaaataataaagtcttacaaaagtcaatagctattctctaaagtgatgttaaatttgtaagaatattatgtga

SEQ ID NO: 128953 - DNA, 215 bp, Homo sapiens
actgcactccagcctgggcgacagagcgagactccgtctcaaaaaagaaaagaaaaaagaagagaaggaaagggagggaaggaaagatatggagcgtggagctctgggggccactgtgctgctctgaacacaattatcctgcgtttcggtgcccttgtcctgtcggcagcccccagggccacagtcatatttgtgagtctgtcagtctgccctgc

SEQ ID NO: 128954 - DNA, 666 bp, Homo sapiens
ctctgcctcccaggttcacgccattctcctgtctcagcctcccgagtagctgggactacaggcctccaccaccatgcctggctaattattattttttttgtatttttagtagagacagggtttcaccatgttagccaggatggtcttgatctcctgacctcgtgatcggcctgccttggcctcccaaagtgctgggattacaggcgtgagccactgcgcccggcaagagaaaaatcacttctaacttgctaaataaatattatttttgttttcctgccccaaacctaatcctaactgagaaaacaatgatctgctttatgcaagcccctgtgcaagatgctgcaggggatgcaaaggtatatgggctttagatacacagagatttgggcaagaacattcacccccacacagaatgcaagaacattctgtctaggggtgaaagaaaggcccagaagagtttgatatggcagaaccatgtgggcatgaagaggactcatgggagctgtggtgagggaatatgatggaaggttcttgaatgccaggctaatgaggctggagttcatcctgtgacagagcagataatcttgttccaatgtacaaatgaagaagcccagacctcaataggttgaaggacttgtccaaggtcacccagccagggagtggcag

SEQ ID NO: 128955 - DNA, 182 bp, Homo sapiens
gccggctcctactttccacagggtaaacattccaggataagaggaactcagccaaataggaagccaggagcagttaaggaagtgggaaacaacttgtgttcgacttcagtaaatcataaatctatgtataatagagaaaaatagtcattatggttacagaaggagcaggattgaaataaagt

SEQ ID NO: 128956 - DNA, 381 bp, Homo sapiens
acctggtttaaggaatttaatattcgttttgttacctccttcaagctgttatcttctagaagaagatgaatctgcaaaacttattatatttactataaaccataataaaaagtcctgttaatgccttttggtgatttgatggaaagttaccctgggctcagttcccacttgatctaggtcacagggaggaaaagtgaggttgggaattgatattcttttcctatacttctgggtttgaatgcatctttttatctggtaaaactttgataaaggtcaaatgagatccagtcatttcaatggtttcctttttctttatttgtaaaattccctatttgactcacacagataatttttgaagtaaattacctttggggaaaattt

SEQ ID NO: 128957 - DNA, 502 bp, Homo sapiens
ttatctagaggatccctcataggtcgcaggaccgtaaaacccaggcctcgacccgtcagcctccagccgctctccgaggcaccttgcagggggtgggatggcagtggggagcctctcacaacaggaactggggtcccagatgctgcccggagcctggaactgcgagtggccgtggcggtggctgtgctgctcttatacgggacaccccggcacccgaaggtcgagcagggacccagcccctgccacagcacctgccaagcatctgggtgacactgtggtcgggtggggcggggggcttaagtcaggtgaatttgtcagctcgggcagctgtgacaaagttgcacagaccctggtggcttcaactgcaggaactgattctcctggaagcccgagatccaagggctggctcttccgaggccccgcttcccgctcttgcacaccgtcttcctgaggcgccctcacatggccatccctcggggcgtgtctgtcccaatctcctctt

SEQ ID NO: 128958 - DNA, 167 bp, Homo sapiens
agcctcagacgaccgcatcggtgtgactggaagctagagcctcaaatagctgtgtcagtgtgactggatgtgtcagtgtgactgtgtcagtgtgactagagccttagatggctgcgtctgtgtgactagaccctggagccttagatggccacgtcggtgtgactgga

SEQ ID NO: 128959 - DNA, 378 bp, Homo sapiens
atcgttgaagcctgtgtgccagaaatgtggggaacggagggacacagctgcatctggattgggtgaggggcagagagaaggtcatttgtaaacctctaggcagacaaagggcccttaggaagtgccagggctgggcagtcccctgggagctctggggcgctgcagaggcgccaggacagtgagccaagatgcgtctgtggagcagtttggggcagcccttcctgcccattctggcctacccctgggattgggaggtggccggggctggtgagatgcccaagacctgcagggctggagcgcagtgggctgggagctggctggattccagggctgctgtgagtaggagcagggttttatctgggtgacaggtagtcttgg

SEQ ID NO: 128960 - DNA, 366 bp, Homo sapiens
gcaagataccgaggaaagtgtgggtgacacctggtccggtgggtgcaggtgaggagacagaggcactactgcaaggggcacccctgaagtagtgtttccccatgagtggtctgaaagccacctgaacccaagtcacctgggagcctttaactgcagattcctggtttcacctcaagagtctgaatttgtagatgggtgatgcccagaaatctacattgtgaagagctccccagaggattctgctgcacagtaaagtgtctctcaagtctacactgcttatgactgtgcgcaatgccctttggatttatttcccttgcatctaacatggtacttggcaattactcagctgccagtaaataatcaata

SEQ ID NO: 128961 - DNA, 433 bp, Homo sapiens
agtgaggatggtgggggggcctgaaaagggaaaagggcaccgtactgtaaatgtatgaatggggttttctgtgggggccacaccggagcatcacagttctttgaaggacaggagagaaggtcagtgcctggatccccaggctaagtaccaggcgctgctttaggatagcctagaagggtggcccctgggcctcattctccacactgtcccaccccttttgaccacctcatctagccatcttgatgatcagttaagataagaatctctagtgaggctacatttttttgtttcctgaataatgcatgatgtccactgaacacatgttactagatgacagtgttgggctcagataaaacttacaacaaaattaatctgatgcagcctccatggctcacatgatccccaccatgtatgaaatgggctgggcacccag

SEQ ID NO: 128962 - DNA, 462 bp, Homo sapiens
gaggctgaggtgggcaaatcatgaggtcaggagatcgagaccatcctggctaacacggtgaaaccccgtctctactgaaaatacaaaaaattagctgggcgtggtggtgggcacctgtagtcccagctactcaggaggctgagacaggagaatggtgtgaacctgggaggtggagcttgcagtgagccaagatggggccactgcactccagcctgggtgacagagcaagactctgtctcagaaaaaaaaaaaaaaaaaaaaaaaaaagcaaagaacctttccaagccgaggtcaaagccagagagagatgggatgacagaaggtgggtcagagagatgtaatgtgcaaaggactcaacccactgttgatggctttgaagttggaagaaagggccacaagccaaggaatgtggctggcctctagagctggaaaagacaaagaaagagagtctctcctagagcc

SEQ ID NO: 128963 - DNA, 786 bp, Homo sapiens
aagtctcttgcccacttagcaattacagagaagggatatatgggtttatagtaaatgtgacaagtaagtccagggggccctgggaacacacaggagaggcacagaacttgaacccagggtgtcagggaaggagtcctggggaaagtgaggtctcagctaacatctgaaggctgaacaggagtttgacatatgaatggggtgaggggatgtgggagctgggggccggatatctgaggaaacagttcagctttatttcagctggccgtgtggctttgagcaaacaagtcacaaaaattctctcagattcccattactaaaatggggataaaaggaggactaccagatgggcaatatagcgagacaccacctttacaaaaaattttttagaaattagctgggcatggtggcacacacctgtagtcacggctacttgggaagctgaggtgagaggatcacctgagcccaggagtctgagactacagtaggctatcacaaactgacgccagctgggtgacagagcaagacctgtctaaaaaaaataaaattaataacaaagaggggactagcagagcatgtgggaagtagtaagtccacttgtagtaatagcacttgtgattatcacttcacagatcaagtagtcatatttagcctatcatcaggactgatttaaggtgtagggcgaagtttcatttccattaattagtgtgttgttcggcagggaggtcaactgtattcccgactggggagccagtcatgggtgggttgagcactgggtgggaccttttt

SEQ ID NO: 128964 - DNA, 498 bp, Homo sapiens
catatttttggctaggaattcttccattttatctaagttgtctaattagttggcttataattatgcatagtatccccttataatcctttttatttttgtaagagtaacagtaatgtttcccttttcatttctgattttaaccctttgagtcttctttttttcttgatcagcctagctaagtttgccaattttgttatcttttcaaagaaccaactttgtttagttgatttttttgttacttttctgtcctgtatttcatttatttccacttgttgccttttgattttaatatttagttcatttatatttaatgtaattactcatgaagtaggagttaaacctgccattttgctatttgttttccatgtgtctttttgtctcttgtttttctattccttcattactactttttttgtgtgttaaatagatatttctagtatgccattttaattccattattgtttctttatctttttttagtggcttccctggggatta

SEQ ID NO: 128965 - DNA, 503 bp, Homo sapiens
ggtggtttactattctgttactaatgggaagttcttgaggcttatacttgcctcctcctacaataataactctcatttcatggatcagagagcaaatgtgaagattctgccactgtctgaatgtgtctactccaattatatattcaagagcttgggggaataaccatagggtgggtaatctgatttacttgtcacaaacataggtcaaaactccactatcatcttacctccataagcccacatttaagctcgtgaaccagtgtaataatgtgggttctcagaaattaacatcaattcagagctagtgtctaatatcccccaaaagatctggctatttccttttccctatgctgtcaccacggtaaatggctataggtccctttggagaaggtttgggataaggtttacagtatatatttatggcagtgctccggggtgtttcatcaaggggacctatcctctcctttgatcacagagctctaggtctatgaactttttttttt

SEQ ID NO: 128966 - DNA, 376 bp, Homo sapiens
ctgcaggggagccatgatcacaccactgcactccaacttgggtgacagagcaagaccctgtctcaaaacaaaaagaaaggctgagagagcaaatgaaggacagtttctcttcatgtggccgaacccataaaatatgaaaagagttgccagagataatattttctattatatggaatattgaacagagggggctggtctgaaaggagaaaagaataaatgcatagaaagaagaaaagagagtacaaatgaaaagagagacagactcctgatggcctccagttctagctgcagtccttctaaagtcagactacatttctgctattgaaatccataggacactcacatcttaaaatattccgtcctgcttaatctttgg

SEQ ID NO: 128967 - DNA, 249 bp, Homo sapiens
tttgataataagtgatctctggcaaatatgaagaaataatttaaaagaagtttaaaagaaactaaatgtattctaataaagtagagacaatgaggataaggtattctttcaaacagcctctaggaacaaaggaagactacatgcaagtctgcatggggaaataagaaattttcttgatctcaccaatcttcctcctcttggagtcactctctttaatcaccaaccaaacagcttcccaaactagaaact

SEQ ID NO: 128968 - DNA, 295 bp, Homo sapiens
cgaatgttctggcacttgggagagggattcagaggctggaatagagtacaaagaagagacctcccagagcttttaggggagcagcactctaaaaattctgggtttgggggtcttgcagataagtcctttcagtgagcctgacaggactggaaaagactaaggcaggagtgagaaaatgggatgtgggggtgcagagtgggacagcatttcagggtatctgtttcccttggtatctagtcagcagcagctgactagatccctgaaaaaataattggatctcttcaaacgactattt

SEQ ID NO: 128969 - DNA, 624 bp, Homo sapiens
ggccctttaggattaggtcccgccaacctggctacccactttccatccttatattgagccatttgctccactctaccctgcccttgagacacagtgagcctctctttgaacacatcacgcatgttcatgctgggacctctccttggcttttcttcactcccatcgcaactttcactgcctagggaagtgcgatattcattctctgtggcccaaatcaaatgacaaataatcttcccgaattccctaaaagaaatctggtttggtatattctgttattatgatctttataagttgctaccatgtattcatctagtcatctccccaacctcaagtaatgtgtaagacttggaggctaggaacccaactttattgggaagccaactttattgctctatttttcatataaacctagctttcagtaaatttaaatcaccttctgcttatccatccaccagtatgcactgtgattaattaacaaggcagtttctgcattaacaccaaactttccctcttccctgcctatgaccaagttttcaaaaaaaattaaaataacattaaaatgttattaacggcaaaagggaattattttttgaaacatctatgattttttactaagaaaaagga

SEQ ID NO: 128970 - DNA, 591 bp, Homo sapiens
cagtttcagtcacaaataaaaacagagcaccactaactacaaaagaatatgcaaaaacaacgtggatgatatagttgtagcatttccatattatcaaaaaagaaaatacaatgaggaaatgaaatttggtaagatgttttcagattataaagcaaggtacttggatgatataatggctaaaacacatcttaaaagcaggagtggagtgttcattgagagaaataaagaacatatatatttctgtgtttgtggacacattgtatagtatgaaaactgacaaagtacatatatatatatatatatatttaaatgcatgtattccatatatgtgtaggtatatcttaagattttctgaagtgaggtaattgtttattctttctgtttatatgaaatcaccaaaaatatctttttcacaccttgcaacctaaatgcctctgataatgtcatgacatgacttttgcctgccttttttatctttcatttttttacctggttatatagctcccttttccgcatcaatagacacttttttgttttgcttcttcattcttcatgaagatggtgccaacagctgaaggcaggtatatgcgt

SEQ ID NO: 128971 - DNA, 460 bp, Homo sapiens
gatagtgtttcttactgtaaatagcatcttagaatggaagaataaaacactatatgccccattgcttctagagtaacctgagcaatacataatgaaggccaaatctcctttgcttttacccttccatggcttgccacagatctaagaataaggtaccaaatctggactggactatagggccttttgtgactggcttcctgttctatcaagacttctgcgcactttttcacatacagtgctccctttgtctcagtgctctcctcttcactctgctcctcaaaaatgcccacactaagaagcaatgcagtggttaagaatacagactcaggccaggcatggtggctcatgcttgtaatcccagaactggggaggctgaggtgggcggatcacctgaggtcaagagttcgaaaccaggctggccaacatcgtgaaaccctgtctctactaaaaatacaaaaat

SEQ ID NO: 128972 - DNA, 790 bp, Homo sapiens
taatttttgtatttttagtagagacaggatttcgcaatgttggccaggatggtcttgaactcctgaactcaggtgacccgcctggctcagcctcccaaagtgctgggattacaggcgtgagccactgcacccagccctaattaatttttaattgacacatatggtacatatttatggggtacagagtaatattttgatacatacaatgtgtagtgatcagatcagggtaattggcatattcatctcaaacatttatcatttctgtgttttggggacattcagtatcctttcttctttatttgaaactacataatatattattgttaactatggtcatcctacagtgctataaaacagtagaagttgttcctcctacctagctgtaattttgtgttattgaacaaatctctccctatcctccccttccctctccagcctctagtaacctctgttctgcttttcacttctatgagattaactttttctttttttttaacatctaactatgagtgagaacatgtggtgtttaactttctgtgcctgacttatttcatataacgtaatgttttctagttccatccatgtcactttgaatgatgggattttattctttttaatggctataaatattttagatgtctggcttaatagaagacagctgtattctcaagccagctatatctttcaatctgctgcagtatgttttgtggttgaagtgtatgcaattggaaaaggagcatttcagtagctttttcagataatcgtggatattctttgataagacaccaaa

SEQ ID NO: 128973 - DNA, 605 bp, Homo sapiens
taagaggtcgacagagtcaagtgcagtaaacagtacaagaaaatagagaatggaaagctgcctcactaagcttagtgaacaggaagtaacaagaagaaagccctcagaatccattctgtggaaggtgacctcaggagaaaatcagctggacaggaggaatggagccccagtgctccctcacccccaggaagctgtgtccaggcagaagctgcacctgctgggctctgtggagagcagcggggagaggactgtgccgagctgcatgactacttcaatgtcctgagttacagaagcctgggtaactgcagcttcttcacagagactggttagcaaccagaggcatcttctggaagatacacttttgtctttgctattatagatgaatatataagcagctgtactctccatcagtgctgcgtgtgtgtgtgtgtgtgtatgtgtgtgtgtgttcagttgagtgaataaatgtcatcctcttctccatcttcatttccttggccttttcgttctattccattttgcattatggcaggcctagggtgagtaacgtggatcttgatcataaatgcaaaattaaaaaatatcttgacctggttttaaatctg

SEQ ID NO: 128974 - DNA, 586 bp, Homo sapiens
ccagggtttcacagcctagctggaaataagtgttataggcttaagggaaaaggttacatactttttttcatttttgtaatttaatgttaactttattttaattttgaattaaatatttttattgatatgatttcatatttgaagttcaataaaagaaaatattcactttctgagtttttttctggaactactatttgtttcatttcatgattaccaaaaatgattttgtcaaatagaagaaacgaatgttaaaatgacctgctctggtatcaaatatacaaggtacaccactgctgaaaatatcagtcattgatttcatgatgggccagatggatactctgctgttcaaagtgttgggcttaaaggctccagtcccatggttacacaaagggcttggccaatcctcccctctctgccgtgaagctcaggctgccctggggaaatcagcttcacttctggcttctgccactcatctctgttttgtcctccctctagtggctgagcacggtgccaggttccagattccattgcttggagccatggccgcgacgctggtggtaggggtatgtctctgatacaggatcct

SEQ ID NO: 128975 - DNA, 526 bp, Homo sapiens
cagaagaggccacatctgcttcctgtaggccctctgggcagaagcatgcgctggtgtctcctcctgatctgggcccaggggctgaggcaggctcccctcgcctcaggaatgatgacaggcacaatagaaacaacggggaacatttctgcagagaaaggtggctctatcatcttacaatgtcacacctaccctgatgggacgtacactgggagaatcttcctggaggtcctagaaagctcagtggctgagcacggtgccaggttccagattccattgcttggagccatggccgcgacgctggtggtcatctgcacagcagtcatcgtggtggtcgcgttgactagaaaggtaatggctccggctgcacaccgcagtcatgggcacccccacgtctggcacccgggtcctttcaggttctctttccacccagagagagacccagatgtgatcttcccgagtgctctttgtgcctttttcctggcatttgttctgcctattagtgcagttatttatgctcttccgttgt

SEQ ID NO: 128976 - DNA, 860 bp, Homo sapiens
cagaagaggccacatctgcttcctgtaggccctctgggcagaagcatgcgctggtgtctcctcctgatctgggcccaggggctgaggcaggctcccctcgcctcaggaatgatgacaggcacaatagaaacaacggggaacatttctgcagagaaaggtggctctatcatcttacaatgtcacacctaccctgatgggacgtacactgggagaatcttcctggaggtcctagaaagctcagtggctgagcacggtgccaggttccagattccattgcttggagccatggccgcgacgctggtggtcatctgcacagcagtcatcgtggtggtcgcgttgactagaaagaagaaagccctcagaatccattctgtggaaggtgacctcaggagaaaatcagctggacaggaggaatggagccccagtgctccctcacccccaggaagctgtgtccaggcagaagctgcacctgctgggctctgtggagagcagcggggagaggactgtgccgagctgcatgactacttcaatgtcctgagttacagaagcctgggtaactgcagcttcttcacagagactggttagcaaccagaggcatcttctggaagatacacttttgtctttgctattatagatgaatatataagcagctgtactctccatcagtgctgcgtgtgtgtgtgtgtgtgtatgtgtgtgtgtgttcagttgagtgaataaatgtcatcctcttctccatcttcatttccttggccttttcgttctattccattttgcattatggcaggcctagggtgagtaacgtggatcttgatcataaatgcaaaattaaaaaatatcttgacctggttttaaatctg

SEQ ID NO: 128977 - DNA, 526 bp, Homo sapiens
ttttcttcatagaggagcctctgagattctcattcggaactctgggctcttatgttagccacaattctaacaagctttgcaatctggtttctcagtcacggaagaatagaagaacaactcagaggaggaagaagtcagacatagccagacacggctgctagcagttccaccaatgaaagaggagaccaggatgtttaaaacaggcaaacacaaggtgcgaaaaaccagaagcgaaaacttctgaggtcatttaagcaaggactatcgttatccccggaagcagagagaagttccctttgcccaacatcacactgcaagcacgtgttggagctgagattcaaacccaggcatccagggtccagggcccatgcttttaatatattccatatcttaggagaatttcccctatttaaacaataaaagtgcaaaaatcttgtggctagccaaaattttcagttgtttggaaaacttatttatccaataagtggaaaactcacttgtcctccaacaattctggataaatgaa

SEQ ID NO: 128978 - DNA, 536 bp, Homo sapiens
gagaaaaggagatgccggccggagttctagcaccgagaaggagagtactggaatacctgagttttggctgggcacagaactgtctggaatacagactgcaattcccagccttctgtgcagttctgtgtggccatgtgactaagttgtggtcaatatgagtcacggaagaatagaagaacaactcagaggaggaagaagtcagacatagccagacacggctgctagcagttccaccaatgaaagaggagaccaggatgtttaaaacaggcaaacacaaggtgcgaaaaaccagaagcgaagttccctttgcccaacatcacactgcaagcacgtgttggagctgagattcaaacccaggcatccagggtccagggcccatgcttttaatatattccatatcttaggagaatttcccctatttaaacaataaaagtgcaaaaatcttgtggctagccaaaattttcagttgtttggaaaacttatttatccaataagtggaaaactcacttgtcctccaacaattctggataaatgaa

SEQ ID NO: 128979 - DNA, 590 bp, Homo sapiens
gagaaaaggagatgccggccggagttctagcaccgagaaggagagtactggaatacctgagttttggctgggcacagaactgtctggaatacagactgcaattcccagccttctgtgcagttctgtgtggccatgtgactaagttgtggtcaatatgagtcacggaagaatagaagaacaactcagaggaggaagaagtcagacatagccagacacggctgctagcagttccaccaatgaaagaggagaccaggatgtttaaaacaggcaaacacaaggtgcgaaaaaccagaagcgaaaacttctgaggtcatttaagcaaggactatcgttatccccggaagcagagagaagttccctttgcccaacatcacactgcaagcacgtgttggagctgagattcaaacccaggcatccagggtccagggcccatgcttttaatatattccatatcttaggagaatttcccctatttaaacaataaaagtgcaaaaatcttgtggctagccaaaattttcagttgtttggaaaacttatttatccaataagtggaaaactcacttgtcctccaacaattctggataaatgaa

SEQ ID NO: 128980 - DNA, 618 bp, Homo sapiens
tgcagtggttcacgctgtaatcccagagctttgggaggccgaggcaggcagatcacctgaggtcaggagtttgagaccggcctggccaatatggtaaaaccccgtctctaccaaaaatacaaaattagccgggcatggtggtgcatgcctataatcccagctactcagaggctgaggcaggagaatcacttggacccgggaggcagaggtcacagtaagccaagatctcacaattgcactccagcctgggcaaaaagagcgaaactctgtctcaaaataaataaaataaaataaaataaaatatttctgtaacacagctgctgctgagggactagtgctaccagagggaattgagttaagtgtggcaatgccaactgactctcctctccttccctctaaccacccacctgcacgcacccaaacatcagctgaactgttctgcatgtgttttctgagcgggcctcctactcgctggcctccctggtttaacacattgtgaccttcaccaagagcatggacttctattagtttggccttcaacaccggacccaaacactgccttctccatgaggttccatctttcccaccaccaaggggtaactctgcttttcttggatc

SEQ ID NO: 128981 - DNA, 546 bp, Homo sapiens
gggggcttcgctgagaagggggcatctgaataaaggcctgaaggaaatcggggattgagcctcacagttatgccagaggcgacagccaatgagtcctgagggggtaagtgggcttgttcaaagagggggcaggaagctggcgctgcaggcatcgggaagagccacgcatcctgcactgtaccagcctgcagacgcagacagggagcagcgatgagggatggacgcccctccctgggagcagcctccccacctgactgagcagaggagattcgtgtcctgctgctctttctggacagagatggcttttaaggtcccttggcccagtcccccagcctgagcctggagtctgggtttgttgatggagcttcctgagtcttggcagctatcaaggttctaaccctggttctgctgcttcctcttagtgcaactgtgagcaagccatgtcacctcactgagccttggtttcacatctataaagtgggttaacaagccagatctctgatgttgtcagctctacaagggtaggcattttcatgaggcttcttc

SEQ ID NO: 128982 - DNA, 450 bp, Homo sapiens
ctttatttttaaaccaccgggaatacttatagtctctatttatagagaggaaagttagagttataaatactccttagtgtgacagaagcgttattactagtagagtaagcctcattaaactccagaagatgaaataaatagcacaactttgtgaccatcttctggtattgaatatcgtcctttcgggggaaaaaattgcctgttcttaggagtcctgtgaggttttgatgatgtatttgtttgttgtttattatggagattttagattttagtaattagagtcagtttttctttaactttataaattaaactcttaagttccttacagccccaaaatactgtgggtaaagttatttgccttctatagctaatctttaaaagactaaagaaaccttggttttctgagaactgtcttgtaaaacctcaaaagtgtggtgggaagcaaaggtc

SEQ ID NO: 128983 - DNA, 343 bp, Homo sapiens
tcctgcctccagcctcgcaaataatccttctgggattataggcgagagtcactgctctggcctaggtgacttgtttgtttctgtgtaggaactttttgttcaaaaagtcttagcccaagaatcctaagttctggagtgggaagctagagacctcagctcatcttgtagcttttactcttcagatgaagaacctgacccccagagagatcgggtgacttgtgtgagggagtaagctggctggctgtggccttcttcacagttgttcaatgccacttatttaaaacatgcccattggttttttattttttaatttttcttttgatgggaatagcaaggttttata

SEQ ID NO: 128984 - DNA, 444 bp, Homo sapiens
agggatccagtaagaggccaagctgggactctgggccaggtggctgtgctgggccctgcccttgggagaccccagcgctccaactcctgctctccgtcagttgccacccctctgagttcctcctgcacttagtgttgacctcacttccactgcagactggttagagtcttctgaccccttcccagggcctttctgtgtggctcccgccgaggcctgccccacagcagtccagcagccactgcgaatgcgttgctcatgggtactgacgtagcagtccgaggagtgacagtgctgccaccctgacagtgccgttgccgactcttgtctccagtctccatgggcccctgccctgcccgtgtccttgtttgactttcactctgccccctgtagccgcacttctccccacttcctccaggctgggccctcccactcagcagatgccct

SEQ ID NO: 128985 - DNA, 862 bp, Homo sapiens
ctgaggccccagaaagacaagatcccaccgtcctttgcaggaagatgtccaaagagttgcatgagggctcaggagctgagctaaagataaaagcattgcatactttgggcaggcactgtctcttcgccaaactcaactcctggaagagccatttttgttcgaaaatgctggagctgccaacaggaggagctgactcctgctcccatgggctcccaatgaaggctctcctgaacattcccggcctccaggcaacccaacccagccacccccagagtcccagttccactatgaggacaacctgaatgctgaggctggagaaaaaaggcagatcagagaagcaagggcaaggagagaatgcagaggaggcagaaaggaaggaggagggatcactgaagatggtgagaaatctaggggtggaaagagaaggcagacagaaagggattgaagaagaagagcacggctcaaacagggacaggaaggagatgggggcaggaggtctagagaaacggcccacactgcctgtgaggacaatctcccatactccatcaacacccgctcctcggccagcccctcattcagtccagcccagctggggagggatttctagaccactcatcttagcccacccagtcctaggggcctggagaacagaccagctgaatgggccaggcataaggtaggggctggagaggcagagagagaagggttactcctgaggctcagcccaattaccggctccctgcctgtggggagagaggtgctctgtgaccttaaacaactaagttacttttctgagtctctgctccctcgtttgcaatatgacagccaacctctgaggcctctcccagcctaaaaaatgttt

SEQ ID NO: 128986 - DNA, 2638 bp, Homo sapiens
  misc_feature (2610)..(2610): n is a, c, g, or t
ggcggctagaccggtggcggcggcatctggagtagcactgagatcttccggtggcgggaactgcagtcatggatcatattacggtacccaaggtagaaaacgtgaaattggtggatcgttatgtgagtaagaaaccagctaatgggattctttatcttactgcaacccacctgatctatgtggaggcttcaggtgcagcccggaaagaaacatggattgcactccatcacattgccactgtggagaagttacccatcactagcctgggttgtcccctgaccctccgctgcaagaatttccgggtggcccactttgttttagattctgaccttgtgtgccatgaggtttatatttcactgctcaagctttctcagccagcattacctgaagatctttatgctttttcttataatcccaaatcctcaaaagagatgagggaaagtggatggaaactgattgacccaatatcagactttgggcgtatgggaatacccaacagaaactggaccataacagatgccaacagaaactatgagatatgcagcacctaccctcctgaaatagtggttcctaaatctgttaccttgggaacggtggttggaagttcaaagttcagaagtaaagaacgtgtccctgtgctctcctacctctacaaagagaacaatgctgccatttgccgctgtagccagcctctctctggattttacactcgctgtgtagatgatgagctcttgttggaggccattagccaaacaaacccagggagccagtttatgtatgttgtagacacaagaccaaagttgaatgccatggccaaccgagcagctgggaaggggtatgaaaatgaagacaactatgccaacattcgcttcagattcatgggcattgagaacatccatgtaatgcggagcagtctgcagaaactcttggaagtttgtgaattgaaaactccaacaatgagtgaatttcttagcggcctggagagctcagggtggttaagacacattaaagctattatggatgctggaattttcattacaaaggcagtgaaggtagaaaaggccagtgtcttagtccattgttctgatggatgggaccgcacagcacaagtctgctcagtggctagcatcctcctagatccattttataggacattcaaaggactcatgatcttgatagagaaggaatggatatccatgggccacaagttttcccaaaggtgtggccacctcgatggggactctaaagaagtgtcccctatcttcacccagttcctagactgtatctggcaattaatggaacagtttccctgtgcctttgagtttaatgaaaacttcctgctggagattcatgaccatgttttctcctgccagtttggaaacttccttggtaactgccagaaggatcgggaagatctaagagtctatgagaaaacacattctgtgtggcctttcttggttcagaggaaaccagacttcaggaaccctctctataaaggcttcactatgtatggggtactcaatcctagtactgtgccctacaacattcagttctggtgtgggatgtataaccgctttgacaaagggctgcagcccaagcagagtatgctagagagcctcctggaaattaagaaacagagagcaatgctggagacagatgtgcatgaactagaaaagaaactaaaagtccgtgatgagccaccagaagagatctgtacctgctctcaattaggaaacatattatcccagcatctgggaagtcctttgaccaatcctcttggctttatgggtatcaatggagacctgaataccctgatggagaatggcaccctatccagggaaggaggcctccgagctcagatggatcaagtaaaaagccagggtgcagacctccaccataactgttgtgagattgtgggcagccttagggccataaatatctctggggatgtgggcatctctgaggccatgggcatctctggagacatgtgcacctttgaggctacgggcttctccaaagacttaggaatctgtggggccatggacatctctgaggccactggcatctctggaaacttgggtatttctgaggccaggggtttctctggggacatgggcatcttgggggacacaggcatctccaaggccagcaccaaggaggcagactactccaagcatcagtgagttagttactcatcttccatgctaggtatacctacagcagctacaatgattcttgtcccagagagggctatgctgcttttccaattggtttaagtgggtgaagccagggcacccctctccccacttaagtctggaagggaattactttactgattaagtgaccaatatgttcatattaagcagtacagagtgtaggcaagagaaagaatatgttattgttctaaaatgggatttaactatagaaatgttgcctctcagctgagacacatattaagctggttctactgtctgttttccttaatgatcgacctgccctattttctatcctcactgcagtaatgtgaaagtgaagtggaaatattgtcacaatggtcaataatgacccttttgagggtatggagagatggtatacagcaggtaactgtgnattgcagaataaattgaaagaaaatttt

SEQ ID NO: 128987 - DNA, 2528 bp, Homo sapiens
  misc_feature (2500)..(2500): n is a, c, g, or t
ggcggctagaccggtggcggcggcatctggagtagcactgagatcttccggtggcgggaactgcagtcatggatcatattacggtacccaaggtagaaaacgtgaaattggtggatcgttatgtgagtaagaaaccagctaatgggattctttatcttactgcaacccacctgatctatgtggaggcttcaggtgcagcccggaaagaaacatggattgcactccatcacattgccactgtggagaagttacccatcactagcctgggttgtcccctgaccctccgctgcaagaatttccgggtggcccactttgttttagattctgaccttgtgtgccatgaggtttatatttcactgctcaagctttctcagccagcattacctgaagatctttatgctttttcttataatcccaaatcctcaaaagagatgagggaaagtggatggaaactgattgacccaatatcagactttgggcgtatgggaatacccaacagaaactggaccataacagatgccaacagaaactatgagatatgcagcacctaccctcctgaaatagtggttcctaaatctgttaccttgggaacggtggttggaagttcaaagttcagaagtaaagaacgtgtccctgtgctctcctacctctacaaagagaacaatgctgccatttgccgctgtagccagcctctctctggattttacactcgctgtgtagatgatgagctcttgttggaggccattagccaaacaaacccagggagccagtttatgtatgttgtagacacaagaccaaagttgaatgccatggccaaccgagcagctgggaaggggtatgaaaatgaagacaactatgccaacattcgcttcagattcatgggcattgagaacatccatgtaatgcggagcagtctgcagaaactcttggaaggcagtgaaggtagaaaaggccagtgtcttagtccattgttctgatggatgggaccgcacagcacaagtctgctcagtggctagcatcctcctagatccattttataggacattcaaaggactcatgatcttgatagagaaggaatggatatccatgggccacaagttttcccaaaggtgtggccacctcgatggggactctaaagaagtgtcccctatcttcacccagttcctagactgtatctggcaattaatggaacagtttccctgtgcctttgagtttaatgaaaacttcctgctggagattcatgaccatgttttctcctgccagtttggaaacttccttggtaactgccagaaggatcgggaagatctaagagtctatgagaaaacacattctgtgtggcctttcttggttcagaggaaaccagacttcaggaaccctctctataaaggcttcactatgtatggggtactcaatcctagtactgtgccctacaacattcagttctggtgtgggatgtataaccgctttgacaaagggctgcagcccaagcagagtatgctagagagcctcctggaaattaagaaacagagagcaatgctggagacagatgtgcatgaactagaaaagaaactaaaagtccgtgatgagccaccagaagagatctgtacctgctctcaattaggaaacatattatcccagcatctgggaagtcctttgaccaatcctcttggctttatgggtatcaatggagacctgaataccctgatggagaatggcaccctatccagggaaggaggcctccgagctcagatggatcaagtaaaaagccagggtgcagacctccaccataactgttgtgagattgtgggcagccttagggccataaatatctctggggatgtgggcatctctgaggccatgggcatctctggagacatgtgcacctttgaggctacgggcttctccaaagacttaggaatctgtggggccatggacatctctgaggccactggcatctctggaaacttgggtatttctgaggccaggggtttctctggggacatgggcatcttgggggacacaggcatctccaaggccagcaccaaggaggcagactactccaagcatcagtgagttagttactcatcttccatgctaggtatacctacagcagctacaatgattcttgtcccagagagggctatgctgcttttccaattggtttaagtgggtgaagccagggcacccctctccccacttaagtctggaagggaattactttactgattaagtgaccaatatgttcatattaagcagtacagagtgtaggcaagagaaagaatatgttattgttctaaaatgggatttaactatagaaatgttgcctctcagctgagacacatattaagctggttctactgtctgttttccttaatgatcgacctgccctattttctatcctcactgcagtaatgtgaaagtgaagtggaaatattgtcacaatggtcaataatgacccttttgagggtatggagagatggtatacagcaggtaactgtgnattgcagaataaattgaaagaaaatttt

SEQ ID NO: 128988 - DNA, 2311 bp, Homo sapiens
  misc_feature (2283)..(2283): n is a, c, g, or t
ggcggctagaccggtggcggcggcatctggagtagcactgagatcttccggtggcgggaactgcagtcatggatcatattacggtacccaaggtagaaaacgtgaaattggtggatcgttatgtgagtaagaaaccagctaatgggattctttatcttactgcaacccacctgatctatgtggaggcttcaggtgcagcccggaaagaaacatggattgcactccatcacattgccactgtggagaagttacccatcactagcctgggttgtcccctgaccctccgctgcaagaatttccgggtggcccactttgttttagattctgaccttgtgtgccatgaggtttatatttcactgctcaagctttctcagccagcattacctgaagatctttatgctttttcttataatcccaaatcctcaaaagagatgagggaaagtggatggaaactgattgacccaatatcagactttgggcgtatgggaatacccaacagaaactggaccataacagatgccaacagaaactatgagattcgcttcagattcatgggcattgagaacatccatgtaatgcggagcagtctgcagaaactcttggaagtttgtgaattgaaaactccaacaatgagtgaatttcttagcggcctggagagctcagggtggttaagacacattaaagctattatggatgctggaattttcattacaaaggcagtgaaggtagaaaaggccagtgtcttagtccattgttctgatggatgggaccgcacagcacaagtctgctcagtggctagcatcctcctagatccattttataggacattcaaaggactcatgatcttgatagagaaggaatggatatccatgggccacaagttttcccaaaggtgtggccacctcgatggggactctaaagaagtgtcccctatcttcacccagttcctagactgtatctggcaattaatggaacagtttccctgtgcctttgagtttaatgaaaacttcctgctggagattcatgaccatgttttctcctgccagtttggaaacttccttggtaactgccagaaggatcgggaagatctaagagtctatgagaaaacacattctgtgtggcctttcttggttcagaggaaaccagacttcaggaaccctctctataaaggcttcactatgtatggggtactcaatcctagtactgtgccctacaacattcagttctggtgtgggatgtataaccgctttgacaaagggctgcagcccaagcagagtatgctagagagcctcctggaaattaagaaacagagagcaatgctggagacagatgtgcatgaactagaaaagaaactaaaagtccgtgatgagccaccagaagagatctgtacctgctctcaattaggaaacatattatcccagcatctgggaagtcctttgaccaatcctcttggctttatgggtatcaatggagacctgaataccctgatggagaatggcaccctatccagggaaggaggcctccgagctcagatggatcaagtaaaaagccagggtgcagacctccaccataactgttgtgagattgtgggcagccttagggccataaatatctctggggatgtgggcatctctgaggccatgggcatctctggagacatgtgcacctttgaggctacgggcttctccaaagacttaggaatctgtggggccatggacatctctgaggccactggcatctctggaaacttgggtatttctgaggccaggggtttctctggggacatgggcatcttgggggacacaggcatctccaaggccagcaccaaggaggcagactactccaagcatcagtgagttagttactcatcttccatgctaggtatacctacagcagctacaatgattcttgtcccagagagggctatgctgcttttccaattggtttaagtgggtgaagccagggcacccctctccccacttaagtctggaagggaattactttactgattaagtgaccaatatgttcatattaagcagtacagagtgtaggcaagagaaagaatatgttattgttctaaaatgggatttaactatagaaatgttgcctctcagctgagacacatattaagctggttctactgtctgttttccttaatgatcgacctgccctattttctatcctcactgcagtaatgtgaaagtgaagtggaaatattgtcacaatggtcaataatgacccttttgagggtatggagagatggtatacagcaggtaactgtgnattgcagaataaattgaaagaaaatttt

SEQ ID NO: 128989 - DNA, 1312 bp, Homo sapiens
ggcggctagaccggtggcggcggcatctggagtagcactgagatcttccggtggcgggaactgcagtcatggatcatattacggtacccaaggtagaaaacgtgaaattggtggatcgttatgtgagtaagaaaccagctaatgggattctttatcttactgcaacccacctgatctatgtggaggcttcaggtgcagcccggaaagaaacatggattgcactccatcacattgccactgtggagaagttacccatcactagcctgggttgtcccctgaccctccgctgcaagaatttccgggtggcccactttgttttagattctgaccttgtgtgccatgaggtttatatttcactgctcaagctttctcagccagcattacctgaagatctttatgctttttcttataatcccaaatcctcaaaagagatgagggaaagtggatggaaactgattgacccaatatcagactttgggcgtatgggaatacccaacagaaactggaccataacagatgccaacagaaactatgagatatgcagcacctaccctcctgaaatagtggttcctaaatctgttaccttgggaacggtggttggaagttcaaagttcagaagtaaagaacgtgtccctgtgctctcctacctctacaaagagaacaatgctgccatttgccgctgtagccagcctctctctggattttacactcgctgtgtagatgatgagctcttgttggaggccattagccaaacaaacccagggagccagtttatgtatgttgtagacacaagaccaaaggcagtgaaggtagaaaaggccagtgtcttagtccattgttctgatggatgggaccgcacagcacaagtctgctcagtggctagcatcctcctagatccattttataggacattcaaaggactcatgatcttgatagagaaggaatggatatccatgggccacaagttttcccaaaggtgtggccacctcgatggggactctaaagaagtgtcccctatcttcacccagttcctagactgtatctggcaattaatggaacagtttccctgtgcctttgagtttaatgaaaacttcctgctggagattcatgaccatgttttctcctgccagtttggaaacttccttggtaactgccagaaggatcgggaagatctaaggtgaatttactttgtgagaagacactgaacagggagaaggtggtcagtgcaaaaagaatgtacctaccaccctgaatttggcatagcagtcaagaaaggggaggagataacaataataaaaagaacttttgaagc

SEQ ID NO: 128990 - DNA, 189 bp, Homo sapiens
gctgctcaacgcagggacgagctgctcaactcaggggcgagctgctcaactcaggtgcgagctgctaactcaggggcgagcttcagagaggagcctgggcggcaggtgggaccctcactccccacggtgtcctcgctccggctcagtctacttctcaggccctcccacgtcctctgtatcttctgcatg

SEQ ID NO: 128991 - DNA, 586 bp, Homo sapiens
gttacaactactttggagaaaattatctaatatttggtaaagctgaaagtaattttattcctctctctctctctctctatatatatatatatatacacaccccggggaaactcaggtgtgtacagggaatcatgaacaataactatttattacggtactcttggaatagcaaaaatttgaaaaaaaccaaatgtcttaatataaagacgataaataaattttggtatgttcatacggtggaatagtatgcacctcttaaaatgtattaactagagctacatagataagtatagataaatttcttaagctaatgttggatgtgaaaagtaacatataaataactttttaaaaaaataaatgagttatatgaaacagtttatattattttttatggatttataaatgtgtagtaataatataaaaatattttttgaaatgattaataccaaagcctagataatggtttcctctggggaagaaaggaacaatatgatttgggcctcagtgatacctgtacagttaagtaaaacattggagataatgcaggtaagtgaaataaacatggaactacgtgtagatttattca

SEQ ID NO: 128992 - DNA, 815 bp, Homo sapiens
cctgatgctacaactaattatgcagcccagctcactcatctcctggcatctccatgttgccagtctttcattcgttcaaaaatagttactcaaacctaccattccagatgctggtgaacaagcagcaaacaagacagacatagtccctgttctcatagccctgacattttaatgggggaggcagagacaaataataaacaagtacacaaataaacgcagaatataatggcagaaggtgaacctcaacaaataccagggtaaggagtctgatttggtggggtacggggagactttagataaaatgttcaggacccacagaggtggcacgtgaacagctatgccaagatctgagatcagctatgtcaagatcccaaagtgctaggattacaggcatgagccactgcacttagcctgggctgactagaggagcagtccgtctgctaaaaacagataacattgacatcatgcctgacaactattctttttgggcacgcgatgagtgccccgttcaataaaagcattttccagcatgatacgctaggtgctgcaggggtacccaaacagagtgtccgactcatggtccactactacgagggctcacacaagggaaaaaccgtaagaggattcttcaaggaggaggttgtggatttcctctcccatttttatgaaataccccgcgggtgcggcaaactacgaacgttgtttcagcaagaagattctaggacgggagtgttaaagggggcagaaagagtggatccctaatacaggagtactccaagcaagacattatagaagagtccccacatcaggggagt

SEQ ID NO: 128993 - DNA, 174 bp, Homo sapiens
ataaagagacatcttacaaaggtgtggacagagtgttagagaaccgcaaggggaaaatacagtaatcctatacagccaatcctatccctagcctgaagggaataagagaatggttactgtattagtcagaattacaaaacagaactaatggaatatgttggtgtaaggagggcg

SEQ ID NO: 128994 - DNA, 475 bp, Homo sapiens
ggctctgccccttcctagcttgtgaccattggtaaatgcatctcatgcatctctctctgcctctgttctctctgagtaatggaaggaccataatagtgcttttctcatagtctgttgcaaggattaaatgagtgatgtgcttagtggcgggcacatcgttcatgctgctgttgttacggttgttattgttatgtagccttagggtttccttctcactgtgaacaatggaagacagtttccctggatgttacacacagcatttaggctcccaggttagcctatgctgtaggtgaactagagatatctggttgtcagggatacaaatctactctgaggatgagaaaagttttggtgggctgacttgagaatcttaacaccatttacgatacaatactgataggaacatgtgttttgagtttctaacaactaacttcagcaactgtaagttagaagcttcagtaaaaataggagtatg

SEQ ID NO: 128995 - DNA, 367 bp, Homo sapiens
gacttttcaatatatgtgcctatactctttagagttgtctttgtttcattttcttttttgagacagagactaggtctgtcacccaggcttgagtgaagtggcaggaagacggatcactgcagcctaaacctcctgggcttaagagaccctcttgcctcaaccgccagttagctcacaggcacataccacatccccagccactgttttgatttttttttttttttttggtagagacagggtctcacactttgttgccagggctggtctcgaattcctggactcaagcaatcctcccgtgttagcctcccaaattgctagggttataggtgtgagccaccctgcccagcctatgtttatttcagatgtt

SEQ ID NO: 128996 - DNA, 1116 bp, Homo sapiens
gcctgctttcttgttcttttccctcatttcttgttcttcctcagtcctttcctcctcattttccctagagtattccaggccctgacacggtcatcagggaggttcattcttgtgttgctgtgactgccgccagtgccaccaccttgcgaggtgtgttggccgatggactcggtgtcctcagtgtcttctctgtcctccagctccactgaccacctggcttcacccctccctgggccccaggagtccggctggcatggaccacagccacagcacccccgtgcccctcacttggtggttggctttggccagcgggggcccccagcaggaggtcgaggaggaagggagagcgagggcctcgtctttactttcccggcttctttgtgagctgcctggagctggccgagtccagcctctccctccttctgggttccgacaatctctccttccctggtctgtcctgtgggcggctgcagcccggccctgactggcacagggctcttgcaccgcccctgtggctcacctgctccctccccaacatgaataaaccctcctgaagccacaaaaaaaagaacaaaagataaacaaagacataaagaatacatctaagaaaaatacatacaacgacaaaagggggcgggcgccgccgatcaaaaagattattcccctcgaggggggcgcgccaaaaattattgcgccgttgaccccgggttgtttgttttcacaaaggtcggcgcccattagtagtagcgccgcgttataataaagccgcaaggcgacatcgggcgcagggagataacaacaacgacgcttgatgtggtggcgaaaaccaacctctgctatcatggggaggaacatgctttttgggagagaagggcaccaacttatcttactgtggggcggatcagcccaaaactaattgtgcgagcgaacactatcagctacacggataatatttaagaccgccctcaagaggagcaataagtataacatatacaagagttgtttatcgcgggtggtaacaacagacgctggtaaaaatacggcgagcgcgttatagaaacaatttaagcgtataacaggaatattatctgttgagaaaaattttatcacacggag

SEQ ID NO: 128997 - DNA, 279 bp, Homo sapiens
ccccacggggagcgcaagaaggcactggaggctgttgcgaaggagcagtgggtttcgggtcctcatgaccggccctggttccgggtgtgaggctgtggagacgcatgggtctgcctttctcatccgcagcttcctgttgctacttgggaagctccatgtttgctgtccggttgtgtttcgagtctgttctcttgggcgtctgtgccgtggaagttccttgtgcttgatagggccagcacgtgtgaacaatcttcacttcagctagaagctttgaagtct

SEQ ID NO: 128998 - DNA, 477 bp, Homo sapiens
tggggaggcctggggctgagacccaagctagagtctcagaggagggggaggagtagtaatgcataatgccattcactcacacactcattcattcaacaactatatatggatgctgactcagagccaggcactcatgatcacatgactcagagtctaatggacgataagaaacaccagttgttaattgcccattaatgtatgaagccctgtgctaagtgccttacctgcataagataattcagtctctgcaaccgctctgaggttaacttgccttctatcctcatgtcgcacagacgaagccgaaggaggaggatcgaggaacttggcccaggtcccacagctaaggaggcggcaaaggaggactgaagggcagttgactcattcatcctcgatttttttcttgaaagcctcctgcatgcttcctttcctggggacttgtttgccctctcacttgttttcccccatagacagccgagc

SEQ ID NO: 128999 - DNA, 220 bp, Homo sapiens
ggatcccctgcttcctgaggcatcccctgagcatgcatccccatcccctctccagtgctgtgcgtgtgtgttgtggtggccactgtcggggtcactttcttccttgttttgggctgtgagcttggggcatggctgctggcctcgggggactgactgtgggctctctggacagatgcttttggtcacggcatctgctgggcagtgagctgttgggctgtga

SEQ ID NO: 129000 - DNA, 333 bp, Homo sapiens
ctgctcccagtcattgctgccttgccactcctgaagcatagcaagagtgccctgggctccgcaccttggccctcactcttcctttctgcctgaaatgattgtcccccatcttcacatgactgtgtccctcatttcacagactcccacagtgaagtcttccctgatcactcaaacagcatccctccccatttcattccctgagagtttttcctttacagcacatatcaccactgaacatttgtgtactgtctatgtatctgtgtaggatgcatagaacagggactacatcagttttgtttgttgctgtatccccagtcttacaatagcatctac

SEQ ID NO: 129001 - DNA, 754 bp, Homo sapiens
ggaagtatgtttactttagcaggaatgtggatagggcaggccatgattgacatctctagcaaccttggtgaaaatatgtcagatacagccagctgaatttgatcaataaaaacttgcgcttttttttttcaaagaacattggattggaactttagaaaataactagaatttattatttacaatataccagatgcttttcctagtactttacacgtatttactcatttaactcttaccacaaccatgtgagtgaagtactattattatctccattttatggaagaaaaacattagccccaaaacttgcccagagtaaagtagccaagttttaatttcaacttgggagtgcctggctctaaaatctattttaatggtgtattgctttgccctctttttcactgagaaccattcagaaaggatatggtctgtatcaaagttggccaacatgcaacttgccaaatctgattgctattctggaatccttcctaatttagcactttagtagttaatatggatttaccaggatttgaatgtgaaatgaagcctatctgccatctctgtttgagggttctaattttattttatttttccactcaagtatattctcacagagggtattctaattttagatagatgtactattatgcttcatcatcggtttatatcagcctgttttaaaatgtatttcagccagccgtggtggctcacgtctgtaatcctagcactttgggaggccgaggcgggcagatcactt

SEQ ID NO: 129002 - DNA, 401 bp, Homo sapiens
gctcagcagaacagcgagagctgtgcgcccgagccaagaatgagtgctactcaagccacgtgccgggttccttacgacgatgacttcctaacatccatttaactcctaaaccaataataggaatctctcattttgcttgctaatgattggtttagaaaaggacatgagaaattttttaaaaaatattttttggcgtagagggcttttggaatgcttttcctcacttttaaaaagaggcatccagtctgggcaacatggtgaagccccatctctacaaaaaatacagaaattagccaggcatggtgacaggcacctatagtcccagctactcgggaggctaaggtgggaggattgcttgagcctgggaagcagaggttgcactgagatcatgccactgcact

SEQ ID NO: 129003 - DNA, 906 bp, Homo sapiens
gtttcattgtgctatcattgggtaggaaaattaggaataatttcttatgtacttttcttaactttctataaatttaactgaatacttttatagtccaaaaaatgaaatagatttcattttttaaaaggcgaattggagcctttcattacagaagtatagtctgcagctcatcgtaataatcttattgcataatttagaatcacttccacagagcccttggccatataagtgaaggcggcacagttcagacctgcactgtgatacgtggctgtttaattaaaatttaaaatccagctcctcagtcacactagccccattccaagtgctcagtagccacatgtggcaagtgacagcttttctagcatcatagaaaattcgattgcccagcattggtttggaagaaaaaacagggaatctggagccagaaaacttggaatcaagtctgcctacaagctgacacttgctgtgtgaaatggggcagtttactcaacctaagcctatttccccatgaccaaattgggactgaggataataccatgtaccatatacagaggttaagaaaattaagagaatgcaggtgacagttctctgaaaacaatagtgtggtttaccaggtagatgctgcttcccagtcccccagcttgaagtcagtctagctcttcaaggactgattccaaatctttgaatgcttcacaccaagaattttgcctgaatgccaccatcaaaatcagattagctcttattacagttcctggaccaagcccgtggcaatgtgcacatttcatttcttccttgtaaaaagctttaatacacagctctctctatacaatgacagctcctaaaagttttctttaataatttaaaatcttcactgtatttccattcctacaattaaaaagactccct

SEQ ID NO: 129004 - DNA, 812 bp, Homo sapiens
atgagcttccatttgttgaactctacattgtgactgacaaacttggctgcaccttaaaattacctgaagagcttttaaaacttgctgtcaattaaatcaaattctctgagagtgggacctaatgctcagtgtgttttttaaagctcccagtttatttcagtgtgtggctaaagaaccacaacacaatatcctaaacttctcattactgatcattctttcttcaatgttctttttctttattcatcatcacttaacatttcctctaaggctttattagcatagttctataattccttagagttaaagaaaattcagatatttttacatcattgaaagctaaaactttgttacttacataagtgcttaaaaggcatgcaatgcccataaattctgtgttagattcaaaatagttaaccttattttatacattatagaaattctaaggttaattttttaaaaattaggtcttaaaatgcttacatttacaaatctgatcaatagttgcaacctcttgttactgtttgcttttataaattgaccattagatgcttgtgctcatgagttgacacattgaaattatgcaaggttgaattttgaaaaatctctgtcaccatatttaatggttcaagggaatgaaaggattctagttacataggcctaaaggacataatgaaatttaaaatttgtttcccttagaaaagattaagatatattttcttaaaagatattaagaaaggtattcttccatatcctaagttcccttagtaagtttccatgattagcatcaattgttgaagtgaagttaatttatg

SEQ ID NO: 129005 - DNA, 647 bp, Homo sapiens
gtccaaaacccaacctgaaataacattaaggcttaaagatggagaataatctcctttgacttcgtgtcctgcatcctaggcacactagaataggggttaaacccccaagacctatggcaaccccagccccatggcatttctgggcttacactggtagctctacagttctcaggtagtcctgcacccatggcttcactaggcattatcctagtggtgactgtgtggtggctttgcttccatggctccatttggcttgtcctagtgggggctcttctatagtagctccatcactgtgacaagtccctgcctgggcccccagttctctgtgatatactttaaaatcttggtataggaagccatgcccccaccactcttgcattctgcatgcctgcagacctagcagtatgtggacattgccaagatttgccacttctaccttccagagcagtgggtcaagccacacctgtagttgtttgagccatagttggggcagccaagagcactgcccaagcaagatgcaggatgcagagacccaaggcagccatgggcagtaagcccatgaagggaaccctaggcccatcccccagaaccattctgccgtcctagaactcttggcttgtgataggagaggaacccttgaagatttc

SEQ ID NO: 129006 - DNA, 475 bp, Homo sapiens
gatgtacttgatgtcacacattttacatgtttgttttcttcttttgctctccaaacaataagtgaggtaggtattggttttctcactctacagatgaagatgcggagactcaaagacagggacttgcccaaaatcacattggcacagtcagagtaagtgatttaaatctaagttggctctatggttttttacttcatctctcttggctgttctggcatatactgatttatttcttttcttctgtgtgtttctccaccccaggacactcccaagatgaagaaaagataatagagtcaagccattatttatctgaacccagagccttattaggggaaagtccaggagtctcttggattccccagtcacttgtatttcctcatcccaaccgctagcacattgtattctgtggtctgtttatgtttctgtagctggtgcaagactgtgagctcttcatggacatgggcaatgtctagtt

SEQ ID NO: 129007 - DNA, 846 bp, Homo sapiens
gcgcatttacagcaattcttggtggatggcaagattttcacagcttttggagaagttttaggtgaccagttttatcttcctagcatcatcttaaggaccgtttggtttgtttctgctgcaactccttgctgccgcagctagcgagatgcgaggcagagaggggacccaccaagggcagagagacagacagcaaacagcacaggatgggaaaactgagaggtagggaggaggtaaactgagggtggagggacgccctcacgcccataacccctctcccctttttatcagagtggaattgttgtaaatatcaaaaggattaaacaagcaaaatcatcaaattgttatttgatgaggtgggcacagagccacagagagtgccctgaaggacagggcacatgccagggaaccagggatttgggtcttgtctctgtccctctcttcacgcccatagggcactgccaggccagcgtttgaacatagcgtattgccccacctaggatgatgggaaaggggcatgtgcaggcctctgccctgctcagctgctttagcaaagtcttggagaaggacacggagacaaatttatttgatctgcagatggcacagagctggtaaccaacaattctgatgatcaaattgacttacgagacgacctggacaaacctgaggtgagctgaatcaaaaattaaagttactgagaaaatacactttaaattttgcattcaagactaggcacaagtggctcatgcctataatctcagctctttgggaggctggggtgggagcatcacttgagcccaggaatctgagaccagcctaggcaacatagtgagaccctgtttctaccaa

SEQ ID NO: 129008 - DNA, 155 bp, Homo sapiens
aatagctttgactgaaggaaactgagagagttggtgctataggttgatttgtatcatggcactcttttatcatttgcctgtagctgtatttgcttaggagaaccatgcttcagggcacagtgccagctcactcatcttgggcacacattatggag

SEQ ID NO: 129009 - DNA, 1085 bp, Homo sapiens
attcctattgcaccataatttaatactgagagattttcttccggggatttctgcatctggtctctgtttacatccccaaacgcagcctgcttagaaacagtcctggtcttgcctgtttggtagccactgactgctgatgtctcctggccagcagtttggggaggtctccactaccacagccgccctgatctcctcgagcacagggctctccaccaggactcgggctgggcatgcgcccctggcttgagaactttccagagaacattcccattggcttcgcagctcaccaggctgtggttggaacctgagaggtacattatgctccatttccttcactcatgattacgaccagctgccccatcgccctcatttagactttatctgcatttgctgttgggttctctcttcatcttgtccgctgtgcctgccgaaaccactggtctttggtaagaaaactcctttaccttctccacctgcttcctagaacagcccctctgccttcctgtggatggagagctagcctgcccctgatgatactcctgtccttctggctttctcaggaagcagcggcacccacatagggaggctgcggaaggggcacaatctgtgtgctttccactggtcccgagagagagtggcctggcccttctcgttagttcctctacccgagtccttctacctcttcctgtcccttttgctttattgcctggcctcgtggacttcatcacatgcttttagcatttgagaacctggccaggatggaaatgtcctattaaatgttccttatacataaaatgatctgaggaaaatccaaaattatttcctaacatcttacgtactgggtataaaagaggttcgctcttcagatatacagagcacacacttactgtattgaaaatatgattacattcagcctaggcaaaccatcattttaggcttacatgacataaatgtatttttgttaaatcttaagacatttctgtccacaggcatggtgatataagaaagagaaaaaaagaaaagaaatatttaaaaaatctttacacattctttgaagttgtatcattgttttatataccactgag

SEQ ID NO: 129010 - DNA, 436 bp, Homo sapiens
gtttgcaaagactaacactctggtagtataagaagaagaagggaaggaaatgatgacttattcaaaactcacaatgactgtattttacaaatgagaaacagaggcagaataaagttaagtaaactgctacaatgtacattttcagtaagtggcagagccgggactcatccatagggatcttggtcaggactgagatccagctcccattcccacagcaaatcacgatttacttggggtagccccctgacttggccagggcatgaatgtcttctgtgcgatttttttttccattaaaaaacacattgggccaggtgcagtggctcacacctgtcatcccagcactttgggaggtcaacgggggctgactgcttgaggccaggagttcgagaccagcctggggaacatggtgaaactccatctctacaaaaaatataaa

SEQ ID NO: 129011 - DNA, 340 bp, Homo sapiens
gtgtagggggttggagtgcatgtcaggttgcacggcagctttctcattttatttaggcccaggacttgggttcttctatgtagtttttcttcatagcacttgccatcatttgcaagtgtatatttataggagcactttgaaggaaggactatgttttttccacggttgtataaccagtatctggcatataataaatactcagtaaatatttgttgaataaattaactaaacaaatagactttgtaaatttttttctgtcccagtctttttggagagtggattcaaccaaactgtaggcttttgaagaggtgtaaggcatctcaaaggcagacagagattt

SEQ ID NO: 129012 - DNA, 430 bp, Homo sapiens
ctgggaggcagcatgcacgtgaggcccacgtttgtttcctgaagcctggtgtttatgcatgcctatcctcactgagatagagtcatttttcagagcaatttaaccatggccgtgggcctgtccccacagagattagataacacagacacacaacagtgcaagttttagggaaagatttaaagtatccaagctcattggcaggccaggtgtcttccagcggaaagaggaggctagaagtagcaggcttgcccgttgctggggccactttgagaagcagcattttcatattgctacatcccttgagcagcatttgtgtgtgttctagggcattcagaaatgtctctttatttcccattgtggctcttgaattccagggcactgcatgggcacttggctctcatgctgttcaacctcactttaaaatccagca

SEQ ID NO: 129013 - DNA, 186 bp, Homo sapiens
ggcatttggagccttgatcctggagaaactgattctcctatgttagctaatttctagagatagcaaatgattcccctgaaatatgcaaagtctcctttgatatacaagccaaccaatccagagcccacacaaccatctccattatcaaactctcacacactaagccaatattcctcctgtcctaag

SEQ ID NO: 129014 - DNA, 166 bp, Homo sapiens
caatgagcaagacagacgcagaccctgtcctctggagttaacagtatagcaggggaaacagaaataaggttgacacaaatgctaacacagttaattcaattgtgagtaatgccacaaaggagacaggcagagtccggaagccacctcaccctctatccctgacctg

SEQ ID NO: 129015 - DNA, 380 bp, Homo sapiens
cacccttcaacccctagtacactgtattaccttctaagcttgatgtttcttcatagctttccctatgagagccaagattgttgttttatctactgctctttccccagtacctagaacagttccccaaatattctcaggtttgttcaatgtgttgttcaactcttttaaattcttactgatttttgtctgattgctctattcattactgacagaagtgtagtaaaatcatccactatggttgtcagtttctctacttattcctgaagttttgataatttttactttatgtattttgggattatgttacttggagtacagaaatttagaagtgacttataacctgaggaattgtcctttgtcattatctagagattgtttat

SEQ ID NO: 129016 - DNA, 384 bp, Homo sapiens
gtcctcatcttaacagtatatccgacatggtagagactctacccttcttgaaatacttcacttttcttatgggaaaccacttcttaccatatttcctggccagtccgtctcattaatctttgctggttcattttcctcttctgacctctaaatgtttgttccccagagctcagttctcagaattcttatgtatctacacttttcccctaatctcatctattaaataatgcatagaccgacctctcccctgaacttcaaacttgcatgtgtaactttcctctttaatctgcacttgagtgtctaacaagaatttcaagcttaacttgtctacagccaaattcttggctctaaaatctcttcttcccttcatcctccttaactcaa

SEQ ID NO: 129017 - DNA, 191 bp, Homo sapiens
tatgtgaaatatatcctaagtgactcttttggataagatatcctgatgggtagcctttgagtagagagaggtgacgagacattagctttggagttccaaagtcaaattacacagaggcagaagaaaccatctagataatattttttttgagatggggtcttgctatgttgcccaggctggtcatgaactcc

SEQ ID NO: 129018 - DNA, 409 bp, Homo sapiens
tcttggaaaggcctttcttcctatccttatctgtctgtactctatcattctttaaaaacaaaacagaaatatgtacagctttttgcaatgtcaattataccacaataaagtgttttaaaacaaacagcaacaaccaaaaaacctcagatatcggttccaaaaactttgttcttaagctggaaatgattgcttccattttgaaattttataggacattgtatctctcttatagaaaaaaatacatcctttatattctgtctctgtttttagacatttgctttaagatagatggaagagcatgctctttttcatttagaccttttgtgaatacctcagcagaaaacagtttagtatgcaccataccacaggtgcagcataagctgctactcaacaggcagacctcaccagg

SEQ ID NO: 129019 - DNA, 312 bp, Homo sapiens
agctgggattacaggcgcctgccaccacgcctggctaattttttgtatttttagtagagccagggtttcactatgttggccaggcttgtctcgaactcctgccctcgttatcctcctgctggccaccaccacggaggcacctggtgagtacttcttcttagaaagggtgcagctcaagaagtaccagggcatgggctcactggatgccatggagaagagcagcagcagccagaaacgatacttcagcaagggggataaggtgaagatcgcacagggtgtctcgggctccatccaggacaaagggtccattca

SEQ ID NO: 129020 - DNA, 511 bp, Homo sapiens
aggggagtcgtccagtagttgtttcagtcaagggtctggaactcagggctggggacacacatttggtcaccatctacctatgaatggtatttagagacactggaataaaaaagactggaaccgagaaacaagccctggttgttcagacaaaggaagagccagcaaaggaaacttcagacacagcatcccaggaagacagaagaaaaccaagaaactatcgtcagagatgccaacataagaaaagggtgtttcaaggaggaagtgggccatggagctataatactgctaaataaataatcttgcaaggaacccctgtattttgtaacacggaagtcactggtgacattataaaaaacagtttcaagggcaagttagggaggaagtctggataagggtcggggagaggagagaatggaatataaggtaaaacaaggatatacaagcaactttacaggcatttacccagattttcccatttgatccccacaattaagtccattttacaattgag

SEQ ID NO: 129021 - DNA, 327 bp, Homo sapiens
atcggtaggaaactaacacccccacatgcattgttatctcagtgagaatggaagcatctggtcagcttggtgtctgcataacaaacacagcagcggctgacatttattacatgcttaggcaggtactgtgcgaagcattttacatcttttttctctccctggcttctcacaatacccccagagggtcctcgtttcttgtgcaagcatggagagtcactcacattgggactcgcatcagatgtgctgtaccaaaaacatatttgatgagctagctaaatgtgggggtggggagaggtaggctttctgagagaagaggccagttggaaa

SEQ ID NO: 129022 - DNA, 768 bp, Homo sapiens
agcagaaagggtggggagccaggtgaagccaggttttcagagtcaggtcggaagggaaggcagaacccagcaacctgggctgcacgaagcagcaatgggagtggtctgggcaagggtctggcagggatcccacccctctgcagcccagaaacccagccacctgggagcgctggcaggggcaccaggctccctggagtaagcctttgagagcaagtcgactgtgacagcccagcctgcgaggaaccctgcctccgaaagttccccaaagtcagtttggggaagtttcttccagtaaagtttccatgaggtggccttctggctgaggcaatggggtcagtccagagcaaaattctcaagtccttgtgtcctcttgtctctgcctgagccttgtctgctaccccacccagatgcctgactttaaatgactggtaacagcttaaaatatgatccgttgtaggggagggcactcctcacatcttagcaagaatcaaaggctaatatttacaagtactttccaactttcatcgcttcccagaaggaacacccagctccccacagcatgggagaaagatggtaaccctgagaagtcaaatatcccactgtgtgttgctgggcagtctctgggcctcagtctcccatctctaaaatgaggaggctgattgaggtcccaggtgtgacttctcagactctcaaacctcaaggctatataataggcaaacagagttgataacaactccaggtaaacagacatgtctttttaaagtattg

SEQ ID NO: 129023 - DNA, 261 bp, Homo sapiens
agaaacaatctcctgatgcttctgcctctgattgaaccctgactcatacaggtgatgcaatctcaacagaagggctagggggaactagaagcctggcagcgcctgctctcaggcaagtgtgagggttttcctgacaatcagaattctgcctgagcctcctgggccaacaggagctttgcacagcagaagccactgacctcctatggatatttctgcaagcttggatgcacgaatgagttgtcagaagcacttggtttcctg

SEQ ID NO: 129024 - DNA, 129 bp, Homo sapiens
gagcccaataaggagagagaacagggcagggaaacatctcccggcttcatgtaaatccgccttctgtattaacatgctttaattgtgcctaattatgtacttgcttatagtttttattctgttgtccaa

SEQ ID NO: 129025 - DNA, 186 bp, Homo sapiens
cactatatatttttcttttgttttgttatgtcttctcccatgatactgcaaaccctacttctccaaaatacaggcaaggggtttttgttggttttgtttgattgttatgtccctagcatctagaacagtgcccaactgtttaataaaagaatgaatggatgaattagtgaaggctaattatttgta

SEQ ID NO: 129026 - DNA, 325 bp, Homo sapiens
atacaataaaacgcacccattttaagcacatggtttgatgagttttgacaaatgcaccagccccctccaaatccatcagcctagaacactcccgcctcccgtttgtggtccatctttcctcagcacccccaggcccaggcaatcactgacccgctctgtcactgcagatttgtgcagtctcgtccagagcgttagggaggtggaatcaggcaggaggagctccttcgcgtctggccgcctttgctcagcccagcggtttaggcttcgggtggcagttgcgtgcatcagtggttggttcctctcggttgcgtggacgtactgcagc

SEQ ID NO: 129027 - DNA, 604 bp, Homo sapiens
atatttctgttttgttgtttgagatgggagtctcgctctgtcacccaggctggagtgcagtggcacagcctcagctcactgcaacctccctgtcccatgctcaagcaattctcctgcctcagcctcccgagtagctgggactacaggcatgtaccaccacacccagctaatttttgtatttttagtagagatgggggtttcaccatgttgtccaggctggtctcgaactcctgacctcaggtgatccgcccaccttggcctcccaaagtgctggaattacaggcgtgagccacgctcctggcccttgtatatttttctaagtataaggtgacaggatgtgattctctaaaagcacaagcatttttggagtattcctcaccacacatttcaaaagctgaagaaaagtctccttcatttactgtttccttcctatgatttaggatttagaagctgctatgaagggggacagaaggagccagttgtactggaacatctccgcttcaccttctgggtcacctgtatgctatgtatttggccatgtttcctagtacaaagagccctttatatttagattccttatgggccaatttcctgatggaaaaaa

SEQ ID NO: 129028 - DNA, 488 bp, Homo sapiens
agatgaggaaattgcaggctgatgctctcttacaacagcactgagagtcccacaggagatcctcactagctacttgacagcattcagcagcctcccagtgcaggtatgtgaagacatttgctttactaagcaaatgataaggctctctgactctcatcagaatctccctgctagtcgtcctcactggcctagaccacaggaaaagatgaccctcttgttacctgcagtgatagaggtgaatggttgcagcagggaatgtaaggcccaggagtataaagtatttactatggccgggtgtgagggctcatacctgtactctcagcactttaggaggccgaggtgggtggattccttgaggccaggagtttgagaccagccttgccaacatggtgaaaccccgtctctaccaaaaatacaaaaagtagccgggcgtggtggatacgcctgtaatcccagctactcgggaggctgaggcataggaatcgttt

SEQ ID NO: 129029 - DNA, 370 bp, Homo sapiens
gcatggctctttaaattctcacaacaactctacgaggtggattctataattactctctcttcaacgtaacagaaaacttacatcaaagaggtaagtgagctgcccaagtgcatgcagcctgacactcagaatgtgaactcgagtcagtctgattcctgagctcctgcctctacagcatcgatcactatacccagggaggaagtgagatcacactacagctcctatgtcaccccgtatcactcagtaatacatctgagaatcacggtgatatggagcctcctgcccacagcaggagtggatatgtcaggtagccagccagcctgcctatgcagcagcagcagcttgataccagaaggtccctagatgtcag

SEQ ID NO: 129030 - DNA, 356 bp, Homo sapiens
ggttgctattatgtttaccagcaccattaaatctggcacgtgttcagcttcacaccgtattatcatgggaccaaatagattagaataattgatgtttccaaagccttttttgaccattcatggtctcatttgataaatctttcagatatgatatcatttcgaacttgtgtttactaatggatcacagaagaagggcagaagagcaaaaccatttatagcttccttgtgcagggtctcctcctcctgttgaaatggacaccagtctggcctgttggtgctcaggttgcagcatgagggcctggacaagaatccatgtactgtttccccctgctcgtttcttgagattggagaagtat

SEQ ID NO: 129031 - DNA, 886 bp, Homo sapiens
gggattgttcagaaggctccatagatgatggctttgggccagacaatcagattatgctaagggaagttaagataaaatcctgttgcctatactgaagagaaacatattatttgctatgaggtaaaatagcctcttctactaaatctgaatgttctagtgagttgaagtgttatttatattcaaaagaacatatagataggtgtaggggtgagttattgctatagtgagaagctgtaaagcaatattttgttgattatggtaaaaattggttaaatgcattgggtaacttttccaattttaagctcaattaataagaagggaaattgagaccctgagtaggttttctgagataggcgtctgtataaattgagacttaagagaagtcaggatgatgaaggaaggctaaaagattggattgttcaggcttgagactagaagagtggggagttaataacagtctttaaggatgaagggttcttataagagaaagaagactagctgttttccatctccagtgagtacagaacaagaagatgggatttaacaaatatttattgaacatctccaccaagtgcagaacaagaggatgggaagtataagtgctttagatgagaactaaaaaatgtactaagatgaagattttaaatccttgagaggttatgaattttgttttttagagatcttttaaacaatatagattttctcttcataactttataaataggcactagtgtcaattcaccttaacaaacgtttattgcattcttaaagccccttccagtttaatgatttcagcaatgtgtcagtgaatagagggctgataactttgtagaactagtcaacatttaagctgtttaaaataataatcgtgatgttagttataata

SEQ ID NO: 129032 - DNA, 471 bp, Homo sapiens
aaacaccatattatttaggaggatagggactgtctgttcagcactgtgtcctcagcagtgcctggtcctgtatgcaggacccaggtttcatgctttctaatttcacctgagaacttctcactaagccccctccctggctgtccaccctcaggtggaagtaagattttcttcttctgaatgttcataacactgaatctaaacctcagatctgcaaatgcatattttctactttgtagtgtttgtgtagtaattccattaatagggtgtcaatgtctggaagatagggcagggtcaatgtctgattcaatctggtgtcctcctgtatcccttatatcatcaggcactgcgtttatctgagtgtttggatggaaacccacatattcctcatttctactatgagatattgaaccaggattgcccaactataaaattgtatgatcgatgtaagatagaacagagaagtaccttccc

SEQ ID NO: 129033 - DNA, 551 bp, Homo sapiens
ccccactcgtccacggttggcttggaatctccaaaccacctgtcctccttctgtgagaagaggaaaaggggaagtctcagctacgtgaggaggctgaggcaggagaatcgctcggtcatgggaattggttctctcatgggagagaacttttttcttcaagagatgtcatttcaggttgtagatttgtgagtgggcgagaaacagactgtagagagtttaggagttagtgggtgctgaggagagaggcagtgggtatgcaccatttggcagggagaagaacgtgcgtagaaggtagctacaaagatgctcagaggagctcaaagctctgagaatttctcagttgaaactatttttcttaaaggtcaccatttacctccttcttgccagataacatctttcctttaccctcaatttgatttctttgcaatatttgacacaatttatctcttaccccttcctttccttaaaactctcttctcctgtggcttctgtaatatgacaggtactgcccagatatcttcctacatgactgaccactaattctctttttt

SEQ ID NO: 129034 - DNA, 349 bp, Homo sapiens
cactaagacccaccgtaagtgccttcacatgtagcgtctcatgtaatcctcatgagtgacctgcaagacaagctacttcagacaggagtctgagaggctgtggccttgctaaagtccaaaaccagttaggtgtgaatggagactcaaatccagatttcctattgccaaatactgtgttcttcctattacaggactctgcttaatacatcatcctcaaaaaagttgcttctcagttattttctaaaactcctcacaacccggagaagtcaaaggcttgtcgtagtccggtttgcaatgtcagagccttcatatgtcatgaaatatttggagtgctgggtgggcaggaggg

SEQ ID NO: 129035 - DNA, 492 bp, Homo sapiens
atactttttcaagctgactcttcctgagtggtggttagggaggagctgtcttggggctgttctggagctgttgaggtcgggtgtctgtctggatactcacagcctatctgttgaggagaatgcagttctcattgtgctgcctttggtggtgctgtgtgtggctttttagatgtgggtggaggtgagttgggggagttaatgagatcttttttaggtgcttttgataaagtagtctgcactagaggattcattgtgactttttcccttaacctgcacatacttctctgctcacccttgctgtctttctcatgtctttgattttccaatctcctcttggttgaatttacataaaggctctgctatggtttaaatgtgtcccccaaagtttatgtgctggaaactcaatcctcaatgcaacagttgagatgtggggcctaataagacagccctcatgaatgaattaaagttgttattgtggtaatagattagtaa

SEQ ID NO: 129036 - DNA, 192 bp, Homo sapiens
atttcacctgcaaatatctatgttggcacttagtcttggaccctcttcttcaattttaacctaaattcagaacacataaaaataaggccaggtgtggtggctcatgcctgtaatcccaacactttgggaggccaaggcaggtggataacttgaggcaaggagttcaagactagccgggccaacatgtcaaaa

SEQ ID NO: 129037 - DNA, 467 bp, Homo sapiens
ctcttctccctatcctaaacctgacatggtcacttgaaataatcttcctctggttttttcttttaatttaatttttattccaatagcttttggagttcaagtcgctttttgttacatggatgagttatatagcggtgaattctgttcctccattttttaaaccatacacctttcactggctcctcttcaggccgcaaatatactcaggtctctcagagagtataataataaaatccttccttggcctggctttccctgctagtcgcctctctatctccttatgttcactgcctcatgtctgaaagactagtctatattttctgtgtctactgtcttcccttttcactctgcaaccactcacaatctgtctccagtgctccactaaaagtgttctcactgaggtccacgtgaccctcttcttgccttgccatctgtgtatttcttgatatctctggtgtttaacagtc

SEQ ID NO: 129038 - DNA, 143 bp, Homo sapiens
gactggtcttgaactcctggactcaagcgatcctcctgcctcggcctcccaaagtgctggaattacaggcatgagccactgagctcagcttgaaatcactttttgtagtagcaaaaatgtatgtgctgttacttctgccccca

SEQ ID NO: 129039 - DNA, 549 bp, Homo sapiens
cctcctagctggcgagaagttaccaggtaactgcactcctgacgggcttcatgttgcaggccctgaaaccagctgcctgggaccaaatcccagctctcatctcggcaaagttactgaatctctctctcccccatttcctcatgcgtaaaatggggaaactaacggcacgctcctccagggccatcagtagggccaagtgagttaacgctgcagagtgccaggactggggccagcacacaccacgtgtgcaggaagcgctgaatacttctattcgctattacgtacaaaggaaggtttaaaccaggtttaaacctatcaacaccttcccacagttcttaacacaaattccaaacttcttccccagctcacacagcccagtgtgacccaggccctgcagccctctcctgtctctccacgcccctgctgcccactgcagtcggggcacctctctcccatcctccatgtgcctgccctgtcttgactctgagccttcatctgtgcaattctctctgcctggaacagcctccccctctcctctgcccacctaac

SEQ ID NO: 129040 - DNA, 324 bp, Homo sapiens
taccctgaggtcataaagaatatataccaacatatttttcttctaaaagttttagttttactttaaatttttcttctgaatatttggttttcattttggttttacatttatgtctttgttccatttggaatttattttgtaaagcaggtttccctgtttcctagtcctctgttctgttccattgagccagtgagcaattgccatatttacaatatttagtcttcccatccatgaacatgatatactgttaatttattcaggtcttcttttatgcccttcaaggatgttttgtaatatttcccataaaaccctcgcacagatttt

SEQ ID NO: 129041 - DNA, 599 bp, Homo sapiens
ccctgtctgctcattgtcctggctcaaataccagattccatagtcagtttccagaatctccatcctgcctatttcctgactgaagtaatcatgtcagataatttctctgttctatttatattctccttagaatacttctacagcttctactgaatagtcaatttaccatagctcctgaaaggacaaatggaccctgatccaatctgggcttatactccttcctaagtgtttacaatttgaacacaaatactttagttagtctgtgtcaagcatgggtgctagaaggctatgtgacatgccaggggaggggaggggcagccattttccatcatggacacagaagcgaggagtatcagtctaaagaagttatcaaccagaggcactagaaaaagcagaaatgagactccacatagccacagagagatggaaaagaaatcctggccttggttcttcatgaaattcaattgcatgctctgccattgagccccaagagaaaacaaatacttttgcaccaggtgggttggcgcacacctgtaatctcagcactttgggaggccaaggcgggcagatcacttgaggtcaggagttcgagaccagcc

SEQ ID NO: 129042 - DNA, 417 bp, Homo sapiens
gcccgccctgtctcactgctgaacactggtagtgtttctaattttttgctatcataagcaacccaccattgaagatcctcccatttaaaaactttgtccacatttccaattatttctttagaatagagctctaggagaagaatcattagatcaaaaggtatcagcgttttaaagaatctagatccgtgctgcccaatatggcagcctctgccatatgtgactaaaatgagaaaaatacaggtttttggctctttcaattgacattgagtaaagtgaaaattcaattcctcagtcacacttgccagatttcaagtgctcaggagcgacacagggccagcagctactgtactggacagcgtagatggagagtatctttattgcggcagaaagttctaatggatggtgttgtctcggcac

SEQ ID NO: 129043 - DNA, 126 bp, Homo sapiens
gctgtgcaggagggaaagtgctctacccctgtgtgatccacagctgggagcaactgatctgctgaggctatgctgagtctaggctcgaggagggcaaggccgttgaacgtgcacaagcggcacgcc

SEQ ID NO: 129044 - DNA, 436 bp, Homo sapiens
ataccccagagtattcttttcatattattcaaatcctctatttgaaatcaagctacagccatagttttatttcaccagtttattcttcacaaataagatgttctttaaaataatgaacatgaaagtatttcattcaataaataaagcaaagtacttacctataatgctgattctgtaacaaataaaaatcagataatcatgactacaattacagaacctaacctcagggtaaagaattcctgacaactgagtccccaagatctgctccatgagggttctcaacatagaaacccaaaagcccatgaagtaagtcctcactggatgaggtaaccaagtatagttcaaactagtaattaaaagatagaagtttgatcctatttagtaattcattatattacttaaaattaataatctaaaattcttaattacgagttag

SEQ ID NO: 129045 - DNA, 351 bp, Homo sapiens
cttgctttgatatggaaaataaactggagaagatcaggctgaaagacaagatcagttaagatgtatttgtggtacaacacaaacgaggctcagccaaggtacagctagctggggaggagggagctggatgaattcaaggcatattcaagaagcagaatgaacaaacgtcatggggaatgagggagagtaagccaagtatgggcacatcttgtcttagtgtgcttcactttatcatgcttcacagataatgcatgtttgtttttgtattttaataattgaaggtttgtggcaatcctgcattgagcaagtctatcagcactgtttttccaacagcatgtgcccagttcatgc

SEQ ID NO: 129046 - DNA, 435 bp, Homo sapiens
tcatacgttcaagtcctaacccctgtgccttagaatataaccatacttgaagatagcatatttaaaggggtaactgagttaaaacgaagtcaaaggatcaatgactgtcttcactgaaagaacttaggacacagatctacacacagaacagcaatgtgaagatgcaccaggccaaggagaggtctcagaagaaaccaaccccactggcgccttgatcttggactttgagcctctagaactgcgggacaatccatgtctgctgtttaggctgagatagagcaagtgtgagcagggagccaccaaagccaccggcaggggcaccctgggggacagtgtgacagtgtcctgcaccccagcctgtgggtttgcaggggatagggacagtgacctcagccagtccctcgagcccctgcctgcttctgcccagcttctccc

SEQ ID NO: 129047 - DNA, 460 bp, Homo sapiens
gggaccctgtgctgaagggcaactagttgggtgatatcattaactatggataattttatagaccctaggatgtgtcaacctcattggggtttacactgtaattactgccgacttttttagtatcttttttttcttttggagacagggtcttgctctgtttccaggctggggtgcagtggcatgatcatggcacactgcagcctcaacttccagggctcagttgatcctcccatctcagccccatgagcagctgggactacaggtatgcaccaccatgcctggctaattttctttttctttttttttttttttttgtaaataccgggtctcactttgttgcccaggctggtctcgaactcctgggctcagacaatccttctgccttggcctcccaaagtgctgggattatgggcatgagccactgtgcccggcctttagtatcattttgaatcatttaatc

SEQ ID NO: 129048 - DNA, 293 bp, Homo sapiens
tagagcccagaaaccccccaaacagtatagtcttcatgcaactaaaatccctttttagatcattttggggttttttaaatgctatttttagaaatttgaagtggcctgctttttttaagcatttaaatgaagcacctcctttagggaactgttttcatgtgttctatcttctaaatcatgcaaaaagtaggaaaaaaagaaactctggcatagttctcctagcattcaaaaggaaaaatatgtttccattcacaatcctaagtcaaaccgcttatattcgtttctgtaaaatt

SEQ ID NO: 129049 - DNA, 365 bp, Homo sapiens
catgtgcaaacctggactagggagaacagggacaaagaaggccgagtagtgattcaaaagggagaccaaaagccccaacatttaccaccaaacacctcagaacaaaaaatatagattcctgggcctctccccagaccaagtgattcagagcatctggggttgattctgatcaacatggcatcaatatttttaaaaagcactccatacctgtaatcccagcacttttggaggctgaggcaggcagatcacgaggtcaggagatcgagaccatcctggccaacatggtgaaaccccgtctctactaaaaatacaaaaattagctgggtgtggtggtgcatgcctgtagtcccagctactcgggaggc

SEQ ID NO: 129050 - DNA, 401 bp, Homo sapiens
aaaaaataaaaaattttaaaaaaggaacatctactatgtgctaattgtgcatgttgggaaaataactatcaattaataagtccttctggacttcaggaacttacaatctagtaagagagatagtcaagccaatagccataattcaatatgagaagatatatgagatatatatgagaagatgtatatatgatatctcagatatcagagaagtacagagtactcgttccttaactactataggaacacagatgagggttaagttaattttccttagggttagagatggttcagaaagactaaaaagaggagaaaatatttgttctgggccttaaaagatgagtagaaatttgctgaccaggtgaatagtgaaacaggtataaggagaggagagaatagtatga

SEQ ID NO: 129051 - DNA, 432 bp, Homo sapiens
gtagattattttctactatacttagatatttggtcttagcgtgtatttccacaacagaaatacagattatcttcagttatgttcactctgtttggatagtcaaccatattagtctagatggatttttggaggtgttgtactttggaggttataaattaagtcttctttcttgtcttttatatagaagtctactttatgtctttgggtagacattaccatcatctaaaacagatactgaagaaacctttattcatgttaacaattgatcagaacatgtctgtatacattattagtacatttttgtttgtttttaaatatttgaatatttatttcaccagatgctcaaataaggagatgagtaaactctgataaacgagtttaatgacaaattgcgacgaagattcttcactttacttgatggtaaaaaaaaaa

SEQ ID NO: 129052 - DNA, 1072 bp, Homo sapiens
ccggctgtgagagggaaggagcatgcgtgcagccgcgtgggggagtctcacggtgactttaccgaggaaaatgaaccagacggaaagacagcactctgtgcgcctccacttaggtacggttctggaaaatgccaaggaatgcagggtgccggcaggcagctaggtgaccgggagggaacatgaggggacgcgaagagatttggggataagggctactgcattatctcgaaggtggtgatggtttcacgggtgtattcgtgatcaaagtgtgtcagttttccactgtagatctgcgcagtttgttatgagtttcttacgtcggttatgcctcatccaagttgtggggatgtagattcatgcttaccaaagcttccatgcttcataggcatgcctgaccccctcagttgcagaacgtcaacacgcccctgatgaggaagctggcgcgcctcaagctcggcctcgtggaaatggctctgggcatgctccagttcatctgggaggaggcccacgggcagcagagtgagcaggggtccctggagaagctgctggcggactatctgcagaacaccagtgactacacttccgtcggcctgcaatggttcacgctgaagcggactctagcacacggggcactggcacagctggggagcctgcagccgctgagcgtgggctgtgtggagatccgcgcccggctcctgggcctggccgggagggccctgcacctgctggccatgcaagctgaccctgtgcaccctacctgctactgggaggcgggcccctcggtgggcgccaagctgagcggcctcaagtctctggagctggaggtagaggaagagggtgccacaaagtccagcagggacccgccggcctccagggcagccccggaggagcactgcaggagaggcgaggacctgaagaggaggatggttctggcccagcagtacctggctcaggcgtcagaggtgctgctgcagtgcctacaggtggcccttggcagtggcctcctggatgtcgcagcagccgccagcctggagatggtggagtgtgtcggcaccctggaccctgcaactac

SEQ ID NO: 129053 - DNA, 816 bp, Homo sapiens
ggaagcgtatggcctggcccagggtgccgtagctgaggaagaagggaggcttcacagcatccagggcttatatggcctggcccagggcgccatggctgaggaagaagggaggcttcacagcgtccagggcctattgtcacttcaagacttgcagaacgtcaacacgcccctgatgaggaagctggcgcgcctcaagctcggcctcgtggaaatggctctgggcatgctccagttcatctgggaggaggcccacgggcagcagagtgagcaggggtccctggagaagctgctggcggactatctgcagaacaccagtgactacacttccgtcggcctgcaatggttcacgctgaagcggactctagcacacggggcactggcacagctggggagcctgcagccgctgagcgtgggctgtgtggagatccgcgcccggctcctgggcctggccgggagggccctgcacctgctggccatgcaagctgaccctgtgcaccctacctgctactgggaggcgggcccctcggtgggcgccaagctgagcggcctcaagtctctggagctggaggtagaggaagagggtgccacaaagtccagcagggacccgccggcctccagggcagccccggaggagcactgcaggagaggcgaggacctgaagaggaggatggttctggcccagcagtacctggctcaggcgtcagaggtgctgctgcagtgcctacaggtggcccttggcagtggcctcctggatgtcgcagcagccgccagcctggagatggtggagtgtgtcggcaccctggaccctgcaactac

SEQ ID NO: 129054 - DNA, 466 bp, Homo sapiens
cgagactccatctcaaaaaaaaagaaaaagaaagtcgtcagataataaggagtgctgggccactattttatagagagtgtttggggaaactgtctctaataaggtgatattgagcataaactgagacatggagagagttttgaggctacctagaagaaaagtggttgagacagaggaaacagcaagtacaaaagacctgagatgggagcatgcttagggtattcgaggaataacaagaaagctgctgagttcaggacaagaatgagtgggagagggcaatgggagacctttctgatcctgtagaacctgtttgctacagtgagaagtttcttgactttcacatttagtgatatgacatgctaattagagagttttgggcaggggaacttgatttgatttactcggctttctgaagaacagactaagagaagacgagaggccgccgggatgcgagccgggctgtgtg

SEQ ID NO: 129055 - DNA, 238 bp, Homo sapiens
gtagagggaggaatggacagcaaaaggacatgaagcggcggccaggctcggtggcagcactttgggaggctgaggcagggggactgcttaagcccagaagctcaagacctcaaggcgatccgctcgcctcgtgctcccaagtgctggggactacaggcgtgagccaccaggcccaggctcaaacacatcattctgagtaaaagccagacatgtatgatgtgggcaggtgggtttattt

SEQ ID NO: 129056 - DNA, 749 bp, Homo sapiens
agtactaaaacttagtacaaagctatagtaatcagatactatgaaattgacataaggacagacatatagatcacttgactaggcttgacagtccagaaataaaccttcacatttctgatcaattgattttctacgaggcagccaacacaattctgttttaaatatggtggtaggacaacggagtagctacattcaaaagaatgaagtgagacccttaactcacaccataaacaaaaactaattcaaaatggatcaaagacctaaatgcaagcattaaaactataaaactcttagaagaaaacataggaggaaatcttcatgaccttggattagtcaatggattctaagatatgatacccaaagcataagcaacaaaagaaaaaatagaaaaattggactttatttttttaagagatggggtcttgttatgttgcccaggctggacttgaaatcctaggctcaagtgatcctcctacctcagcctcctgagttgctgggactacaaacatgtaccgccatgcccagctaaattggactttaaaatggaaaacttttgtgcttcaaagacgtcaaaaaagtgaagacaacccacagaatgagagaaaattttcacaaattgtatatctgataagagacttgtgcctagaatctataaagaatgattaccactcaataataaaaagacaaataaccccattaaaaacaggcaaaggatctgaatagacgtttctccaaagaagataaataaa

SEQ ID NO: 129057 - DNA, 426 bp, Homo sapiens
gagattaccttgtgagcctacaccaccagggccccgggttttaagtacaaaactgggtggctgtttggacaggcactgagcagcaggaattttttcatattcctgtggcacctggaactccagtgagacaggaaaactgtccactcccctggaaagggggctgaagccagggagccaagcgatcttgctcagtggatcccactcccacagagccccgcaaactaagaaccacactagcttgaaattcccactgccagcacagcagtctggagtcggactgggaggaccaagtttggttgggggaggggctaccgccattactgtggctttagtaggcggttttcccgacggtgctaaggagactcggaggtttgaactgggcagaattcaccacagccagcaaagtgactgtggccagactgcttc

SEQ ID NO: 129058 - DNA, 331 bp, Homo sapiens
gcctggggagggtgtatgcgtgcgtgtgcgcctgtgtatgggtcagtgcccgctattttaggaggaggccatgggggccagagttctcttccgatttcctcatgctggcctggtcagtcagctgcatctccgggataggaggccctgactcctctgctagggtcttttagaggcgaatccggctgacctcttcctccccctcctctcaagccaggacagtgacctgggaggagctagtggccacgtgcgggtggctggcacagcccagactgtgggaactggggtgccagcctgtatccccgtgtgtgggcagctgacacagcccggcctg

SEQ ID NO: 129059 - DNA, 436 bp, Homo sapiens
actcccaattccaaagttcctgagtccatattctcacaccgctccagccatttgactctgtaagccttttactacaggaaggaccttttgctatctcaggtgtcctgtgctcaggattctcaagaggcaggatgagtaggagattggcaatatgattcagagtatgggcagacacagcacagtctactctcggtccattatccatatttgtggagggcagctacggataagaggggaaaaaaacaaatggctctatgtaacaggtgctgaaatctgggtcctgtactatatttatcagtatgtttgtgatagtggtcatgatgctaattacatgggacatgttataatgaaggctgtcaatcctgaaacttaattcaagaaaagagtttaggccgggtgtgatggctcaagcctgtaatcccagcactttgggagg

SEQ ID NO: 129060 - DNA, 330 bp, Homo sapiens
tatttagaatgcacttactgtttttaatgaagccatgaatcttcagggtaaaaaaatacaaaaaggaatgaagacttagaccaatttacttatttatttattttctggactaaaaccacttctgtgctgttctatgcttgtcactgcatcatgtgtctccccctacaggtaaagagcaggcagctgtactagtttcaccgctcctgtagaagaatttgtattttccaaagtcaaaatccagaagtcttttgctttagggtgctggtctctatgcctctggggtataagcagtagatataatcaaaatagctataactacagagatatgtc

SEQ ID NO: 129061 - DNA, 641 bp, Homo sapiens
gggtggggaacaactcctactaaccctttgagatgctgagttttcttttaaagtaaaggaaatattacaagattttctgaaactgccaacctttagcaatattttcagacattctccaacattttcctttgtcggcaatcagagatgacctttgtcagcaatcagagatgacctccacactgaggcgaatgttccactccccttacccttttccttttgtctctctttccctcctctcttcatccagtaactccagttagcctccattgtctccaagccggcttttgtcctcatccacaacgcctccacacaagctctgaacacctgtccattgctaacttgagactgccatgctgttaggaagttcaagttcaccacatggagatgaaataagatatcatgataaacatccccagctgatcccagcctccagtgatccatcaactacatatatgatcctaagtcacatgtgtgaccccgagcaagatcagcagaacaatcactcagccaacccacagaaccctgaaaaaatataaatcattatagtttaaaccacaagttttgggtagcttgttatgctgctattgataattaaaacaaactggaatattttcatctagatggcaatctactcaattgtt

SEQ ID NO: 129062 - DNA, 395 bp, Homo sapiens
gccattagctccccctgcagaatgtcttcagaatcggggcccggtcagtctcctgggtgacctgctgttttcctcttaagatcctttccactttggttgctgctttcgggactcatcgagtccttgctcaacaggataccccttgaagtggctgcctgggccacatccccttccaaacaagaaatcaaaatattagaaatcaatttttgaaatttcccctaggaagactcatttgagtgttcaagttcagagccagtggagaccttaggggagggtggtcacaaggattttgcacagtgctttagagggtcccagggagccacagaggtggtgaggggctgggtgctcttttctccgtgcatgaccttgtgtgtctatcttcattaccacaatgc

SEQ ID NO: 129063 - DNA, 474 bp, Homo sapiens
caaaagaacaattttggtaggggcgtacatgatcagtaatatctgaaaatatggcagaggagtaaatcaaagctacatcaataaaatagattaacttcccaatagggcagtattgggaatatcttctcatttgggggtggggttaggctctgagtataatagaaagacataggttttattctactagggtgagctggagttcatatcccgttcaaatgggtttcagtttttttcagctgtaaaatggggggtaataccttcctaatggtgtcatttggagggttaaattagataataaatgttagtaactggtgtatcctctggcaaatagtaggaacttaatcttatcgttatttttagcaacaatatgggagctccatcccttccccaccctctcaggtgtggttaaagcaagtaacaaaatcactcccagtgggtgcaaagagtcctgtctatcgccgtacctggcacacg

SEQ ID NO: 129064 - DNA, 650 bp, Homo sapiens
gacacaggagaactagagaaccctgctccggtgggatttgcagttttgattctccctagcctggcctccatcaacaaagataccttgagtcattcatttttccacttccaatcactgaatcccaagtggagacctcaagcaaattcactctccaacaatacttctagagaatttgaacagatgtatgccattcttcaaagagattttcacaagactaaggaagccaggatgaattttgtcacctttttatgtatatcagtgtacaatctcctttttgctgtaatgtagctcattttcaaatgctattaagtggctaaaagctcaaaccttaccatactaaaaaaaaaccatgaagtttcttttatcccacctctcctagacaatacatgttaccatgaaaaccaaataaaaagatgatatatccatggcattaaatacaaggatagactagtagattaaacattctttaatggagtgaatattcttctcatagtagtgtcttttaaactcatctctccgtttacattcccaatgcacctgctctagatgcaagctttattattgccttctaattattctccccgacctccaaactctctcctccccaaaccataatttatgtcacaggaagaataatcttcctaaaatag

SEQ ID NO: 129065 - DNA, 303 bp, Homo sapiens
cagtgacacctgagcacgtcttgcctgagtcccaggtgagctgtgctttccagctgttgagggctacctttctctgctatgtatgattaatactgtccaggaggggttcagaggtgtgttagtcccgggtgttctctgggcaactgggtacctcccaggctgtgggctgacgccttttctcctttttttctgccttctcacttaaaaaaatcatgttctgttaattcctttatcgcctggccaattcatagccaggtggctaggctgcttctgtacagtggcaggttctgagctgaagtccat

SEQ ID NO: 129066 - DNA, 359 bp, Homo sapiens
ctccaagctcttcagcctagagaagcttgagccctgaccacggggcctgagaataggagcgaaggaggctgtgtctagaggaaagaggagacacccacccaggactgaggcacccagaggatgcactgaggccccagaggtgtagtcaagagggttataggaatttggagaagagaggcactgctgacgtgtcacttgctctctgagtgtcactagtggacaaatcactggagccagctcctaccacttgaattttgtctgttagagggggtcctgctggtggcttgaaatagaccacgacagaaatgtttacaccacagaaattggcaaacgctacacgtcaagcaccagagaccaga

SEQ ID NO: 129067 - DNA, 301 bp, Homo sapiens
cggctctctggggtgacagttcctcagacctcccttgttttgagggctctggcagttttgaggattggtctcatgttttgtaggacgttcctcagttgcgattgtctgatgtgtttctcacagtgggcagagctggagtgaacgtttttgtccctgggtttggtaactgctgcttagaactcaggagaggtgcacggctctttgtcccatgttgtgaacagatgggtaggcagtggataggtagttgtttcttcagcctccccttgtgtctttcaagcgagcactgtgtgtcacgtgggga

SEQ ID NO: 129068 - DNA, 158 bp, Homo sapiens
cttgacctccctctaatttcttacacttccataggtgaagtcacctcaacctgtgattttaactatgaattatttctaaagccctcttcaacaccaccctttctcccaagctccaaatctgcgtgactaaacacttgctaagcacatacacctacata

SEQ ID NO: 129069 - DNA, 455 bp, Homo sapiens
catgttatttgtgttgttttgcacctagcctttttcattcaacagcatgaaagatctcatatcagtaggttgagagtttcttccttgttttcagctgtgtcatatgccttctatagaattatagcatttatcaagttcattattaatagacatttggttgtttccagtccatttcctgctacaaatgatgctgcattgaatatcatgcatttcacacgtgaggggtatatctgtatattaaattgtcagaaatgaaattgatggctcaaaggatatatgtatgtaattttaatagattctgtcaaattgcttcccatagaggttgtgccatttgcatgcccagtagtaatgcaagagaatgcctgtttcacctcaacgttgccaacacaaaatgaaagtttgaacattctaacctgatggataaaagaacagtacatcagtatagttttaatttg

SEQ ID NO: 129070 - DNA, 384 bp, Homo sapiens
gtgaggatgaaagcattaacgcaatctaaatgttcaggtagcactcgctgttttgattcctcggctggaatttacggtgcctggaacttgggcccaatgaggcaataactgggattttcttctctttttttggagacagggtctcactctgtcaccaagcctggagtgcagtggcatgatcccggctcactgcagcctcttgacctcgccaggctcagctgatcctcccacctcagcctcccgtgtagctgggactacaggtgcacaccaccacacctgggtaatttttctgttttttgtagtggtgggttttatttatttatttatttttgagatggagtcccgctctgttgcccagactggagtgcaatggcacgatctcag

SEQ ID NO: 129071 - DNA, 174 bp, Homo sapiens
cagtgatgaaaaataattgaagagaacttaaaaagtggaaatatatcctatacccatgggttggatcaacagttttaaaatgtctataccaaaggtcgtatacagattcaatgccatccctccaatatgccaaagacattcttcaccgaaacagaaaacacgaccctaaaatat

SEQ ID NO: 129072 - DNA, 394 bp, Homo sapiens
atatgccaaggcactgttctaaagtactttacaactagtacatgatctatacctcataatgttacaaggtagatatgttatctccattttacagatgaggaaactgaggcacagggaggttgaagtaatctgctcaaggtcacagagctagtaagtagctgagtgggattcaaatctagaggacctggctcttgagtctgtgttcctgaccactaggttaggtatctggctttttaatttgtttttaaccccatataaagcaagattttagctttccatttctctcacactcaactaaactgggtctttctacacgctgtgacctctaagcacctgatctttcccaattctcctggttcaactcaacgttctgttaaaccccatcctttgttct

SEQ ID NO: 129073 - DNA, 304 bp, Homo sapiens
cggctaatttttgtattttttatagagatgaggcttccccatgttgcccaggctcacctcgaattcctgggctcaagcaatctgcccaccgcagcctccctaagtgctgggattacagacatgagccaccgcgcctggcctcttaactttaaaatctaactgactacctttcacccttaatcatcacagcacattctcatttcgtaagtgaagaaacgcccacaatgcatgttcatttgttaaatataccccatttttagttgtttatcgtaattaaagaaaatgaaagcagccatatatttga

SEQ ID NO: 129074 - DNA, 229 bp, Homo sapiens
ctatgtgcctagtatagccacagaaatgtgcacaggattttgacatgcaataaattgcatatatttgagtatacacattggtgtgttctgaaatatgtatgcacctgaaaatacatttctatcagtgcccaggatatttaagaagttcaaaactcaacccgaaagtcaaggaaggcttcctagaagaggcgacacatgaggagcatgtgaaagaatatgaaaaagccag

SEQ ID NO: 129075 - DNA, 330 bp, Homo sapiens
actgaatatctttatggtcagttccagccaagtcagccataggataattcagcaaatttacttcttttcgggtacaatgatgaatttttcaatgactgtgcagtccctggttcatgagggatccttaacaggtatttggtgtgagggaacccaggccaatgcaacagtccctagtagtttaatccaggaggacagagtatccaaaagagacatatcctgaagagcaatgctcagaaagccatggagtgacctgagcatactgtgcaaggcttggaagcgatcccatccgggcttgggagagacaggagagggataacatggagagttctg

SEQ ID NO: 129076 - DNA, 250 bp, Homo sapiens
ctttggccctcccaccttcgggagcaccaactctcccacctgaactggagcagagggtacggagtttctgttgttttaaatcccagcatgcacacctgcatataccccatgctttcctactttttaaaaagtttgggctcccaaggtacagagtcgcctcaacaacagtgcactgagcacggactctgggcctgagggagttccctggggtggacgaagtgggcagagagcacatggccggtgggaggag

SEQ ID NO: 129077 - DNA, 347 bp, Homo sapiens
gccttattagtaaacatgttagtgtgaattagtttgtcaaaatagttctaaaagctatctgaaagcagattatgaggtaggagagggcaaggtgggaatggtagaaattgtacatagaaggcaggcctttgaggatggtataaccgtcacctgaggcagtaggtgtgaggaacaaggaacataaaatgggtagattctaaaaagggagatggcagggcatttaaatgatttattcatttgacaaaactaaatatctattgtgctgggcagaactaagaatgaataacatcatcactgcctcagggagttcagtctagtgaaggaccagggcatgtaatatcctatct

SEQ ID NO: 129078 - DNA, 406 bp, Homo sapiens
cttggactgggttacctggaaagtagagattgaagtgaacagggattttaaaatctgagttgtatatgacaggtgcaaacctaggggagccagaatgagtaagaagggaaactacgcaaagacagatgggaaatcagtgggatgggaaacattaccaccttggctcctgcttccagaatggccaagtcattcagccggtctaccaggaacttctccagagaggtcaaagggagaaactgtaccttgcagcagtccagggatgcagggaggggactatatctacctgattccctcttatccctttcccattgatcagagtttgctccatggggggttcaactccctgtcacttctagcttgcatcacaaggcagcttcagtggctgctcagggtgttttgcccagct

SEQ ID NO: 129079 - DNA, 668 bp, Homo sapiens
atcccaaagtgctaccctctaaaattatggataaaaggctctattaatatttatgtctccttgtggcaggccacagatatgaattaattactgcatctgcacagatgtggcctgattacgcaaggcggaactaagctaaacagccagcatgataaacccaagactggcaaggtagcaggagaattttgagatatattcaagttgaatgcttttatcggttctaagttgttagttcttggaggagagtattgttccctaacaaagcctaacacagtgtgcagtacacaacaagtactcactaaatatttgtgagatgaataaaaccaagaatcttgaatatgttttaggcctatcactataaaaaaattttaatgtcttattgtaattgttctattttgttttgacaggtgatgaaaataatgcttcccttagttgaaattcttaggaaaatggctccataaatatgtatgtaggatgctattactcactcattattgacagttgtatcaagtgtgatataaaacacaattttcagtgacaatggaataattacagtcttgtagtcttggaatagcccctgatcactactgttgctgattctgtcattatattttgtgtcacctggttcccagtggactgtcaacactctttacatcctggaatctgaa

SEQ ID NO: 129080 - DNA, 548 bp, Homo sapiens
cagtacagaaaagacagggaaacctgaatccagtctagtgagcagtttggagggcaactgtcattctgaccgtctccttcaaatcccagttcaatttcctaccagctgtgcaggttagtactgtaccttttgtttcctcatataaaataaggacaataataacaatttaatagagattaaacgtattaaaccgtataaagcattcagcaaagtgaatggatcatgctaagctctcaagaaattttagctgctattattattttctatagtttatattgttctgaatatgttaactctgtcaacaattggtaagcagcaaacgtctccatttttctaggactgtcccagtttatgcctagtataaatattattaacacccttttccttttaaaaagtattctagtttgagaaacaaattatatggtcaccttagcagggagtcccagaatagaaatagaaaataccacccagaatatacccaaggattttaaatcattctactgtaaagacacatgcacacatgcgtactggcccggggtaccgagctc

SEQ ID NO: 129081 - DNA, 356 bp, Homo sapiens
ctgggaagtccttcctgagccacttctgggcttccttccaaggctggtaaagggaacgcctaactagctccaagactgacctggggccaccatacctgacctgcccaccatctcagaacagtcataagaggctcctgccagctctcactacttcagaggaggcagttgaggacgcctggcacacggtgagccctcaaaggggaaggggagccaagcacggtcaagtggcggaaacagactccagagtgagacagactcaggttcccattctgcctctactatccccaagcacttgcctctctctgcctcagcatccttgtgtggaaaatgtgattaagaatcccttcctttagctg

SEQ ID NO: 129082 - DNA, 705 bp, Homo sapiens
gtcagacattactgatggtgggcatgggatttcttttgggattgatgaaaatgttttcagattgtggtgatgattgcacaattctgtgaatatgcataaagttttgaatatatattttaacgtagtaaattttacgctatgtttattatatctcaataaaacttttatttaagaaaagacgaatacaggagcacccagatttataaagcaagtccttagagacctacaaagagacttagactcccacacaataataatgcaagactttaacaccccactgttaacattggacagatcaatgagacagaaagttaacaaggatatccaggaattgaattcagctctgcaccaagcagacctaatagacatctacagaactctccaccccaaatcaacagaatatacattcttctcagcaccacaccacacttattccaaaattaaccacatagttggaagtaaagcactcctcagcaaatgtaaaagaacagaaattataacaacctgtctctcagaccacagtgcaatcaaactagaactcaggattaagaaactcactcaaaaccgctcaactacatggaaactgaacaacctgctcctgaatgactacttggtacataacgaaatgaaggcagaaataaagatgttctttgaaaccaacgagaacaaagacacaacataccagaatctctgggacacatgtca

SEQ ID NO: 129083 - DNA, 250 bp, Homo sapiens
ggaccttttcaagactggtgaggaggatgcagggaggccgtggcagggaccacaggcagatgccttgccaaggaatgcccaccagccagagagatggagtctagcacctgcagacacatgcagagaccggaggggcagggggctgatggatcaccaccctcctctgccagttcacccccagacagggagaaggagctagagagtaaagcaatgtaagatgatttgcccaaacgtgactagtgagtaagat

SEQ ID NO: 129084 - DNA, 862 bp, Homo sapiens
gacatttctaaaatcgcttcataaaacaatatttatttatctttatctttatcttatcttttctactgcctttcattccttcctgcattttcagtttcaatatgggattattgtcccttggaaagaacttgtcacagtatttttttttttttcctttttgatggagtctcgctctgtcgctcaggctggagtgcagtggcgtgatctcgctcactgcaagctcctctctcgggttcacaccattctcctgcctcagcctcccgagtagctgggactacaggcacccgccaccatgcccagctaattttttttattttcagtagagacggggtttcaccatgttagccaggatggtctcgatctcctgacctcgtgatctgcccacctcggcctcccaaagtgctgggattacaggcgtgagccaccgctcccagccgaactcgtcacagtatttttaaacaactcacggtaattctaattcagactgctaacagtgaaatagttcagtttcagtttttcttaacacaactttattaatttgctcaaagctaagcacaaagtttagaccatattgaagaagaaaagaaatagacaccacctcttgatagaaggagtggcaaagttgcattgtaaacaggcatgcaggatggaaagaattgcatggacatctttgaaaaaactcaacaaataaagagtattctacaactctttatttttcagactcactgtgttgatcattttatatgtattcatttattcgatcctcccaataacctaacagatactattgtaatgtcaatttccattttgcacacgaaggacttgaagaacataggactttatttaatgtctaaaaaacaca

SEQ ID NO: 129085 - DNA, 627 bp, Homo sapiens
catgcccagttatgcctgcaaaggagagggagctggggtatttgtccaccagctcccatctgtcattggctgagagctgcttccaggagcattaattctccagcacttccagctactccaggaaaaaaaaaattcttcaactgagagttggaggtgttgagagactctggcacaccaagaagacaggaacaggacaccaacagtggctgatgatacactgccaaggtcacacagctagttagcaacagatctatagtggaatccagacagtgtctccatcacccaggctctctgtagtgatctgcgcttcacatccgaggcaggcagagggatggtgtgggccttagatgggaaggctgggaacctgaagctcctatgtctgtatcacttttgcttctctgagtagctgccctgatttcacacttgaggggcttggccattttagattccttcctgctctaggagcctacatactacactggaaatgatggggagctctctacctcacatgcagcctgatgtttgttagaaacacctccttgcgccaggcatgatggctcatggctgtaatcccagcaatttgggaggctgaggcgggtgtatcacttgaggtgaggagttcaagac

SEQ ID NO: 129086 - DNA, 252 bp, Homo sapiens
tcatttaataaaatacaataaggagaattaagaaagaaggctgcaggggaacatcctgcttattatctctgtaatgagaggactattttttctcccatcagttgccaatgatgaggttttttgtttccttttgtgcaggcacaattgtgatattcaacgagagtagtgcgaagtgccactttacagccaaacattcaattcctcctaattcacaagggagagagggatcaagttgtgcagctgggaggtgat

SEQ ID NO: 129087 - DNA, 216 bp, Homo sapiens
gtggaattcaacacaagggagacgcaaaggagattcccaggatgacggtgaaaggagcttgtgtggccactacatagcaggcctgtagagcaagcagtccaggttggagcaaaggatggaaacatccagaaagaatgtttccaaaaattaatcagcagctggaaatgaccatgttgagagttttaaattccaatggagagtttggaaaggatttag

SEQ ID NO: 129088 - DNA, 673 bp, Homo sapiens
tttaagaaaaacaagcaagcagtcagcgttaccactatttcccttccaacttgtccttttctattttctaactagctgtgagcaaaacaagctgccaaaagctctaaatactttccaaatgctttcttgcctacaagtaggtctagccagaatgtatcatttcagaaaccttcagccacagcccattcagtaacttctgcctgcagctcaacctttgggttcttccagaaggtctgttactctggagttctccagtggttggatatcatttccatatcatggctacactgttaagtccttgataattccagaaaaaacattcctgcttgatttttattttattttggagatgaggtcttgctatgttgcccggtctgttctcaaaaccctgggctcaaagggacccccacctcagcctcccaaagcgctggaattacagacatgaaaggtagccaataaatgcatatgtaaaataaacatttcaaaatatcagatgcttaagaaatattaccactgaccagcttctttatcattggaacacggcatacttttgaaaaaacaaacaaacaaactcaaccatcatagttttctttcttttcctttttttttctttttttctcgagatggagtcttgctctgttgcccaggctgaagtgcagtggggcaatctcga

SEQ ID NO: 129089 - DNA, 305 bp, Homo sapiens
tacaggtgctttaaaaactctgagttataactcactagtgggtcctgtaattagtttgagcattgtggtcagcattaaagacacacaagcaaaacagaccactagactgtggattaggatcggaaacatcagaatgtatctccccttagtagggggtcatatcgtttcctgacatttttgtttgctttcagtatatgcaaatatgtctgtgtatatatatgtataataattgacttttgatacataatattgtttcttactgttggtcttgggcaaaaaagtttgaaagctactgtgtcaactta

SEQ ID NO: 129090 - DNA, 367 bp, Homo sapiens
  misc_feature (310)..(310): n is a, c, g, or t
tgaaattctgacagttactacaagatgaatgaaccttgaatacattgtgctatatgaaagcagccagacagaaaaggacaaatatttcttgattccacttacatgaggtacccagaatagtcagatttatagaaacagaaaatacaatagttctaacttgaagctagaggagaaagtagtaggaagtaactgttttaacaggcatggagtttcagtttgggatgatgaaacgcctacaggatgaatggggataaagacgacttgggccgggcgcggtggctcaggcctgtaatcccagcacttggggagngcgaggggggcggatcacctgaggtcaggaagagacgcgcagggtagcgagctcgaa

SEQ ID NO: 129091 - DNA, 714 bp, Homo sapiens
gtggttactggactctgaatgtgataagagaattatgaagtaatttttagaatagcaaagcataaaagctggatcttggaaattccccatttatatcaaaatgagatttatcatgtttatgctgctgcagtgtcgtatttaaatatctcctgtcattttgaatactaatttttcttactgtccttttacagatcagtagctttaattttgttattacatgttcacatataatttccctgatgtttatttgttattaaaggtggtgaaattattttagtttctttaatttcattaaagaagtagagaactggttaaaaaaaaatactggttaagagcaagttgggaaaattggaactcatttgaaattataatatttaaaatattaaagtaaatgtttaagatatacttttaatttgcttacatgtggattataagccagtattaatgaacactttacaattagtttaagagacaaatatataaataaataactgaaggcagcatataataaattggtacaaagtttttgggtgagagatcacactgtagggatgtggcatttaagatagattttggtatgaaatgagaacttcgaggtggggaaaccacagcagaggaaaggagatgagaatatgcaggtcatactggggaggggaatatctggttgtatagttcagctgaatagtgatgggcttttgtggcacacaggccata

SEQ ID NO: 129092 - DNA, 609 bp, Homo sapiens
taaattcgcggccgcgtcgacgcagtgtcgtatttaaatatctcctgtcattttgaatactaatttttcttactgtccttttacagatcagtagctttaattttgttattacatgttcacatataatttccctgatgtttatttgttattaaaggtggtgaaattattttagtttctttaatttcattaaagaagtagagaactggttaaaaaaaaatactggttaagagcaagttgggaaaattggaactcatttgaaattataatatttaaaatattaaagtaaatgtttaagatatacttttaatttgcttacatgtggattataagccagtattaatgaacactttacaattagtttaagagacaaatatataaataaataactgaaggcagcatataataaattggtacaaagtttttgggtgagagatcacactgtagggatgtggcatttaagatagattttggtatgaaatgagaacttcgaggtggggaaaccacagcagaggaaaggagatgagaatatgcaggtcatactggggaggggaatatctggttgtatagttcagctgaatagtgatgggcttttgtggcacacaggccata

SEQ ID NO: 129093 - DNA, 1559 bp, Homo sapiens
gaacaagctggaatcagataaagttgtggaaaggaagtcgaggtttcactctgccatatcagtaggaggtactaaagccaaactagtagcagcaaagtgaacagaaatggtaagggggaaaaataggaaaggaaagaacaacgtggattgcaagacgtcttactaaaaacaaagaattacacttggaacagaagaaattcattaccattgccttacactgtgcaacaacttgataaaaatataaatccaataaaacaaactcaaagatgagaaaattgtaaactggagatgaaaagggagattgcagacctaaaggaaaattgaagaccgtaaaaacatagtgacagaataaataagtcaggagaaagaacagaagcaatactgctgaaaataaaagtattttaatagaagaaagcccagtaaggaagcccagtaaattcaactgaaaagggacaaagattaagaagaaagaagctattatgaaagacaaaatacaatcaagaattgggaccactgaagtcccagatgtagagaagtcaacaaatgggacagaaaattcaaataaaaataagtccaaagaaagcttattgagatgaagaaaaaatggtctgtaggccaaaggaacatgccatgttccagaaaatgtcatgtgggaatacggaagcactacgatatcttaaactatttaaattcaaagaaaaagatttaggaatctaagaagaaaaagtaaaggagggaaaaacaaaatcaagctcgcctcagacttcagtgcagcactaaatgccagactatgatggttgtgaggaaacagttccaagggaaagaaacttttccgaggggcatattttttttccggaagaacaaagggaattcagcacccatgaaccgtttttggaaaaacaaaaacttgctgagtaataaaatccaggaaatagcaaattaagagataaatcaaaataaagaacttaagagtagagaaaggtaaaaagacttggtgagtatttattctatttaaatatagaagtaatacatctatagaaattgtgggtaagatagaatgcgattgttattaatctagacaaaaatatacagccaaaaaaaaaagaagtcagagaggaagatggaaggaaacatgagaataccaatattctcttctttcaaagaatggaatagtaaatatggtataaaattaaaagatgctatgtgaatatataatactgcaacttttaatatctttcataagttttatttaaaaccttagagggatatcataggaaattatactttcttatggacaaaaaaatttaaattttaacaactcctttgactttattttagtcttttcccaagtaacattaaacagaaacactgtgtgtgtgtgtgtgtgtgtgtgtgtgtgtgtgtgtgtgtttatgcatagaaagatctgtgggattatgttcgcctaatattaatgatagtaatagtttttacagaagaaaaaagaaagatgtttgaaaaataagctagaatcaaatatgccaagatgttaacaattgttgatgctggatggtaggaat

SEQ ID NO: 129094 - DNA, 319 bp, Homo sapiens
ccatgtggaagaacactgagtaactacagaagaaatgctaatgaaacattaaaggagagatcaaattgactactaaaccaaaaggtatctctgataaggaagacgtccaaaaagaagagctgtgggaaaggagaggaagagagaaacatcttgggataatcaaaaggaagtagccaatgcaaataatcaataagctgtaattaacacagaggaaacacagtctcacaagatgcatggctgaaatgaactgaatattgtttgtttttgagatggagtctcactctgttgcccaggctggagtgcagtggtgcgatcttgg

SEQ ID NO: 129095 - DNA, 690 bp, Homo sapiens
atgtcatctttattctttctcacagggcccagcatggggcctaacacagttagacttaagtaaatggattcaactcactggtccccagcactgtcctctgcatgatgttaccgaaatggagacaaccaaaactaactggacaacttagtcagctggactggaagactgcacttccaaatggaaaggtttgcagtggctcctttggaaatgtggcttcaagggtggagaggggggaagtgaatgtggggctcgcattataggctttgggggttacagagcttgctggtgttgcttgcccttacgctctgtcaaatctcaggcagatgaaacaagatgtaagctttctaaattatcaatagagggcctgtcattcaaatggaagataagaccagagaaaataaaaaaaaaaaaaaaaaacttggttgggcggcccagggcccgagaaaagagcttccaaaaccatgtctgtttggggcgcggcggcccccagtggggtaacgcgaccgtgggccaacaggggtaccaagaggagacacgtggcccatgcacacaggtggcgtgggttccccccaatataaaaagcgcgcggccgcgccaacgggcggtccggaacacacccggaaggagttcggacgggccagcggctcacacacgggccaggcgaggcgatataatccgccacgagcgagg

SEQ ID NO: 129096 - DNA, 472 bp, Homo sapiens
tatgtattatttaatgttatgaagtacttgacctcctggatataatttctgattttagaatttaactgcttcattcagacttctcgtaagttagcaattttaacatatatgctgtctaattttctaatttgacattctagaattgttaattttagataaaacctcctgttacgttgtgtcttaagatcttagaaagtcagtgcatagtagttgatgtttgtcaactctaaaaacagtgatataattgagagaaatggtcagttgaattacccttgtgaaatttctgcatttacttcctctcttacctagctgggtcttagactgttaactgtcaatttgtagggatggaaggaggttgagatttaataacaggagataaagtatgaatgtgtgcttattttcagacttagaaataatgcattattttggattattcacagcttttaaaattttttctctctgagacagggtc

SEQ ID NO: 129097 - DNA, 777 bp, Homo sapiens
ttactctaattgtgcaaggcatccttcattagagagtgacttagactttaatcatgaatgttgaaggttggcctagaagaatctttcctgatagtgggatataattatgcttgtaacaaaacaagaatggattctaattctgagtctaattaatttgctaattccaggcattgtcagaaaagtgatgcaaactgtaaactttctgttaggtaataatgctaacttgtttcccacacagcatcattgaaaaggctatcagttggggttctgagtcgtttatatcgaagagccagcctcttagtctggagttttccactctccaatttgaggaagagaggagagtagaaaagagatgttaatggggatggtacatgtgaaacgttggaagatttggaagcaatcctagattatatttaaaaagcaatctagcttttttctttagaaaatatctaactatacaagcaatgcgtagtaatcacatcagggtaaatggggtatccatcatttcaagcgcaggtaacatattttttttacacccgatccaggttatgccattcaagcttctttattataatttacttccattactggttggatttttactttttatagtttaccctttcatctaggcctattggggatgtcgttctaatttcccgactcatgttggcccgaggtctatttcccatgagcagttaaatccaaatcgctaaggtgttgcgagatcagaacccatccttttcaacctcccagggctgctgtaacattctctctaga

SEQ ID NO: 129098 - DNA, 762 bp, Homo sapiens
gaattctattaaaatacttgaaatgactaataggctagataaacagccaatacatttttaaacatttctaatttgatcaagaccatcacttctcttaagggagtacagacaaaactcaagttacttagtaaataaaatgattcctgtaatgtgtactctgctgtttagtggtaactttctcaaaattttcctcttttccctttgcaaatatagcaaaataaatctgtttcaaacagggcaggaaatagttactcagaatgggttactggtaacaggctttaaagtgagtggtgacaggcatttagaatcatactagaaaaaagtataggcaaggttttcaaaagaaacgggtagtttaaaatgtatttcattaaagaataattaaataaaattcatcattctcatttttaactttttatttttattgtctttttgtaactcttggattaagaaacagaaggtaaaaattaaatagcaattagagatatatagttaaataataacagttttgcttctttgtttctgaggaactgcaacgtaacattatggagtggagtgcatcctgttcttttcacctcccaagatgattatttttctatttctggagtcatttttttgagattctgtccaaataatcatttacctttgaggaagtttacactatgaataaatgtaatcccaatgtttgaatacctttaagctttttgatatattaaaaatatttttgagctgtatcactaggtataacctcaggtagatgga

SEQ ID NO: 129099 - DNA, 399 bp, Homo sapiens
atagtatagttacattacattctattaagcaatgctctgttgatggtcatttagatttttaattcacttttattttttgagacggagtctcgctctttcacccaggctggagtgcagtagcgctatctcggctcactgcatgctccgcctcccgtgttcacgccattctcctgcctcagcctcccgagtagctgggaccacaggtgcccgccaccacgcccggctaattttttgtatttttagtagagacagggtttcactgtgttagccaggatggtcttgatctcctgacctcgtgatctgcccacctcggcctcccaaagtgctgggattacaggcgtgagccaccgcgcccggcctaattcactattttaaataatgtggcgttcaagtcaaaac

SEQ ID NO: 129100 - DNA, 243 bp, Homo sapiens
gtgtaggccaggctggtctggaactcctgacctcaagttatctgcccgcctctgcctcccaaagtgttgggagtacaggtgtgagccaccacacctggctgcaagcattgtagaccagagtagacttaaagtatactttgttacaactcatgctcagtctgaggtcactgataaaattgaaactttctgtaagataacaaggaaatgaagtcttttttttttttttttttttttttgagaggg

SEQ ID NO: 129101 - DNA, 499 bp, Homo sapiens
cagagtccaaacagtgcccagagtccaaacagtgctcagagtccaaacagtgcccagagtccaaacagtgcccagagtccaaacagtgcccagagtccaaacagtgcccagagtccaaacagtgcccagagtccaaacagtgcccagagtccaaacagtgcccagagtccaaacagtgcccagagtccaaacagtgcccagagtccaaacagtgctcagagtccaaacagtgccaatagggagaggggtccttatgtagtcaactaaagcatgaatgaggagtaagaaggtaacctgtttaaaccattcctttaaaaaaaaaaaaagacacccattaggatggatattattaaaaaaaaatagaaaatagcaaatgttggcaaggatgtagagaaattggaatccttgtgtaacgctggtggggatgtaaaatagtacaactgctgtggaaacagtctggcagttcgtccaaaaattaaacacagaattaccgttaaga

SEQ ID NO: 129102 - DNA, 405 bp, Homo sapiens
agggtaacatgattttagaactttattctaggggaattcttattcacagctaaagaagaaatgtacagtcaagttcaaagttcttcccccagttctcagcagagtcaagacaaggaccatttacaacaatccacacaacaaacgagcattcagaaaagggttcaccactgtagaaaattactcttgtagagttttatcatcttaaagctgccaacttaattttcttttgaaactagaagaagaagtggtgataacttttaattgagtgaagcacactgttatttggaaaaagacaacgataattcacacacagaatgctccttgctggtgggtgaaggccagattgctgcagttggacttagaactccactttcacatagaactttgctgacagtaactaattaa

SEQ ID NO: 129103 - DNA, 200 bp, Homo sapiens
tacgaaattaacctgattggtcccagggctcatattccatcctaccttttctgctatgcatctattgcaaatagctaaatggtccaacagaagtgttagttgttcctatcagagacgtcaggaatcacctctggcggtggggaaggtggctcttggccagggcgctctcacccacccctgcccacgaggatggccccttt

SEQ ID NO: 129104 - DNA, 313 bp, Homo sapiens
tttcgccacagtcaaaatacacagtaactattttaagaactcattaaaaattgtgtgtgtgtctgaaaagaccaagaccatattaatgagaagtgtattttccatctcttagatttaatcttctcttcccttatatctccaaatagccaagaagaagaaaagtcattactgtatgagcattaacataggtggttctaaatcacatcacagctgtcattcttgttgtgtcagtcaaggaatctgatgaaacatagaacaatttcagacaggccaaggcctcctatgaggtaagaaacacttcgagagaagccac

SEQ ID NO: 129105 - DNA, 571 bp, Homo sapiens
ttggaccatcaagatgataaattgaaagtaggtactcactgggctttacaaattggctatatgaacatcattgttattcatttggtcctgtgagctaaaagagctaatgtatgaggaatagtcacttcattcaaccaatatttaatgagctcctactcagtgccatgtactatactaagtactagggatacaataaaaggaaaaaacagatccattccctgcatgacaatccaaaatagtccattttgaatggcataaaccagcagtctttttgttgttgagacagggtcttgctctattgcccaggctggagtgcagtggctgatcatagcttgctgaaacctcaacctcctgggctcaagcaatcctcccacctcagcctcctgagtagctggcactacaggcatgccccaccacacccagctaagttttgtattttttgtagagatggggtttcaccatgttgcccaggctggtctcagacttctgagctcgagagctccacctgacttggtctcccaaagtgatggccagcagtcttttctagtgataagatatttttaccccttca

SEQ ID NO: 129106 - DNA, 230 bp, Homo sapiens
tatctgctgttagttcctggagattttgtcctgagctgagtctccagggacactcgcggtgggtgtgtgctgtgcttggctgagctgcagtgcttgagaggacaatcctaagccccttgttgatgtgcagcaacttcatcttctttcccagccctcattggaaggattggattagatgagaggtttcagcatttagccgacctctttatgtaggaaccccaactaaaaca

SEQ ID NO: 129107 - DNA, 559 bp, Homo sapiens
acaactatcagatgtcctagatatttggtaggtgaaaaaagtttatataataattagctgagcatataacctaactcccttttacataaaaacaaagtattttttgtacagttctgcaggcatgcaactaaatagaggcaagactgtacagtagtttgttcaccatttcagaaaatcgtgccattaatggctgagctggctcctggtgtttgagtctctgatacaacagaatatagatcagtctgcacaggatagtagagtgttttaaggccaggcacagtggcttacgcctgtaatcccaacactttggaaggatgaggtggaggattgcctgagcctaggagttagaggttactgtgagccatgattgcacgactgcactccagcctggcaacagagtgagaccctgtcttttttttctttttttgagacagtcttcctctgttacctaggttgcagtgcagtggcgcagtctcggctcactgcacccttctgcctcccgggttcaagcggttctcctgcctcagcttcccaagtagctgggactatgtgtgtgcgc

SEQ ID NO: 129108 - DNA, 910 bp, Homo sapiens
atagaatcgagccggtccccgtggtgtgtcatgcacacactcacatacacacactcatgtacactcatacacacattcacatatgttcatacacaatatcctcatgtacacttacactcacactataacactatacacacacagcactcaacacactacacacacactcatgtactctcacactcataacactacacacacaggacactcatgcacacaaaaaacacgtacactcacatatactcacaacacagtcatacaccacacatacattcactacacacaacacacgtacactcacaatacacatgcaacacagatacactacagacaacacatgcactcatagcacactagcacacatatatacactcactacacacctgcatgcacacatatacacacttgcacatatacactaactacacattcatacttacgtactcaacacactctcacgcaaacatgcacattctttgctattttgtagcagcaagggggcttagccaagggtaatggccaagtggcccgaggtatttcatggctcaaaagtgcagtcagtaggcgagaatgccgtcgtcccactcgtttagaatgcgtctgctttaaagggtacgtgcctggcactcacgctaaaaggctgacacacggcgtctcctaagcctcctccctctactgccagaagcagctccggagggcacaagactcatgcaagacttgtccctcgtggttcttccacctccatcctcctaaaggtcgctcacacttgcttctttatcttgagtgcacatatgaaggcggtgcgcgctctgggaagggaaggagggaagaattcctgtcctattctatcaggaattggggagagaaaagctgctaggaggaataaatgaaggggacttttcaaacactg

SEQ ID NO: 129109 - DNA, 677 bp, Homo sapiens
ggtttagagaaatatattttctcctagacgtctctctttatataagtgctcgaaaatataaacaggttaagatgggcatggttgttgtaaagcagaaattactttctcaatgcccattccccaactttttaacatttttagttaattctgatctcaaattctgccttgcagagtttttcaaaggcaagatcacagttgtatgtcttgtcagaatgctcctgtcatgacccgtgaatttcatttgtgtcaaattctagagtaaaactaacagtcttttggctagacttcctccgtgttgcctttggaagtcaggggtaaaaaggatggacttatgaggttgatttacaatgggaaaaaaaatgatttcattatttattttcttccacatacctcataaatgtctatgtatcatgaaaaattatttttgttaatatgcccattattcattattaatgaattataccagtctctctttctctcatattttctttatcatattgttgaaaccgtaaggtttttacactgctaggacctcccctagaagatcgtgtacataatcaatattaagtagatagtacaaaatattgattttagaatgcttacactaaattaacttgaataccatattccattctaatgttttcaaagtacacctttcctcatacaactataatgag

SEQ ID NO: 129110 - DNA, 1231 bp, Homo sapiens
gttcaactcccacttatgagtgagaatatgcggtgtttggttttctgttcctgtgttagtttgctgagaatgatggcttccagccatccatgtccctgcaaaggacatgatctcatcctttttatggctgcatagtattacatggtgcaattttaaagcagaaattattagcacctacccctaaaatgtgaacaatattgtgctcactttggcagcacatatactaaaatttgaacaatacagagaagattagtgtggcccctgcacaaggatgagacacaaatttgtgaagcttttcatacttaaatatatatgaacaatatttataaggagggttattcttttttgttttttgtaggtctgttttaatcttcaggtctgtgaagttaaatttggggaattaggaaaggccatatcaaattttatctatatttaagcagtcaaactataaagtattccttaagttttgggaaatgaacttgttttcaatttaattaaatacttcttttgatttgcttcacttgtaatgtaggaactggaagaggaggcaacagtatttggggcaagaagtttgaggatgaatacagtgaatatcttaagcacaatgttagaggtgttgtatctatggctaataatggcccgaacaccaatggatctcagttcttcatcacctatggcaaacagccacatttggacatgaaatacaccgtatttggaaaggtaatagatggtctggaaactctagatgagttggagaagttgccagtaaatgagaagacataccgacctcttaatgatgtacacattaaggacataactattcatgccaacccatttgctcagtagctatgatagacctggacaaataacttgacaaattgctggaacacacttattgtggtttacccggttttaattatgtcagagattgcatcatccttctgcttgtttacaactatgatcttctatgaaatggtggtaccaaggggcgcccaacagcttttatccccattcttagagcatattctttattataatgattatccaacatatttctttaattttaatacaaaaaatacatcatttaatttttgttacatatgaacattcatttttaaatgctcagcctcaagtgcaggcatttttgagtggcctgattacatattcctcccacagcaagtccgtatcctggaagtgttattttataataaaatttaaaaagttttaaaga

SEQ ID NO: 129111 - DNA, 1602 bp, Homo sapiens
ggcaggccgagtgtaaagcattgcttgaggttgcccaggtagtttcgccttacacttcttgtcccagtgcaattattagtagagctccctttcactgtcaaatttccggttggggataaattgcattgtcgttttggtttgagataggaagatgaggggaggaaggaggtgaggcggtaaggggcgttctctctcttgggtcccgcgcccaacttccgctggcccaaagaaactataattttgaaccaacagacctctgctggcatctgcgattgcatttttcctgttttaacaacggctgtgctagacgaagtggtgaagcccaaagacttatttttgagctcgctgtaagactgagaaatcacgtagtccttcctgaaaccactaagaggaaaaatgtctgtgacactgcatacagatgtaggtgatattaaaattgaagtcttctgtgagaggacacccaaaacatgtgagatggagtctcgctgtgtcccccaggctggagtacaatggcgcgatctcggctcactgcaacctccgcctcctgggttcaagcaagtcttctgcctcagcctcccgagaactggaagaggaggcaacagtatttggggcaagaagtttgaggatgaatacagtgaatatcttaagcacaatgttagaggtgttgtatctatggctaataatggcccgaacaccaatggatctcagttcttcatcacctatggcaaacagccacatttggacatgaaatacaccgtatttggaaaggtaatagatggtctggaaactctagatgagttggagaagttgccagtaaatgagaagacataccgacctcttaatgatgtacacattaaggacataactattcatgccaacccatttgctcagtagctatgatagacctggacaaataacttgacaaattgctggaacacacttattgtggtttacccggttttaattatgagccagcttgacgtggttgtggccgttgggcgagatgaagctacactgtgaggtggaggtgatcagccggcacttgcccgccttggggcttaggaaccggggcaagggcgtccgagccgtgttgagcctctgtcagcagacttccaggagtcagccgccggtccgagccttcctgctcatctccaccctgaaggacaagcgcgggacccgctatgaggattccatatggctctcatatcattccattccatctctgccaagatttggataccgcaaaaatttgtgtttgtggaagattctgtctgaactctttcattcaaggaactactaccatgaatctgcattctgttgcccacactgtggtcttagtagataatttgggtggtactgaagcacctattatctcttatttctgttctctaggctgttatgttaattcctctgatatgttaaagtaatgggtgagaccagaaaaagaaatttcaataacagatcagtttggggtgcatgtatgattttgcagcgtcaaattggagtaagggaagatttctgtatacttgctggagaggaggaatgtgtatagttactcatttagatgactccaaaacttttattaaaaccaattttagtttt

SEQ ID NO: 129112 - DNA, 1558 bp, Homo sapiens
ggcaggccgagtgtaaagcattgcttgaggttgcccaggtagtttcgccttacacttcttgtcccagtgcaattattagtagagctccctttcactgtcaaatttccggttggggataaattgcattgtcgttttggtttgagataggaagatgaggggaggaaggaggtgaggcggtaaggggcgttctctctcttgggtcccgcgcccaacttccgctggcccaaagaaactataattttgaaccaacagacctctgctggcatctgcgattgcatttttcctgttttaacaacggctgtgctagacgaagtggtgaagcccaagtatggagtaacgtcattaattctttcattcacttattcgaatgcttgctgagttctgtgttgctactggtttagttcttgggatactgcgagtgaacagtgggcggcgaggctgttgttgcaacgtcagagtaaaagaaggaccctgcacctcggcctcccaaagtgttaggattataggcgtgagccaccacgcccggcgaggtttttatttaaaatgttcagtaaagatgagcgtgtgtgagttaagacaggaaaatgagcctaattctttttttcttttgggactagagacttatttttgagctcgctgtaagactgagaaatcacgtagtccttcctgaaaccactaagaggaaaaatgtctgtgacactgcatacagatgtaggtgatattaaaattgaagtcttctgtgagaggacacccaaaacatgtgagaatttcttggctctttgtgccagtaattactacaatggctgtatatttcataggaatatcaagggtttcatggttcaaacaggagatccaacaggaactggaagaggaggcaacagtatttggggcaagaagtttgaggatgaatacagtgaatatcttaagcacaatgttagaggtgttgtatctatggctaataatggcccgaacaccaatggatctcagttcttcatcacctatggcaaacagccacatttggacatgaaatacaccgtatttggaaaggtaatagatggtctggaaactctagatgagttggagaagttgccagtaaatgagaagacataccgacctcttaatgatgtacacattaaggacataactattcatgccaacccatttgctcagtagctatgatagacctggacaaataacttgacaaattgctggaacacacttattgtggtttacccggttttaattatgtcagagattgcatcatccttctgcttgtttacaactatgatcttctatgaaatggtggtaccaaggggcgcccaacagcttttatccccattcttagagcatattctttattataatgattatccaacatatttctttaattttaatacaaaaaatacatcatttaatttttgttacatatgaacattcatttttaaatgctcagcctcaagtgcaggcatttttgagtggcctgattacatattcctcccacagcaagtccgtatcctggaagtgttattttataataaaatttaaaaagttttaaaga

SEQ ID NO: 129113 - DNA, 1320 bp, Homo sapiens
ggcaggccgagtgtaaagcattgcttgaggttgcccaggtagtttcgccttacacttcttgtcccagtgcaattattagtagagctccctttcactgtcaaatttccggttggggataaattgcattgtcgttttggtttgagataggaagatgaggggaggaaggaggtgaggcggtaaggggcgttctctctcttgggtcccgcgcccaacttccgctggcccaaagaaactataattttgaaccaacagacctctgctggcatctgcgattgcatttttcctgttttaacaacggctgtgctagacgaagtggtgaagcccaaagacttatttttgagctcgctgtaagactgagaaatcacgtagtccttcctgaaaccactaagaggaaaaatgtctgtgacactgcatacagatgtaggtgatattaaaattgaagtcttctgtgagaggacacccaaaacatgtgagaatttcttggctctttgtgccagtaattactacaatggctgtatatttcataggaatatcaagggtttcatggttcaaacaggagatccaacaggaactggaagaggaggcaacagtatttggggcaagaagtttgaggatgaatacagtgaatatcttaagcacaatgttagaggtgttgtatctatggctaataatggcccgaacaccaatggatctcagttcttcatcacctatggcaaacagccacatttggacatgaaatacaccgtatttggaaaggtaatagatggtctggaaactctagatgagttggagaagttgccagtaaatgagaagacataccgacctcttaatgatgtacacattaaggacataactattcatgccaacccatttgctcagtagctatgatagacctggacaaataacttgacaaattgctggaacacacttattgtggtttacccggttttaattatgtcagagattgcatcatccttctgcttgtttacaactatgatcttctatgaaatggtggtaccaaggggcgcccaacagcttttatccccattcttagagcatattctttattataatgattatccaacatatttctttaattttaatacaaaaaatacatcatttaatttttgttacatatgaacattcatttttaaatgctcagcctcaagtgcaggcatttttgagtggcctgattacatattcctcccacagcaagtccgtatcctggaagtgttattttataataaaatttaaaaagttttaaagaattaaatcgtaggacaaattaattaaaatattgtgtaaaattaccttcaggct

SEQ ID NO: 129114 - DNA, 1279 bp, Homo sapiens
ggcaggccgagtgtaaagcattgcttgaggttgcccaggtagtttcgccttacacttcttgtcccagtgcaattattagtagagctccctttcactgtcaaatttccggttggggataaattgcattgtcgttttggtttgagataggaagatgaggggaggaaggaggtgaggcggtaaggggcgttctctctcttgggtcccgcgcccaacttccgctggcccaaagaaactataattttgaaccaacagacctctgctggcatctgcgattgcatttttcctgttttaacaacggctgtgctagacgaagtggtgaagcccaaagacttatttttgagctcgctgtaagactgagaaatcacgtagtccttcctgaaaccactaagaggaaaaatgtctgtgacactgcatacagatgtaggtgatattaaaattgaagtcttctgtgagaggacacccaaaacatgtgagatggagtctcgctgtgtcccccaggctggagtacaatggcgcgatctcggctcactgcaacctccgcctcctgggttcaagcaagtcttctgcctcagcctcccgagaactggaagaggaggcaacagtatttggggcaagaagtttgaggatgaatacagtgaatatcttaagcacaatgttagaggtgttgtatctatggctaataatggcccgaacaccaatggatctcagttcttcatcacctatggcaaacagccacatttggacatgaaatacaccgtatttggaaaggtaatagatggtctggaaactctagatgagttggagaagttgccagtaaatgagaagacataccgacctcttaatgatgtacacattaaggacataactattcatgccaacccatttgctcagtagctatgatagacctggacaaataacttgacaaattgctggaacacacttattgtggtttacccggttttaattatgtcagagattgcatcatccttctgcttgtttacaactatgatcttctatgaaatggtggtaccaaggggcgcccaacagcttttatccccattcttagagcatattctttattataatgattatccaacatatttctttaattttaatacaaaaaatacatcatttaatttttgttacatatgaacattcatttttaaatgctcagcctcaagtgcaggcatttttgagtggcctgattacatattcctcccacagcaagtccgtatcctggaagtgttattttataataaaatttaaaaagttttaaaga

SEQ ID NO: 129115 - DNA, 1226 bp, Homo sapiens
ggcaggccgagtgtaaagcattgcttgaggttgcccaggtagtttcgccttacacttcttgtcccagtgcaattattagtagagctccctttcactgtcaaatttccggttggggataaattgcattgtcgttttggtttgagataggaagatgaggggaggaaggaggtgaggcggtaaggggcgttctctctcttgggtcccgcgcccaacttccgctggcccaaagaaactataattttgaaccaacagacctctgctggcatctgcgattgcatttttcctgttttaacaacggctgtgctagacgaagtggtgaagcccaaagacttatttttgagctcgctgtaagactgagaaatcacgtagtccttcctgaaaccactaagaggaaaaatgtctgtgacactgcatacagatgtaggtgatattaaaattgaagtcttctgtgagaggacacccaaaacatgtgaggaactggaagaggaggcaacagtatttggggcaagaagtttgaggatgaatacagtgaatatcttaagcacaatgttagaggtgttgtatctatggctaataatggcccgaacaccaatggatctcagttcttcatcacctatggcaaacagccacatttggacatgaaatacaccgtatttggaaaggtaatagatggtctggaaactctagatgagttggagaagttgccagtaaatgagaagacataccgacctcttaatgatgtacacattaaggacataactattcatgccaacccatttgctcagtagctatgatagacctggacaaataacttgacaaattgctggaacacacttattgtggtttacccggttttaattatgtcagagattgcatcatccttctgcttgtttacaactatgatcttctatgaaatggtggtaccaaggggcgcccaacagcttttatccccattcttagagcatattctttattataatgattatccaacatatttctttaattttaatacaaaaaatacatcatttaatttttgttacatatgaacattcatttttaaatgctcagcctcaagtgcaggcatttttgagtggcctgattacatattcctcccacagcaagtccgtatcctggaagtgttattttataataaaatttaaaaagttttaaagaattaaatcgtaggacaaattaattaaaatattgtgtaaaattaccttcaggct

SEQ ID NO: 129116 - DNA, 1284 bp, Homo sapiens
gttcaactcccacttatgagtgagaatatgcggtgtttggttttctgttcctgtgttagtttgctgagaatgatggcttccagccatccatgtccctgcaaaggacatgatctcatcctttttatggctgcatagtattacatggtgcaattttaaagcagaaattattagcacctacccctaaaatgtgaacaatattgtgctcactttggcagcacatatactaaaatttgaacaatacagagaagattagtgtggcccctgcacaaggatgagacacaaatttgtgaagcttttcatacttaaatatatatgaacaatatttataaggagggttattcttttttgttttttgtaggtctgttttaatcttcaggtctgtgaagttaaatttggggaattaggaaaggccatatcaaattttatctatatttaagcagtcaaactataaagtattccttaagttttgggaaatgaacttgttttcaatttaattaaatacttcttttgatttgcttcacttgtaatgtaggaactggaagaggaggcaacagtatttggggcaagaagtttgaggatgaatacagtgaatatcttaagcacaatgttagaggtgttgtatctatggctaataatggcccgaacaccaatggatctcagttcttcatcacctatggcaaacagccacatttggacatgaaatacaccgtatttggaaaggtaatagatggtctggaaactctagatgagttggagaagttgccagtaaatgagaagacataccgacctcttaatgatgtacacattaaggacataactattcatgccaacccatttgctcagtagctatgatagacctggacaaataacttgacaaattgctggaacacacttattgtggtttacccggttttaattatgtcagagattgcatcatccttctgcttgtttacaactatgatcttctatgaaatggtggtaccaaggggcgcccaacagcttttatccccattcttagagcatattctttattataatgattatccaacatatttctttaattttaatacaaaaaatacatcatttaatttttgttacatatgaacattcatttttaaatgctcagcctcaagtgcaggcatttttgagtggcctgattacatattcctcccacagcaagtccgtatcctggaagtgttattttataataaaatttaaaaagttttaaagaattaaatcgtaggacaaattaattaaaatattgtgtaaaattaccttcaggct

SEQ ID NO: 129117 - DNA, 1365 bp, Homo sapiens
ggcaggccgagtgtaaagcattgcttgaggttgcccaggtagtttcgccttacacttcttgtcccagtgcaattattagtagagctccctttcactgtcaaatttccggttggggataaattgcattgtcgttttggtttgagataggaagatgaggggaggaaggaggtgaggcggtaaggggcgttctctctcttgggtcccgcgcccaacttccgctggcccaaagaaactataattttgaaccaacagacctctgctggcatctgcgattgcatttttcctgttttaacaacggctgtgctagacgaagtggtgaagcccaaagacttatttttgagctcgctgtaagactgagaaatcacgtagtccttcctgaaaccactaagaggaaaaatgtctgtgacactgcatacagatgtaggtgatattaaaattgaagtcttctgtgagaggacacccaaaacatgtgagaatttcttggctctttgtgccagtaattactacaatggctgtatatttcataggaatatcaagggtttcatggttcaaacaggagatccaacaggaactggaagaggaggcaacagtatttggggcaagaagtttgaggatgaatacagtgaatatcttaagcacaatgttagaggtgttgtatctatggctaataatggcccgaacaccaatggatctcagttcttcatcacctatggcaaacagccacatttggacatgaaatacaccgtatttggaaaggtaatagatggtctggaaactctagatgagttggagaagttgccagtaaatgagaagacataccgacctcttaatgatgtacacattaaggacataactattcatgccaacccatttgctcagtagctatgatagacctggacaaataacttgacaaattgctggaacacacttattgtggtttacccggttttaattatgtcagagattgcatcatccttctgcttgtttacaactatgatcttctatgaaatggtggtaccaaggggcgcccaacagcttttatccccattcttagagcatattctttattataatgattatccaacatatttctttaattttaatacaaaaaatacatcatttaatttttgttacatatgaacattcatttttaaatgctcagcctcaagtgcaggcatttttgagtggcctgattacatattcctcccacagcaagtccgtatcctggaagtgttattttataataaaatttaaaaagttttaaagaattaaatcgtaggacaaattaattaaaatattgtgtaaaattaccttcaggctatgtgtataaggtatatatgaaacgtaaatgaacttcatgtttaa

SEQ ID NO: 129118 - DNA, 1308 bp, Homo sapiens
ggcaggccgagtgtaaagcattgcttgaggttgcccaggtagtttcgccttacacttcttgtcccagtgcaattattagtagagctccctttcactgtcaaatttccggttggggataaattgcattgtcgttttggtttgagataggaagatgaggggaggaaggaggtgaggcggtaaggggcgttctctctcttgggtcccgcgcccaacttccgctggcccaaagaaactataattttgaaccaacagacctctgctggcatctgcgattgcatttttcctgttttaacaacggctgtgctagacgaagtggtgaagcccaaagacttatttttgagctcgctgtaagactgagaaatcacgtagtccttcctgaaaccactaagaggaaaaatgtctgtgacactgcatacagatgtaggtgatattaaaattgaagtcttctgtgagaggacacccaaaacatgtgaggctggagtacaatggcgcgatctcggctcactgcaacctccgcctcctgggttcaagcaagtcttctgcctcagcctcccgagaactggaagaggaggcaacagtatttggggcaagaagtttgaggatgaatacagtgaatatcttaagcacaatgttagaggtgttgtatctatggctaataatggcccgaacaccaatggatctcagttcttcatcacctatggcaaacagccacatttggacatgaaatacaccgtatttggaaaggtaatagatggtctggaaactctagatgagttggagaagttgccagtaaatgagaagacataccgacctcttaatgatgtacacattaaggacataactattcatgccaacccatttgctcagtagctatgatagacctggacaaataacttgacaaattgctggaacacacttattgtggtttacccggttttaattatgtcagagattgcatcatccttctgcttgtttacaactatgatcttctatgaaatggtggtaccaaggggcgcccaacagcttttatccccattcttagagcatattctttattataatgattatccaacatatttctttaattttaatacaaaaaatacatcatttaatttttgttacatatgaacattcatttttaaatgctcagcctcaagtgcaggcatttttgagtggcctgattacatattcctcccacagcaagtccgtatcctggaagtgttattttataataaaatttaaaaagttttaaagaattaaatcgtaggacaaattaattaaaatattgtgtaaaattaccttcaggct

SEQ ID NO: 129119 - DNA, 1558 bp, Homo sapiens
ggcaggccgagtgtaaagcattgcttgaggttgcccaggtagtttcgccttacacttcttgtcccagtgcaattattagtagagctccctttcactgtcaaatttccggttggggataaattgcattgtcgttttggtttgagataggaagatgaggggaggaaggaggtgaggcggtaaggggcgttctctctcttgggtcccgcgcccaacttccgctggcccaaagaaactataattttgaaccaacagacctctgctggcatctgcgattgcatttttcctgttttaacaacggctgtgctagacgaagtggtgaagcccaagtatggagtaacgtcattaattctttcattcacttattcgaatgcttgctgagttctgtgttgctactggtttagttcttgggatactgcgagtgaacagtgggcggcgaggctgttgttgcaacgtcagagtaaaagaaggaccctgcacctcggcctcccaaagtgttaggattataggcgtgagccaccacgcccggcgaggtttttatttaaaatgttcagtaaagatgagcgtgtgtgagttaagacaggaaaatgagcctaattctttttttcttttgggactagagacttatttttgagctcgctgtaagactgagaaatcacgtagtccttcctgaaaccactaagaggaaaaatgtctgtgacactgcatacagatgtaggtgatattaaaattgaagtcttctgtgagaggacacccaaaacatgtgaggaatatcaagggtttcatggttcaaacaggagatccaacaggaactggaagaggaggcaacagtatttggggcaagaagtttgaggatgaatacagtgaatatcttaagcacaatgttagaggtgttgtatctatggctaataatggcccgaacaccaatggatctcagttcttcatcacctatggcaaacagccacatttggacatgaaatacaccgtatttggaaaggtaatagatggtctggaaactctagatgagttggagaagttgccagtaaatgagaagacataccgacctcttaatgatgtacacattaaggacataactattcatgccaacccatttgctcagtagctatgatagacctggacaaataacttgacaaattgctggaacacacttattgtggtttacccggttttaattatgtcagagattgcatcatccttctgcttgtttacaactatgatcttctatgaaatggtggtaccaaggggcgcccaacagcttttatccccattcttagagcatattctttattataatgattatccaacatatttctttaattttaatacaaaaaatacatcatttaatttttgttacatatgaacattcatttttaaatgctcagcctcaagtgcaggcatttttgagtggcctgattacatattcctcccacagcaagtccgtatcctggaagtgttattttataataaaatttaaaaagttttaaagaattaaatcgtaggacaaattaattaaaatattgtgtaaaattaccttcaggct

SEQ ID NO: 129120 - DNA, 1247 bp, Homo sapiens
ggcaggccgagtgtaaagcattgcttgaggttgcccaggtagtttcgccttacacttcttgtcccagtgcaattattagtagagctccctttcactgtcaaatttccggttggggataaattgcattgtcgttttggtttgagataggaagatgaggggaggaaggaggtgaggcggtaaggggcgttctctctcttgggtcccgcgcccaacttccgctggcccaaagaaactataattttgaaccaacagacctctgctggcatctgcgattgcatttttcctgttttaacaacggctgtgctagacgaagtggtgaagcccaatctgtgacactgcatacagatgtaggtgatattaaaattgaagtcttctgtgagaggacacccaaaacatgtgagaatttcttggctctttgtgccagtaattactacaatggctgtatatttcataggaatatcaagggtttcatggttcaaacaggagatccaacaggaactggaagaggaggcaacagtatttggggcaagaagtttgaggatgaatacagtgaatatcttaagcacaatgttagaggtgttgtatctatggctaataatggcccgaacaccaatggatctcagttcttcatcacctatggcaaacagccacatttggacatgaaatacaccgtatttggaaaggtaatagatggtctggaaactctagatgagttggagaagttgccagtaaatgagaagacataccgacctcttaatgatgtacacattaaggacataactattcatgccaacccatttgctcagtagctatgatagacctggacaaataacttgacaaattgctggaacacacttattgtggtttacccggttttaattatgtcagagattgcatcatccttctgcttgtttacaactatgatcttctatgaaatggtggtaccaaggggcgcccaacagcttttatccccattcttagagcatattctttattataatgattatccaacatatttctttaattttaatacaaaaaatacatcatttaatttttgttacatatgaacattcatttttaaatgctcagcctcaagtgcaggcatttttgagtggcctgattacatattcctcccacagcaagtccgtatcctggaagtgttattttataataaaatttaaaaagttttaaagaattaaatcgtaggacaaattaattaaaatattgtgtaaaattaccttcaggct

SEQ ID NO: 129121 - DNA, 961 bp, Homo sapiens
ggcaggccgagtgtaaagcattgcttgaggttgcccaggtagtttcgccttacacttcttgtcccagtgcaattattagtagagctccctttcactgtcaaatttccggttggggataaattgcattgtcgttttggtttgagataggaagatgaggggaggaaggaggtgaggcggtaaggggcgttctctctcttgggtcccgcgcccaacttccgctggcccaaagaaactataattttgaaccaacagacctctgctggcatctgcgattgcatttttcctgttttaacaacggctgtgctagacgaagtggtgaagcccaaagacttatttttgagctcgctgtaagactgagaaatcacgtagtccttcctgaaaccactaagaggaaaaatgtctgtgacactgcatacagatgtaggtgatattaaaattgaagtcttctgtgagaggacacccaaaacatgtgagatggagtctcgctgtgtcccccaggctggagtacaatggcgcgatctcggctcactgcaacctccgcctcctgggttcaagcaagtcttctgcctcagcctcccgagtaagtgggattacaggcgtgcgccaccatgcctggctaatttttgtatttttagtagagacagggtttcaccatgttggtcaggctggtctcaaacttctaacctcaggtgatccatgcacctcagcctcccaaagtgctgggattacaagcatgagccactgcacctggccttttttttttttttttttttctcaagacggagtcttgctctgtcacccaggctggagtgcagtggcatgatcttggctcactgcaaccttcgcctctggggttcaaacgattctcctgcctcagcctcccaagtacctgggattacaggcacccaccaccatgcccagctaatttttatatttttttagtagagacggggtttcacca

SEQ ID NO: 129122 - DNA, 1044 bp, Homo sapiens
ggcaggccgagtgtaaagcattgcttgaggttgcccagagacttatttttgagctcgctgtaagactgagaaatcacgtagtccttcctgaaaccactaagaggaaaaatgtctgtgacactgcatacagatgtaggtgatattaaaattgaagtcttctgtgagaggacacccaaaacatgtgagatggagtctcgctgtgtcccccaggctggagtacaatggcgcgatctcggctcactgcaacctccgcctcctgggttcaagcaagtcttctgcctcagcctcccgagaactggaagaggaggcaacagtatttggggcaagaagtttgaggatgaatacagtgaatatcttaagcacaatgttagaggtgttgtatctatggctaataatggcccgaacaccaatggatctcagttcttcatcacctatggcaaacagccacatttggacatgaaatacaccgtatttggaaaggtaatagatggtctggaaactctagatgagttggagaagttgccagtaaatgagaagacataccgacctcttaatgatgtacacattaaggacataactattcatgccaacccatttgctcagtagctatgatagacctggacaaataacttgacaaattgctggaacacacttattgtggtttacccggttttaattatgtcagagattgcatcatccttctgcttgtttacaactatgatcttctatgaaatggtggtaccaaggggcgcccaacagcttttatccccattcttagagcatattctttattataatgattatccaacatatttctttaattttaatacaaaaaatacatcatttaatttttgttacatatgaacattcatttttaaatgctcagcctcaagtgcaggcatttttgagtggcctgattacatattcctcccacagcaagtccgtatcctggaagtgttattttataataaaatttaaaaagttttaaagaattaaatcgtaggacaaattaattaaaatattgtgtaaaattaccttcaggct

SEQ ID NO: 129123 - DNA, 307 bp, Homo sapiens
cgggaaggtgtcgaggatccctcataggttcgcaggtactgatgaactaataaattctctctgagcctgcagttttgggtctctcataccagcagcatacatagtagaaaatgggttgaaatatgagtcatgggatctagattctagtcctgactttgtcattaacttgtaatatgatctcaagtagtatggttcaatctttcttctagaccacagttggaggtattatgaaagggggctggggaggaggctgttgcggctgatttccttctggaccaaaaggtctattattctatcttcctcttga

SEQ ID NO: 129124 - DNA, 462 bp, Homo sapiens
ttttgtccttgcgggaggtagctggaacacggggaggcctgtgcggggccagggctgccattgtggggaagtttgcctgagtctagggtccacgtagcaggtgcgctcagttctcacaatgagcagcatcttgtgactttgcctctatgggcaataaaggtgtgatttggactctgacctaatattttagtttcccaatttgttcagagcctgggtggtttactgggcccctttaggaactccagtggaccttatgggggagggagggcccggtgagagacacaacttcccctccagcctgactgtgactttgtgctgcccatgactgtgtcatgtgcacagctgggagggccccactgccatcggctagacctacgtagggtgaccttggttgaaccaggagcacctaccccaatgttatcgtgccctagggacaatgggaagcagcacctgagatggtca

SEQ ID NO: 129125 - DNA, 431 bp, Homo sapiens
gaagccccatggagctctgcctgggagtaaccaagcctgttttgtgtttcttgctctgctctgtatatatagagcttctcttccctcctccgtagctgaaagcccccaaccggtccgaaagctccttgaagaccgtgctgccgtgcacagacacgggttcctcctgcagctggagcccacggtgaataggcaggcgggccacagggccctgtgtgtccctgctgcttgcagtggccatctgctgcccacgctgtcagcaggttctttggactggcgtctggagggtacacaaggcgccatccctgaagtgctgcctggggcctgctgttggccacagtggaattcctcagactcaaagccctcccctcagggaagtggtgcaaagcccagtctgtagtacttgcttgggacccaggtgtcctgactcatca

SEQ ID NO: 129126 - DNA, 136 bp, Homo sapiens
catctgtaaagaagccacagctataatcatggtcaatggtgaaagactgaaagctttccccctgaaattaggaacgagacaagaatatgtgctttcatcactgctattcaacagtgtgctgcaagttcaattagac

SEQ ID NO: 129127 - DNA, 498 bp, Homo sapiens
ggttaactgcgggcttctgtggggagcagtactactgtgtctgtcggcagtggccatgggaccctcaggcccgtcctgtacatggagcagggtgcacagtcaccctccatcctgtggcgagaggctggcccggcccggccaagcgaggcagaaggtgtcggccaagtggccccgaccccatcccgcaatctctcagctgctttttattacctttgtgccccatttgggagtttgcttcctccacctggacactttgcccgggaggtcatcagagcccaaccccaggctctgctcggttggagaggggatgacttcaccaccacctgaccttcctagggtcctggtctcactgtcagctgggggtccgttgtgtgtatttgtacagttttgctgtatggggtttgtcacccaaaagctgatgctgagaaaggcaaatccaacaacagacctaaagccacctctggagccgccagctgggctccgtccccagagcctaag

SEQ ID NO: 129128 - DNA, 587 bp, Homo sapiens
tcataaagttggcaaaaatagtgtgataaaaccaggggctggtgaggatgtggaacaataggaacattctggtaggacatatattcctcatcactttggagagccatttgaaaaacacatatcttgtgaaccagcaataccacttctaagtgtccaactggagcaccaggagaaatgtaaaataatgttcactggggcatcctaactatctaactgtcccccaaaaggggaatggaaaaatcggctcattctgataaaaagaatgaactggatctatgaatcagcataaatcacgtcaatcatatgatcagtaaaatacgcaggttttggggtttttgttttgtttttgagacggagtcttgctctgttgcccagcctggagtgcagtgacacaatcttggctcactgtaacctctgcctcctaggttcaagtgattctcctgcttcagcctcccgagtagctggaattacaggtaggtgccaccatacccagctaatttttgtatttttagtacagacggggtttcaccatgttggccaggctggtctcgaactcctgacctcaggtgatctgcccaccttggcct

SEQ ID NO: 129129 - DNA, 530 bp, Homo sapiens
aattaatatttgactgttcagtaatcattactgacatcttgtttttcacttttaaatgcctccaatttaccatagcactttgttaaaataaattgtgacttttaactttttcatgaacataactgctacataaatgttctttagaattttagacatatctcaggcacacaaattattagttctcacaaattagagaacacttataattgtgaactctaaatagaaaccttcattttaatcactgagcaacagtatatagagcaatattgttgatcctgataaacactgcatataaagaaaaactgtaatatacaatatataccatctcaagtatgcttagctttgaaaatgatgaaaatagaaggcaaaagtaagtgagtaataaagatgttatagtaactgcagtagtggtacatgtttcacaaagattttaataaaagcacataaagctacaataaaagttctatattccagtttcttatagtccagaaatagcagtgatttggcatttggcaaattgaaagttaccc

SEQ ID NO: 129130 - DNA, 647 bp, Homo sapiens
tgttctaatgaggaatactgcatttaattgctgttattttcagttccaccttgattttgatgtctttatagtgaatttgactcacattcatttcttatcaaagggagattaaatctatgtagttttgagatctggactatgctttgagaagtcagatgtttgtgaaaaatgtctttggatttttttttcttttttcttttgatttctttgctgtagattagtttcctaaagggttaatgaaagatatattgacttttttagttatgcttttatttattcatcaccatgaaaatttatcagtacacttgtgaaaatttatcaattatcaattgtggaaaattgtgaatacacttgcactagaatgtttcattttattacctagttaaaccagccactttttgtaatttgtacttaagaatatgctgttttgattatatttctaagtaaataaatttttccattattaacatagaagtcttgtttgtgttatttgctgctgggaagatgctctgaagcttctgccattgtcctttgcatgtcatgtgggtggttatgctttttagacacttacatggtttttaatggaagagagtgatggatatactaccatgagaagcactaatatcctttttgaagttcaccattga

SEQ ID NO: 129131 - DNA, 170 bp, Homo sapiens
taaaataaattgatcaattctcatattccaggatttgagaaagtttatacttaactctggaatgcagagattctgaccctgtaaaaataacatttatatgccagataactctgttaagcatatgacatttattacttttttttttttttttttttttgaggcagagtctc

SEQ ID NO: 129132 - DNA, 880 bp, Homo sapiens
gtgtcttgttttttgttgcttgaagtcaaaagcattcctaactgacaccctaggtgagttgagagtttccagatagggttggtggtcagtggtgttaaatgttgcagagaaatcctataagcttggaagatgtctggaggatttggctcttgagaagtcaattttacctttttttcttttttaaaattttttggtaaaatatacataacataaaatcttttaagctgtggttaaatgtacaattcaatggtattaagtacatccaagatgttgtgaaaccatcatcactattttcataactttttttatctcaaaaacaaaatactcattgataataacttatcactgctcccatctcctgttaacctctattctactttctgtctctatgaatatgcctattatagatatttcatataagtagaatcatacatatttgttcatacatatatgtccttttgtgtctggcttatttcacttatcataatgttttcaatgttcatctgtattgtaacatgtgccaaaaaaaaaaaattttttttacgaacacaactctttttgcgaagaggggtctccaagttggcagcccctttggtggtgcgtgcccggaattcatagtccgggtgacgggggggctggcttataggggcctgggcgttctccacggggtacacattggcgggcgggcggaagggaatccatcgcaacggtggcgcctgtgcgcccccggtggcgcggtgggcgcccaccctgttacttgtggtgcccacatctttgtacctacacgcgcggccaagaggttactcctctgcccgtgtgtgtgttcccgccctgccgccgagttatgtacggtatgcacaccctctgccgttcgtcactc

SEQ ID NO: 129133 - DNA, 385 bp, Homo sapiens
tggtctcgaactcctggcctcaagtgatccatccgccttggcctcccaaagttgctgggattacaggagtgagccaccatgcccgaccaagaaaaccctcttgaatgctctctcctgaactcctgacctgaggtttggtgtctgaggctggggagagctcagatagagggatgttcaactctagtatctatgaggtgagactcaggatggttcttgtaacgtcttgaaacctcttgaagatttatgctgtgtgtaatagctcatcaagaaaccctggtaataatccttgaaatagacctgcgaactctgctttaatgaattttacatgatggcgttggagaaatgaaatccccttaccctcattaatcctgagacacagcaatca

SEQ ID NO: 129134 - DNA, 364 bp, Homo sapiens
tcatggaattagaataaaacccctggagaaggtgtgtgctgacttgatcacaggcaaaaagtttaaaaatctcaagtaaaaggaccagtctgtatgcctaccaagactctgaaaatcactacaagaaaaactccttgtggtgaaagttctaaggcactgggatggtttccagatgagaatccaaaagtgactcactgacttgcacagtccttccaagattgtcaagcagattatttccatcagtgttgcgccaggaatcgattctgaagtcaccaatgcagatgtttaagtcaactattttaataaattaattggccgggcgcggtggctcatgcctgtaatcccagcactttgggaggccaag

SEQ ID NO: 129135 - DNA, 437 bp, Homo sapiens
taatattcagaagttaagcaggacattccagatttgttagggagaattattaatcatatcccctcaccccaccaaaagaaaaacagcagtgaggtgtgacttaatcacaaaggactccatctgcctttgtgcctcaatttagagcttatattttaaactgcttttctctatgtggcttctgaatataatacatatcctgattggcaatcatggacttcagtctacctctgtagagtaacatctctttgaaaaactctcatgttgaactttatatgggccataactcattttctgatagcccaatcacatatttctccatatcattaaaatctaagcatccatatgtgtatgatgtggtagcatacataatttacttttattgatataaaagtaacagtaaatcagaagagataataatgtattggaaagaaaactga

SEQ ID NO: 129136 - DNA, 180 bp, Homo sapiens
ctctgtcttccagaaaggctgtaccagcatggtgagtgtataatggacatgagcatggacatgggatggacatgagaatgttcatctgtctataccctctccattactaggtataatcactctagaaaatctttaataatcttttatctggtccccttggctttagcctttccctatgca

SEQ ID NO: 129137 - DNA, 789 bp, Homo sapiens
ctacactacgtgtatcctacaagtctagccttctgaggaaggaaaaacaggacagtagttaggagataatcataggctcaaaaggttctttcccccaagattagaaactggagagcacttgaaagaagaaaggaaaacccctgagaaagaacatggctgaagatgctgaaaaaagacctgaaagtggatatggttttcatgactccccataatgtgccccatgatgtcccctccggcctcatcactcacttctcatcgttttacacagcacccaaactacagcagactccccctagctccctaaacacaccacgcctggctaattttgtgtttttagtagagacgggtttcaccacgttggccaggctggtctccaactcctgacttcaggtgatccacccacctcggcttcccaaagtgctgggaccacaggtgtgagccaccacgcctggccctcatgtgctgtcttaatccaggagctctgcgtctgtggttccaactgcctggatacacttccctcaatctcccagctgctaagcccaccaccactccacccggttatgtccttctcatgttttaggtctcacttgtcacctctttgaaagaagccttctttaatcccatctatccttcttatgtggaccttagcacccacttcttccccttcagagctgtccccacaccgtatgagcattctctcacactttctacctcctgaccagtctcctatctgtgtgagggtaggtatctcatccatcttattcactgctgttatctgcagcaccttca

SEQ ID NO: 129138 - DNA, 368 bp, Homo sapiens
tgcctcacaggtgtgagagttaattaatgtttgtggggcagctttgagatccacagatgaaaggtgctctataaacgcaaaatgcaattcctcattagcactgtcagacggttcccaggggaaacagttcaccctgcaccacgaggctgctaccctcagccagatgagtctgagacacgtctgggaaagggctacgtatttaggcagagtgcttttggagggagggttcaaggataggtcactagcttccagaaaagatgggtgtttttagaacatgtctcattctcagttggcatcgtgtccctgaggcagagggagagtggccttcagtgcacacagctggagggaccatagttcagagggaacag

SEQ ID NO: 129139 - DNA, 226 bp, Homo sapiens
tacaggcatgagccaccatgcccagcctagcagaggtatttttgctgtttgttttctctcccccttatttgtgtgtgattcctaccaggcagagtacaggacccaataaataggcctcaataaatgttgagtaaatgaatgaaaagaacttcaagtctccctgccaatcaaagtaatcaatctctccatgattacaccattttcctcttaatcataattatttata

SEQ ID NO: 129140 - DNA, 796 bp, Homo sapiens
gtagagcaaattctatcacctcattctttttgtttttcttgaaactctgttgcccgggttggagtgcagtggcctgatagctcactgaaacatctgcctcctgggctcaagcagtactcccaggttcaagtgattctcatgcttcaccctctcgtatagctgagactacagatgcgcaccaccacacctgcctaatttttgtatttttacgagagatggggtttcgccatgttggccaggttgatctcgaactcctgacctcaagtgatccgcctgcctcagcctctcaaagtgttggcattacaggcatgagccatcgcacctggctcttttcttgttttttaatgtaagcatttatatctataaattcccccctgcgcattgcttacattgcatcctctaagttttggtatgtcctgtgtttgttttcatttgtttctgttacctaatttttcttctttgagtgtgttgtttaatttccataaatttgtgaatttccagttttcttttgttattgatttctaacttgatttttttgtggtcagagaagaaactttgatatctgtctttttaaagttattaagacttgtctgagcatggtggctcatgcctgtaatcccagcactttgggaggccaaggtgggcagatcacttgaggtcaggagtttgagaccagcctggccaacatggtgaaaccctgtctctaccaaaaaatacaaaaattagctgggtttggtggcgtgtgcctgtagtcccagctactcgggaggctgaggcaggagaatcacttgaaccc

SEQ ID NO: 129141 - DNA, 482 bp, Homo sapiens
attcagggagataggattagtttctgttggtggcaggagcctgacagctagtggtgatggagctgctggggcagagggccgctcactgcccctaatgggacaggtggcagcaagtggatcacttgctacagctccaggaggtaagaatgcttgggcattggcaaaagtccatagggctcagcagcctcctgagtttgggaggtaagactctcctcctgctgatgcatctcgtgaacctgccacaaaccctcctgtctgtgctgtgcaggggagcttgcccagataaattgagggcacttggcatcataacttgatgaatttctccagtgttaccacttgatagcaatatatataaacaggaatggttactatggagacttactacaagctgccaccctgtgttggagataatttcctcttcagcttaaacatatcagaatatgacaattctataaagaaaagcagttctgaaaacttaacac

SEQ ID NO: 129142 - DNA, 473 bp, Homo sapiens
ctccctccttggcctcccaagtagctggagctgggcagagtagctgggaccacaggcgtgcaccaccaagcctggctaatcttttgtatttttggtagagacacggttttgccatgttgcccaggctgggcctgaactcctgaacttaatcagatttttagtagaaaggtggtgaggcgttcctagggactgccacaggttccatacgagtgtgatagtcgctgccctgggttttggtttctattggtctgaaaattccttaccagttaagtggctgttactcctcagtggactcagaggacaagctggccacatctgcaggggagtgaacttaggttgtgtgatggactcttgagtctgcaagatgccaacttggctgcatccaaggctcccttgtggcacagcacccagggctgctctgtgagtggctgctgcctgcaggggctggagagaggaggaagggtgtgcacagt

SEQ ID NO: 129143 - DNA, 594 bp, Homo sapiens
  misc_feature (56)..(56): n is a, c, g, or t
tctacaggatcttgatcaagagcatacccctctaacaattttcattactgctcccntacaggaaccatgagatgggacaaaaaccctctctggattccaggaaactcctgtactaaaggagcctccttcccatggggaaatgtcgcaggtgggagtcagaagaggcctgcgatgagggaagagccatctggagcacctactttgataactaacaatgactgttgggcattgttctatgtgctttccttacatgatgtgtttaatcaacaaactctaggaagtagctactattaacatccacatttcacagctgaggaccctgaggccccatgaacttaagtcactccttaacctggacccctacacgatgctattctgcctgctgtgcacttggaagttctacatactaggtctcttgctggtgacagcctgtgagctagatggcattatctatgttgttcagatgaagaaataagacacagagacatttagtaagttcataaggtcacgcagctcatggtggcagagtcaagattcaattccaagtccttctgaccaccgcccaagctctctctagacagttgcactggtttc

SEQ ID NO: 129144 - DNA, 372 bp, Homo sapiens
acggccgcttttcctttaactctcagcttctatttaaaaagctaatttgggagcttgtcgatgctcccaattcagacattttaaataggaactgaaagtcaggagctgccagggcactagatttcctcccgttgccaccagcacagctgaggcatttgttcagtcactcctctggccctggccgtgtgtgtctgtgtgtgtgagcacccgcgagctcagggtgtatttcaggctatcttttctatttaaagacggtgctcctatggatgactattctttctctgtgtgtgtgtcctttccaagctgtgcacacatgaggattcttctttagtctcatggctgtggccggtatttgcaaagcttgtcaccgtg

SEQ ID NO: 129145 - DNA, 628 bp, Homo sapiens
atatggaaaaatcttcttggcccataaatttataaaaatgaaaaacagaaatagaattaattttgagccctaactcattctagtaataaataatatatccactgatttcatgacctaactagaaaaacttagactcgcttttggccatggagacatacatttccaacaaaattttacttctgcataataattatttcttaaaatttattacatcttatttttttatcaattatgatctaaagataattgtaattataacccaagcagaaaaaatccaatatttagagacttattgccacaggaaaattttaaaaattaaatgtcaatttatatatgtaacttattgtacatagaagtatggtgacaaaacctataaaatattttctacacgaaatacattacattagaataaaagtctgtggaaatgaaaataagagctcaaagagaaaaaaattgatgtcaaatttcagactattaaagaacagtctgtttatagcaattggacacctgatagcatataatattcatactctattgcagccatcccttcctttttggcactagggaccagttttgtggaagacaattattccatggatggagggagtgggggctgttcggggagatg

SEQ ID NO: 129146 - DNA, 358 bp, Homo sapiens
acagttctgaatgcgcaggagtttatagatggtaacgtcttttctctggatcattaattctccttactactctgtgattttaaaaacttagaatgttggctagtgtggtggctcatgccagtaatcccagcactttgggaggctgaggtgggagggtcacttgaggtcaggagttcaagaccagcctggccaacgtggtgaatccctgtctctactaagacacaaaaaaactagtctataatcccagctacttgggaggctgaggcaggaggatcgcttgaactcgggaggtggaggttgcagtgagctgagatcatgccactgcactccagcctctgtgacagaacaagactgtctc

SEQ ID NO: 129147 - DNA, 778 bp, Homo sapiens
aacagagaaagctgccagcctagaccagtatagagtaccaggggctctcggtaagaggcaacacttctcctgcctcccagatcaaggggcttctcctccagcacccttattagctacttattttggagcacctgctctgtatcaggcagggcacctggtacattgtagactctaatttgatcctcacaacagtcctacataacagctattattatccttattttatatatgagaaactcaaggttcagaaaagttcacagctgaatgtcatatacttgataagtaattaagcagggctttcaacctgagattttcatttagataaactcaacttcaaaactcacattaaaatcacagtatcacttggattccccagtatagtatataagaatggaaatggtaagagcaaagggtagggaaagatgaatcaataacagcatcaaactcacagatgcaacagctgaagtggcatggggctgcaaataacagagcatcctgtagaaggaatatggtctagaaagtgagggctggttatcagagggagatatgaaagaagagagagtggggttctgcggggcagagagagatactgtggaacaaacttaaacttttcactaatagtacaaaagtagtttattttaaattacaatggaaatttatatttgtaaattaaaatagtgctatgtaaaaatatacttagaaggtcatatatgctttaagagaaaaaaaaacatattttctaggaactataaattaccggaataatgtaaaatcacag

SEQ ID NO: 129148 - DNA, 110 bp, Homo sapiens
tcaggaggtagaatgttattcttttaggctttgaaagggtaacatttgtatataaaagctactacttttttaagttaaaaataattaggaaacagggtgtccctgtgttg

SEQ ID NO: 129149 - DNA, 734 bp, Homo sapiens
aagaggggtgtggactgggggtgctctgcctgggacattccacccttccccactccccccacccagctcttctgtaacagctcactcttcctcacttttcaggtctcaagttaaatatcccccctctgggaagcaccctaggcacccccaaactcgggatggtgctcctactgacctttcacacaggactcacctctcacaagctctacggacaggactgagttcgtcctgcttaccatgatagccccaggacccagcacagggtatagtacacagaaggtgctcagtaaatctttgttaaatgaaagaaacatgggatttttaagtatattagtcttacctgacttccttgactttaaaaaggaaattgagggcacattgagaaaatgagacaaatgtgggggtcaaaatcatgtcatgtgactaaatcacgatcccaaaattttccaacaaactagagcagtgaacagggattagcaaaatgagatttaacaggaatacatgtaaaggcctgtatttggcttgcaaaacccactaactaccctagtactggatgggggaagccattgctgagacagcacacatgcaaaagacttcagactttcagttgactccatatttaccaagagaatgtatccaaccttgggatacattaagaaatatgtagcaccctgccaggcgtggtggcttacgcctgtagtcccaacacttggggaggccgaggcaggtagatc

SEQ ID NO: 129150 - DNA, 197 bp, Homo sapiens
agtcacctaagtaagctttagctgacttctaaggacaggcatgccatagaatataaacaatgggtcaaagttatttaaaatcattgttagacaaaggaaagatggatggaggaagaagacgcaaaagggaagatgataggaagagaaagaaaaagtttgtagccagagattgctttatggatatgtaaccagtgcag

SEQ ID NO: 129151 - DNA, 647 bp, Homo sapiens
tagccgggatggtctcgatctcctgacctcgtgatccgcccgcctcggcctcccaaagtgctgggattacaggcgtgagccaccgcgcccggcctgaaatgcaattttaagagtgccttcaaatgccatctcagagagatgatctgcagggccacagggcatcaacaatcaagaagagttctaaaggaggccaacaccattttaagagactggttggtctggtggataacggaagactggaagagttaaatacgtatagtttagctgggcagacccagtagggagcaatagaaggtggtaaatgtggatgtggtagcaatctaaaaatatccataagatgtaaaggattagaaggaagtattatttagcatgcaaatcagaaagaatcactagatattttaaagaatgatatgaggaattaggttctgagatcaaaaaattggaaaactgatattataaataaagtgaaaaagaaagcattctcaaatactttttacttgagaagatgggaaaaaaaattctttggataagaattgaaaatggggttaactttagggagacatctaagagcacctgaaataaatctgacctctcgcattcacacacaagatttatatttgctagctaaattctagcgtgagggagca

SEQ ID NO: 129152 - DNA, 184 bp, Homo sapiens
ttacatatggctctcctcctgaagatacgccccactcagaaaaattcaggtaaaactcagccggaaaccacagcctcaatgacctaaggagacagaggacaattcagagtgactacagcggctagaaagtgagaggagaaatcagagagaaacataaagaagacccaaattctgcatatgaact

SEQ ID NO: 129153 - DNA, 194 bp, Homo sapiens
agctgcctggagctctgtggggaacctacgccaagtcccgggcagcggttcccgaaagcagccccagtgacattgcacccggcgccgggctgggatctcctccgctggggccgcccgtgggaggagacctcgctgggtggccgggctcaggcgctctcgagcggatttggggtcacaggctgggacaccgcgga

SEQ ID NO: 129154 - DNA, 675 bp, Homo sapiens
ggtccaaatttattcgtttgcatgtagatatacatttgttccagtaccgtttgttaaagactgtttttcccattgaattttcttgttatacttgttgaaaattgaccataacatatatttctgtactttcagatcaatgcgtatacatctcgcattgatctagttgtctatctttgtaccagtaccacaccatatttgattacttgtacttgaaaactctggattattatagtttttaagtttcaaatcgagaagtgtaagtgctccaactttgttcttttcaagattgttttggccattttgaatacctagcattttcatttgaattttagaatcagcttggcaatttctccaaaaaaaaacacaacacaaaaaaacaaaaacacacgtgtgtgtgcggcgcgcgcctctgggcccttgagaaaagcttttttgagacacctttcgttgtggggcgccgggggcccccgtgggtacgggaaccggtggccaaacgtggttccccaagggggaaaccgcggctgatgaccaagggcggggaatttctccccaattataaaaagcgccgcgggggaaccggaaggtttctcgtgacaaatttccagaaggcatctcggagggcccatacggggctctttacacgggggttccagcgagccggatttcaattacccg

SEQ ID NO: 129155 - DNA, 415 bp, Homo sapiens
taagaggtgtctacgggcttggaaggacgggctacaccgcttgcatcaagacggcggctgctgtgagatagtccaactgcatcttagtttccatttcgaaaatgagactggccactaaatgactctaaggactcatcagcactacctttttctgaactaagaatgtctaagacaagtgctactagcagtttgagagaatcccacatctggagaggaaggaaataagaacaacacgcagaaagacggaaaacaaatagatcaatgacagtactcctttgcaaaaggtgccaagaatctaaataaaatagtccccgggataaacatggcgcccaccgcggcaggacataatcaccagaaaataaagattccccgcctcattccattttataaatcacggcgccatcccaaaagaaat

SEQ ID NO: 129156 - DNA, 425 bp, Homo sapiens
ttattttccttctttatgggaaaaagaggagaggggactggctgcctgcagacaggtagctccacagggcaccgatagggttggggacaggtgggatatgcaagccttcacgtgactggccgtctctgccaaggtgcaggcagctcctagcatggagacatccctcatggaagtgagctttcccacccacctccatacccacatttctcagaaacagaccttcactctgctcttctccatcctgttctaagcctggtcagctgacctccatgaacttcatcaaaggacccccttgcccttggacttttacatgggtttggccagtagaagccagtggctacaaatcaaaggaagaacagagaggccaagatatttattctacttcctcctccttgccagatcacattggttaagtttctcctctg

SEQ ID NO: 129157 - DNA, 369 bp, Homo sapiens
ggtgaaggagaatgaaatatctgctcagggaatgcagggccccaaccaccgcttaccccacgtggctggcagagcccagggactactaccctctggagagggagatggaacagcactgaaaactgcggaccagtggaagctggccagctacacgtgaggtgtcctggtcttcctgccccagcatgggggcagggcaggcagcattgggccctcccagtgaggtcacaggggctaagcagcctgctggacaccatgccaagtgggaccgggcagcccccagcggccagcaccctgcatgcccctgcaggtcccgccagcctcagtgccctctgctacagatggcagataccgtgctcaccagaaaggcca

SEQ ID NO: 129158 - DNA, 674 bp, Homo sapiens
ggagataaaggatagatagccttccacaaaacgcttcagtatggcaagaagaatcatctaatattgacaaataaagcaacgtgacatctgtgttgaattccaaattgacttgttgagctgtgcaaaaaagtaaaagaaggtgcttattttcaggatgtgaaatacattgggaaaagccaaggtcaaagatgaaacatgactcaatgccaaagattttcaatcttaatgaaaatctctttcaataagaaattgacgattgagaaacagtgtcattgttagaagttcgatgttcttttgggggtctaacagacgaagccccagagaactgacttttattaatagatagcttaagatttatagcttaggaagaacagattaatagtttttggagtaaagcctgaattatagaaggatgacctgagccctggcatgagtgatcaatcagttcagtgtctgcaactgcacaattttaagaactcttaaaaggctctttggccactgaaaatgcattataaaggataagtccataaccagccaagtctggaatatatgtttatatggctatacagatccagtgtttctttaaaaataaagcaaagggtatgacacaggttggtttgctgttacttaggatatgtacgattgaattgagcctaagataagtgggatgtact

SEQ ID NO: 129159 - DNA, 342 bp, Homo sapiens
tgtcactcctggctagatatccaggcatgccccatgcccactaggtcccatgggtacaacaaactccaggcaccagtacatgatgttattcattgaacggcactcactttatgatctgtggctggcacactgttaattacatggcaaggagaggtcaatatcaagctaaaatggaacccagctgtcccacaatataatcacgtccacctgagacactgagccgtcacctttaaatcacttgtaagcactagctttcatagcctctcttctatcaataagccacaccacaaatgcagtccctgaatcctgcagtttttcagcataaagcgacattttcttagc

SEQ ID NO: 129160 - DNA, 201 bp, Homo sapiens
ttcccgccttggccacccaaagtactgggactacaggtgtgagcctgtagggagataaccattcttttcagatgggaaaacacagacccagacacataacttgcttgggttctcccactaggccctgatttttaaattttttggtagagataaggtctggctttctggcccaggctggtctggaactctaggcctcaagta

SEQ ID NO: 129161 - DNA, 471 bp, Homo sapiens
gtagctgggattacagacacgtgccaccacacccagctaatttttgtatttttagtagagacacggtttcaccatgttggccagcctggtctcgaactcctgacctcagatgattcatctgcctcggcctcccaaagtgctggaattacaggtgtgaaccacaaacccaaccctttctgcctattttctagtccaaatcctcagtttttgtttgcatgtactgaaataatgcaacataattttcatattagtttcagaaaattaagaatcagaaaaataaggctattgtaaaataattcacataatgcttgtcaaagcctactgccaatgtgttattttttatcatctgctatgataaattagcattgacattaattgacacgactggttttgataagtgtaaaacatcaaaagctgattttacaatttatgtgtaaagatctaaaatggtgattttgcatcctatattct

SEQ ID NO: 129162 - DNA, 190 bp, Homo sapiens
actgttttttactcgttctccaactccaacctcttagtggacagcatcaagcctggagacatctgatggccccccactgcagctactccctggtggatcagaaggtcccagtggaaagaagttgaccgtcactgcccgatcgagtgagagtttagagtttactttcctttcccgtcttctggtggacaaa

SEQ ID NO: 129163 - DNA, 483 bp, Homo sapiens
gaccagagccccgggcacggccccagctccgtggggctctcacggtgccaatcacaagacccagggttgtgcttttgagttttagaattagtcattctttagagcagccagctagtggcatttcctaggaaaactgtgacctgtgacaaatcgctgcatttttaatgtcaagatgtgttttcccacataaattcaccggagacatccgggccccgcttcgatgtaacatgagaggaagtcggcgtcctggccacgaaatgcagttcacttttttttaggcttttatatggattatgttttgctgacccacgcccgcattttcagattttgtatctaacagacagtgctcagtgcaaatcaacattccagcggtcaggactgaccccggggcagcactgggctcaggcttcagcgcgactgtccgcatggctccctcccgtcctggcaccaatttctgaataaagtcctttctaccaaaaaaaa

SEQ ID NO: 129164 - DNA, 402 bp, Homo sapiens
catgttgcttctccctctttgcagagtaaactgcaactcatcttcaagatctaattcataacaagtagacacaatccaataaaaaaatagaaacaaggtttgaatagacattttaccaaagaagatatatgagtggctaatacactcatgaagatactcaacatcattagtcattagggaaatgcaaaccagaaccacgagatactatttcatatccactaggatgattataatcagagccagacaataatacatgtctggctgaggcaggaggatcttttgagcccaggagttcaaggccagcctaagcaacatggtgacatcccctctctaccaaaaataaaaataaaataaaacaaaataaaataaaaatcagctgtagtcccagttactcgggaagct

SEQ ID NO: 129165 - DNA, 717 bp, Homo sapiens
agagaattagatgatatattcaaagtgctgaaagaaagaaaaactgccagataaaaataccatacgcagtgaaactattgttaaaaaatgaatgcaggctgggcgtggaggctcatgcctgtaatcccagcattttgggtggccgaggtgggcagatcacttgaggtcaggagttcaagaccagcctggccaacatgatgaaaccccgtctctactaaaaatacaaaaattagcagggcatggtggcgtgcacaggcatggtagagtgcgattgtggtctagctacctggaaggatgaggcaggaggacaggttgagcccaggagtttgatactgcagtgcaccataactgtgcctgtgaacagccactgcactccagcctaggaagcatagcaagacatctgtcttttagaaaataaaaaataaaaaaaatagaaataattttttttaaattaaaaaataggtaaataaattttttaaaaataaaatgagagataaagtctttcctagataaggaaaaactgagaaaattcatcaccactaaaccagccatataagaaatgcttaggccaggtgcctgtaatcacactttgggaggccaaggcgggcagatctcttgagctcaggagtttaagaccagccctgggaaacatgacgaaacctcatctctaaaaaaatatgaaagttagccaggcatggtggtgtgcatgggtaggcc

SEQ ID NO: 129166 - DNA, 292 bp, Homo sapiens
ctcttctagaaagctactcaaactttcactttcattgctaatgaataagaatgtcctgactttagtcaatacgctgaatttgttatcatctagttttgactttgttttttaatcttgaatactctttagagaaaatgttagttcactattgtttaatttgtatttctttaaagttggggttttattcatgtaactcaccaattgtgtttcttatggattgtgttcattttcctggaagaaaggtcatttttttccttattaatttctaagaatttttttttttttgagacag

SEQ ID NO: 129167 - DNA, 194 bp, Homo sapiens
ctatttaacaataccactaagtaaaaagaacagattttccaagttatgcagcaataccagagagcaggattaaatgtttaaaaatttttcattatctacttccatcacagaaattttctctaaggtcatttctatagcggttatagagggtccactgctaaagtgagtaaagattttttcaatataatgcatat

SEQ ID NO: 129168 - DNA, 461 bp, Homo sapiens
tgttttgagcagaggataagagggtaataggaaaaccacttttaagtagtctatggttctcttggagtatttcaaaattaatctcacttttaaatgaaaagaattaaactttagtctgacctagagacgacagccacctacaagattttagaaatcgtacaatggaaatggcagaatggtggagggattgcaagttgctagatcagtgatttttaagtggggtgattttgtcccccaagggacatttggcaatatctagagacatttttggctatcacaattgagggacagggatattattactatccagaggtcacaacccgggatgctgcaaaatataacacaaaagactctctcctcacagcaaagaattatacagcctcatgtcaatattgttactgttgagaaactctgtgctaggtatttcatttgaaatagaacacagttaaaagataattctg

SEQ ID NO: 129169 - DNA, 434 bp, Homo sapiens
ggtgatgatgggctactgaggcctccttacatgtatctagttaagaatatacatggtttcctgcgtgagaagcatgagagggctacaaggtgggcttggcagaatgttctgggcgttagcccagaaaaccagcttggccaagtccacactttcatgtctacggtgagagaggaaccatgagcaaatgtttacaattttttgtgcttctgctcaatttttttctctccaattgactgggtaagcctcctgccatagtcaaagggcttcattcatttgttcattcactcactcaccaaacaagtctgtctggcacaacacgaggcatgggggccgtggtcagtgtgagtgagactgataggtctctctctcccacagtctgatggacaggcaggcagacagatacagagcaggaaattacaagcgcaattactgtt

SEQ ID NO: 129170 - DNA, 618 bp, Homo sapiens
caagtttctgttgagattgacctatcaattatatagtaatgaataaaatcttagaaataatattgttacaaattgtaaaaaccaaatcttcttaagaatcacatttatgaattgggaaattggtagatccatttttcacttgccagggtagaatgacctgatttatatatgattagagtgataaaagattaagaaatggaaattatcagtttctattagagatatatttattagagatattggttagctgtggttcttcccagtattaggagaattagaaaattatttcccttaagtaattaaatgagatatgatatgattttcagcatctgaaaactaaattcagtttaattttgtaacattatttgaccctttctgcaaaattttatatagtgaaataagattgaaaatttaacttgatgataccatgtcagataattagattccttacattttctcctaacctttaaggatcccagatataattttgtggattgctgctttgaagataccagtccatgtgtgctgctgcaataaaattcctgagactgggtaatatataaagaacagaaattaattttcttactattctggaggctgggaagtacattattaaaa

SEQ ID NO: 129171 - DNA, 610 bp, Homo sapiens
tgacaggggcctggatgagacaagagacttgtcttgcctttgcagacagtgaatgtcagcttgaggagaagaaaagggggacttcaatgataattactggggtgtgttggtttgttggcctcattgtgaatgcctgaaaacaacttaggggtattttgaggagttcaaattcctctcttcacaggttggggacttgaagtcaatttctatagtcacaggcaggtgagtttatagtcaaaatcatgttccatatacaattcactcattcctgctactcactcttctatctccctgggctttgcttccttactcagatgtcaaggatttctatcatgtagctttttgatgctgctttacttcttcctgtctcttgctatcactatctgaaccttatggcacccataaggttcctggggacataaggtgtctctggggacaaggggataatgctgaggaaatgggagacaaggactcaggggagtagtccctaaagcacaacagttctgagagcgtcccaactggatggagcgtacacttgttcacaggctcctaaaggtgcttgaccgcaccagagcaaactcaccatgcaatggacatcattgttaagtgt

SEQ ID NO: 129172 - DNA, 804 bp, Homo sapiens
ggggagagaggctctgggttgctgctgcttctgctgctgctgctgctgtgtggctgtttctgtacactcactggcaggcttggtgccggctccctcgcccgcccgcccgccagcctgggaaagtgggttacagagcgaaggagctcagctcagacactggcagaggagcatccagtcacagagagaccaaacaagaaccctttcctttggcttcctcttcagctcttccagagggcttgctatttgcactctctcttttgaaattgtgttgcttttacttttcacccttctgcttgggttttatgagggctttgttaagtcttagagggaaaagagactgagcgagggaaagagagaggcaaagtggaaaggaccataaactggcaaagcccgctctgcgctcgctgtggatgaaagccccgtgttggtgaagcctctcctcgcgagcagcgcgcacccctccagagcaccccgcggacccgcacctcggcgtggccaccatggtcaggagagttcagccggatcggaaacagttgccactggtcctactgagattgctctgccttcttcccacaggactgcctgttcgcagcgtggattttaaccgaggcacggacaacatcaccgtgaggcagggggacacagccatcctcaggtgcgtcgtagaagacaagaactcaaagcgtggcctggttgaaccgttctggcatcattttgctggacatgacaagtggtctctggacccacgggtcgagctggagaaacgccattctctggcactacaggctcccgcatccagacacc

SEQ ID NO: 129173 - DNA, 1214 bp, Homo sapiens
  misc_feature (1214)..(1214): n is a, c, g, or t
ggggagagaggctctgggttgctgctgcttctgctgctgctgctgctgtgtggctgtttctgtacactcactggcaggcttggtgccggctccctcgcccgcccgcccgccagcctgggaaagtgggttacagagcgaaggagctcagctcagacactggcagaggagcatccagtcacagagagaccaaacaagaaccctttcctttggcttcctcttcagctcttccagagggcttgctatttgcactctctcttttgaaattgtgttgcttttacttttcacccttctgcttgggttttatgagggctttgttaagtcttagagggaaaagagactgagcgagggaaagagagaggcaaagtggaaaggaccataaactggcaaagcccgctctgcgctcgctgtggatgaaagccccgtgttggtgaagcctctcctcgcgagcagcgcgcacccctccagagcaccccgcggacccgcacctcggcgtggccaccatggtcaggagagttcagccggatcggaaacagttgccactggtcctactgagattgctctgccttcttcccacaggactgcctgttcgcagcgtggattttaaccgaggcacggacaacatcaccgtgaggcagggggacacagccatcctcaggtagggctttcgggcaacttttctgctgcgcgcgtctacacgtgtgtgtgtgtgtgtgtgtgtgtttgtgtgtgtgtgtgtgtgtgtgtctgatctccttgaactccagctcctgatgctgcaggcttgtggtgtgtgtgtgtgtggtgtgtgtgtgtgtgtccctgtacaccgacggggggcttatcgctaaccaatatccgggggaatcgggcccttgtcagccgccacggtgtggctacgtgtgcgcgctctgaggaccgtgttctcttatggggacgctaactacccgatgacatgagtgctgtgcccgttcccactatgtcactgcgggccatgccctcgaagttgggcgggcctaatccggacacaaggtggggatatggccccagggtgaccgctgttccctggccccgtgggtggttgtgtttctgcccccacctctacccccctcggggttgggcgcacactgcgactccgcgcaacccacaggtggcctcgcgttacaacgcaagcggtttctcggggtgctcactgtgccgtggtgcacttctctctn

SEQ ID NO: 129174 - DNA, 726 bp, Homo sapiens
accttaggccaatcttcaaagactttgaaatataatattattattatcattattttccaactattctgtttcgagtcaagggtagtgtgtttgaagtttttattcacaataacctcaatttttgttaatgattaatttctagtttttatatctttggttaaagggtgatatctatagtctaccttttatagaattatgactatttcctttataacaaatttgtgaatgtttcatgagcatttaaacagaagatatgctctctgtttcttagcacaaaatttattataaggttattgttattttccccttgtattttatttctggctatttttattttgtatcattcaccattttttttttttggtgcaaaaagcttcatgccagttatatcttaactgatttatatatgtccttaataattgaaagttaccactttttcccatctaatgctatttaatattaaattctatttgtcaatattattatggataatactgtttgcattttttataatgtaaatattatatgacaatattgctgatgttaatatagtgatactaatgttaatattggtatcattaataatgttatattaattattgttacttgcatatttttattgaattattaggtgtagtttggcctatctttagtactcaataattttttttgagaaagttggtattggtttggtatttttaactggtctgaaagctttttataata

SEQ ID NO: 129175 - DNA, 631 bp, Homo sapiens
caaagtgctgggattataggtatgagccaccaaacactgccagaattttaaatatcaggatataggaaaggttttgctttcgttttcaattttgtttttgtcttatggcacggggccaggcagggcaaagggtagattccattgacacttatttttaattttctgcccaagtacgttcccaccattgttcctggtgtttcagaccctctccagggtctgcagagtcttgtttggctggagccccttctactctagtctaatgcccctctgccctaattcctcaactaccaggccgtcactgctttccattacccacaaccatggagaaagctctcatcagctaatgtgccttctccagtttgccacattattacattattgtctggacatacctgtttttttgttgttgttgtttgtttgtttgtttttgagacagggactcgctgtgttacccaggctggagtgtagtgttgccttctcggctcactgcaacctctgcctcccaggttcactcgattctcctgcctcagccccctgagtagctgggattacaggcacctgccaccacgcccagctaatttttgtatttttagtagagatgattttgccatattggccaggctggtttcaa

SEQ ID NO: 129176 - DNA, 569 bp, Homo sapiens
gaacacttaataccttgcttgggcagatagctccagtttgcagaaagtctagacaggataccctgctatgtatctagatttactgagaagaagcggcccaagctaatcagaattttaaagtaggtttctcagctgggcgtggtggctcacacctgtaatcccagcactttgggaggccgaggcaggcagatcacttgaggtcaggggttcgagaccagcctggccaacatggcgaaatcctgtctctactaaaaatagaaaaattagccgggcatggtggcacgcacctgtaatcccagctattcaggaggctgaggtgagagaactgcttgaaccctggaggcggaagttgcagtgagctgagattgtgccactgcactccagcctgggcgacagagcgagactccgtctcaaaaaaaaataaaataaagtaggtttctctatacctttgaattttctgtctcccatgataacctttgggtaaacatgtccatcagaatggaaacaaatcattttttaaaatagaaattattctcatacctattttagtgggaatccccctgagaaga

SEQ ID NO: 129177 - DNA, 509 bp, Homo sapiens
caggagacaggaccactggaatagacgggaggaggtaaagagtaagagtataatgtttctacatcagtatttctccaaatgtgttcaacaaaaatgtatacctcaaaaatatccgcctctatacgctagttcaaatacatgatgttctttctgagcacttcagttccaaaaatattccttagaacaattctcctgtatctaaattcttttcataggttctacgtagtattcttgcacctacaacttcaccagttactcctactaccaggaggcctcctatgggctagaataccactttcaaatttcacaaattcagtggcttaagccttttggcctcctcatgagtaacccatcagggattgtcaacctgtctgtctctttgtctactggatgggactttattttcctacctgcctctctcatgtcatttctgcattaatttctgggacctcttaaccctcttcactttctccaggatcactgtgatgataggttcagaattcctccct

SEQ ID NO: 129178 - DNA, 325 bp, Homo sapiens
aaactgccctcttgttgaggcggtgcacatgagctgggactgcacttggagtttccaggcacattgcagggttggatgatgctcagccgacccaggcctcatctccacatgagtagcatctcatgagtgcacctccacatgcaccctccccgcctcctccctccagtcggtaaaatgtcttagcatctcagattgtcagagttttgtttgtgcaacttcttagctctccttgtgatgtttaatatgcgaagaagccgtgcagatgtcggattccccattgcctgcattatcagtggctagaatgcaatctagttcacagccaaca

SEQ ID NO: 129179 - DNA, 511 bp, Homo sapiens
ttttaagtttagacaagcaactgtggaagttccaagaggtgcactcctgcatcacctcacaaactaacaatcgttgtgaactatgttactgagtaaaagcattctacccctcaggtgtgctgggagcagaaaagagggttaagaaccactgttatatactatcaaattcctctacaaggttagatgagtaacaaagaagcaagttatcaaagtaactgttagaggacactgtgctggaaaggcttttagaagaaattgccactgtctaaattaaaacagtaaaagtacataatctctattagctattttgaaaatgcttatgtagctattagaatccctgaaaatacttatgtttatcttaaaaataatgtattttcacagattccaatgttgacataattctttaataaaattaactggaaaacctagtatttctaaacttttgtaagaatctatcaggaaaagaagagagcttcttttcaagacaaagtaaataagtaaatgactagat

SEQ ID NO: 129180 - DNA, 173 bp, Homo sapiens
ggagtgggagctttacctgccaaaccccagaggctgccttgccagagagcagaggagaatggagatggggcaggggaagcaggcgtcgacccacgaggaaaaatcagagcagaaggaagctctgggatgagtggttgagaccagctgcctctggtgttcacagagggcatggg

SEQ ID NO: 129181 - DNA, 1013 bp, Homo sapiens
agagtgcaagggacatagaaggaagtctttagaacttggatgggagtccaagttctgccacttccaggcctttgtgcattcagccagttacttaagctgtttggcctcagtgtccatatattgcattaacaccgggaataacaatttttaccttacaagattgttaagggaattaaatgagatcatgtgaataaagagcctgccatagagttgcactcaataaacactattttacttccccctgaattccctacctgtacttttggcacatgaaaaaataattaggtagaaataggctggagtccagcaggggaagacaaactaatctttcctggactacatttttacatggataaaaatttttgccactgcaactctaagcagcactcagtatctttgagatattagtgatgtttttctctgatgttcttttagctcctggggtcactgtgggctaagagaggtggagacaggctttgtgcaacgctgccttgtccccctgctcagaggcagatgtgacttaataggaagaatcctagaggccttcagatgctgtagagaagattcatgtttgatgagagagagcctggatgacatgaaagttgttgtttttttccagagaaaaggaaagagacataacattccccctacccgcccaagcatcagcttcctcttctgaactggttgctgtggagattaaaaactttgtacacagcacattgcacacaggcgatacgcggttgttagaatctcattaccattgacaatggctaattatagatgtgaacatctaaatgtgtctgaaggggacagagaagtttggtaaggataacttacaatctttccatcttttgttttgttttgttttgttttgttgtgttttagagagggtcttgcaatgtcgcccaggctggagtgcagtggcatgatcttggctcactgcagcctccacctcccgggttcaaataattttcaaatctctgcctccaaagtagctgggattacaggcacat

SEQ ID NO: 129182 - DNA, 835 bp, Homo sapiens
atctaataagacactaccacatgtctgagctttcctgttagccgaaaaaactgctagtccctggatcttctccctactttccacagcactcaccaaagcaggagccagtaggtcagtgggaacagtctctggactcacttttccagtgagtcccatatattcctttgaagctcttggcatatttttagatgatatattcataacttgcttctccttcaaaattaaatgttctatttagaatggctcttggggatataaatgataattttgaagagcaggatatttgctccctcagatctttccatcattgaagccatttagagagcaatagtagaggcacaaatgattcaggttactgtaatggctcaggtcatggtaaaatgagtgtcttggatgcctttcctctgtgttttatgtttttttaaaatgagatgtcttcatgaccttgtaaatgagagaaagttcaaggggatccgaggtaaatgtctgtcccagatccacagacaactcaagaatttctcaggatgtttctcagtagagatagggagtggctggttggctttgtggcttttcaaatcccttgccttccgctccactaagacctagcagtcctctaaagcctcattcatatttccctcttttcaaaaaaaacgtctgagatcatcctaattggaagtgcccttatgtcctctgaacccttacggtactgaacactcttttgtggcatttgtagttactgctctgtacggtggccttgttcatgagtctctcctcagctaggtcgtcagctccacagtaactgaaactaagtgtgatttcttttgtttcccaccct

SEQ ID NO: 129183 - DNA, 140 bp, Homo sapiens
cgagactttgcctcaagaaaaaacaacaacaaacaacaacaacagaaaaaagttcctatcaaagactttctctttgtacacacacttttaaggtattctgaattcacagacattcatatctaacctaccacagcctctac

SEQ ID NO: 129184 - DNA, 674 bp, Homo sapiens
gatttgtccagtgtcctacagttggttggtgtgaggctggatttgaaaattggggatcttggatcttgactcttcagctctcatcacctcacactgaccccctctccccccgaaacatgagggaatattggaggaaggcattgatgataattgaaagacaaaaatacagaacctcagaggaattattaaaagaactgcacatatgtagttcagaaatctttgagaccctactgtatctaatagtgcttagaatcttcttatataataatattattaatattctataatctagaatagattatagtaggattcgttttatgatgacttgggctgtatctttaagaaaacaaaagattatagcaaaaggagtttagggcaaacataaataaaaattgatactaaaatcgtatgtatgctatttccaaaaaagggaggagggaatatatgagacctttcaagttcctctggtactataattacattttctctcatcttgcttttgattggattagaattcacgcaattaaagataatctagggccaggcacctataatcccagcactttgggaagcagaggcaggaagattgcctgagcccaggattttgagaccagtctgggcaacatggcaagaccccgtctctttaaaaaaaaaaaaaaatctaagtgaaaaat

SEQ ID NO: 129185 - DNA, 401 bp, Homo sapiens
agctctagaggactcgctcgcagctagctgactcaaggaggatacacatcgtcactatactgatgatgaaacacaactgacagataaacttcgctcttgggagccattattagtttcctggggctgccacaacaaaccaccacaaactaggtggcttaaagcaacagacatttatttcttgcggttctggagtctgcaagtctgaaaacaaggcattggcaggaccatgctccctccaaaggctccagggaagaatgcttctttgcctcttccagcttctggtggttgctggcaatccttggcattcttcggtttgtggcagcacaactccagtctttcctctttgctttctcatggccttcctttctgtgcctcctctgtatcgtcaaacctctctctcc

SEQ ID NO: 129186 - DNA, 346 bp, Homo sapiens
atctagatctgttttagaacttgatttctgaggatgatgtaagaatatcacaatgtctggccagacacggtggctcacgcctataatcccagcacttcgggaggccgacgtgggcggatcaagtgactcttgaagtcaagagttcgacatcaacctggccaacatggtgaaaccctatctctactaaaaacacaaaaaattagctgggtgtggtggtggacacctgtaatcccagcaactcaggaggctgagccaggagaatcacttgaacgtgggaggtagaggatcctggagtaagccacgattgcaccactgcactcgagcctgggtgacagagtaagactcc

SEQ ID NO: 129187 - DNA, 516 bp, Homo sapiens
tgcaagagtctaaagtttgcttttttaattgttcattgttaaatcttttatagatcactctggttgggatttgctcacttataaggagaaagtcaccaacagcttgatctattatttttccctcttcaatgtggattaaggtctttttatggatgctttcctgtcattaaaaaatatgtatcctttagacttctttccaaatggaatcatctttgatgctaatatttatactctgtgttgtatgaagaataaaactaagagccccagccacttttgaagatgtgtgtctttacaccagggccagtctctgctgctcctccctgagagccagtcattctttgtaacaatgcattatttcacctgagttgaaggttttcattagtgtgaggaagtagcccttcaacatatggactcatcagattttaattgtactaacttttaaattgactgctaccttattctgtgctgtttatatgcctttatttttccagttcaacttttttttctagtgttctg

SEQ ID NO: 129188 - DNA, 437 bp, Homo sapiens
aagcgtacatgcgggtttcttttaacttctgtgagtttgaaattttgttaaaatttaaaattacaaaaaaaatttcagaaacatagatgggtacttacgtatttagagtaagaaaaattatttcccacctgtcacccccaatttttatcccgagtcgcatataatgatttaaatatttttaaatgcacaggaaatagaaatttttggttaaaatgattgtttgcagaacagatcttcacatttagaacaggagaattgtggtcacatataataacttgaaagatcatcagttattggttcagtcttaaactataggttgagagtccctaatgtgaaaatccaaaatcttaaatgcttcaaaatccaaaattttatgagggctgacatgacaccacaagtggaaaattccacacctgacctcatatgacaagtcacag

SEQ ID NO: 129189 - DNA, 136 bp, Homo sapiens
cttgggcctgttgatgagcagaggtgagtaaaaataaaacagccgtaaccacgaccccaaaccatcctgatttcttcatccctggcaggcacccaggtggaacccagctgaaattgcagctcattagcacggacag

SEQ ID NO: 129190 - DNA, 336 bp, Homo sapiens
tgcatgtacattatctatacatggtatctctatcaaaaacagtgccctgtacatagtgggcacttgactatatctaatagattttctccttgaaaacatgagaacattttagaaaaatttttctgtcaagccaatttttcaacaattacaaaactaaaccaaatttccgcaaatagtttgttctacccaggagaagcttagctgtgtaacagagaaccagtcagaacaaagatgtaatatagtaattagagtactcacaaacaaagccttattttctagaaacataagacatcaaaaaaggccacatgcagagaaaaaatatggctactagatagg

SEQ ID NO: 129191 - DNA, 484 bp, Homo sapiens
ctaaagaacccattcccaaaaagtcatggataaaagaaaagaaactgagcttttaagtgtctcaaaagaggtcggctggaaaataagttcagaagaaaatacattaccacaaacatgaacaatatagcaaacatgagagcaaattacacttagacatttcctttatcagaatttcctttaaattcattccatggccacggcttttcttaggctaactacagtagacatagctcttctattatgatatctcctctgcactttctagtatactttacatcacaacatgagttttctttttcaagcaaggtttagttattgttcccttctgtagctgtgccttcccaaagctaccagttgtcctcaaatcaaattaaaacatctaaacatagggtttcaaggctccataaattcctgggcccaaaccactccagctttatcatcctacagtcaatgcacactggctcacattttctatctatttact

SEQ ID NO: 129192 - DNA, 439 bp, Homo sapiens
atttgcaggaattcaggtggcgggcctttgcatgtttcaaagtcctaggtagcttaagccaggcttagctgcaaggggagagaccctaaggagagaaaaggagaacaagtgataggatgaagaaaggggagagattcagaactggcgctacagggcacgtgaacgtgacaccaattgtgttattgtggattcagaaaaatgactagaataacacactgggaaaaatgttacgaggaacactaggtgttacaaatcctcgagggagatgtgatggcattaagttaaaagaattaggtgagaggtcacaaactctatagtgggctgttgtggtgtctttaacattttaacttaggcactaattaaaaaaatcagcagcagtcgtctgaaaatgtgtggattttttttttttttacatcttttgaaaattcctagtgtgtgg

SEQ ID NO: 129193 - DNA, 573 bp, Homo sapiens
actttgggaggatcacttgaggccaggagtacaagaccagtttgggaaacaaggcaagaccccatctctacaaaaaaatttttttaatgcaaaataagccaggtgtggcagtgcatgcttgaagtcccagctacttgggatgctgagaaaggaggacctcttgagcctaggagttcaaggtttcagcaagctatgatcacgccaccacactccatccagcccacgtagcaggacaagaccttgtttgtttaattctgagtaagaatgttagctttccagcctcagtaagatttatttatttatttggactctgtgatgcaacagtagttggctaacattataatgtaaaaaattaattggtaatgacgaatgatctctaactgattattatttagtagtcagaactaggagatgaagacaagtctataataaaatctggaaattaaaataaacttaatatgaacatatttcctcataatctgtttctcccaaaggtaatactctactttccaaaaataaatgtaaaagttattttaaaaaaactaatttttttttttgagaaggagtctcact

SEQ ID NO: 129194 - DNA, 415 bp, Homo sapiens
agatggatcctagggtcccacatgggaatctgcctgtgtagacgcctgtgttccagccccttggttcactgtctccacctctgggaagagggaagggtccaaggaagaagcagcgcaggaggttcttggagggggcaagacatctgtgtagagagtggggtggtgtgggggaggccagaacccctccctcctgcccttgaggtgctgttcccataaccccaccttggcctcaaggtctgggcgggtaccttgagcttcctgtgggattcttgtaccttggaggcagtgactcacgcgctaggcagcagatctgtgtcatggtctccggccttgcctctgattaaagagggactgatgcggctcgtctgcagcctgggtctgggatgcctcccacactggaacccacctttatccc

SEQ ID NO: 129195 - DNA, 162 bp, Homo sapiens
tctcttacataaaagttgtagagacagtgctgggagttctcatgtacccttcccatagttttctctgatgttaatatcttacataaccatggtacagtgatcaaaaccaagaaattaacattggtacatactattaagctaaacttaaattttatttgaatg

SEQ ID NO: 129196 - DNA, 457 bp, Homo sapiens
tatatctgtataaacaacacaggtttgaactgtgcgaatcttcttacagatgaaacttaagattgttaactaaaaaaaagatggtagaaaattacatatagttttattttatgtcttaaataataataatcaggaaatttggataaatatataaaaagttattagcagccaggcatggtgactcactcctgtaatctcaacactttgggaggctgagacgggcagatcacctgagggcaggagttcaagaccagtctagccaacgtggtgaaactccgcctctactagaaatacaaaaattagctggacgtggcagcacatgcctgtagtcccagctactcatgaggctgaggcaggagaattgcttgaacccgggaggcagaggtttcaatgagtggagattgcgccagtgtactccagctcatcagcctgggtgacagagagagactccgtccca

SEQ ID NO: 129197 - DNA, 427 bp, Homo sapiens
agactcaactttagtgattaggagccctggctcctaatagtcagcctgggttcagatccaaggtgtggcagttctagctaggtgtccttggacatgttatttaataatcctaagactagttttagttttatcatctgaaaagtgagatacctgctacatagggttgttgtggagaataagtgatacagtgtatgtgagtctcagtgtagtgcctgtttcagagtaagttattctggctccggatcccttgctttacactagtttagatcccatctcgttcaagtgataaaagtcaagagaggctgggcgcggtggctcatgcctgtaatcccagaactttaggaggctgaggctggcagatcacttcagtccaggagttcaagaccagccctggcaacatagtaagactccatctgtacaaaaaaaa

SEQ ID NO: 129198 - DNA, 140 bp, Homo sapiens
tccagaagcagtgactgctattgcatgaagaccacagtatctattttgtgagccaatcaaaagggaccctccctctggcctttcccttcctcgtcagggctgggtccacacaggagagtcccaagaacaaccaaggttct

SEQ ID NO: 129199 - DNA, 153 bp, Homo sapiens
taatgaccttggcttggggtgtagtactataagctattatccgtccttaatacctcactttctaacacaacagagaaaagcttgagataagagggaaaatgaccaatagacagggagtggtaggcagtggggaatgtaactgtccttggaggt

SEQ ID NO: 129200 - DNA, 448 bp, Homo sapiens
caaaaagagggaagaaaaagggaaagagttttctttctaccccttctctccaccaggatatgggcctttggaaagaaggttagggtgtgttttctctggattcgttgtggagtgttactttcatcaataacttcttgttatatttagccagtcaacagctcaaagagcctaccagaaccgtcagaaggagtgtgtgaggggaatactctcgaactctagtctgtcttgaagtaattcagtctaaatttctttttttctttttttgaaacggagtctcactctgtcgcccaggctggatacagtggcgtgatctcagctcactgcgacttctgcctcctgagttcaagtgattcttctgcctcagcctcccgagtagctgggattacaggtgactgccaccaagcctggctagtttaatttttgtatttttagtagagacaggtttcac

SEQ ID NO: 129201 - DNA, 663 bp, Homo sapiens
gcattggcattcttatagagcttcccagggtgaagtgtatactgatgcctgcaaatcactttgaaatgcatcaaaaataagatgaattaatgcatggatagagagatggatagatttgtgagaaaacaagtataatgaaaggtcagtttagaatctggctgttgggactatgggtactcactatacaactttttgaactttaatatatgtctgaaaaattttaaaacagaacttcagggagagaaaatttccaagatgttgtggatatacagccaagtttggggaccactctgaatcattgatatagaataagatcaaggtgggaccaagaggccaaaaaagaaaagaattttactctaaaaaaaaaagcagaactttgccaaaagaaaaaaaaaaaaaaaaaaaaaaaattttttggggccggcttcgggccatgagaaagtttttaagcccttccgttgtggccggcggcgcgcccaagaggttattggaaacttggccaaaggctggcccaaagggaaaccgtgggctagaactatggcggtgggtttcctcaccattaaaaacgccggggaaccggctgttctgaacatcccgtggcgtcggaggctaccggtcttcaacgggttccacggagtcaatataccgcggcgggagagggag

SEQ ID NO: 129202 - DNA, 397 bp, Homo sapiens
ctcaagtgatatgcctgccttggtctcccaaagtgctgggattataggcatgagccaccacacccagcctagattgctttaaattatagaagtagtaaatgtgtatttcatgaacaaatttaaataccaaagggatatgaaatgaaaaagataaagatcatttttcttttctcctctccatccagttctccagaggacaccgttaagtttcttgtgtaaagagagagaggtgatttagacagatacactcttaagtttgaatgtttctgttaaactacagtttaattataactttcagaaaatcatgaatgctcctctttgtgcaggataaagacagctggtaatccagccaagtctcccgttgctaccatatttttagtatttgataccacagaaa

SEQ ID NO: 129203 - DNA, 885 bp, Homo sapiens
agtggtggtgctcacctgcagtcccagctactggggaggctgagacacgagaatcgcttgaacacaggagatggaggttgcagtgcaccgaggtcgggccactgtactccagcccgggtgacagagcgagactctgtctgaaaaaaacaaaaaatgcaattctgaataccgcttccttatcagaaggtcactaaagaagcacaatcacggactagtttgggggaaaacacgggacttccactgggcaggtgcagtccaataaagaaatctactgtaaagcactgaatttacaactcgatttgctggacattgttttagaaaagcaaatccacattaaacaccatgactgcattttgttgttgtcagactttaagcctaaaataactatgtcaaagagtgtggcaaagaatgaagtactcaatcaataccttgctaatgacagttcatacctgggcccctgatgaaatacatcagtccacgtggattgactgggctatagttactaaagtatcaacttggatagatactaagttggctatttaatgtaggttttatatctttttcagctttaattattttttaaatcaggggaaaaaaacttcaaaactcttaaactttttctgaatagactgttagcatgaaaaatctatcactttaacattaaaatatgacttttcttcctttatctgactgctctactacatatgcccagtaaatacattcctggatcccccaaagcacataggagagtatatacagggcttcttccctatgtgtgtgtgttgcggggggtgggcgggggagattttagggctcaaagggaggaaatatactttgcattcttttttcattcaaaaaactgtatttcaaaaaaatttttttaac

SEQ ID NO: 129204 - DNA, 632 bp, Homo sapiens
gcgaggcgactctaaggatctccaaacaccgcatctaatctgcccaaacttctattctccatctcctaaacaaggggttacagtgtgtgatttctaaggttctgcctaagttccacatattaaaattttatatcaacaaaaaccaccacactgataaaatgaaagaaatcattataaagcattttattcacttaatgaagtaatctggagttcacatataattacatttttaagaaacacatttctgtacttgctttagttctcaatcagttgtttcaaagaaagaatgaaagctttagttaccaagagaatttactgaaattataccgtatgattcaggagaatgctttggtccctgacccctcctcctcttcctcaaatctttcaaagaacaaagtacaccaagagcagcattcagcctttgtgcttttgtgttcccttctcactggaattgtcaacctggtcctccacaccctgcacatctccatcacccgtctccgtgtaaaccaacattttcaatgctgtattcattttcaggctataaaatcgaggagaacaggaattgtgcctttgtttctcactgaaaccccagaatgcagtatagtgtccggcacacagtgaccattcagtat

SEQ ID NO: 129205 - DNA, 176 bp, Homo sapiens
ggccacggcatgtggatggatattagtttgagttttaaaaactcgactgaaaaggtggctcaagtctgtaatcccagcactttgggaggccgaggcaggcggatctcctgagatcgggagtttgagaccagtctgaccatcatggtgaaacgccatctctgctaaaaatacaaaaa

SEQ ID NO: 129206 - DNA, 484 bp, Homo sapiens
gaccccgtgattcactcccttcagcctcccaaagtgctgggattacaggtgtgagccactgcgcctggccaattttttttgtatttttagtagagacggggtttcaccatgttggccagactggtctcaaactcctgacctcaggtgatccgcctacctcggcatcccaaagtgctgggattacaggcgtgagccactgtgcctggcctatatacattcctttagtacatactcgccctaagctattataattattaaacaaatcattggagggaaaaggagttgccaacagcagcaaagagtgtacattgtataataaagccttgtgtcaggagtgtttaattggcaacataggaaacatttttaaaagccaagagtcaggagctggttttttaaaaaactaaacgtcttagggaaggaactctttttccatcaaggaatgaatgttgggttgagtgggtaaaggaaatgtgtcatatacatg

SEQ ID NO: 129207 - DNA, 166 bp, Homo sapiens
ggagatttcagaaaggaaaggtcagccacaagcctagcatttgctatcagccatctgccaagcaggaagtgctactcagatctatttttaatcatcttccccaggctagggcttctgggaaaattcagaggccagggttattccaagacaaacatttaattgctac

SEQ ID NO: 129208 - DNA, 1296 bp, Homo sapiens
ctcagaagcacgtgcgccttacgtaatagcgggttattcttcggtttgcctcctcccagtggcgtggatttgctcccgacccgcttttggggcgtgcctgcttcctcctctctgttagatgagccccagagaggcgaagccacttgagctcgtgagtgacagtcagatgtcaagccctgctctttctaaagcgtgctgccttcagaaaagaagagccagaaggatggaaattacttcagaaagatgaataccagctttgaaggaataaaagctgacgaggaattgaaggagttgaggcacgagcttgaacagggttgcatgtttggcccttgattgtaaatgcccattgctgcacctgttcctgttacttggggagttgcagcagaaggaacagcggcctgggactccagagaactgggttccctctcatccctccagggccaccacttcttgtgggcccttgggcaagtcactgtactttctgagtctcagtttccccatttgcagaatggaaataactaccccggtctaccaacttagaagaattgctttgaggatctgataaggtggtgtggatgatgctgccttgggggctttacagtctggagctcaagggaccccttaagttgggcttacttagtaactccaggggtgggcagaacaggactccaatgagggtttattctttttcccttttttttcttttcctatctcttaacttttatctttattattttacaatgcccttgtaagatgaaacaagtgatgctgaaatatcttttctttttaacctttattttagaattggggtacatgtgcaggtttgttacataggtacagtgtgggctgctgaggtttgggagtacgaatgaattagtcaccccagtggtgagcatagtgcccgataagtggttttttcaacccttactcccatccctctccattcttgtgttccccagtgtctgctgttcccatttttatgaccatgtgtactcaatgtttagctcccacttagaagtaagaacatgcccagcactttgggaggccgaggtgggtggatcatgaggtcaagagatcgagaccatcttggctaacaaagtgaaaccctgtctctactaaaaacataaaaaattggccgggtgtggtggtgggcacctgtagtcctagctactcgggaggctgagacaggagaatcgcctgaaccggggaggtggaggttgcagtgagctgagattgtaccactgcactccagcctgggtgacagagtgagactccatctcaaaaaaataaaaataa

SEQ ID NO: 129209 - DNA, 1412 bp, Homo sapiens
ctcagaagcacgtgcgccttacgtaatagcgggttattcttcggtttgcctcctcccagtggcgtggatttgctcccgacccgcttttggggcgtgcctgcttcctcctctctgttagatctcgctctgtcacccaggctggagtgaaatggcacaatcttggctcactgtaacctccgcccccaggttcgactgattctcgtgcctcagcctcctcagtagctgggattacagatgagccccagagaggcgaagccacttgagctcgtgagtgacagtcagatgtcaagccctgctctttctaaagcgtgctgccttcagaaaagaagagccagaaggatggaaattacttcagaaagatgaataccagctttgaaggaataaaagctgacgaggaattgaaggagttgaggcacgagcttgaacagggttgcatgtttggcccttgattgtaaatgcccattgctgcacctgttcctgttacttggggagttgcagcagaaggaacagcggcctgggactccagagaactgggttccctctcatccctccagggccaccacttcttgtgggcccttgggcaagtcactgtactttctgagtctcagtttccccatttgcagaatggaaataactaccccggtctaccaacttagaagaattgctttgaggatctgataaggtggtgtggatgatgctgccttgggggctttacagtctggagctcaagggaccccttaagttgggcttacttagtaactccaggggtgggcagaacaggactccaatgagggtttattctttttcccttttttttcttttcctatctcttaacttttatctttattattttacaatgcccttgtaagatgaaacaagtgatgctgaaatatcttttctttttaacctttattttagaattggggtacatgtgcaggtttgttacataggtacagtgtgggctgctgaggtttgggagtacgaatgaattagtcaccccagtggtgagcatagtgcccgataagtggttttttcaacccttactcccatccctctccattcttgtgttccccagtgtctgctgttcccatttttatgaccatgtgtactcaatgtttagctcccacttagaagtaagaacatgcccagcactttgggaggccgaggtgggtggatcatgaggtcaagagatcgagaccatcttggctaacaaagtgaaaccctgtctctactaaaaacataaaaaattggccgggtgtggtggtgggcacctgtagtcctagctactcgggaggctgagacaggagaatcgcctgaaccggggaggtggaggttgcagtgagctgagattgtaccactgcactccagcctgggtgacagagtgagactccatctcaaaaaaataaaaataa

SEQ ID NO: 129210 - DNA, 1566 bp, Homo sapiens
ctcagaagcacgtgcgccttacgtaatagcgggttattcttcggtttgcctcctcccagtggcgtggatttgctcccgacccgcttttggggcgtgcctgcttcctcctctctgttagatctcgctctgtcacccaggctggagtgaaatggcacaatcttggctcactgtaacctccgcccccaggttcgactgattctcgtgcctcagcctcctcagtagctgggattacagagttttacacctggaactcctgggtgggaaggtataaaccgtttaaagtctccggcaacacactaataaattgcttcaaaggaaagttctcaaccgttactctcagcagtgtgtgtattagggccatcctcaccacaccctttcaggtagcgagatgagccccagagaggcgaagccacttgagctcgtgagtgacagtcagatgtcaagccctgctctttctaaagcgtgctgccttcagaaaagaagagccagaaggatggaaattacttcagaaagatgaataccagctttgaaggaataaaagctgacgaggaattgaaggagttgaggcacgagcttgaacagggttgcatgtttggcccttgattgtaaatgcccattgctgcacctgttcctgttacttggggagttgcagcagaaggaacagcggcctgggactccagagaactgggttccctctcatccctccagggccaccacttcttgtgggcccttgggcaagtcactgtactttctgagtctcagtttccccatttgcagaatggaaataactaccccggtctaccaacttagaagaattgctttgaggatctgataaggtggtgtggatgatgctgccttgggggctttacagtctggagctcaagggaccccttaagttgggcttacttagtaactccaggggtgggcagaacaggactccaatgagggtttattctttttcccttttttttcttttcctatctcttaacttttatctttattattttacaatgcccttgtaagatgaaacaagtgatgctgaaatatcttttctttttaacctttattttagaattggggtacatgtgcaggtttgttacataggtacagtgtgggctgctgaggtttgggagtacgaatgaattagtcaccccagtggtgagcatagtgcccgataagtggttttttcaacccttactcccatccctctccattcttgtgttccccagtgtctgctgttcccatttttatgaccatgtgtactcaatgtttagctcccacttagaagtaagaacatgcccagcactttgggaggccgaggtgggtggatcatgaggtcaagagatcgagaccatcttggctaacaaagtgaaaccctgtctctactaaaaacataaaaaattggccgggtgtggtggtgggcacctgtagtcctagctactcgggaggctgagacaggagaatcgcctgaaccggggaggtggaggttgcagtgagctgagattgtaccactgcactccagcctgggtgacagagtgagactccatctcaaaaaaataaaaataa

SEQ ID NO: 129211 - DNA, 1885 bp, Homo sapiens
gtgagtaggcgtcattcttcacagtagtcctctgcctccaccgccccgggatctccttgcgctcggtcctctacgtggagtcacctatgcagaggaattccacggggcgggggcgaggacagggtgcgggggtctttatggcagacaatccccggctgagcgcttggccagagtttctgtgatgctagaatctggactgcctgcgacctctccgggactcggacaccagccctcgcctcctggtgatcttttaggtcctgcagagaagtgaagagatctcgctctgtcacccaggctggagtgaaatggcacaatcttggctcactgtaacctccgcccccaggttcgactgattctcgtgcctcagcctcctcagtagctgggattacaggatggagagtaaaggaggtaaaggaggactctgatgcctcagccatgcgcctgtgtgccgattcccattaagcctgcaccaatttgatttccaagactccagtcaatcctcagagctccaggaggggaggggcagcttttcctggtagctgctgatcaccagcagagggagccctaggactgcagggcctctttccttaccgttggtgaagcccttcactgtggcttcaaaactgtggaagacccgggatttgtggatcacttgcctttagaatagaatcaagaaataaagctgcagaagaaagaatctccatgtgatgagccccagagaggcgaagccacttgagctcgtgagtgacagtcagatgtcaagccctgctctttctaaagcgtgctgccttcagaaaagaagagccagaaggatggaaattacttcagaaagatgaataccagctttgaaggaataaaagctgacgaggaattgaaggagttgaggcacgagcttgaacagggttgcatgtttggcccttgattgtaaatgcccattgctgcacctgttcctgttacttggggagttgcagcagaaggaacagcggcctgggactccagagaactgggttccctctcatccctccagggccaccacttcttgtgggcccttgggcaagtcactgtactttctgagtctcagtttccccatttgcagaatggaaataactaccccggtctaccaacttagaagaattgctttgaggatctgataaggtggtgtggatgatgctgccttgggggctttacagtctggagctcaagggaccccttaagttgggcttacttagtaactccaggggtgggcagaacaggactccaatgagggtttattctttttcccttttttttcttttcctatctcttaacttttatctttattattttacaatgcccttgtaagatgaaacaagtgatgctgaaatatcttttctttttaacctttattttagaattggggtacatgtgcaggtttgttacataggtacagtgtgggctgctgaggtttgggagtacgaatgaattagtcaccccagtggtgagcatagtgcccgataagtggttttttcaacccttactcccatccctctccattcttgtgttccccagtgtctgctgttcccatttttatgaccatgtgtactcaatgtttagctcccacttagaagtaagaacatgcccagcactttgggaggccgaggtgggtggatcatgaggtcaagagatcgagaccatcttggctaacaaagtgaaaccctgtctctactaaaaacataaaaaattggccgggtgtggtggtgggcacctgtagtcctagctactcgggaggctgagacaggagaatcgcctgaaccggggaggtggaggttgcagtgagctgagattgtaccactgcactccagcctgggtgacagagtgagactccatctcaaaaaaataaaaataa

SEQ ID NO: 129212 - DNA, 1569 bp, Homo sapiens
gtgagtaggcgtcattcttcacagtagtcctctgcctccaccgccccgggatctccttgcgctcggtcctctacgtggagtcacctatgcagaggaattccacggggcgggggcgaggacagggtgcgggggtctttatggcagacaatccccggctgagcgcttggccagagtttctgtgatgctagaatctggactgcctgcgacctctccgggactcggacaccagccctcgcctcctggtgatcttttaggtcctgcagagaagtgaagagatctcgctctgtcacccaggctggagtgaaatggcacaatcttggctcactgtaacctccgcccccaggttcgactgattctcgtgcctcagcctcctcagtagctgggattacagatgagccccagagaggcgaagccacttgagctcgtgagtgacagtcagatgtcaagccctgctctttctaaagcgtgctgccttcagaaaagaagagccagaaggatggaaattacttcagaaagatgaataccagctttgaaggaataaaagctgacgaggaattgaaggagttgaggcacgagcttgaacagggttgcatgtttggcccttgattgtaaatgcccattgctgcacctgttcctgttacttggggagttgcagcagaaggaacagcggcctgggactccagagaactgggttccctctcatccctccagggccaccacttcttgtgggcccttgggcaagtcactgtactttctgagtctcagtttccccatttgcagaatggaaataactaccccggtctaccaacttagaagaattgctttgaggatctgataaggtggtgtggatgatgctgccttgggggctttacagtctggagctcaagggaccccttaagttgggcttacttagtaactccaggggtgggcagaacaggactccaatgagggtttattctttttcccttttttttcttttcctatctcttaacttttatctttattattttacaatgcccttgtaagatgaaacaagtgatgctgaaatatcttttctttttaacctttattttagaattggggtacatgtgcaggtttgttacataggtacagtgtgggctgctgaggtttgggagtacgaatgaattagtcaccccagtggtgagcatagtgcccgataagtggttttttcaacccttactcccatccctctccattcttgtgttccccagtgtctgctgttcccatttttatgaccatgtgtactcaatgtttagctcccacttagaagtaagaacatgcccagcactttgggaggccgaggtgggtggatcatgaggtcaagagatcgagaccatcttggctaacaaagtgaaaccctgtctctactaaaaacataaaaaattggccgggtgtggtggtgggcacctgtagtcctagctactcgggaggctgagacaggagaatcgcctgaaccggggaggtggaggttgcagtgagctgagattgtaccactgcactccagcctgggtgacagagtgagactccatctcaaaaaaataaaaataa

SEQ ID NO: 129213 - DNA, 1453 bp, Homo sapiens
gtgagtaggcgtcattcttcacagtagtcctctgcctccaccgccccgggatctccttgcgctcggtcctctacgtggagtcacctatgcagaggaattccacggggcgggggcgaggacagggtgcgggggtctttatggcagacaatccccggctgagcgcttggccagagtttctgtgatgctagaatctggactgcctgcgacctctccgggactcggacaccagccctcgcctcctggtgatcttttaggtcctgcagagaagtgaagagatgagccccagagaggcgaagccacttgagctcgtgagtgacagtcagatgtcaagccctgctctttctaaagcgtgctgccttcagaaaagaagagccagaaggatggaaattacttcagaaagatgaataccagctttgaaggaataaaagctgacgaggaattgaaggagttgaggcacgagcttgaacagggttgcatgtttggcccttgattgtaaatgcccattgctgcacctgttcctgttacttggggagttgcagcagaaggaacagcggcctgggactccagagaactgggttccctctcatccctccagggccaccacttcttgtgggcccttgggcaagtcactgtactttctgagtctcagtttccccatttgcagaatggaaataactaccccggtctaccaacttagaagaattgctttgaggatctgataaggtggtgtggatgatgctgccttgggggctttacagtctggagctcaagggaccccttaagttgggcttacttagtaactccaggggtgggcagaacaggactccaatgagggtttattctttttcccttttttttcttttcctatctcttaacttttatctttattattttacaatgcccttgtaagatgaaacaagtgatgctgaaatatcttttctttttaacctttattttagaattggggtacatgtgcaggtttgttacataggtacagtgtgggctgctgaggtttgggagtacgaatgaattagtcaccccagtggtgagcatagtgcccgataagtggttttttcaacccttactcccatccctctccattcttgtgttccccagtgtctgctgttcccatttttatgaccatgtgtactcaatgtttagctcccacttagaagtaagaacatgcccagcactttgggaggccgaggtgggtggatcatgaggtcaagagatcgagaccatcttggctaacaaagtgaaaccctgtctctactaaaaacataaaaaattggccgggtgtggtggtgggcacctgtagtcctagctactcgggaggctgagacaggagaatcgcctgaaccggggaggtggaggttgcagtgagctgagattgtaccactgcactccagcctgggtgacagagtgagactccatctcaaaaaaataaaaataa

SEQ ID NO: 129214 - DNA, 1471 bp, Homo sapiens
gtgagtaggcgtcattcttcacagtagtcctctgcctccaccgccccgggatctccttgcgctcggtcctctacgtggagtcacctatgcagaggaattccacggggcgggggcgaggacagggtgcgggggtctttatggcagacaatccccggctgagcgcttggccagagtttctgtgatgctagaatctggactgcctgcgacctctccgggactcggacaccagccctcgcctcctggtgatcttttaggtcctgcagagaagtgaagaggtattggacgtggccaggatgagccccagagaggcgaagccacttgagctcgtgagtgacagtcagatgtcaagccctgctctttctaaagcgtgctgccttcagaaaagaagagccagaaggatggaaattacttcagaaagatgaataccagctttgaaggaataaaagctgacgaggaattgaaggagttgaggcacgagcttgaacagggttgcatgtttggcccttgattgtaaatgcccattgctgcacctgttcctgttacttggggagttgcagcagaaggaacagcggcctgggactccagagaactgggttccctctcatccctccagggccaccacttcttgtgggcccttgggcaagtcactgtactttctgagtctcagtttccccatttgcagaatggaaataactaccccggtctaccaacttagaagaattgctttgaggatctgataaggtggtgtggatgatgctgccttgggggctttacagtctggagctcaagggaccccttaagttgggcttacttagtaactccaggggtgggcagaacaggactccaatgagggtttattctttttcccttttttttcttttcctatctcttaacttttatctttattattttacaatgcccttgtaagatgaaacaagtgatgctgaaatatcttttctttttaacctttattttagaattggggtacatgtgcaggtttgttacataggtacagtgtgggctgctgaggtttgggagtacgaatgaattagtcaccccagtggtgagcatagtgcccgataagtggttttttcaacccttactcccatccctctccattcttgtgttccccagtgtctgctgttcccatttttatgaccatgtgtactcaatgtttagctcccacttagaagtaagaacatgcccagcactttgggaggccgaggtgggtggatcatgaggtcaagagatcgagaccatcttggctaacaaagtgaaaccctgtctctactaaaaacataaaaaattggccgggtgtggtggtgggcacctgtagtcctagctactcgggaggctgagacaggagaatcgcctgaaccggggaggtggaggttgcagtgagctgagattgtaccactgcactccagcctgggtgacagagtgagactccatctcaaaaaaataaaaataa

SEQ ID NO: 129215 - DNA, 902 bp, Homo sapiens
ctcagaagcacgtgcgccttacgtaatagcgggttattcttcggtttgcctcctcccagtggcgtggatttgctcccgacccgcttttggggcgtgcctgcttcctcctctctgttagatctcgctctgtcacccaggctggagtgaaatggcacaatcttggctcactgtaacctccgcccccaggttcgactgattctcgtgcctcagcctcctcagtagctgggattacaggatggagagtaaaggaggtaaaggaggactctgatgcctcagccatgcgcctgtgtgccgattcccattaagcctgcaccaatttgatttccaagactccagaggggaggggcagcttttcctggtagctgctgatcaccagcagagggagccctaggactgcagggcctctttccttaccgttggtgaagcccttcactgtggcttcaaaactgtggaagacccgggatttgtggatcacttgcctttagaatagaatcaagaaataaagctgcagaagaaagaatctccatgtggctcctcttttcttgccggtctgctgaccctcaggggccatgccttggctgtcttctcatctcacattcacttccaggatgatgccgggttggagaatatggaaaacaaatctgacttgctcgagtgaaaaaggaatccactagaagaatgtcagaaagctcactcaacaaaaggaaaagctaaacagctaggccttatcagcctgggagccagaccgagcccttcccaggtgccaggaatctctgagcattgcctcaggcgattcagttccacacatctttgttcctgatacatctctccgtacaagattcaaattcccaggaaagaaactgattggctttcatggcagggtcatatttgacccactccta

SEQ ID NO: 129216 - DNA, 1079 bp, Homo sapiens
gtgagtaggcgtcattcttcacagtagtcctctgcctccaccgccccgggatctccttgcgctcggtcctctacgtggagtcacctatgcagaggaattccacggggcgggggcgaggacagggtgcgggggtctttatggcagacaatccccggctgagcgcttggccagagtttctgtgatgctagaatctggactgcctgcgacctctccgggactcggacaccagccctcgcctcctggtgatcttttaggtcctgcagagaagtgaagagatctcgctctgtcacccaggctggagtgaaatggcacaatcttggctcactgtaacctccgcccccaggttcgactgattctcgtgcctcagcctcctcagtagctgggattacaggatggagagtaaaggaggtaaaggaggactctgatgcctcagccatgcgcctgtgtgccgattcccattaagcctgcaccaatttgatttccaagactccagtcaatcctcagagctccaggaggggaggggcagcttttcctggtagctgctgatcaccagcagagggagccctaggactgcagggcctctttccttaccgttggtgaagcccttcactgtggcttcaaaactgtggaagacccgggatttgtggatcacttgcctttagaatagaatcaagaaataaagctgcagaagaaagaatctccatgtggctcctcttttcttgccggtctgctgaccctcaggggccatgccttggctgtcttctcatctcacattcacttccaggatgatgccgggttggagaatatggaaaacaaatctgacttgctcgagtgaaaaaggaatccactagaagaatgtcagaaagctcactcaacaaaaggaaaagctaaacagctaggccttatcagcctgggagccagaccgagcccttcccaggtgccaggaatctctgagcattgcctcaggcgattcagttccacacatctttgttcctgatacatctctccgtacaagattcaaattcccaggaaagaaactgattggctttcatggcagggtcatatttgacccactccta

SEQ ID NO: 129217 - DNA, 387 bp, Homo sapiens
gggcccctctcagattctctgcccgaaggtccctcattgttaccttcatccctaccaaacatagtttccaggcggaaactcaagagtttttgtatcccagcaatcctgtccaggacctgagccagggctctctgtgcttccagttcactctggtctcattttgactgaataggaaggcaaggggaatggacattagcctggggcctagtacctgtacactccccacggctcctttggtccctgacacccccagggcccaggaacagattactactaagggcttggctgtcactgactcccagcctcgtatctatctgcctgggaggggacttggcgagtgtctgggacacagggtgatggtagtaaagtggccctttctcccaggga

SEQ ID NO: 129218 - DNA, 721 bp, Homo sapiens
gactctgggcatggatttgggcagttaattagacagagcagctaaatcaagtgacatattttcctttaattgctcctaactagaataagaggatgatttgcgtcctgatttttatgaacttttgcattctttctcaagttctaaattcattgagtaaatccttcagaacatttgaccttgtattatgggttttgtggtttaaatttcccatgaagttaattataccatggacagtattggggtgaaagtatagtccctaagatcatgtttaaaatgttttgtctcagaattttaataccccttttggcctgtaaacactttgtagcaccatgataagcaaagacagtatttgatgcaggtcagttttaagtgggagaaggaggagtctctttaatttagagaggcttactacaggacatttcactgaacaattggttatcccaattgcgttttctagaggtttttttttttttggctttccctcaagttgtgttgtgtactgtgcaagaatacgaataggcaagagcgagtggagacggcctgtaataggcttccagttaagctcttaatttacgctggttgtctttatcggccaacgctcccacgtcgttatctgtgagagaatggagaagaaaaaatggcattctattttttgcaccctcttctccttgtgatcttacatcttcacttaaaagcaatcaggtgcgcaggtgaagagata

SEQ ID NO: 129219 - DNA, 354 bp, Homo sapiens
cgcggacatattactgacgtatagtatcgtggatattcctgaaaaaaggcgcgccgctcgatactcaatacgtgtaacaccgagtgtagggaagtacaacaaaggaaataaacagggttctgcaggtaggatgaagctgggcagtgggcaggccaaaggtagctgaggcctgaaggatgagaaagaggcatgtgtggaaagattgtgggaacagtgtttcaggtagatggaatggcaacagcagatgtcctgaggctggggagagcttgtgggtgttggcaacaggccgtatggctggagtctggcgaatggcggacaagagtggacgagaggaggtggaagatggggacagga

SEQ ID NO: 129220 - DNA, 494 bp, Homo sapiens
cacaacgtgacaatgagttcctcagttacatttctgagcacctgccaaatgccagggataacgctgggtgctgtgctgtcaacgacaaagaagatacggtcctacccctaaaaagcgacggtgggaggcatgtgaacaggtcgtcactgtccataggatcgaactgcgactgccttccagcacgcatgcttctggagaatagaggagaggaactcgcttctgcttggaggaacaggagcagggaacactggaggctccaagtaaagaatgagtaggtgcgtcccaggcaggaaagggatgggaggggaatggcaatgtgaagggagcaattgcaaaggctgaagtccagatgaggtcaaatgtgcttggggagaggcaagggtgtgtgtgtgtgtgtgtgtgtgtgtgatggttaacataagaaaagaagtttaagaaataagaagcctctagattgtgacgggctttttcttccatgctaaggactgtggtct

SEQ ID NO: 129221 - DNA, 284 bp, Homo sapiens
acatagggacgagctcaccacacaacaaccaagggtggggataccagtcaggtactgcggaaaacactggacatgaggtagaccaggtgcaccaggtccaggtgctgatgagaggtggagagtgggagacagggtcagtgagccacaggccagtccctaggctgagggcaatatgacaacaggacattggccaacttccagctgtcatcactgtctgtgtttcattttcacagttcgattaataaatgctctatattcagggatgcctgcggccttatttcttg

SEQ ID NO: 129222 - DNA, 378 bp, Homo sapiens
ggcttgcttaatgggttcatgaacaaagtggctatggcaacaggtatagcttctacatggcacaggtgtcctgccactaatcttccaatttttccttgcaagcttttgaacaaaattgactttctttcaccaaaacttgtctggcgactgggctactggcactgttgaatattcagcctgttcacaaaaaagaccaattgcaaatcccaaaaaaaagcttcattctccagaggaaaccaaccagtctcttagtgtcaggttgattacagtaggcctcttccatcatggaggaggcatcaattttttttttttacagtagttttaagtattttaggtatggttttgtctattatatttttaccaatattaccattctta

SEQ ID NO: 129223 - DNA, 167 bp, Homo sapiens
tgtgctgctgtctggtagttaactctttgaatccaagcataagacattaacccacattaaattagagtggcgattgtgaaagccattaagtgaggagaagctaatgaacaaagacattatgaaatagcactttttgctcaggcctttttctggcctgcaggtatgaa

SEQ ID NO: 129224 - DNA, 581 bp, Homo sapiens
tcaaaaggatgatataattaatatgtaaaatagtaataaatgaacatgatgatagcatcagtaagttcaaactttcttttgttattcttgaaattggcttattttgaagccagcttttaaaccagtccatttccagaataataataagtaaactaatgaatattagtatacaaatatgtaactatcagtgatctgtgtgtcagtgatgatcctttttgcctgacgcatacttgctatatttacttttttgtggatgattcacagtagttttgtataactagtgatgaaaatatgcttgcctttatttttattatgacaatttttttcaaattttgtgtgtagaatacagaaatagatatatcagttatatcttttggtaattacagttgacccttgaacaacataggagtgccaagccctctgtgcagttgaaaacccacataccactttcgactccctcaaaacttaactgccaacagcctactattgacaggcagccttaccaaaaacataaacagtcaattaacacatattctgtatgttctatatattatatactgtactcttacagtaaagtaagc

SEQ ID NO: 129225 - DNA, 581 bp, Homo sapiens
gggattacagatgcgtgccaccacacctgcttaatttttgtatttttagtagagacgggtttcaccatgttggtcaggctggtctcgaactcctgacctcaagtgatctgcttgccttggcctcccgaattgctgggattacaggtgtgagccactgcacccggctttttatttttttaaatttatttttattttttatttttaatgatgactacactggtttgaggaggaagagagaagaaatacagtatatatttgagtggcacatcctgaggaggctgcctgacatggggcagagagcatgctttatttatttattattaattaattaatttatttatttttatgagacagagtctcactctgtcacccaggctggtgtgcagtggtgtgatcttggctactgcaacatctgcctcccaagttcgagcaattctcgtgcctcagcctcctgtggtcccagctgctctggaggccgaggcaggagaatcgcttggaccctggaggcggaggttgcggtgagccgagttcatgcattgcacttccagcctgggcaaacaaagggcgaaagtccgaccccc

SEQ ID NO: 129226 - DNA, 745 bp, Homo sapiens
ggctgcctccctgaagccgagcttttgggggtctccacccactgccatcccaggggaagaaagctctgagcttggggtcatgcttacagggtcaggggctgctctcaggatcccctcccaccctcttccttaatcttatgtgcccatccctctcactcccctcaccccacttacaactcttcaacttacaccacctcaactctattccccagccccatgtcctgactcagtcattgtcacactgggtgattttgagcatctcactgagcaggacttcagtttctccatctgaaaatgggagtgatctcaactaccctgttcacaggagggaaaataaaatcatgaggatgagaaatgtttagggaggttataggctatggggacctccaagggctccccacatggaggttctgggggtctggacagaaccctggtgcttcggagctgagctcagcctctgcttcctccagggtggtagaagatgccactgaagtggaggtgtctgactcaaaagctgcctcagagctgtacttgcaggccaccgcaggtgaaggcaggtgagggcaggagagtatctgtcaccccatccccgctaggcatttggcctgagtccaccctttcctccacagggcctgctgtctgctcactctcaccatgtcctgcccagggcctgaccctcctgaggggcccgggacccagcgtgtgtggcaaggggctctacggatcctacagctcccaggagccc

SEQ ID NO: 129227 - DNA, 455 bp, Homo sapiens
aggagggccccctgcttggctgggaccacgaggttccagaggcccccaggtgaaatcgcctaagggagcggcccatgacagggacaatctgctctgctctctgctttcgtccacttggaacagagtgttcctgcctctgaaacataagagaaagggggaaagacattggtactgagcactgaagactgtcggttcacctggacccagaacccagtcataacatcccacagaacaagaacccttctctcgcaattcctccaaccaccatacttacggacactggcatgtgacagcttccagaaaatggaaatgcccacccaggctttcactcacacaaggaaacctgcatgctgttgggcagtcatattttttatttgagatgatcagcatttttctgtacatttgactacaggataacaataaactcatagtaatcctacagcccctgggacatt

SEQ ID NO: 129228 - DNA, 330 bp, Homo sapiens
aacgacttctgggttttcattggatttggttaaaactgagagcaggatgctcccctttgcttaacctctaccctcatggtatctgtaagcgatttccttcctgtttttcccttcttttaaaatttttattttttatctccaactttttatattgaaaattttcaaattacagaaaagttgaaagtatagtacagtgaaataatcatatatcccttacctttatctaacaaatgtcattttgtcacctttgctttatctctgtataagcacttttcttttgaaagaagcaacatcgtacttcaccctactacatcagcatgtatctcttaa

SEQ ID NO: 129229 - DNA, 639 bp, Homo sapiens
agctatatttttccacttattcagattaagtttctcactcactttaagacaataaacctggcgtattatgctaagacactttgctatcttttatctgttttccccgtgatttaaaagtcatgtgtgtttcagaacctccacaaggctgagaaaaaaagtagtttgtggaggtgaaagatgagatacattttcagcataatccttatttcttaaaaccatttgtttctactgatggtcgatttcaccatatttaaatcatctttgttcataagtcattaggatttaatagatgacactctaatcttataatgtggcttttttcactataaatctggggcaattttgaaggccatatatgtctgtttcaaaggtggagaaacaaaatataagcttaaattagatggaaagcacctgttctttttcattgactcccagagtacacttctgtcatcatcattttgtaggtgacagatctgagggccagggattccattagagagagagttgaaacctgaacccgtgactctagatacccagccctggcattcagagatttttgggatcaagtcagaatatagaaacttgaagatgattttctacttctggatgtcttgctgttttgtagcatgtttcgtgttt

SEQ ID NO: 129230 - DNA, 325 bp, Homo sapiens
tatgtttaatgttttataaaattctacacttgcttattattagataatttaatcattttaatttgctcagtgatataattggcattattatttttatgtatttatttattttttgttttgagacagagtctcactctgttgcccagtgccttccagctcgggtgacagagtgagactcattctcaaataaataaatgaatgagtgaatgctttatgtcatcattattgacactttttgcatcagctaacatttttccaaaacatataatgtcaacatccacgtatgctagaatgtttcgcaagctactccttttttttttttttt

SEQ ID NO: 129231 - DNA, 289 bp, Homo sapiens
caaaaaaccacagcttgcgatatgatttacatatcatatgatttactcagtttaagtgtacaattcaatggtttttagtacaatcacagataagtgtgaccatcaccatagtcagttttagagcattttcatcacctctaaatgaaactttatattttagctattcctccatttccccattcctttattcccgcattcaacacaatcataagcaagcacttgtctactttgtctctatagatttccctcttttggacatctcatatgaatggaattgtataatctgtgg

SEQ ID NO: 129232 - DNA, 516 bp, Homo sapiens
cagggtttagtattgtcacctaaatcaaattttgcattgggggttgcaaatcattgaaggttttgggctatggtgaaccatgatcaagtctgtttagaaaggaaagagggccaggtgcaggtagctcacatctataatcccaatgctttgggaggccaaggcaggtggatcacttgaggccaggagtttgagatcagcctggacaacatagtgagatcccatctctagaaaaaattttttaaaaattatccaagtgtgatggcacagaactgtagtcctaactacttgggaggctgaggtgggaggattgcctgagtccagaagtttgaggctgtaagtgagctatgatcgtgccactgcactctagcctgggcgactgagcaggactctatttcttaattaaaaaaaaaaagagctcaaatacacagaaatagagaatgaaacagtggttaccatggttatttcggggggaaaggagagggagctgtgggtcaaaagatacaaaatagcagatat

SEQ ID NO: 129233 - DNA, 491 bp, Homo sapiens
cagggtttagtattgtcacctaaatcaaattttgcattgggggttgcaaatcattgaaggttttgggctatggtgaaccatgatcaagtctgtttagaaaggaaagagggccaggtgcaggtagctcacatctataatcccaatgctttgggaggccaaggcaggtggatcacttgaggccaggagtttgagatcagcctggacaacatagtgagatcccatctctagaaaaaattttttaaaaattatccaagtgtgatggcacagaactgtagtcctaactacttgggaggctgaggtgggaggattgcctgagtccagaagtttgaggctgtaagtgagctatgatcgtgccactgcactctagcctgggcgactgagcaggactctatttcttaattaaaaaaaaaaaggaaaaaataaccagaaaggaattaatcacagtttatgggagtaatgctagctgaaggccgggggtcaagaggcctgag

SEQ ID NO: 129234 - DNA, 371 bp, Homo sapiens
ggggccttggggtaacagcaaaggactgcaaccagagaagcaactaggagtgtttcactctgggattccttcagtttggtaaaactccagacaaaaagcatgagggctggctgggcagggcctttcctgcttctgaaaatcagagcacctgaaattggaggtccagccagctgtgcgctctcttacagggcactgcgctgcagtaatagagcattccttagatactgggggacaccaggggtctccaaagtgcacagcactcaatcctgaggtgctcaagatgacccacggagttctagaagaaaacagtagaacacctattcaggtttatttttatgccatccttttacaattgtgtgtgttttcattag

SEQ ID NO: 129235 - DNA, 831 bp, Homo sapiens
cagctacactcacaggaggggcaaagagacaagagccctgccatatacccctgcagctccggagggcactgaggagttgtcccagggacctaacccaggtcactatcccatgcaggagacagtgtggtttggagctagctctgctgctaatccttgtgaccctgggcaggcagctaagtccctctgagcctcagtttcttcaccaataaccagtactaatcatcctggcccagagtcagaaggctggggggagaacccaatgagagagtgtagttgggagcactttgccgtcagatgatacagtgccccccaagcaccccacaggacagcgctgcctacatagtgacgtgatgttctgatgacaatagtgagaagctggagagcactgttgacagcatgttaccagcattctctttagcgtatccttggagctttgctaaggagacacaagtcagtggcctcaaatactgagcagctggtgaataatggaggcagaaggccacctcttttgggtgagggagctcactgcttcacagtggccttccagggacagtcttccagctttgcagatcacgaggggcgtccaggaagggctgaggccctcgtcctctgtgggcagtgacctccaagcccccaccctgtgccacagctcacccttttccaagtatggagagccttgtccagccctgtctcaccaagccctctgcgggaactcccttgcacttgacagatgagtgcacacccagcttatccaagggctcacccaaaaaccttcccaatttcataaaagatctacgcccggtgtggtggctcacgcctgtaatcccagca

SEQ ID NO: 129236 - DNA, 341 bp, Homo sapiens
ctgcatggggctctgagggattattccagctgtttggggactgtagccatggctcccagctgcagagcctgacaggcctggaggccggcaggaagaagatgggggctgtgcccgcctgccgagagctggctctgagactgactcttggcactggggtcctctgaggccccaggctcattctcacctcctccagagacccagctgacataccattctcatgagctgcagtcctgtgacccagctgatttctgtctcattggtggaaccctttagaggtggggtagggctcctaaaacattagccctactgccttccccacagattggcctctcttccctgcc

SEQ ID NO: 129237 - DNA, 307 bp, Homo sapiens
tgcgtgagagagtggacgttagacagtgagccgagatggtcgccacggatttccagcctagggcgacagagcaagactctgtactcaaaaaaaagaaaggaacagacatctgtaagctggtgtagcaaaagcctccaatggctccccatttcacgtagaaaaaatgccaaagtccttatgagagcctacccagcccaaagcagcttgactcctgttcccaaggtttcctttcctactgccctcctcacttgctaaactcaggctgcactggccctctcaccctcccttgacaacaccaggcatgttc

SEQ ID NO: 129238 - DNA, 456 bp, Homo sapiens
gtggaagagccagacagcgccaactcatcgttctacagcacgcggtctgctcctgcttccccggctagctcataggttcgcaggatgtgatgatggcagaataaggaggaaaagcatttaggtaaacagaaagatataaagctatcaaaacataaagatgggtcattctcaatctgcagatatttaattctgatgagtttttctttggatgagacaggcagtcacaatcctgtgctgacaaacattcggagttttcttcaatgtgccaatacctggttctaattctagaaacaccaagaatgattcaaatctagtaagtttctcatgaccacaaatatactgggtccgttttgggtgccttgagaatactcctataaactgagcctcccaagaaagctccagccagatttgtgacaaactctttcccctgcattgaaaccaacctaaagaactaaa

SEQ ID NO: 129239 - DNA, 197 bp, Homo sapiens
aagaggaaatgaacagtaggaatgacaacaacaaaaacaacaacaacaacagacagataatgagaagaaaaatagaacatggaggattcatccaaggaagaggttgttttaagccacatgttcaggaaaaggatgaatgattgataaaaactcacaacccttaagattagcttctgagtcaaactatcactgaaggt

SEQ ID NO: 129240 - DNA, 520 bp, Homo sapiens
gactgagaagtggcacaagatttagaaatcagggtggtggtggtgacccgggctacagcagttttagtggagagaaggaaatggagataattgtagagaataatccagtgacttcactgtgaaggagcaattggtatctggaggggcacatgacattcagagacttatttttatcatatttgaagattggtaggaaagagccaggagaagagaggttacagcagaggacggttcctgaagaggtaggatctgagctcaagtagagattgagttctctacaggaggccttagacactccttccttcctaagggaaagcttaggtggacatgtagctgtgtttgtaggtttggtgatgggaggtggaatttctttcattaactaaggcgggggaggtgttgaaggtatattgggactcttgagaatggcaaagggctgactattgcaactcacccagcggtagacagttaagggagaccgtgaaatcatctatgatcccaatctatagttaccttattttat

SEQ ID NO: 129241 - DNA, 356 bp, Homo sapiens
cttattttccttctctattgacttccttcactcagccagtagtagccagcacctgcaggttcactctgagtccatcacaggcatgtaggcgttcctttgccttaaatggctctgggaatcatcttctgtagccaagctccccaagctgtcacttatgacagctgcatgacactactgctgctgataatctatacatccaactcaccctctgccgtagttttcaggcttttgttttgtttgttttgttttgtttgtccttattcctattattactggctctcagccctgaaccccagcccagtcagtgaaagtcctgattccctcagcttctttgccctcccactaaagaagggttt

SEQ ID NO: 129242 - DNA, 285 bp, Homo sapiens
ttcttactgattttctatctgaatattctatcattgagatatagttgctgaagttttcaattataattgagaatttgcctatttctctctcagttctagcattatttcttcacatattttagctttgttgtttaatgcacacacatttagaattgctatgtcttcttgatggatttaccccttatcattacacaatgttcttttctgtctctggtaattctcttggctcttaggttgactttgatgttaatatagctattcatgctttcttttaattaatgtttg

SEQ ID NO: 129243 - DNA, 157 bp, Homo sapiens
tgcccagcctagttttattcattattgagaggaagaatcacaagggaaattagaaaatacttacagatcaataaaagtgaaaacacaacataccaaaatttaggggacacagcaaaagcaatcctgagggaaaaatttatagttatatatgcttaca

SEQ ID NO: 129244 - DNA, 358 bp, Homo sapiens
cctcagcattttggagtggaagtcgcaggccttggttgtgaacaaaactgacctctactgaccacttacagtgagttatgagctatgccagctccttccagttgtgcttgctatctcatttacttcctactacagtactggaaggtggctgtgattagctacatttaaaagatgaggaaattaaaggtcatcttttgtatcttgttcaaagtccctcaataaatgacagagttaggattctaacgactgactgtaaaagtacagtgtccaaacctatcctctatttaatgattagaaacagtggacacaagacaccagtgagagtgaggggtgtgtgtgtgtatgtatgtgtgtgtgt

SEQ ID NO: 129245 - DNA, 819 bp, Homo sapiens
cataaataatgacttctagcctcaaaaatcataaaatttacttaaaattataaagtataagcatttaaaaattaatttttttatttcttaattctgtaaacatttattgagtacctactatgttccaggcaccactctagccactttgaagatgtattagtaaactaaacaaaaacttttgctatcttggcactcatgttcttttagcagagacggtagattttaatattattaaaaggtaatagatgtttagaaggaaaacaggataaggaagattgggagagccagaaggcggcctggggggagatgggagattacaatactgtattaaaaagaaagtcagggtgggcctcattaagggtgctgatatttcagccaaaacttgacaaaggtaagaaagttgaccactttctagaaaacagcatttcaggccaagggaacaagagagatattaaggctggcatgcctggtgtattcaaggaacaacaaggaaaagatgtcgctgaagtaggataagtgaaagcaggaaaatagcaggagatgaggttggggatgtggagggccagtggtgatatagggcatgggtggtcttagaaactatggtgaggattttgactttcgttctggatgaaacaggaaccattgcagagttttgagcaggggacagatgggatctatttatgccgtaagtcaggtcaactataataataaatattgtaaatgatttaaacttccctgttgtaaaagagaaattatcagattcattcaaacgtgattgacatagaaaagctgaaatttaaggattgaaagaagatgtaa

SEQ ID NO: 129246 - DNA, 474 bp, Homo sapiens
agcagcaagactggcgtctccccgtacttctctcctctgaccatctctcaacacaccatgaccctggtcagaccactatcatctcccacctggatgttgccacagctgggcccccatgcttatacccaattctttcacagaaaatatggtctttgctggtgggctcccaccagcaaagacccgtaactgtccctccttcctcccttcccacagcacaaaccaagctaaaatgctagctcaacttctctcttttcacttcaaaacaacacaactcgccagccgggcatggtggcagtagctcacgcttgtaatcccagcactttggcaagccaaggcgggtggatcacctgaggtcaggagttcgagactagcctgagcctcccaagtagctgggattacaggcatgcaccaccatgctcagctaattttgtatttctagtagagacggggtttcgccatgttgctcaggctagg

SEQ ID NO: 129247 - DNA, 261 bp, Homo sapiens
tcagaagaacctgatgtcaaatcagatccatcttatagcaagtcgagccacctctctgaaacttgaatttaaatgatctaaggtcatttcctttggattttatagaaagaatagtgtcaggagaaaaagaaaaacaaggaaccatgacttgctaaacatactcagaaccaaaggttttctttctttccttttaaaaaaaaagtgatatacagtgaatacaggcttagttccctaatggtggcaaatgatgtaatgttcaca

SEQ ID NO: 129248 - DNA, 437 bp, Homo sapiens
ttcccagcctgtggaggcctcacagtggtagcttgttagcagagtcctcagaatatatccaggataaaaatgtgactttgtgcaagtccccagcttgaaacagggttacatcctgcttcctgggtgatgctacctggcagaggagcccaagggcagggggcaggctcctcgtatctgggtgtggtgccctgagctccttgccctgctgtttatttccagagcagaaccttggggctcactggagcagtgaccacctctaatcacaagagctggttgtactttttcttcgcaggctgcatagggtggaggatggggctggggcctctggagagtggcgattcctccctcagccccacatttctacctgctccccagggcaccttgttattacagttcaactggctggggtttgtcaggcctcaagccagcctacctgg

SEQ ID NO: 129249 - DNA, 217 bp, Homo sapiens
tttgtgatcgtagtgaatacattggacttttggtacttacagtcctttgatcactgaaaggggccatggcttcaggaatgatgcataaacccattctgtgcacttcagcaggcaggcagggtttgggcattgggtcaatgcagaaggaggaggaagaattctgcagtcactctggggctgctgctctcatcagtgagtcactaatgggcatcaggag

SEQ ID NO: 129250 - DNA, 725 bp, Homo sapiens
gcaaggaaacgcccagaaggataaagacctgggagctctagcttggaggtggaggtgagcctctcgcttgggctgaggaaggatgctgactgtgccttcccaggcaagcccgcctgcctgatagcttctccgcagggtttttctggtggtggtggtgatggtggtggtggtggtggtggtgatggtggtggtggtggtggtggtgatggtgtgtgtgtgtatttcaccacttcttacccagggctacagtatgtgacatgaatttcccaagctctgcttagctgttttcagaacagcccctaagcgcagctaggaggtggtgcaaatctttcacaatcattcacaaatctttttccgttgctgagaaaccaggagtattgctcaccttggcatctgtccttgaaagggctttagcttgaacaatatgcttctgctaccattcacccaacagtgctctgttcactcagtgaattgccatatccaaaatgaatacagttaatcaatattcctaatatgtctgaaattcctgcccctcctttttactcctactttcaaggagtatgtgttagatttaattgtgaatgagaaggaaggaccttacttctcatagaagggaagatgggatatttttaacacatatctgggtgagattgaaattaacttgtaaaaagtaacccaaattaataatacatatatttctatttttttctcaagaagaataaaaa

SEQ ID NO: 129251 - DNA, 633 bp, Homo sapiens
atatcctgagtgcctaagacagtatccagcatatggtgggttctcattcatttaaataaataaatgaatgacccaatgtgtcagtcaaggtaacctgggttgtgctgcagtaaacacaacctctaaatctgagtggtctatctcttatgcactgaggtcagttgggagctctcctccatacttcctcccattggaacccaggccgacaaagaagctgccatcttgaattttgcttatcactggatagaggaaaagtgagctgtaggttttgaaccagcaatagaatgttctggcctggaagtcatatgtgatcctttaacttacaattcactggacagagctagtcacatgttccctgccaaaccatgtggaagtatgtttgcaatctgactacattccaaaactattaatagcaataatgactactacatttaaggaaggctttaacttaattttttatgggaacttgaccattattagaattttggtgaggccatgaggcagctccatttcccagaatgacttttagaatcataagctaatcactttgaatcacgtgtcttagttttgggctgctattaacaaattacaaaatagactggtggcttaaacaatagaaatttatgtctcaca

SEQ ID NO: 129252 - DNA, 127 bp, Homo sapiens
attaaaaacaatccattgatactgatacttccaatcgcagtccaacacactgagggttgacttttggcattctactttccatctttataacttctctctccaaagggatgaaacttggctcccatta

SEQ ID NO: 129253 - DNA, 331 bp, Homo sapiens
ctaggccccaaatgacattcaagaccaaagattttgacatctatatgtaattataatatattgcattattaagaattactaaaaatttgcatgcataaactaaaatgggcccatttccagtttaccgaggactctaatttagcattctactaaaaagtctcggaaaggcacagcggctcacgcctgtaatcccagcactttgggaggccgaggcaggtggatcacctaaggtccggagttcaaaaccagcctgaccaacatggcgaaaccccgtctctactaaaaatacaaaattagctgggcgtagtggcacatgcctgtaatcccagct

SEQ ID NO: 129254 - DNA, 501 bp, Homo sapiens
tccttgagaagagatatgctctgtcttgttagcagtgtctggcggatagaaggtgttcaataaatttgttgcatgaatgactgcaggaatgaaggcctgagatcacgtcttcttctccttggagtctgtgtcctttttcctgaattgtcttgtgttgtccttgccttgggcatgttacttcctcagtgtcatttctgactgggcagctgtgtgaggctgctcctgtggaggtgctggagacaggttacaaatacatagaagtcattgaacttgtgtctgtctgtccaggccacagatgaggtgtgttggttgtccattatttcatatttgcacccatgacacttaccttccttctgctgggtcacctccccacccagtccttaagtctttgaaggaacaatgatagtcaactccagggaaattagcattttcaaggtaaggagggacacagaaaagcactctgctcatcctttctctctgtttgtggagtctgctggcagt

SEQ ID NO: 129255 - DNA, 434 bp, Homo sapiens
aacaaacaacctcagaaaagaaatctggttgcccataagacagtgcacagaaataaccacataaccactgaagatagatgtctattgagtgccttctgggtgctggcctctgttctaggtcctgtggattcgacaatgaatacatccagtgaaaattcccacccttgtgcaagttaccttctagttggtgttgcaggtaatagacaaaatgaataagtatctagtggcctaaataatcagaaggataatgaagaaacatgaagcaagaaagtgattggggagcgtataccaccaccatgggcagatgtgggctgccaggagggccgctttggcaagtgacagggtgatgtttggatgatgacttgagagaggtaaagtagtgacatatgtcatagtaatgacatagataaatggagggagaaggaggagcaggt

SEQ ID NO: 129256 - DNA, 768 bp, Homo sapiens
gttgaatgtaaatggcctaaatgcaccactaaaataatatagagtggcagaatggatgagttaaccaaccaagtatctgctgtcctcaagggactcaactgacacataagaattcacatgaacttaaggtaaatggatgggaaaagatattccatgcaaatggacacccaaagtgagcaggagtagctattcttatattagacaaaacaaactttaaagtaacagcagttaaaaaagtcaaagagggacattatatgatgataaattaactagtccaacaggaaaatgtcacaatcctaaatatatatgcacctaatactggagattacaaatttataaaacaattactactagacctaagaaattagatagacagcaacccaataatagtgggggacttcaattctctactgaaagcacaagacaggtcatcaagacaaaaaaccaacaaagacacagtggacttaactatacccaagaacaaatggacttaagagatatttacagaacattctacccaacaactgcagaatatacatgctattgatcagcacatgtagcattcgttctccaagacagatcatatgatagtccacaaaataagggtcaacaaatttaagaaaattgaaattatagcaggtactctctcagaacacagtggaataaaattggaaatcaactccaaaaggaaccctcaaaatcatgcaaaaacatgtaaattaacctgcttctgaatgatcgttgggtcaacaatgaaatcaagatgga

SEQ ID NO: 129257 - DNA, 510 bp, Homo sapiens
  misc_feature (57)..(57): n is a, c, g, or t
  misc_feature (73)..(74): n is a, c, g, or t
gctctagacgatcccttatatgctgtctcacctgagagaggctcctgcatgtgaagncctgccaatgacacannctggagagcacctaggatgggtgttctctaatgggggaggaaggtgggcttaggaggctgctagctgaacatgcgatttgcagttattaggcaaggtggggggcctgaactcaattatagactctgtcagggctgtttgactaaagtggctaagggaacccatatcaggtctgctgtgttgaaaccaaactgcccttttaccaacgtttctgctgtgcagcccagagaagtgtcagggaaggagagggagaaatgggagaaatacatattttcaaaaacactgtctcacttcctaagggtaatcaaaagcaaccagggaaaatttatttgtatgctgaaaaataatctgaagcaattagagacaaacattgttacagagaacttggaagttatacatgtacatgttactttctacctttgtttttttttctatttc

SEQ ID NO: 129258 - DNA, 481 bp, Homo sapiens
taattggccccatcctcaggctagattcttttcctgggatccttctctgcaagctcttctagctcttttcccaggagcctcctcagcccctacgttaatctgtttatgcaaacataacacagaaggcctggccctgccctcatgcctggcacaggttaggttctgacaaagcacctgccatgtaagctccctcatcctgtcctgagtgtgagattctagcatagggtagaaagataccaagaaagcacaaaagcttaatgtttgtggctctgttttatgaatatgttgaaatattcccaatttcaaaattgctgagtcaaaacgtcatgaatcccaggatctagtgggaattataatgcaaactggtccacaagggaaactgtatcaacggccagaatgaagcaaattagaatcacttcaataatcaaaagttaatgtaattctactgggtggctttataaagcttaaaaagtttgtttga

SEQ ID NO: 129259 - DNA, 609 bp, Homo sapiens
gtcaggagccatggcacctgcagccttccttgcttgtcacttggctgtccagtgactccatgtgcccaacagtaagtcccacatttgaggcctgaaaatgacaagaaacacagactgtgatccactctcacccttaatggtagggcagaaagcccaaatttatctctccaaaaagaatccaacgtaggctaagggggagtgttctcaccatcttatgtagtatcaagaaccatttctctcatccctagaaaagtcgtaagtgacaccaaggaaatgttttctgaggtgatggaatcttccattgcccaccccctctcattgagggctgaggggtaaaagtgatgggctctaaaatggtgtcagaggggacattcccttgtgctgccaggagcttcccacttgatggaggttccagttcattaagaggagtcagctgcccagactgaaccagtgctattaggttcctcatagcactctccagttcttttctgagtgactgaaatgagggtaatgattcagagctgtgaaggccaaaattgcctgaaacttggtaagaatctgaggttcagaaatcgtcttatttcccactccgtcccaaatgtgtgcata

SEQ ID NO: 129260 - DNA, 343 bp, Homo sapiens
acaccgctgttagagttctatgacgctagaccggtctcgtgtcccgtgtgctctggttctgctgctggaacttcacgcatggcagcagacccagaaaactgggttacctacctggtaagcagtattagatgccagctctccaacctttcaagccctccccactgggggtgaggtggagcggttctttatttctttgcctccacccaccgaaaatttgtccccagtttcccattctctccattgtgtctgtttctattattgtcctcaacacccacccaaacccagactctacagctgcactgtccaatgtggacaggagccacaggtggccatttaaattaat

SEQ ID NO: 129261 - DNA, 774 bp, Homo sapiens
cggctatcattcaaatttgcgaaacattgaaatagacatcgtaatagaaataaatgattttaactagattttcatcagttacatatccaatttaaattcaagaaagtttaaaaattaaaaaattcaaaaacgaaagacatgctacaatactattgtaattgaagtagttttttcttagtcctggttgcataacttccttgaaaggaaagcaataagatacaatgaaaacaacatcaaatttagagttagcaaacccaagttcaaattcaggctctaacatttctcagcttgacagagcttcagtttcctcatctgtaaaatgcaggtaacaacatttaactttatcagaaataattgtaaggacgatcccacaaaataatgaatgtcaaagtacttaataaggaatccagcactcttcagatacatattagtatttatcacgtcctctgggtttctctatcaaaagtggagaaggtttgtgtgccattattcacagcttcctacctactccttcttggagcagtagtaagtgtttacagtatagatgaaacctgtgttgatttaatcttgatgttatcattcaatctcttaacactcactagccatgttggccactcagcccagaaccgatgaattgggagaaagaacagtatgaacagcactgattttaaaaaccaggagatgttggaccctgcttttgggagatcctccaaccttactttcccctaaattacctcctctatgaagactttgtgttccctttgctatactgac

SEQ ID NO: 129262 - DNA, 171 bp, Homo sapiens
caattaagcaaaggttggtgtgttggtagtacaggactagggagtttcagaaggtgctggaaggggagatggaaaaggagatagagaaaaataaatgggaaacagcaggggggctggctgacagcaggaaattctgagcctaagggttctttgcagcttcccagcccctgc

SEQ ID NO: 129263 - DNA, 498 bp, Homo sapiens
tccataatgtgtgcccataataaaatgcaagctaccaagcaaaacttagaattttgggaagcttgtatccaccactgtgagcttgatgggcttctcaatatttacagacttttttttaagagatcagtggtgacattaatgaatgtgaccacatatgacatcaaatcacactgtgaccaaaaaccatgtttttgcaaccacagtgtcaatcaaaacataacactttaaagtgataagctcttcctactatggctactgatagtgtattcacccacttaacaaaaggacctactatgtgctacgttctgggtacagcagtggtaacagatttaaaaacccagacattgtccaaggagttttacatatgttaattaacttaatgctcacaataatgttataagaaatgtaacattaaaaacctctttttgtagttgtggacattgagccataggagttgagtaacttgattaatgtcacaagcttgtaagtaatggaacc

SEQ ID NO: 129264 - DNA, 554 bp, Homo sapiens
tgactgagagaaagcttgttattgagtaggtaaggcgcaggtgtgatgtcactgtgcaaatattgaaccaattaaaagcaaagccaagggtccagtgtagatgacttatctgcagatccagccctaggtctgtctgcctggcctcttaacatggggcaaaagctgcttaacctattgtttcctcctctccttccttccttccctccttcctgcctccctctgtctctccctccagctacccttggagtggtcattctcttggactgccaggttcccagaaaatacttgcaagcattttcaacaattcagttattttcaacaagcattgatgctctctctgcagcaccctgggcaagagcaagagggttggggagacagttcctgcctctagagagttctaagagacagcagaggacacaggcaatgaagccatggttctgtataaggcagattgcgctgggcctgttggggaggagggagaagggtgagtaattcatactagggtaattcatactatgagtaattcatactaggagaggctgcctgggggcgat

SEQ ID NO: 129265 - DNA, 828 bp, Homo sapiens
ggcacgtgccaccatgcctggcttattttttatattttagtagagatggggtttcaccatgttggccaagatggtctccatctcctgacctcatgatccgccctcctcggcctcccaaagtgctgggattacaggcgtgagccactgtgcccggcctgtttgagcttattcatgcaaactttagcagacttgactgggatttttactaacagctctaatcctctggggttttcagtgacagatgcagaacgttgaccaagatgggtgggggctgcggggggaagaaaaacagaaaatccctcaccccacagaaaagcaagagttggttgatagttccagttttatccttgagccacaccgcatgtaatttttctgcacatgaaaacatctggctcagatcatcatatcttgaaaagaagagcaagctacacattttcaacaatagagctgattaaattatagtgcagtgcatccacaggaaagaggcttggagccatgaaagtggctttggaataatgcccaataatagaaaggaaagcattttacaatcgctatggtctgtatggacccaccttctcctcatgtctttatctctatttcccacccacttctgaaggagttcagtttggcttctaccctcaacactcctgcactgataaccagggaggtatctgtgcagttaaagccaaaggtcattctttcattttcatcttgagaacattcagtatcctcatcgtgtttgtttcattcattcattcattcattcattcattcattcattcacattttcttttggacatgagagatgatgcattaaatgttgaaaaa

SEQ ID NO: 129266 - DNA, 322 bp, Homo sapiens
ttacaggtgccttaaccctggctggctaatttttgtatttttagtagagatggggtttcaccatgttggtcaggctggtcttgaactcctgaccttaagcaatcaacccgcctcggcctcccaaagtgttgggattacaggcgtgagccaccgcacccgcccctgcaaaacccctttcagattgaaggctgcctcggaagacttctgcacttcccctccccactgtaccttccttctcaacattaacaagctgtccgggtcaggatccttgcactccttgtactgtgccttgacctggagctctctgtgccttccttcctct

SEQ ID NO: 129267 - DNA, 411 bp, Homo sapiens
tgccaccacactgtgctcactttttcctctagctcatgctactctagccaacactggcctctggttggttctagaacattccagatcctctccctctgagggccattgcacctgctgtgcccgtgtctggaacattctttacatggcttttcatgtagccagcaccttttcatccttctgctcttggtttcagtgttgtctctccagagggtcctttcctgatctcttatctaaagcagccccatcaccactattagcccccattgcagtcctcctttggttttctgcctggtattcctattttgtttatgcgtctccttacttatttatctctaccttcaagaatgtgagccacaggagggctcctatgtcatcgctgtattccctcacttccagccctgcagagagcct

SEQ ID NO: 129268 - DNA, 179 bp, Homo sapiens
aacagagtgagatgctgtgtctaaaaaaaaaaaaaaaaaagaaagaaaaaagaaaggaatgcgcaaaattaatatgacatcagctggtgctaccgtgaagaaaaagaagctgattttaaaaatgagcaaaggactagaatagatatttctccaaagaggacataccaatggccaacacg

SEQ ID NO: 129269 - DNA, 497 bp, Homo sapiens
ctgatttgtgagaccatttctatagagtatgcaccagtaggcaggaagcaggtgagccaggaagcaggtttctgcccactgatgcacgcatacccttcctaaaatgcacagtttctggttttttcttcagaatggccactactttccccattaccacccccaactctaatgatccgcccagtgtcctcatccacctgcctatggagggaacatcaagttggtacaaagctatcctgccccctagccacaatgaattggcccggggcctccacctaagtcaaacagagtcatagtactttttcacttgagaccaatcgagtataaagctctaaggtgtaacacccatgagctactagcagcaatgtttaatccaaatggagaaaatatgtagtgtaaccaacaaatgctagaaagagtcagaggcaggagataaatggagtccctattccagtgctccttgaatgcttataataaattttctttttcacttaatctag

SEQ ID NO: 129270 - DNA, 623 bp, Homo sapiens
attgaatctatcttgaaaagagaattttttttcagaatgtgcttagaatgtattcataggtttaagctcccaaagacaggcatcctttcagttatttctgaagctctggtagagcctggtcctttactaggctagaatttttgaaaagaatttctaaaacttccaagcagtggcaatgttgtaagaattaacctgcaggttcccaaagccactacttttcaaagatgttatccatttgaatgtcagagttacattgtgcttgcttttaaaaaaaaatagacagcattttatgataacatcttaagcatataagggaaaaaaagactataatgttagctagaagtgtagcactcattcagagtcacgtgaccatgccgcaccacaatttaaaattagtttgaatcctctgcttgttcctgattaaatggttaatgtaaattaatttaatttagaatcggttctactgctataaccaatacaagccagacttctacttggaatcttagatcatatagctgactgatattgaagaatataggaatggttcaaaagagaaccacaaagtaactattaagaaacaaaagcctctcaagaaggttttaagaagtaagattttagaatcc

SEQ ID NO: 129271 - DNA, 539 bp, Homo sapiens
caggctggagtgcagtggtctgatctcggctcagtgcaacctctacctcgtgggttcaagtgattctcctgcctcagcctccagagtagctgggtctacagacacatgccaccacgtccggctaatttttgtatctttagtaaagacagggtttcaccatgttggccaggctggcctcgatctcctgaccttgtaacctgcccacctcggcctcccacagtgctgggattacaggtgtgagccactgcgcccagccacttttttgttttttggtggtgggaggggcagtgtggcagtggagatagtctaaattgactttctaatctcttttttttgtaaattgtgtgagtggatgcagtttgtgtgccttcatccttcattaagctgagagagatgattgtttctctgggacaacagttcaaccagcaactcagtttcttgggcattaagacagaagtttttgctttgtaatcctcggaaataatgcctatggtaggactgaggataaatgctttgaccggtattgagtggtagtgtag

SEQ ID NO: 129272 - DNA, 121 bp, Homo sapiens
agtggttattctttgaaattttggtttgatgccagatttgcctacgcaggctaggaagcagccccatctgaagaaatgacaagttggattccctacaagagccctctcctttcttaaccag

SEQ ID NO: 129273 - DNA, 735 bp, Homo sapiens
tacttactctctgagcgttatgcatatgaatatggctttagcttcccttttgcagagagaaaaatatcacagtatcctattaaaatttttgcaaatataaactgtttctgctttatgtttttaatcagaagtagaatttagaaaaataaatttcatatagtattttttcttcacaaagctattagagtaggaactgatttggttgaatttttttcctaagttaaatctgagactctcatgaacacaaagtgtatgtttttcatggaaatataaattaaatattttggagaattggatgtctatagataaagtataacacttggctgtctagaaccttgggaaatgagttattcaaaacaactgagttttatagatgacatagtgtttatcttgataggttaaacactttaaaatgtttaccattttgaataaaaactatctaaagatgtgtttgtttatttttctattttttaaaaaacagtacactaaacattttttagctttttcttgatgattcatgatcattattattattatagaaaaagctttttatggaattatagtaatgtttattgagagcttattgaaaagtatattctggccaggcacagtggctcatgcctgtaatcccagcactttggaaggccaaggcgggcagattgcttgagtccaggagtttgaaaccagcctggccaacaaggcgaaacttcatttccacaaaatattaaaaaaaaa

SEQ ID NO: 129274 - DNA, 382 bp, Homo sapiens
acacacacccctatcctagggtgccatgaatagcagaagggagcggggctggcaggatatgcccacagggcatctgccacctctgcaaaccagtctcatgtctgagaggattccagaatagaggtgtggcacacgggtacttccccagagctagtaccccagaccccagctcctgccttggactcaggagccccaaacaaaaccagctggaaccaaccccctcccttatgaccctctgcccacgaaggtagggtcccagggaagatgggcagctcctggaccctctaagaatgagaggactccagaaagtggcttgggggcacggtggctcacacctgcaatcccggcactttgggaggccgaggcaggtgggtcacctgag

SEQ ID NO: 129275 - DNA, 251 bp, Homo sapiens
tgctgagatgatctagaggatcccgagctctctctgtggggtcagacgaggggttggatgtgattgatttatcgatcagccatttattgagcacctcctgcatgccaggcacagagacaacaagacctggcccctcggagctcggagcctggcggggaagccagacacagggacgggcagttcagaacggtggacccagagccacttggggatccacgtgggaagggggattgtgggaccccagtgagccc

SEQ ID NO: 129276 - DNA, 260 bp, Homo sapiens
gtagctgggactacaggcgcccgccacgcccggctaatttttttgtatttttagtagaggcagggtttcaccgtgttaaccaggatgggacaatggtgatcttgatgagaatgaggacggactttgagcagggttgagaagcaagggtagtgaggctgggtttcctgtgtctctaggtaagtcccgtagctttccgtcagcccatgccacaccttcttcctggggacccttctgtgtgcggtgtggagagtagcttagga

SEQ ID NO: 129277 - DNA, 406 bp, Homo sapiens
gcaaattcctcattaaagtttcatccaaggaataaacaaagatgtaaaggtcccccactaccgttccctgtgtccacccctggtcctcaactgctgctacagccccgagatttcctaacactctcagtttagggagaggagggggtagtaaggaagtaggggagcagcagccagtgaggcgggacaagaatgctgggagagcggggcgtcctggaagccaagagaacaaggcagagagggcaagattagcatcgccagaggctgctgagacactgagtaagatgagggtgcaaaggaacccttagtgctcagctctgtgcaggcagagtcagccagtggtggggacacacgacagaatggggtggtgggcagtgaatgggaggtgtgcggaggaagtatgcctaga

SEQ ID NO: 129278 - DNA, 332 bp, Homo sapiens
gttaaacaaggataatacggcttcactaaatatgaaggaactcacacttaaagatgtggaatgtaaattctccaaaatgaaaactacttatgaagaggttacaaccaaattagaagaatataaagaagcctttgcagcagcattgaacgctaacaattccatgtcaaaaaaattaacgaaatctaataagaaaatagcaatgatcagcaccaagctccttatggagaaagagtgggtgaaatattttctcagcactcttcctacaaggcgaggtcaagagtcaccttgtgttgaaaatcttactagtatagtactcaacagtaaatatattc

SEQ ID NO: 129279 - DNA, 294 bp, Homo sapiens
actatctaaatgaacatgtgccaagatccttttatgttgagaagaaagattaaaagaatcatcttaattaaaatagcattgtatacaaaattgagctttaaatacgactccaaaataaataccaatagggatctttttttaaagttagtaagccaattctaaaatcttaatagaagagcaatggtgcattaagagtcaagataattctgaagatgacaaaaatgaaaggtatttaccttacctaatataagtgcagagcatacatttatattcattaagaaagggtgttcatgg

SEQ ID NO: 129280 - DNA, 275 bp, Homo sapiens
ggaaaatggcaacctaaaggtgcattatctaagaggaagaggaatcttcagattcctagatgtatcttctctaagccagtgctgctgaccttacctcaactactggaggacaacctgagccacaaaaagtcatttaagttgcaaaggcaaaaagagctctttctgtagcatcatgggtggtgaagtgcaagctccgcgggtccagatcaccagggctcaattccaggtctcccacctacccatcaggccaccttgggcagttagttagcctctct

SEQ ID NO: 129281 - DNA, 697 bp, Homo sapiens
cccaggacttgggtgtgtattggtgagggttggggtactctatgttgagtactcttaggagacacataactctgggccttaacagttaaggccaaagtcagttctttattcagtgctccttctttgctgctcaaattttttataccgagtgccatggagtttaaagaatagtgaaaaatcttcatggagacattggcctttgagtcaagtgtacctcctttagcacaactgactcaaagctcgattcctaaatctcatctaaatctccttgagattttaactagtaaagaagtgaggggctgaagagggtggtggtgggaactgagacaaaagcataaccctgtgttaggtggggaggcaaatttgagaatggctgtgtgtgccatgtggctggacacagtgcacatggagggaaataatagagatggcaagggtcattttatgcaaggatatgaaactcaactggagagttttgactgtgagacccccccctcagacggaattttgtctctgagactcccctcatgagagaccccaccaaatctatttttcaggcagtaggtaaaaatcatctttataaaatgtaaataacagcattttattcccctacttcagatcctttagtcaattcccactgctctcaggaaaaaatgggaatcttttcatatcaccaacaggccatagccttggcaggtga

SEQ ID NO: 129282 - DNA, 733 bp, Homo sapiens
gtgatacaagtaatttttttctctttaaacaatgaataataaaattacctacctcctgtgttttttgtgaggagtaaattaaaaaattatttccagttcttctccatatgcatttagcttgtttacttttataatctaatcacagccacttcatgtaaatagtatatctttaacttgttgagaggtgagtagacttcattcccatggcaaagtcttccttaaatgaattcaacacaattcctattgaaatcccaacagggttttaatgttgaaacttaaccaaatttactttcttttcctggaataataaatccaacatctctaagtacttagcatatatggacactgaattcaattcagttatatatgtatgacattatatatgttgaattatatgtatatgttgaattcatttgtaaaatgatacatgtacatgtgaggacgtccaggatagttttgaaatgagaaatgagagcagcatttccttggtgtcgtgaaaatatattatacatttattaaatattgaagaagtgtgggctgggcgtggtggctcacgcctgtaatcccagcactttgggaagctgaggctggtggatcacctgaggtcaggagttcgagaccagactgaccaacatggtgaaaccccgtccctactaaaaatacaaaaaattagccaggcatgggacaggaggctgaggaaggagaatcacttgaacctgggagatggaggttg

SEQ ID NO: 129283 - DNA, 738 bp, Homo sapiens
atggtgttctaatgttatgtgtagcacctgccatgtagagtcagggaattcgttttccgggtgaggttcctggctagctctaagattctgtaattctatgagggataaagcgttttagatgtgtttctccccattgtgccaggaaaacctggcagaggccataagttccttaattaaatcaaagtaccaatgttacagttgagttatatctcccccactgactctgcatacacactattggttggatactgtactgttgaagtccccaagttgactccaatttcgacttagctggattgaatgcggtcaataaggggttgcaccatgagctaaagtagaaaggtaaagtgatttaggcttctctaatatgctgtggaagtcagatcgactcaacaagagtttatacttaaatacattttaagttacgtgctcaggattttacaagcaccatggaagaatcaaaagaaacgtaagacagttttgcactgagaaacttaggctgagtgaccaactcacataaaattattagtcatctacctgaggcagaatatgatgaaacactaaagagcacagtttaagacaagacccagaaggtcagcccgtagatggggaaaggagaatggcaccatgtaaagaggaggtagacatgggttatgaaagacagattgatctgagagggaggagtgggaggtgagtggagtgttgggtacaaaaccttgggatagttgttgtaaagga

SEQ ID NO: 129284 - DNA, 181 bp, Homo sapiens
ccatcaccaccagccaaagacttaagtcattcctgactcttgctcccaagctcagcatccactccaccctagtcctctcagtgctgcttctgaaaagaatgtatcctgaatccaaccatttctcaccgattctactgctactgtcctctgccagcctacaggaggaaaagcaaggcttaca

SEQ ID NO: 129285 - DNA, 223 bp, Homo sapiens
gtctgttttatctgttgttcaagcaaattctttaaaacacttaaaatagttcagttcttcagttggttgaaatttatatggccatttcttttctaagcagtactctcagataaacaccagaatgctggtctatggacttcagtttgaaatcaatagtttactgtcttgctggaaggaggaaagtgatcttactgttgtggaaaatatatcactgcagaatcta

SEQ ID NO: 129286 - DNA, 364 bp, Homo sapiens
aggtggcaggtggggcggctacgtccaaggctaggctaagggtggagactctctgtatacacagggcagctgaatgagctgtgagctcaagccaggggaccacaggagtcctgattcccaggaccacagggacctgtcacctccccctgctatagttgtggcagcatggatgggccccagggtgctggacagagctcagctgcggagtctcctgagggtttggcacaggtaccaagagccctgtgtcctaggctgtgagaggaccccaggcgctcaaacatgtggggatccatgtaccccggctcgcccccatccaaggaggtgggtcacagctgtccccactgcaaaggaggctgacaagctg

SEQ ID NO: 129287 - DNA, 441 bp, Homo sapiens
taacccaatctgagaatgtcaagaaaaccttagcatgttaacataacctcagagattctacaaaggtctcccagaagaaacgatgcctaaataagacttagtgtggtcatatagaaggagagaaagggtattaatagtaaagagaaggagaaggagtggagccaatgcccagttcagttttgaactgcctccttgatacttccaagaggagattctgccgtcaggtagttagagaaacaagtcttaatctcaggagagacagctagactgtaaacacagatttgggaataatcactagataagcagaaatgagggactgtttacatgtcaaaattggaaggaaagccttgaaatttagtctgataaactaaagaaactccctaaacaatttgccagagagaaaaatacagaggaaaatttaaaacaaaatataaggctgca

SEQ ID NO: 129288 - DNA, 156 bp, Homo sapiens
aaactcttctgagacatgatactgttactgggatgggaaggctaaaattattgcatattttaaaatctggaagggtagaatttactgactcctaaatttaccctttcctgaaatgggagaaatgcaggtaataatatttatggtcagttctgtttt

SEQ ID NO: 129289 - DNA, 318 bp, Homo sapiens
accaaataaggtcaacttatgtccagccgagtagccaggtaccctggccaagcaagagtttactagactagacttgaccttcgtagagtctctcatgccttttgtcaaggaatttttatttattagtcattttattttcattaaaaaaaacccctccatatggattaaagacttaaatgtaaaacctaaaactaggctggtcatggagactcatgcctgtaatcccagcactttgggaggccgaggcaggtggatcacgaggtcaggagttcaagaccagcctggccaatatggtgaaaccctgtctctactaaaaat

SEQ ID NO: 129290 - DNA, 265 bp, Homo sapiens
tttctctgcctcccagattcaagcgattctcctgcattcaagtgattccccacctcagcctccctagtagctgggatacaggcacacaccaccacagcaggctaatttttttgtatttttagtagagacggggtttcaccatgttgaccaggctgttctcaaactcctgaccgcaggaagatcacttgagcctagtttaaggttgcagtaagctatgattgcaccactgaaatccagcctgggtgacagagcgaaacctcatctc

SEQ ID NO: 129291 - DNA, 153 bp, Homo sapiens
ctaccccctggcctggcctggtcaaaagggtgcacagagcccagccattctagaaaaggctactctttgcacccctctgctcagagacccctcctgatggattatgtctggggtccaggaatagcgatggtttcacatcccctgaaacatacc

SEQ ID NO: 129292 - DNA, 770 bp, Homo sapiens
atatgtcattatgtctgattttatttatttcttttaaaatctagccattatctccgtcatgccctttgatttgtttcagaagaaagctgattggcaggcggggtaaaacagagggaggcagcttttcagtagacttttcaaacacatattgaggtgatactcactcctggctaatccaggaatgccattaattagttaagctcatgtcttaactaggagtcttctcctcaataagcaattcacttctcttcctggtctatccctcaaaactaagaatgcgtttaccaaacaagattatcttacagctacagagatcacactccacatattcttaacctaaatattttattcactgatcttgcagagaaaaatttgtttggacaagttaacagttttaactggaatttatgttttaggaggaggataaactactatttctatgcaaatattactatacttttagaatccatgtgaatagtataaaatgatttttctctaaagcctagaatcattaatgtaatggttaaacatttctgcaataataaaacataaaatacgtggaaatactttatatattcaagttttaacaatcatttaaacatattaaaggtgatccaattttcagtcttgaaggaaggtcattattctttcatgtcaattctttcctcatgctcttcttactgattcctgattactgattaaaggatgtgttgtacaaggagggaattttggaaaattcacaaatacatggaaattaaacaacatactcc

SEQ ID NO: 129293 - DNA, 549 bp, Homo sapiens
tgggaggtaattgaatcacagggacgggtctttcccatattgttcttgtgatagtgaataagtctcatgagctctgaaggctttacaaatgagagtttcccttcacaagccctctctctccctctctttgcctgctgccatccatgtaagacatgatttgttcctccttgtcttccaccatgattgtgaggctccccagccatgtggaagtgtaagtccaattaaacctctttcttttgtaaattgcccagtcttgggtatgtctttatcagcagcatgaaaacggactaatacagtgatagtatttgaaaaggggcctttgggaggtaaacaaggttaaacaaggtcatgaggaccctaatccaataggatttgtgcccttatgaaaacagggagagacaaaccagagctcattggctatctcttccatgttgggacacacaaagaagatggccatctccaagacagaaatgtgatcatgctggcaccttgaccctgaacttctagcctttggaactgtgaaaataaatttgttttttaagccaccca

SEQ ID NO: 129294 - DNA, 350 bp, Homo sapiens
aaagatggaaaagatgaaactatctctgtttgcagatgacagaactgcttctgtgacaattcaagaaacatcaatgaaaaaaacatcctgctaaaaactgtaaagataaatgagtaattaagagaaattagaagtagattagaaaatttacatataattgcagatgtaatggtaaaattcaattaacaaaagaccataatgttagaaaaaaaaccaaacaaactaaaaacatctgacaagtaaaattccagataatttggagggagagggatggcagtagaaggcaaggaaacaaaatgtaatagagtttgttaaattattaatgctgactgagatgcatgtctgtcaga

SEQ ID NO: 129295 - DNA, 455 bp, Homo sapiens
tccataatgtgtgccaccagcacgctggctcatttttggtatttttactagagatggggtttcactatgttggccaggctggtctcgaactcctgaccttaggtgatctgcctgcctcagcctcccacagtgctgggattacagatgtgagccaccaccccagcctggaatttttaatctaaaagttacctgcaagggcattgaatttatgtaatttagccattttctcactctatgtccttaagcaagttatttaatccctctatgcacctcagttttcccatctacaaaatgagatacagtagggtcattgtaagttaaatgcagagattaaaaagcacttaagactgtatttgatgtgatggactgaatagcatctcctccctaaaattcatgtgctgtgagaaatgagtttctgttgtttgtttttattatggctgcttgagcagactaat

SEQ ID NO: 129296 - DNA, 588 bp, Homo sapiens
aagtctaaactagtagcttactaatttaggagtactggtgcagctacgatccagacagcagcctgttctctgagcttctccattccatggcttatccagacttctcatttatcactctctgggttctatgaaattgtggtgcaaagagtaaacaccctcaaccatagtaatgtatacttcaagataaataattccacatttcctatataaagttgttgaattttgattcaaaaatgcgtaagtattccaataagaaaaactttgtatgtagtgatttctatgtaaaaatattgttattattattatattcaaatggtttatatgttttcattgtcactcagttaagcagccaattctgttagctggtaattccacaaagagaagccatctgccccaggagcaacagaccaagctgccttggtctgagagggtgcatctgtggaactcttgcgcaacttacattttatgtcaccttttgattttactcccaagatactgtgaaaatgttgcacttggaatttatttatggctataacttataatattcattttaataataaagattgtctttgtaattacatagaaatt

SEQ ID NO: 129297 - DNA, 1204 bp, Homo sapiens
tccagggtaaattcactcttaagacagccaaaccactacatgccctctcccaagtgggagaggcccctaagcctctgagcagctgatacacccccaggtcaacagagtgactatgagcccatgctcaggacctgagaaacagccttgcaggccccatccaccacagacatgctcctggcctgcccaggagccctctgcctttaataagggcctgagaaacagtcccacaggctgcccccagcaggcacaccaccgagtgggccttgcacctgtctctcagacctgagagacaagcagctgtgtatgcccaagtctcagggccaagaaacaaccctgggagcttactctggccagcagactgtcaggccagctaagcagccacatacctatgtcccagcttgaggaacagccctttaggccacccccgacagaaacactcccaggccaactaagcagctgtgcgaccttgcatgagcctgagaaatagtcctgtatccattcccagcagatgcacctccagaccagccaatcagccatgaatgtccatgtcctggacctaagaaagagctccatgggctactcccagaagacatgcccttaggccagccgagcagcctcgtgtccacatcctggctcatagaagcagtcccctgggcttcccctggcaggcaccacccaggccagctgagcagcagtgtgcccacatcctgagctagaatagctctatggactacccccagcagacacacatccgggacagctgagaagtcatttgactgtatcccaggcctgagaaacccccttcttggccagccctggcaaagatattttcagtccagcttagcagctatgcagctatatatttggcccatgagtttccccccagcagactggccacaggccagatgagcagctgtgtacccacataccaggtatgggaaacagcccttcaggccactcctggagtgcattcttccaggccaggcaaacagctgtgtgcctgcatcctgggcctgagaaactgtcctgcaaagcacatctggcagtcatgccctggttgagcagctgcatccccatgctcctggctagagtgacagcaccatggccagccgcataaagccatactccaagttttctgacccactgtgtgcctgcacacacccctaccctgcgaacctatgagggatcctctagatcaccacca

SEQ ID NO: 129298 - DNA, 574 bp, Homo sapiens
ctctggcactgcagcatctagtactactgaggtgtaagcgcttacacctcagtagtacccatgacaacatttatttaattgaccaaacacgaacattatagaggaaggtgatcatttaaatgatatacttgaaattcatctgagtaaggaagctgagaacagtcaaagaagctaatttaaaaaataaaaataaataaaaagaaccacctaatccgctgatttctaatcatgccgagtgcttatctctcctgccaggcatacagcgagcgccttgcagagtctcacagcggcactgtcttctcttttgcagcactccgtacaaagtgagacctgtggccatcaagcaactctccggtaaggccctgctgtcgttttttaaactaaaagaaggaaaaagaaatcttgagcttgcccctgtgataaaatatatactagttaagcatttgaatctaagcatttgaaatatatatgagttacctttgaagcatttaactatatgttagttaagcatttgaatctgcatttgaagccgatacaactgcagaatctgaaccttgtactactgagggctctg

SEQ ID NO: 129299 - DNA, 625 bp, Homo sapiens
cgcctcccgcggcggctggcgtcgggaaagtacagtaaaaagtccgagtgcagccgccgggcgcaggatgggatccggctcctccagctaccggcccaaggccatctacctggacatcgatggacgcattcagaaggtaatcttcagcaagtactgcaactccagcgacatcatggacctgttctgcatcgccaccggcctgcctcggaacacgaccatctccctgctgaccaccgacgacgccatggtctccatcgaccccaccatgcccgcgaattcagaacggaatgagctcattctctatacatcactccgtaacttgttgtttttacctagtaaggagtcatgggcgtcccaccagcactccgtacaaagtgagacctgtggccatcaagcaactctccggtaaggccctgctgtcgttttttaaactaaaagaaggaaaaagaaatcttgagcttgcccctgtgataaaatatatactagttaagcatttgaatctaagcatttgaaatatatatgagttacctttgaagcatttaactatatgttagttaagcatttgaatctgcatttgaagccgatacaactgcagaatctgaaccttgtactactgagggctctg

SEQ ID NO: 129300 - DNA, 1852 bp, Homo sapiens
  misc_feature (1819)..(1820): n is a, c, g, or t
  misc_feature (1828)..(1828): n is a, c, g, or t
cgcctcccgcggcggctggcgtcgggaaagtacagtaaaaagtccgagtgcagccgccgggcgcaggatgggatccggctcctccagctaccggcccaaggccatctacctggacatcgatggacgcattcagaaggtaatcttcagcaagtactgcaactccagcgacatcatggacctgttctgcatcgccaccggcctgcctcggaacacgaccatctccctgctgaccaccgacgacgccatggtctccatcgaccccaccatgcccgcgaattcagaacgcactccgtacaaagtgagacctgtggccatcaagcaactctccgagagagaagaattaatccagagcgtgctggcgcaggttgcagagcagttctcaagagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgtgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaagtcgnncggccgcnaatttagtagtagtaggcggcagc

SEQ ID NO: 129301 - DNA, 2112 bp, Homo sapiens
cggctaggtagcgaggcgggtggttgactggacatcgatggacgcattcagaaggtaatcttcagcaagtactgcaactccagcgacatcatggacctgttctgcatcgccaccggcctgcctcggaacacgaccatctccctgctgaccaccgacgacgccatggtctccatcgaccccaccatgcccgcgaattcagaacgcactccgtacaaagtgagacctgtggccatcaagcaactctccgagagagaagaattaatccagagcgtgctggcgcaggttgcagagcagttctcaagagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgtgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaatgggtactgtacttcttctttggtagagttgtgtatgctgcttccggtaagttctctcatggagacgaaggacactgtgcttttcccccagatgtatcttagagcaattgaccagtgtgatgcggtgcgtacgtccctgtaaattcagcattaaatgtcagcacggtgccctgagtgcaaggacatgcacgggtcctgtgtttctgagcagagggggacgtcagtgccgtgtgtgggacatctggggactgaggcaggttggccagactgtaggtcgtgtgtcggagcaaacgcacccatgaccatggg

SEQ ID NO: 129302 - DNA, 2045 bp, Homo sapiens
cgcctcccgcggcggctggcgtcgggaaagtacagtaaaaagtccgagtgcagccgccgggcgcaggatgggatccggctcctccagctaccggcccaaggccatctacctggacatcgatggacgcattcagaagcactccgtacaaagtgagacctgtggccatcaagcaactctccgagagagaagaattaatccagagcgtgctggcgcaggttgcagagcagttctcaagagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgtgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaatgggtactgtacttcttctttggtagagttgtgtatgctgcttccggtaagttctctcatggagacgaaggacactgtgcttttcccccagatgtatcttagagcaattgaccagtgtgatgcggtgcgtacgtccctgtaaattcagcattaaatgtcagcacggtgccctgagtgcaaggacatgcacgggtcctgtgtttctgagcagagggggacgtcagtgccgtgtgtgggacatctggggactgaggcaggttggccagactgtaggtcgtgtgtcggagcaaacgcacccatgaccatggg

SEQ ID NO: 129303 - DNA, 1990 bp, Homo sapiens
cgcctcccgcggcggctggcgtcgggaaagtacagtaaaaagtccgagtgcagccgccgggcgcaggatgggatccggctcctccagctaccggcccaaggccatctacctggacatcgatggacgcattcagaagcactccgtacaaagtgagacctgtggccatcaagcaactctccgagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgtgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaatgggtactgtacttcttctttggtagagttgtgtatgctgcttccggtaagttctctcatggagacgaaggacactgtgcttttcccccagatgtatcttagagcaattgaccagtgtgatgcggtgcgtacgtccctgtaaattcagcattaaatgtcagcacggtgccctgagtgcaaggacatgcacgggtcctgtgtttctgagcagagggggacgtcagtgccgtgtgtgggacatctggggactgaggcaggttggccagactgtaggtcgtgtgtcggagcaaacgcacccatgaccatggg

SEQ ID NO: 129304 - DNA, 2897 bp, Homo sapiens
actaatgtggcatcctgcctgtggagagatgcacagactgacccatccagacagcacagtggagcacgctctttcaacccacctgcacctgaccacagtgggcactcaggaagaaatgggtagagcgagtgaatgaatgaatgagcaagtcaaagacatgaacacatgacatctgactgtctccctgtgtgcttgtgtttcattctgatacatccctccctaaattcatctgctgagacaaaggattttaactggtgtttctacactgctttccccaagatgtggcaacccacaccccaccagcaacacctgtgatgtctgccgccctgtgtccttgtagcacctctcttaccaggtttccaaatgttgctaaactgctgggtcaaggaatagcatctgcctggggttagcctcacttgtgtggattttttcttactcctcttggccactgactgctcctggtctatgcctgttccattggctgcactgtccttccctgcctcttggccagaggctgtcgtgtgtcagcgacagaaacgttttggctgtcgtctgcacagccagtattctctccccatcacgctgggcctcgtgatgatggggggaggggggttgacatcacagagatcccagtgcattttcgacttcatcactgtcaccatcctctcttgttcatttgggggatacagccgccatcagctcaacagagcaaaagagagggaggccacctgcatccgccaggtgctgaaatgggtccaggcagctgccagagtctgacatttccaacttgatacagcacctgtgatcggcagtagtacccatgacaacatttatttaattgaccaaacacgaacattatagaggaaggtgatcatttaaatgatatacttgaaattcatctgagtaaggaagctgagaacagtcaaagaagctaatttaaaaaataaaaataaataaaaagaaccacctaatccgctgatttctaatcatgccgagtgcttatctctcctgccaggcatacagcgagcgccttgcagagtctcacagcggcactgtcttctcttttgcagcactccgtacaaagtgagacctgtggccatcaagcaactctccgagagagaagaattaatccagagcgtgctggcgcaggttgcagagcagttctcaagagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgtgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaatgggtactgtacttcttctttggtagagttgtgtatgctgcttccggtaagttctctcatggagacgaaggacactgtgcttttcccccagatgtatcttagagcaattgaccagtgtgatgcggtgcgtacgtccctgtaaattcagcattaaatgtcagcacggtgccctgagtgcaaggacatgcacgggtcctgtgtttctgagcagagggggacgtcagtgccgtgtgtgggacatctggggactgaggcaggttggccagactgtaggtcgtgtgtcggagcaaacgcacccatgaccatggg

SEQ ID NO: 129305 - DNA, 2098 bp, Homo sapiens
cgcctcccgcggcggctggcgtcgggaaagtacagtaaaaagtccgagtgcagccgccgggcgcaggatgggatccggctcctccagctaccggcccaaggccatctacctggacatcgatggacgcattcagaaggtaatcttcagcaagtactgcaactccagcgacatcatggacctgttctgcatcgccaccggcctgcctcggaacacgaccatctccctgctgaccaccgacgacgccatggtctccatcgaccccaccatgcccgcgaattcagaacgcactccgtacaaagtgagacctgtggccatcaagcaactctccgagagagaagaattaatccagagcgtgctggcgcaggttgcagagcagttctcaagagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgtgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaatgggtactgtacttcttctttggtagagttgtgtatgctgcttccggtaagttctctcatggagacgaaggacactgtgcttttcccccagatgtatcttagagcaattgaccagtgtgatgcggtgcgtacgtccctgtaaattcagcattaaatgtcagcacggtgccctgagtgcaaggacatgcacgggtcctgtgtttctgagcagagggggacgtcagtgccgtgtgtgggacatctggggactgaggcaggttggccagactgtaggtcgtgtgtcggagcaaacgcacccatgaccatggg

SEQ ID NO: 129306 - DNA, 1907 bp, Homo sapiens
cgcctcccgcggcggctggcgtcgggaaagtacagtaaaaagtccgagtgcagccgccgggcgcaggatgggatccggctcctccagctaccggcccaaggccatctacctggacatcgatggacgcattcagaaggtaatcttcagcaagtactgcaactccagcgacatcatggacctgttctgcatcgccaccggcctgcctcggaacacgaccatctccctgctgaccaccgacgacgccatggtctccatcgaccccaccatgcccgcgaattcagaacgcactccgtacaaagtgagacctgtggccatcaagcaactctccgagagagaagaattaatccagagcgtgctggcgcaggttgcagagcagttctcaagagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgtgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaatgggtactgtacttcttctttggtagagttgtgtatgctgcttccggtaagttctctcatggagacgaaggacactgtgcttttcccccagatgtatcttagagcaattgaccagtgtgatgcggtgcgtacgtccctgtaaattcagcattaaatgtcagcacggtgccctgagtgcaaggacatgcacgggtcctgtgtttctgagcagagggggacgtcagtgccgtgtgtgggacatctggggactgaggcaggttggccagactgtaggtcgtgtgtcggagcaaacgcacccatgaccatggg

SEQ ID NO: 129307 - DNA, 1372 bp, Homo sapiens
cgcctcccgcggcggctggcgtcgggaaagtacagtaaaaagtccgagtgcagccgccgggcgcaggatgggatccggctcctccagctaccggcccaaggccatctacctggacatcgatggacgcattcagaaggtaatcttcagcaagtactgcaactccagcgacatcatggacctgttctgcatcgccaccggcctgcctcggaacacgaccatctccctgctgaccaccgacgacgccatggtctccatcgaccccaccatgcccgcgaattcagaacgcactccgtacaaagtgagacctgtggccatcaagcaactctccgagagagaagaattaatccagagcgtgctggcgcaggttgcagagcagttctcaagagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgtgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagaacgcgcctaatgggtaccgagct

SEQ ID NO: 129308 - DNA, 1338 bp, Homo sapiens
ttggtggcgttctagaggatcccattaggcgcggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaatgggtactgtacttcttctttggtagagttgtgtatgctgcttccggtaagttctctcatggagacgaaggacactgtgcttttcccccagatgtatcttagagcaattgaccagtgtgatgcggtgcgtacgtccctgtaaattcagcattaaatgtcagcacggtgccctgagtgcaaggacatgcacgggtcctgtgtttctgagcagagggggacgtcagtgccgtgtgtgggacatctggggactgaggcaggttggccagactgtaggtcgtgtgtcggagcaaacgcacccatgaccatggg

SEQ ID NO: 129309 - DNA, 941 bp, Homo sapiens
tggttaactggcgcatcttgtctttctctgagaacagcgatctggttatggggcatttctgtctctaatgtcactgtctgctgcattccctgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaatgggtactgtacttcttctttggtagagttgtgtatgctgcttccggtaagttctctcatggagacgaaggacactgtgcttttcccccagatgtatcttagagcaattgaccagtgtgatgcggtgcgtacgtccctgtaaattcagcattaaatgtcagcacggtgccctgagtgcaaggacatgcacgggtcctgtgtttctgagcagagggggacgtcagtgccgtgtgtgggacatctggggactgaggcaggttggccagactgtaggtcgtgtgtcggagcaaacgcacccatgaccatggg

SEQ ID NO: 129310 - DNA, 1629 bp, Homo sapiens
actaatgtggcatcctgcctgtggagagatgcacagactgacccatccagacagcacagtggagcacgctctttcaacccacctgcacctgaccacagtgggcactcaggaagaaatgggtagagcgagtgaatgaatgaatgagcaagtcaaagacatgaacacatgacatctgactgtctccctgtgtgcttgtgtttcattctgatacatccctccctaaattcatctgctgagacaaaggattttaactggtgtttctacactgctttccccaagatgtggcaacccacaccccaccagcaacacctgtgatgtctgccgccctgtgtccttgtagcacctctcttaccaggtttccaaatgttgctaaactgctgggtcaaggaatagcatctgcctggggttagcctcacttgtgtggattttttcttactcctcttggccactgactgctcctggtctatgcctgttccattggctgcactgtccttccctgcctcttggccagaggctgtcgtgtgtcagcgacagaaacgttttggctgtcgtctgcacagccagtattctctccccatcacgctgggcctcgtgatgatggggggaggggggttgacatcacagagatcccagtgcattttcgacttcatcactgtcaccatcctctcttgttcatttgggggatacagccgccatcagctcaacagagcaaaagagagggaggccacctgcatccgccaggtgctgaaatgggtccaggcagctgccagagtctgacatttccaacttgatacagcacctgtgatcggcagtagtacccatgacaacatttatttaattgaccaaacacgaacattatagaggaaggtgatcatttaaatgatatacttgaaattcatctgagtaaggaagctgagaacagtcaaagaagctaatttaaaaaataaaaataaataaaaagaaccacctaatccgctgatttctaatcatgccgagtgcttatctctcctgccaggcatacagcgagcgccttgcagagtctcacagcggcactgtcttctcttttgcagcactccgtacaaagtgagacctgtggccatcaagcaactctccgatattcatttctccagcaccatttgttgaaaagatgatcttttctcccactgaattaccatgacacctttgtggaaaatcgatgggccatgtatgtgtgagtctttttctggactccagatcctgtcgtgtgaatttacatgtcttaaaacaacagcacaccatcttgactaccgtagataaatagtaggtcttgaaatcaggtactctaagttatctctggtttcttttttctttttcaaaaatgttattgcttttattttcaaataaattttagaatcagtctatgaattgcttccaaaaaaacagtctgctaggattttgactgaagttgcattaaatatacagaccaatgtgggaagaattaatatcttaagaatgttgagtcttctggttcataaatatggtctatctccccattcatttgggtttcctttaatgtttctcaataatgtgttaccattgttaatatgaagtacttaataaatactgataaatacatcactatttcatgta

SEQ ID NO: 129311 - DNA, 995 bp, Homo sapiens
aaaagaatgctataagagagagaagcattaacaaaatggaatagtaagtcctttcctaggcactaagtactttcaatgtaaatggattaagctgctcaatcaaagacatacagtgaattccgaaaacccaaacaagatcccactataataacgtctacaagagactcactttagatttaaggacacacacaggctgaaagtgagaagatatttaatacaaatggtaaccaaaagacagcaaggttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaatgggtactgtacttcttctttggtagagttgtgtatgctgcttccggtaagttctctcatggagacgaaggacactgtgcttttcccccagatgtatcttagagcaattgaccagtgtgatgcggtgcgtacgtccctgtaaattcagcattaaatgtcagcacggtgccctgagtgcaaggacatgcacgggtcctgtgtttctgagcagagggggacgtcagtgccgtgtgtgggacatctggggactgaggcaggttggccagactgtaggtcgtgtgtcggagcaaacgcacccatgaccatggg

SEQ ID NO: 129312 - DNA, 1467 bp, Homo sapiens
actaatgtggcatcctgcctgtggagagatgcacagactgacccatccagacagcacagtggagcacgctctttcaacccacctgcacctgaccacagtgggcactcaggaagaaatgggtagagcgagtgaatgaatgaatgagcaagtcaaagacatgaacacatgacatctgactgtctccctgtgtgcttgtgtttcattctgatacatccctccctaaattcatctgctgagacaaaggattttaactggtgtttctacactgctttccccaagatgtggcaacccacaccccaccagcaacacctgtgatgtctgccgccctgtgtccttgtagcacctctcttaccaggtttccaaatgttgctaaactgctgggtcaaggaatagcatctgcctggggttagcctcacttgtgtggattttttcttactcctcttggccactgactgctcctggtctatgcctgttccattggctgcactgtccttccctgcctcttggccagaggctgtcgtgtgtcagcgacagaaacgttttggctgtcgtctgcacagccagtattctctccccatcacgctgggcctcgtgatgatggggggaggggggttgacatcacagagatcccagtgcattttcgacttcatcactgtcaccatcctctcttgttcatttgggggatacagccgccatcagctcaacagagcaaaagagagggaggccacctgcatccgccaggtgctgaaatgggtccaggcagctgccagagtctgacatttccaacttgatacagcacctgtgatcggcagtagtacccatgacaacatttatttaattgaccaaacacgaacattatagaggaaggtgatcatttaaatgatatacttgaaattcatctgagtaaggaagctgagaacagtcaaagaagctaatttaaaaaataaaaataaataaaaagaaccacctaatccgctgatttctaatcatgccgagtgcttatctctcctgccaggcatacagcgagcgccttgcagagtctcacagcggcactgtcttctcttttgcagcactccgtacaaagtgagacctgtggccatcaagcaactctccgctggtgtcgaggacaagagaaccacaagccgtggccagtctgctgagagaccactgagggacagacgggttgtgggcctggagcagccccggagggaaggagcatttgaaagtggacaggtagagcccaggcccagagagccccagggctgctaccaggaaggccagcgcatccctccagagcattcaaaatcaatgaactgaaagctgaagttgcaaatcacttggctgtcctagagaaacgcgtggaattggaaggacgcaactgaaacggctggagagcctggctagccgtctacaaggaaaacatggagaagctgactgaggagcgggatctgcgcatgcagccgagaa

SEQ ID NO: 129313 - DNA, 594 bp, Homo sapiens
ccaccgcgccctaattctaacaaaaacaaatcagtcatcgtttcccttcttccaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaatgggtactgtacttcttctttggtagagttgtgtatgctgcttccggtaagttctctcatggagacgaaggacactgtgcttttcccccagatgtatcttagagcaattgaccagtgtgatgcggtgcgtacgtccctgtaaattcagcattaaatgtcagcacggtgccctgagtgcaaggacatgcacgggtcctgtgtttctgagcagagggggacgtcagtgccgtgtgtgggacatctggggactgaggcaggttggccagactgtaggtcgtgtgtcggagcaaacgcacccatgaccatggg

SEQ ID NO: 129314 - DNA, 591 bp, Homo sapiens
  misc_feature (552)..(552): n is a, c, g, or t
cgcctcccgcggcggctggcgtcgggaaagtacagtaaaaagtccgagtgcagccgccgggcgcaggatgggatccggctcctccagctaccggcccaaggccatctacctggacatcgatggacgcattcagaaggtaatcttcagcaagtactgcaactccagcgacatcatggacctgttctgcatcgccaccggcctgcctcggaacacgaccatctccctgctgaccaccgacgacgccatggtctccatcgaccccaccatgcccgcgaattcagaacgcactccgtacaaagtgagacctgtggccatcaagcaactctccgagagagaagaattaatccagagcgtgctggcgcaggttgcagagcagttctcaagagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgccnctgtaagtacagttttttgatgctccgtcgaagtgggga

SEQ ID NO: 129315 - DNA, 306 bp, Homo sapiens
aagaaagaaaaagaaagagaacgggagaaagaggagaaatatctcagcatgcacatcactgtcacaggcccacggcgcctggttaacacggaactcctgtcctttctagtacctgctctctccagagaccatcgaggccctgcggaagccgacctttgacgtctggctttgggagcccaatgaggtaagtgcggggcttgcaggcaccacgtcccagggggaggcagctcaggatcttggacgccagtgggaccacccccatcgctcttcctccttcttgctttttcctcttctttttaaagactg

SEQ ID NO: 129316 - DNA, 724 bp, Homo sapiens
gcacgctctcacacggtcatcttcagccagcactgcaataccacagacttcatcgcacatgttctgcatcgccaccggctcgccttggaacacgaccatctccctgctgaccaccgacgacgccatggtctccatcgaccccaccatgcccgcgaattcagaacgcactccgtacaaagtgagacctgtggccatcaagcaactctccgatattcatttctccagcaccatttgttgaaaagatgatcttttctcccactgaattaccatgacacctttgtggaaaatcgatgggccatgtatgtgtgagtctttttctggactccagatcctgtcgtgtgaatttacatgtcttaaaacaacagcacaccatcttgactaccgtagataaatagtaggtcttgaaatcaggtactctaagttatctctggtttcttttttctttttcaaaaatgttattgcttttattttcaaataaattttagaatcagtctatgaattgcttccaaaaaaacagtctgctaggattttgactgaagttgcattaaatatacagaccaatgtgggaagaattaatatcttaagaatgttgagtcttctggttcataaatatggtctatctccccattcatttgggtttcctttaatgtttctcaataatgtgttaccattgttaatatgaagtacttaataaatactgataaatacatcactatttcatgta

SEQ ID NO: 129317 - DNA, 2194 bp, Homo sapiens
cgcctcccgcggcggctggcgtcgggaaagtacagtaaaaagtccgagtgcagccgccgggcgcaggatgggatccggctcctccagctaccggcccaaggccatctacctggacatcgatggacgcattcagaaggtaatcttcagcaagtactgcaactccagcgacatcatggacctgttctgcatcgccaccggcctgcctcggaacacgaccatctccctgctgaccaccgacgacgccatggtctccatcgaccccaccatgcccgcgaattcagaacgcactccgtacaaagtgagacctgtggccatcaagcaactctccgagagagaagaattaatccagagcgtgctggcgcaggttgcagagcagttctcaagagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgtgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaatgggtactgtacttcttctttggtagagttgtgtatgctgcttccggtaagttctctcatggagacgaaggacactgtgcttttcccccagatgtatcttagagcaattgaccagtgtgatgcggtgcgtacgtccctgtaaattcagcattaaatgtcagcacggtgccctgagtgcaaggacatgcacgggtcctgtgtttctgagcagagggggacgtcagtgccgtgtgtgggacatctggggactgaggcaggttggccagactgtaggtcgtgtgtcggagcaaacgcacccatgaccatggg

SEQ ID NO: 129318 - DNA, 2374 bp, Homo sapiens
cgcctcccgcggcggctggcgtcgggaaagtacagtaaaaagtccgagtgcagccgccgggcgcaggatgggatccggctcctccagctaccggcccaaggccatctacctggacatcgatggacgcattcagaaggtaatcttcagcaagtactgcaactccagcgacatcatggacctgttctgcatcgccaccggcctgcctcggaacacgaccatctccctgctgaccaccgacgacgccatggtctccatcgaccccaccatgcccgcgaattcagaacgcactccgtacaaagtgagacctgtggccatcaagcaactctccgctggtgtcgaggacaagagaaccacaagccgtggccagtctgctgagagaccactgagggacagacgggttgtgggcctggagcagccccggagggaaggagcatttgaaagtggacaggtagagcccaggcccagagagccccagggctgctaccaggaaggccagcgcatccctccagagagagaagaattaatccagagcgtgctggcgcaggttgcagagcagttctcaagagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgtgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaatgggtactgtacttcttctttggtagagttgtgtatgctgcttccggtaagttctctcatggagacgaaggacactgtgcttttcccccagatgtatcttagagcaattgaccagtgtgatgcggtgcgtacgtccctgtaaattcagcattaaatgtcagcacggtgccctgagtgcaaggacatgcacgggtcctgtgtttctgagcagagggggacgtcagtgccgtgtgtgggacatctggggactgaggcaggttggccagactgtaggtcgtgtgtcggagcaaacgcacccatgaccatggg

SEQ ID NO: 129319 - DNA, 3159 bp, Homo sapiens
actaatgtggcatcctgcctgtggagagatgcacagactgacccatccagacagcacagtggagcacgctctttcaacccacctgcacctgaccacagtgggcactcaggaagaaatgggtagagcgagtgaatgaatgaatgagcaagtcaaagacatgaacacatgacatctgactgtctccctgtgtgcttgtgtttcattctgatacatccctccctaaattcatctgctgagacaaaggattttaactggtgtttctacactgctttccccaagatgtggcaacccacaccccaccagcaacacctgtgatgtctgccgccctgtgtccttgtagcacctctcttaccaggtttccaaatgttgctaaactgctgggtcaaggaatagcatctgcctggggttagcctcacttgtgtggattttttcttactcctcttggccactgactgctcctggtctatgcctgttccattggctgcactgtccttccctgcctcttggccagaggctgtcgtgtgtcagcgacagaaacgttttggctgtcgtctgcacagccagtattctctccccatcacgctgggcctcgtgatgatggggggaggggggttgacatcacagagatcccagtgcattttcgacttcatcactgtcaccatcctctcttgttcatttgggggatacagccgccatcagctcaacagagcaaaagagagggaggccacctgcatccgccaggtgctgaaatgggtccaggcagctgccagagtctgacatttccaacttgatacagcacctgtgatcggcagtagtacccatgacaacatttatttaattgaccaaacacgaacattatagaggaaggtgatcatttaaatgatatacttgaaattcatctgagtaaggaagctgagaacagtcaaagaagctaatttaaaaaataaaaataaataaaaagaaccacctaatccgctgatttctaatcatgccgagtgcttatctctcctgccaggcatacagcgagcgccttgcagagtctcacagcggcactgtcttctcttttgcagcactccgtacaaagtgagacctgtggccatcaagcaactctccgctggtgtcgaggacaagagaaccacaagccgtggccagtctgctgagagaccactgagggacagacgggttgtgggcctggagcagccccggagggaaggagcatttgaaagtggacaggtagagcccaggcccagagagccccagggctgctaccaggaaggccagcgcatccctccagagagagaagaattaatccagagcgtgctggcgcaggttgcagagcagttctcaagagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgtgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaatgggtactgtacttcttctttggtagagttgtgtatgctgcttccggtaagttctctcatggagacgaaggacactgtgcttttcccccagatgtatcttagagcaattgaccagtgtgatgcggtgcgtacgtccctgtaaattcagcattaaatgtcagcacggtgccctgagtgcaaggacatgcacgggtcctgtgtttctgagcagagggggacgtcagtgccgtgtgtgggacatctggggactgaggcaggttggccagactgtaggtcgtgtgtcggagcaaacgcacccatgaccatggg

SEQ ID NO: 129320 - DNA, 1443 bp, Homo sapiens
ttggtggcgttctagaggatcccattaggcgcgttctgtgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaatgggtactgtacttcttctttggtagagttgtgtatgctgcttccggtaagttctctcatggagacgaaggacactgtgcttttcccccagatgtatcttagagcaattgaccagtgtgatgcggtgcgtacgtccctgtaaattcagcattaaatgtcagcacggtgccctgagtgcaaggacatgcacgggtcctgtgtttctgagcagagggggacgtcagtgccgtgtgtgggacatctggggactgaggcaggttggccagactgtaggtcgtgtgtcggagcaaacgcacccatgaccatggg

SEQ ID NO: 129321 - DNA, 1769 bp, Homo sapiens
  misc_feature (1736)..(1737): n is a, c, g, or t
  misc_feature (1745)..(1745): n is a, c, g, or t
cgcctcccgcggcggctggcgtcgggaaagtacagtaaaaagtccgagtgcagccgccgggcgcaggatgggatccggctcctccagctaccggcccaaggccatctacctggacatcgatggacgcattcagaaggtaatcttcagcaagtactgcaactccagcgacatcatggacctgttctgcatcgccaccggcctgcctcggaacacgaccatctccctgctgaccaccgacgacgccatggtctccatcgaccccaccatgcccgcgaattcagaacgcactccgtacaaagtgagacctgtggccatcaagcaactctccgagagagaagaattaatccagagcgtgctggcgcaggttgcagagcagttctcaagagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgtgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacacaaggatcccgcgcagctcggccagcccgtccagaactgcagccacgccccccgctttcctcaggcacagtctccttcactgtttttcacatctctgcttccctctctggacttcttggtggccccagacgtcaagctgtcagtcttcttctggtcgnncggccgcnaatttagtagtagtaggcggcagc

SEQ ID NO: 129322 - DNA, 1491 bp, Homo sapiens
cgcctcccgcggcggctggcgtcgggaaagtacagtaaaaagtccgagtgcagccgccgggcgcaggatgggatccggctcctccagctaccggcccaaggccatctacctggacatcgatggacgcattcagaaggtaatcttcagcaagtactgcaactccagcgacatcatggacctgttctgcatcgccaccggcctgcctcggaacacgaccatctccctgctgaccaccgacgacgccatggtctccatcgaccccaccatgcccgcgaattcagaacgcactccgtacaaagtgagacctgtggccatcaagcaactctccgagagagaagaattaatccagagcgtgctggcgcaggttgcagagcagttctcaagagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgtgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcaggtaagagtcttgcagagcaatcaagcctccagccactcttattagccccacttagtaagggtttgcgttaaacgagcacgcctgggtggtcccgcatattccccgggctgccgacagttcagcctccagaaagccttcagggt

SEQ ID NO: 129323 - DNA, 1924 bp, Homo sapiens
cgcctcccgcggcggctggcgtcgggaaagtacagtaaaaagtccgagtgcagccgccgggcgcaggatgggatccggctcctccagctaccggcccaaggccatctacctggacatcgatggacgcattcagaaggtaatcttcagcaagtactgcaactccagcgacatcatggacctgttctgcatcgccaccggcctgcctcggaacacgaccatctccctgctgaccaccgacgacgccatggtctccatcgaccccaccatgcccgcgaattcagaacgcactccgtacaaagtgagacctgtggccatcaagcaactctccgagagagaagaattaatccagagcgtgctggcgcaggttgcagagcagttctcaagagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgtgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctggtgagtggcttattctgcctgggtgggcagccaggcggtgggctggcgaagcaggtcatccatccagctcacactggaagccaagaagctgaaattattagtcttcttggaacaaggtgtctataaatctggttttcaaggtcatgactcttactaggaaagtccgggcagggcctccctcctgatgggtcctccttcatggtcagaggcagcattctcccattcctccatctcttttggatttgaaggagataagtgggtgaaggccgtgcatctcgctctgctttccagagaattaaaaccagctctcccattgaaggcacagccccagcatggcactctgaaagcccacctatgtgggggcaactccaacacagctcccgctccccaagccagcatcccccaccaggcccacaccatagcccagcacccctccataaccaggacaaggtggccagagaaggggtagggggcctcccccatgagaaggtgcacttaggttgcccagcatctgccttttggaaaggacaggcactgggcacaccaaggcacacaaggaccagagcacgactcatgcctggaatccagcactttgggaggccacggcaggaggattgcttgagtccaaaagtttgagaccagtctgagcaatattagcaagactccatctccacaaaaaaa

SEQ ID NO: 129324 - DNA, 846 bp, Homo sapiens
tctgcaggacgctgctgccgtcctgggatacatccatccaactcacctctgcctatctctcagagcgaccgtgagaagtcagaaggccttcctgtggcaccgttcatggaccgagacaaagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaatgggtactgtacttcttctttggtagagttgtgtatgctgcttccggtaagttctctcatggagacgaaggacactgtgcttttcccccagatgtatcttagagcaattgaccagtgtgatgcggtgcgtacgtccctgtaaattcagcattaaatgtcagcacggtgccctgagtgcaaggacatgcacgggtcctgtgtttctgagcagagggggacgtcagtgccgtgtgtgggacatctggggactgaggcaggttggccagactgtaggtcgtgtgtcggagcaaacgcacccatgaccatggg

SEQ ID NO: 129325 - DNA, 739 bp, Homo sapiens
cgcctcccgcggcggctggcgtcgggaaagtacagtaaaaagtccgagtgcagccgccgggcgcaggatgggatccggctcctccagctaccggcccaaggccatctacctggacatcgatggacgcattcagaaggtaatcttcagcaagtactgcaactccagcgacatcatggacctgttctgcatcgccaccggcctgcctcggaacacgaccatctccctgctgaccaccgacgacgccatggtctccatcgaccccaccatgcccgcgaattcagaacgcactccgtacaaagtgagacctgtggccatcaagcaactctccgagagagaagaattaatccagagcgtgctggcgcaggttgcagagcagttctcaagagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcagcaaaacaaaaaagaccaactgcccctgtaaatacattttttgggaaaccacaaagaagtgtcttcttaacgggtgttccatttccccaaaagccttgttttttaaaaaaacctggaagccctggggaacccacttttgtatttgggtttggggacccccaaggaaaaattgcgtcctagaaccaattaaccccaacccg

SEQ ID NO: 129326 - DNA, 106 bp, Homo sapiens
gtggtggagattgagaaatgcaagagtgacattaagaagatgagggaggagctggcggccagaagcagcagaggtagggtctgcgctggggccacgggcggccggg

SEQ ID NO: 129327 - DNA, 446 bp, Homo sapiens
tgggactacaggtgcccaccaccatgcccagctaatttttgtatttttagtagagatggggtttcgccatgttggccaggctggtctcgaactcctgacctcaggtgatccgcccacctcaccctcccaaagtgctgggattacaggcgtgagccaccatgcctgaccataaagacatgtttctaaattctcctgggacaacagtgaagttctacctttccttcctactttaccgaaggaacctgaaaataaggctgctttctgaaacttaaactactaagtcagtgatatttagagcagatgtaagcagctgtctagacacagaatggcttcccaggctcgcaagacttgtcatgaagcccccagcacgtcaacagaaagcatccaagctagaagaggcactggctcacagcagcaccccagaaaggaagcgtctcagggacaga

SEQ ID NO: 129328 - DNA, 372 bp, Homo sapiens
tgctgggattacaggtgtgagccaccgcacctggccaaaacaattattttagctaaaagtcatacattttctcttatttaaatgacaggctgatttttgtctctgcttacaggaaacacataccttggaagtggtcaaccttcatagtctgaaggaggaagtggtcaaataccaagatcagaacctggtctattaatcactaggcaggagtgtgtagaggaagacagactggggaatggagaccctgctagggaccacatcaaacccaggttacaatcaaacattggtacctgaaagctgttctgtctccacctggagacttttcacttctttgctctggacaggcttggctgatcccagcatttaacaaca

SEQ ID NO: 129329 - DNA, 766 bp, Homo sapiens
ggagttagttgcattcaatattatctgctagaaaattctttaagttagtattgtttaataggggaaacaattcaggacatgggcctaggcaaaaattttatgacttaagacttcaaaagctcaggcaacaaaaaacaaaaatagacaattgggactatattgaaccgaaaagcttctgcacagcaaaggaaacaatcaacagagtgaagagaccacctgtagaatgggagaagatattagtcaactattcatctgacaagggactagcacagaatatacacagaactcgaataactcaatggcaaaaacacaaataatttgatttaaaattggacaaaggaactgaatagacatttctcaaaagaagacataaaaatggccagcaagcatatgaaaaaatgcttagcatcgctaatcctcagggaaatgctaatgaaaatcacagtgagctagctcaccttagttagaatggctgttatcaaagagacgaaaaatagtaaatgttggtgaggatgtggagaaaagggaactcttacacacattctcttgtaattttgtctttgagaattattgctgatcattttaaatcttatggctatctatagctaatggaagtgtaagttagtacagccattgtggaaaacagtatggaggtctctcaaaaaaaaaactaaaaatagaactgctgtatgatccaggaattccactaccaggtgtttactcaaaggaaagaaaatctgtatatcaaagggatgtctgcaatccc

SEQ ID NO: 129330 - DNA, 353 bp, Homo sapiens
ggccctcatccagatgccaatgccatgaccttggacttcccagaaccatgagccaaataaactaattatgttaattatatctcaataaaactaatttttaaaaaagtattacttcatctttgtcactttcttcacataactaacttctcatttaatagcaaaaactaataataataaataagttttccagggatgactttagtgccagacttagtctcctttttgtacatcaatcagaaaagtgtgcacgtggttcctgacttacaatggcttgacttacagttttgctactttacaatggtaaaaaagcaatatgcggctgggcgcggtggctcacacctgtgatcccagca

SEQ ID NO: 129331 - DNA, 442 bp, Homo sapiens
agcttcctgaccttgtccctgtctccactaaaaatacaaaattagctgggtgtggtggtgggcacctgtagtcccagcagagggactcttgaggcagaggttgcggtgagccaagatcgcgccactgcactccagcctgggcgatagagcaagaattcatctcaataaataaataaattcattcattcatttctttgctatgtagactgaccagaatggattctgttgcttgcagctaagacccataactgatgtacttggcattcaaggctcactgtggtgtggtctttgcttatatctctggtcccatctgccaccattcccagcctagtactttaccctccagtgaaagatctctctccctcttccatactctctcatggcctctgacccttgtacaggctgacagatccatatttatttcacctctgtcatcacctcc

SEQ ID NO: 129332 - DNA, 554 bp, Homo sapiens
tgaggtggctcacacctgtaatcccagcactttgggaggccaaggggggtggatcacttgaggtcaggagttcgagaccagcctggccaatatggtgaaaccccatctctactaaaaatacaaaaattagctggatatggtggcacatgcctgtaatttcagctactcgggaggctgaggcgggagaatggcttgtaccctggaggcagaggttgcggtgagccaagatcgcgccactgcactccagcctgggcgatagagcaagaattcatctcaataaataaataaattcattcattcatttctttgctatgtagactgaccagaatggattctgttgcttgcagctaagacccataactgatgtacttggcattcaaggctcactgtggtgtggtctttgcttatatctctggtcccatctgccaccattcccagcctagtactttaccctccagtgaaagatctctctccctcttccatactctctcatggcctctgacccttgtacaggctgacagatccatatttatttcacctctgtcatcacctcc

SEQ ID NO: 129333 - DNA, 274 bp, Homo sapiens
acaggggatatatgtgtgtttacttggagatgcataaaacatttcctgaagaacacacaagaaagcaataacattagtttctttgggggtggagaaagtaaataactagggaacagaaaggagtcttcatagcatattcttaagagccgccagaattttaaaccatgtatatataattctttccaaacatgctcatttttcaaaatatatgatttatgaacctaaaagcttctgattttgaattttagaaatattcgtatcgcctatcctttta

SEQ ID NO: 129334 - DNA, 520 bp, Homo sapiens
acctgactccaaagctcatattcttcctatcatgccttccacagatggccaggacccctagcagccctgaaagtctgcaggagataaatgtacctggaggatggaagaagtgggtgctcgcctcatggagtgcataggtcaggatgattagtagggccctttggcacccaagagacccagaggctgatgcaccaaaagtggccctggcagcagtggcatagctagggtgagggcagaagtgggaagaaacaccaggttttcaattcacatcgcttgggcatctcctttgcaggagaggagcattgctcctcttctcctctgcaggggccgctaggctgtgtcgccagctttggatcccaacagagcaggattcagatcctgactgccatttatttgatgagtgacccttggaatctcacccgtaaaaatgaagaaaatggccaggcacagtggctcacacctgtaatcccagcactgtgggaggccaaggctggggatcacttgaggtcagcagtttgag

SEQ ID NO: 129335 - DNA, 192 bp, Homo sapiens
tataaaccgtggctcttctgcccctggtcccacaggctggagcttggtgtcaggcacctctcctggcagcaccacgggaaggaaggtcctgagaggcctcgcttcaccacacacgcgtcagaggagggcgggccggtgagctgagctcctgcgtgagagcgggagctgccacctgtgagacccgcaggggca

SEQ ID NO: 129336 - DNA, 171 bp, Homo sapiens
cgagcggccgtgggacagtatccggatcgagtcccccaatccgctgcaagcaggcgcagatccgggaggtggctatcggccccggggacgccgtcagagcgcgctgctccggatctgggggtgaagttgacacccgggacaagagagctgaacgcggcgtggcggacagtg

SEQ ID NO: 129337 - DNA, 476 bp, Homo sapiens
tgctaatattttgtatctattgtttccataaaccaaaacagagaaccctgtatggtgaatgctttaagttttcataggtcatttgcttcttcttagtcacatctacaggtaaatatttttaaatcaatgatcttttcctcagtataatcagtggttctatatgactttaaagaatgagctgttttggctgggcgtggtggctcacgcctgtaatcccagcactttgggaggccgaggcgggcagatcacgaggtcaagagatcgagaccatcctggccaacatggtgaaaccccatctctactaaaaatataaaaattagctgggcgtggtggtgcatgcctgtaactccagctactggtaagtctgaggcaggagaatcacttaaacctgggaggcggaggttgcagtgagccaagatcgcaccactgcactccagcctggcaacaggatgagactctgtctaaacaaacaaaca

SEQ ID NO: 129338 - DNA, 924 bp, Homo sapiens
tatataacctaaacctgtagttaccatatagaattcctatttgtctttcaaaaatctgaagaaagactgttcttcaaaagtctgacgacatttccaaaaagccttttctaatcttccaactcttccttctccttctatcctctggactgccatgatattcaattgcactgcatttattgcacttagcatactgaattataattaacaattacataaacctttctcctactaggttgcctcttatttgggatctagttaatggagagtttattgttagcaaaataggattttgatttaaagacatttattttaaaaatatcagtagtatatttatattagatacaatatagccaataatatgaaaacttttctcattttccaaaatatgtctgttcttctatggctttattttgttctctttataagaaacactttcagaagtgcaatagcaaagattatttgagaaaataatcttataatgcatttgtgcctggacttctttgtttctttgtttttgctttcgagcatttcattatccttgtggccatgaaaatatttcaattaaatatcatcacttttgaaggaaattctaatagggagcaagaatgtcccaccaagagacagggtcaagacaccagccttagctgctggcctttctcagaaatgtaagtggccactgcttttaaatggacacatgctccacttcttggaatctgttagtgttttataagggatggctgtttttgagtagttaagggtataccttcaaacttccaagattctaggtgagcctagggttccagttttgactctagaattctggcttagcctttcagtcttccacttcctcacaagccctttactttgaaagtctcccaaaccagctatgaaccccttggccagcaggcactcccttggtaaatt

SEQ ID NO: 129339 - DNA, 266 bp, Homo sapiens
cttttattcatttgtcatttaaaatcttgtttttatgaattttatgatttgagagaattttcatgtcaaaatatcctttcttttctgaaagaatattttagcattaaatattagaaggaatacaatttcagtagttatgtgatgaataaatttagctttctgaaaacagaccgcacttgctttgttttttccatttggcaatgaacctgtgcactagcatttaggaatcatttaggaattatcagtgtagtggaaacagccttgct

SEQ ID NO: 129340 - DNA, 362 bp, Homo sapiens
tgggctggggggaggcagagtcagtctctcaggtaaggcaggattttcagtagcaccgtacggctcccatgcttcctccactgcccctcttccccagccagctgggctggggaagagggcggggctggggaagagggttcactcttaggaaatccacctgaggggaggcaaggggaagccccaggaaagggccggggtgctggaaatctgagaaatctgagctgagaggcaggcagggtctgttttcatgcaccacatgcccaacctaacctgggccttcagggagctgtccacaccctgtccacaagccatgtgttcaggacttgacccacaagccacccagccttctgtacccattccac

SEQ ID NO: 129341 - DNA, 164 bp, Homo sapiens
tctatgatcacaaaagctttcatatcacttcagctgactttacacttttttgtttttttttttgagacagagtcttgctctgctgcccaggctggagtgtagtggcgcaatcttggctcattgcaacctccacctcccaggttcaagcgattctcatacctcag

SEQ ID NO: 129342 - DNA, 289 bp, Homo sapiens
gttattttaattggagaaacctgtgtaagctaagtttccttattgttccttttactctttataattgacataggtgaatttattcattcagccaatttgtttaagtaaatactggggaggcttcataagtcacaaagatattttgatatgtaaatgtagcaaacacaatgcttgctgtaatagaggcaccattattggccataaatatttctgctggagttagtttgtagctccaagtaaagataaagaaatatgcgtggtgaagaaataaaatcgattctgtatgtgg

SEQ ID NO: 129343 - DNA, 3159 bp, Homo sapiens
cgcgagagtacccctgatgagctacttcgcccacccgcggagctggccctggagcatcagccaccccaggccgggctccccccactggccttgtctcagctctttaacccggatgcctgtgggcgccgggtgcagacagtggtgctgtatgggacagtgggcacaggcaagagcacgctggtgcgcaagatggttctggactggtgttatgggcggctgccggccttcgagctgctcatccccttctcctgtgaggacctgtcatccctgggccctgccccagcctccctgtgccaacttgtggcccagcgctacacgcccctgaaggaggttctgcccctgatggctgctgctgggtcccacctcctctttgtgctccatggcttagagcatctcaacctcgacttccggctggcaggcacgggactttgtagtgacccggaggaaccgcaggaaccagctgctatcatcgtcaacctgctgcgcaaatacatgctgcctcaggccagcattctggtgaccactcggccctctgccattggccgtatccccagcaagtacgtgggccgctatggtgagatctgcggtttctctgataccaacctgcagaagctctacttccagctccgcctcaaccagccgtactgcgggtatgccgttggcggttcaggtgtctctgccacaccagctcagcgtgaccacctggtgcagatgctctcccggaacctggaggggcaccaccagatagccgctgcctgcttcctgccgtcctattgctggctcgtttgtgccaccttgcacttcctgcatgcccccacgcctgctgggcagacccttacaagcatctataccagcttcctgcgcctcaacttcagcggggaaaccctggacagcactgacccctccaatttgtccctgatggcctatgcagcccgaaccatgggcaagttggcctatgagggggtgtcctcccgcaagacctacttctctgaagaggatgtctgtggctgcctggaggctggcatcaggacggaggaggagtttcagctgctgcacatcttccgtcgggatgccctgaggtttttcctggccccatgtgtggagccagggcgtgcaggcaccttcgtgttcaccgtgcccgccatgcaggaatacctggctgccctctacattgtgctgggtttgcgcaagacgaccctgcaaaaggtgggcaaggaagtggctgagctcgtgggccgtgttggggaggacgtcagcctggtactgggcatcatggccaagctgctgcctctgcgggctctgcctctgctcttcaacctgatcaaggtggttccacgagtgtttgggcgcatggtgggtaaaagccgggaggcggtggctcaggccatggtgctggagatgtttcgagaggaggactactacaacgatgatgttctggaccagatgggcgccagtatcctgggcgtggagggcccccggcgccacccagatgagccccctgaggatgaagtcttcgagctcttccccatgttcatgggggggcttctctctgcccacaaccgagctgtgctagctcagcttggctgccccatcaagaacctggatgccctggagaatgcccaggccatcaagaagaagctgggcaagctgggccggcaggtgctgcccccatcagagctccttgaccacctcttcttccactatgagttccagaaccagcgcttctccgctgaggtgctcagctccctgcgtcagctcaacctggcaggtgtgcgcatgacaccagtcaagtgcacagtggtggcagctgtgctgggcagcggaaggcatgccctggatgaggtgaacttggcctcctgccagctagatcctgctgggctgcgcacactcctgcctgtcttcctgcgtgcccggaagctgggcttgcaactcaacagcctgggccctgaggcctgcaaggacctccgagacctgttgctgcatgaccagtgccaaattaccacactgcggtctgtccaacaacccgctgacggaggcaggtgttgccgtgctaatggaggggctggcaggaaacacctcagtgacgcacctgtccctgctgcacacgggccttggggacgaaggcctggagctgctggctgcccagctggaccgcaaccggcagctgcaggagctgaacgtggcgtacaacggtgctggtgacacagcggccctggccctggccagagctgcccgggagcacccttccctggaactgctacacctctacttcaatgagctgagctcagagggccgccaggtcttgcgagacttggggggtgctgctgaaggtggtgcccgggtggtggtgtcactgacagaggggacggcggtgtcagaatactggtcagtgatcctcagtgaagtccagcggaacctcaatagctgggatcgggcccgggttcagcgacaccttgagctcctactgcgggatctggaagatagccggggtgccacccttaatccttggcgcaaggcccagctgctgcgagtggagggcgaggtcagggccctcctggagcagctgggaagctctggaagctgagacactggcggcaggcacctagctatgtgaccactggccctaaaccttttccctctgtggcctcctggcttgcactgctccctctagaaagattccttcaggtctggaggcagaggaatgggcatagctgagccagttgccctcctagggcatgtttgaccaggactgagtctggaatctccaagttaaagatggtgaatcaatgcttcgggcttggagatggaacatgcctcctctccattcagctagaaggaccaaagcatgtggcatttggatggccagagtgccctgaagcaccactaccaaccttgcctccccctcctctcaaagagcctctgattgtgtcaccaaggggctcacatcttatgtctgccatgccaggggtgtcgccatccagatgtgttggaagcttcccctcctgccttatgctcacctgtggacaccgaggatgccctcacattggtgctctctcctcatcctcatgccccctttgccacaatggtatgatggcttggtagcccctcgaggcagatgcacctgacttgctgctattaaaaagccgtgtgccttctacc

SEQ ID NO: 129344 - DNA, 2293 bp, Homo sapiens
acgtgtctgtaatcccagctactcgggaggctgaggcaggagaatctcttgagcccaggaagtggaggttgcagtgagctgagatcgcgccactgtactccagcctgggtgacagagcgagactctgtctcacaaaaaaaaaaaaagaaaaaagaaagaaacaaagaaacaggctcgggcagcccaccccttctcacacatcacctccgacaggaggtcacagctgctgctgaggccaccccgccttgaggatgtgcctgccggacctgagttgcaacgagaggctgcagtctcccgaggggattcagaaagcccccagttattgaaaacccagcagaattgtcagccctgcacccccaagccctcttggagggagggttgccctggcagagcactgagcccatctgtttattcaccatcctgtggattcagcttcacagggtgacatattctgtcacaggtggttccacgagtgtttgggcgcatggtgggtaaaagccgggaggcggtggctcaggccatggtgctggagatgtttcgagaggaggactactacaacgatgatgttctggaccagatgggcgccagtatcctgggcgtggagggcccccggcgccacccagatgagccccctgaggatgaagtcttcgagctcttccccatgttcatgggggggcttctctctgcccacaaccgagctgtgctagctcagcttggctgccccatcaagaacctggatgccctggagaatgcccaggccatcaagaagaagctgggcaagctgggccggcaggtgctgcccccatcagagctccttgaccacctcttcttccactatgagttccagaaccagcgcttctccgctgaggtgctcagctccctgcgtcagctcaacctggcaggtgtgcgcatgacaccagtcaagtgcacagtggtggcagctgtgctgggcagcggaaggcatgccctggatgaggtgaacttggcctcctgccagctagatcctgctgggctgcgcacactcctgcctgtcttcctgcgtgcccggaagctgggcttgcaactcaacagcctgggccctgaggcctgcaaggacctccgagacctgttgctgcatgaccagtgccaaattaccacactgcggtctgtccaacaacccgctgacggaggcaggtgttgccgtgctaatggaggggctggcaggaaacacctcagtgacgcacctgtccctgctgcacacgggccttggggacgaaggcctggagctgctggctgcccagctggaccgcaaccggcagctgcaggagctgaacgtggcgtacaacggtgctggtgacacagcggccctggccctggccagagctgcccgggagcacccttccctggaactgctacacctctacttcaatgagctgagctcagagggccgccaggtcttgcgagacttggggggtgctgctgaaggtggtgcccgggtggtggtgtcactgacagaggggacggcggtgtcagaatactggtcagtgatcctcagtgaagtccagcggaacctcaatagctgggatcgggcccgggttcagcgacaccttgagctcctactgcgggatctggaagatagccggggtgccacccttaatccttggcgcaaggcccagctgctgcgagtggagggcgaggtcagggccctcctggagcagctgggaagctctggaagctgagacactggcggcaggcacctagctatgtgaccactggccctaaaccttttccctctgtggcctcctggcttgcactgctccctctagaaagattccttcaggtctggaggcagaggaatgggcatagctgagccagttgccctcctagggcatgtttgaccaggactgagtctggaatctccaagttaaagatggtgaatcaatgcttcgggcttggagatggaacatgcctcctctccattcagctagaaggaccaaagcatgtggcatttggatggccagagtgccctgaagcaccactaccaaccttgcctccccctcctctcaaagagcctctgattgtgtcaccaaggggctcacatcttatgtctgccatgccaggggtgtcgccatccagatgtgttggaagcttcccctcctgccttatgctcacctgtggacaccgaggatgccctcacattggtgctctctcctcatcctcatgccccctttgccacaatggtatgatggcttggtagcccctcgaggcagatgcacctgacttgctgctattaaaaagccgtgtgccttctacc

SEQ ID NO: 129345 - DNA, 264 bp, Homo sapiens
agcccatctgtttattcaccatcctgtggattcagcttcacagggtgacatattctgtcacaggttggtgttggagaaggggcactatcacctctatgagagtaacctcacatataaacatgaaaacaagccaggtgcagtggggcacacttgtagtcacagctgtcaggaggccaaggcaggaggatcgcttgagcctaagagttaaaggctacagtgagctatgatcacaccactgcactccagcctaggtgacacagcaag

SEQ ID NO: 129346 - DNA, 185 bp, Homo sapiens
tcttcagcatataaacaaagtattaatacttaccatagtaaaaaaacaaaaactaaaagactactgacttcccctaaaatttattgctcaatcgttatcttttcttctgcaatcccgctttttcaaactatggcttccctcagtgtccccactttctttcaccccctacctcaattttggcattt

SEQ ID NO: 129347 - DNA, 327 bp, Homo sapiens
cacagtggctcacgcctataatcccagcactttgggaggctaaggcgggcgaatcacgagctcaggagttcgagaccagcctggccaacacagtgaaaccccgtctctactaaaaatacaaaaattagctgggcatggtggtgggcacctgtaattccagctactcaggaggctgaagcaggaaatcgcttgaaactggtggtgggggtgggcaggggagaggggcagaggttgtaatgagccgaaatcatgccacttcactccagcagcctaggcaaaagagcgagactctgcctcaaaaaaaaaaaaagaaaaagaaaaagaaat

SEQ ID NO: 129348 - DNA, 613 bp, Homo sapiens
gacgctctctctgtggggcttcacacttgcaccggccttcccaaacccgtgctcactccgtgctcacacttgtgtggggcacttctcctggagctgcacaccccatccacgaactcagtcaatggctcatgatcacacacacgggttgcccaacctcgggcctagggccaggcttccaagcccagcaagtggggaagaaggggggcagagtccaaggaaggactgcccaggaacactgccccctcctagctgttgccatggaaacagagtcttcagggccagtaactgacagcaggtctcccccttgggaacctgggggaggcttagaaagcccctactcccacccaggccagggagcagggtaaccgtagcccccaggcaaccttcaaccccacctggaatccctagccaggagcaggatacttcccagttttctccagatgttggggggacctctgagaccctgccctcatctgggtattctgcattggagagcagacccaaggccagtggacgtgctcacaccgagttcacacactccactcaccggggtgctcaggagccccacaagcccacgcaggctcgctctctgctgagggctttcacacttgca

SEQ ID NO: 129349 - DNA, 512 bp, Homo sapiens
tttagggagctttccgacagctgaacacctgcgggctgctggacagtggtggtgcatccagagagggcatgaaagctctgtgccccttcccctataccttgctctatgcatctcttcatctgtatcctttataataaagcagtaaatgttaagtgtttccctgagttcagcgagctgctctagcaaatgaagcccaaagagagggtcatgggaacctcaacttgaagctggtcagtcagaagttctggaggcccagacttgcaactggtgtctgagggagaggggcagtcttgtgggatggagccctcaatctatgggatctgaggctacccccatatttctttaaaaaaaatgtattttttcaattattttttccctactattccccaactccttccccacttcctacttagacctttagaaatacaatataaccttttacctttcctttactagacactccctacagggcaagttcatctatgtgcttagaagctccagagcagaacttt

SEQ ID NO: 129350 - DNA, 553 bp, Homo sapiens
ttgcatagaattaggtcttgcctgatcaaagccttggagctgctgggtgattggacatggactgtgttctccctaggcatcttgtgcttgtccttccagtgctgattgtcctcggcggtgcccataggtgactctgtcttccgtaccagggctgttctgtggagccacagactgtgtgcctctctgttaccgctgtctccagcaccttgaagggtgcatctgctgctcacagaccttcagtaagttcctgctgagtgaatgaacacacgcttgtttgtaaggattagtgcttctgttggcagtgggatttgagaagcagggcacgaggagagagcaaggaacacccgggaacctaccctccctcagcctccaccttgttagagttcctcctgataggaagtggcagggaaatgcagtgaatctaaggaggggcacgtgtctatctttctgattgaaacacttttcttttctgtaattgaaatagctgtggccgctggcttgagaaaatatcccctaccttgcagtgtctagcatcaatgctgtttaaaatctt

SEQ ID NO: 129351 - DNA, 103 bp, Homo sapiens
gaaaaatgggcaatgcccttgaaatagatctcagagatacctccaagttgaggtgatggctcacttagcctctagaggtttcctaagacccactgcacaatgg

SEQ ID NO: 129352 - DNA, 336 bp, Homo sapiens
ctctcctcctctctacgtctctttctctctctccctacccctcccctcatcagatgcctcattatgactctggttccactctcctagttcagccccaggaggataggagatcccaggtaacggaccatccacaaagtgagaaatctacttactcattcggataatcaggaagccactagctgtattacagtttacttcccatatatctgtcctttgtcaggagaaaggcttctttctctgcccctacaatcttcgtgtgaattttagacccagctccttgaccatacccctaggaaatctaagtcctcaggattcagggcacaagtgggaagataa

SEQ ID NO: 129353 - DNA, 186 bp, Homo sapiens
aacatgaaatagattagcatgagtatttcatttgtttcttgtgaaactggttttttgcatttcaaaatgcatttcatttcatgttgttttatgatgaagagattaataccatctacgcagaagtattttctacactggtcagaatagttttaaagttcaaaaggaaaggatgactttttttttttt

SEQ ID NO: 129354 - DNA, 679 bp, Homo sapiens
gagacctcaggatgcaaaattaatatgtaagaatttcatcactttgttagaagatgcaatcggagttcatccaatatactgtcagagacttggtggatatttgtcaattttgtttgttattcaggaggaatacctggattttctctgagggagtcatccctgcttggtctcggtctacgtggtttatgtggtgctttgccaagtccactccctatccaccttccagtcttaagcagggggaatagctcaagctcagccactcaggctttcccttccgggaagctgaattccgagtggtgagacacaaaagtgggaatatgcttggaacagattcttcctgtgagcagaaccttgaagaggctgtttattcattcctgctacctggagccctgaagctgtctggttcccatctttgttctgtcacgatctgagcgtccagcttttggtttctctgagccgctccatatccttccaatcattttcctcttttcttttgcttcatttagtcagagtttaactgatagtctaagtgatagaataaaaatgtgaacacagaaaaaaatatcactagatgacagctgggattactagacagcattttctcactggacatgtgttttgaaagcacataccagcaccaggcactgttctaggcacttgagtcagtgacaaacaaaac

SEQ ID NO: 129355 - DNA, 457 bp, Homo sapiens
tatcataaaaaaatacattcaataaatagttactgcaggacacagagtattttaattattagtggaaaaattaccagttttcaaagcatgtctgccattctcaacagaaacttggccacaagcacatcccaacgaaaatcctgctgctgttcccccagcagccgccccccgggctatgcacagctctgaactcgccagtgtgtggcaacggctgttcctcttgaccctagcacactgggcccagccgcccaacttctcctgggaattctgactcaggtgaggaataaggcagtgggtgtgctggtttgacaagaccatgggacaggtgggcaaagaccactgagaagtaccatcaccaacgtttccaagaaataaagatattgttttgcacttgttacaccatcacagataaaatggtttttacaatagtcatgcaccgcttaataatgtttcactc

SEQ ID NO: 129356 - DNA, 852 bp, Homo sapiens
  misc_feature (830)..(830): n is a, c, g, or t
cttaatatccttagaaatagtcgatttcagtaacataacataatgggactgggaacacattttattagttaggaggaaattatagtagtagtattaacatcttacatctgtaagtaccctggagtccacaaaccaccgtcacaaagtttctaatttaatccagtcttagccacatggcaccctggaggactacaaaagaaactaaagaccctctgaagcttttaagctacagactaaaaagggtggggggacagaagtaacaagacataagaacaaatacaacatatcaaaataactagaaacattaagatctggtcaaatttataccatttcaccaaacccaaaatacataaatgtctatgatactaaaaaatgatagttagacctggccctatttttgatataaaatttcagtataaaaaaaacagctaagtgtttctaaaagtgaaatttgacgtagcatactaacacagcattttgagtttggggtattgttaatgtgggaaaccattcctaaagaaatgggttattgaacagggtctacacattgacaaatatgaatttaagaacagcattttaactgaggaaaaaaaataagaaaagaggtatcaaaaactgtactgaaatgatcttgcttgtgagtccagctcttccaaaagaagggtgaatttattttctttgtatctccagcactgactagaaattcagaaaaaatttttaaaacggaaataaaacaagttatgtgaaaatacagaaggataccttaaagaacaggtttttttaacaacaattactatggcagctttgtaattctggcagaagaaaaaaanctgggggtcctctagagtcacc

SEQ ID NO: 129357 - DNA, 1037 bp, Homo sapiens
cgctgcgtatctacaactatctgatctttgacaaacctgagaaaaacaagcaatggggaaaggattccctatttaataaatggtgctgggaaaactggctagccatatgtagaaagctgaaactagatcccttccttacaccttatacaaaaattaattcaagatggattaaagatttaaacgttagacctaaaaccataaaaaccctagaagaaaacctaggcaataccattcaggacataggcatgggcaaggacttcatgtctaaaacaccgaaagcaatggcaacaaaagccaaaattgacaaatgggatctaattaaactaaagagcttctgcacagcaaaagagactaccatcagagtgaacaggcaacctacaaaatgggagaaaattttcgcaacctactcatctgacaaagggctaatatccagaatctacaatgaactcaaatttacaagaaaaaaacaaacaaccccatcaaaaagtgggcaaaggacatgaacagacacttctcaaaagaagacatttatgcaccaaaaaacacatgaaaaaatgttctgcttttctttctttcaatttttggttcatgtattttggggctctgttattgggggcatacacatttaggatttttatgtagtttaatcagttgatcccttatcactgtgaaattactttctttatccctagtaactgcccttactcttacatctactttctgtgatattaatatggtcactttttatttcttttgactagcattagcatggtgtagctctatccatccttttacttttaacctgcctatgtttttaaagctgtactttttgtagacagcatatcgtcgtcttgctttttatccagtctaacaatctctgccttttaactgaactgtttataccattcacatttaatatggttattgacacagtaggattaaatttaccattttactattttttaatttgccccagctgtttgtttcccctctatatctatttttatcttttttgaattgggcattttttatgattc

SEQ ID NO: 129358 - DNA, 623 bp, Homo sapiens
ccatgatattctcatctatcagtacaaaaatgctggcttacctttttagcaaaacattggaagtcaattccttcttccttctcttattttttagattttaaaaattcataatttcatcctagggcatatataaaatggattatggaaatttatcaaacattataaatatagccatatttgtgaacattatttatgaggataaacatttatcagcatttggtaaaatgcctcttgattacaataactctttggatgataaaatgttccaatatttatatacaattctgttcccatttggaataaataccaaaatgtgcaaaggatttatgacactcttggtgtcttccaaaataagtctcaaacaaagattttctccagctattccagcatggggagggaatgagaaaatgtttcacaaataactgcattactcatttatgtggtagtatgccagtggcagtgcttttacaaagtcagaaaaatagtgattctccctatgttcccctcttcataattattagaatgggaagatttggaaagtagactgtgtctgcattattaaaaaaagcattaaaattttacatttatacgaaaattttagttttacacattgcattttccta

SEQ ID NO: 129359 - DNA, 552 bp, Homo sapiens
  misc_feature (15)..(15): n is a, c, g, or t
  misc_feature (27)..(27): n is a, c, g, or t
  misc_feature (39)..(39): n is a, c, g, or t
tccagctggccccanggatgtatgggntacagtactttnaaatagatcctttatcagagctggagggagtggacccagaatgggaagcagcagggtgtgatgtggaccctggattgtatgtattccctctcttagggcgtggctgctttttatttgcagctttaccattgccatgctggaaaatcatcacatatttcaagatttgctgaaaatttctcataaaaactcaactttatgggcaattaataaaaacaaacaaaaaacaatgtgagggccattacaataagggccaaacagacatgtctgtgggctagatgaggcctgtgagctaccagcttgcaaagcaggcatggccatcaaggatgtatggtggttacagtactttaaaatagatcctttatcagagctggtattgacatgaaaaagccttaaattattttcattttccaggcagatgaggtggactagtatgtttggcattatggagatagcatgttgaattaagagcaatgggcatctgccgttctagctttgtgggctttggggagtcag

SEQ ID NO: 129360 - DNA, 269 bp, Homo sapiens
catatattaatacatggcgtctatatccatacatgtatgtaaatgtatgcaaacaatttaatctactttttccttaacattaactccttcagatagaatggttggcccaaatgatttaattattttttaggttgttgattcatagaaacaaatcccctgcagaaaggttgtaccaatttacacggttacctttcttcacattttctctaacactgggtattcttgagcttttagtatttctcagttggtggaaaggatctcttagtttg

SEQ ID NO: 129361 - DNA, 538 bp, Homo sapiens
  misc_feature (7)..(7): n is a, c, g, or t
ccacggntggctggcagcttatgccagttcagcttcttcatgttttgtgtgggtgggttcacccgccgatggcgggggacctatgctgagcccaagccatgccccacctgggcatggtggtgcacaccaattgttccagcttactggagagctgaggcaggaggataacttgagccaggagtttgaggctgcagtgagctgtgatagtgccactgctctccaggctgaatgacagagcaagatcctgtctcaaaacaaacaaaccaaacacttttattttgggcaataggttagcttgttctgggaagttggaccctgtatatatgggatataccattgcttctaatttaagagatttataaacccacaaaaaatatgtattatttcttatagtaagttaccagtttggttcttgtaggaggatgtgatgtaggcttgggtgaagaaggtttttcctaaagctaattcaagcaaaaaaaaatttttttcagaaagtctgtgccatgaaaaaaaagttatattagcatcatatagacaa

SEQ ID NO: 129362 - DNA, 401 bp, Homo sapiens
tgagttttatgtatgtgatgagctaataggattagcagtttatcatttgataaaataaatctttttgaacatgtttgcagtttctccaaaacagactcatctttcatcaggtctttggagacagtggtgtcaaagtacatccccccctctttctccctgtctccagggctgagtggatttatatagtaaatatctttggtccggagaagtctgaagttaacctggccattgagtgttaccattctgtagagaataacaatgcctaaacatgacacatttgtgcacaacttaatcagtagcctgaacttttcattcagccttggacaatacatcttggaattcacaataatgcagatcctcagaaccaagtcagtgtcatccgtataggaggctgttactgt

SEQ ID NO: 129363 - DNA, 786 bp, Homo sapiens
ggggtaaagctgtcatttcatataggtcatcagaaaaggcctttgtgatttcatgacatttgaggagacacctgaaggaaatgagggagggaccatagggccacctggtgaaataatgttcccggaaaaaaataacagcaaatgcaaaggtcctggggtggaaatgtgtttgacacatttgggaaacatcaaagggcagcctaaatgagtagaggggtgatatgggaagaaaaataatatcaaaagatgaagtggaggaacatagacctcaaaaggctttgtcagccttagtaaaacttttttaaaaattctaagtaacaagaaaagtcaaaagaaggtgttgagtctacctaatctgatttacgttataaaggaagggtaggcaaacattttctataaaggtccaggtagtaaatattttagatttttcagccacaggtacctgttgcaaccactcaactgtgtccttgtacagggaaacagtcatagacaatacaactgagtgtggatgtgctccaataaaactttatttacaaaagcaagtgcccaaatatatttggcctatgggaaatatgtcctaaaagcttcactctaactccattcatagaagtcatcaaatccaactaataccatccactgatgggaaaattgaatgtcaaaaagattgagttatttgatcaagatcacacagcaaacgatcaggaaggattaaatcagagcccaaggctcatgacttcaagtgcaataccctttccattgcaacatgccaccttaaaaaaaataatg

SEQ ID NO: 129364 - DNA, 481 bp, Homo sapiens
gaaatgacttccataaggttgtgcagctagtttgcaacaggtcccctgacttccaggcccgtggtgtttctgttacctcccagtggttacttgcctgcagctagaagggctttctgcagtgctgctgctggagttggggggaaaaggctgacactcagcacagccttctgcatccacttgagtcatgcaggacacttagctttgttctttctccacagttaatattatgccaaacctacctgtaattagtaattttcaaagaatattataagttccagtaaccaaatgtttgggcataattatatgccaaaagactactttttaattgataatttttaactgctttttatatatttgcagcctgagaaggctgtttggatactgaggttcagcaaagtgggtctgaagatacttgtttatgcaaatgggactttgtaacctgggaaatctacaggatttatacaaattattattgaaatag

SEQ ID NO: 129365 - DNA, 524 bp, Homo sapiens
  misc_feature (463)..(463): n is a, c, g, or t
ctgttttattacttttctgggaattcaaatcagtgtaaccacgcttgatgcgccggtgaaaaatgctatctccctcccccttctccttcaacctaatgaattgccttttttcataacaaagagtaatgagcaccaaaccacataatatttattcaaggaacaaaagacttaagaatggggtggcaggaagaggagcaactcctgggtgtggacagaagaaaagctggacgttataacagagcccctcacactgatctctggtgacagtgggttcaatttatagggaaatccaaaccttttggctctccccactcattcctgggaggggcttccttcaagcaattccctagttcatgtgtagagaccctgctgctgagaggtggcaggagccaaatgtaattcatcccatagccttgactgtgaagtgtctgcacattttatttttcagtgaaattcccctaanaagcctcctcttgcctctctcataagcaataagcccagtatatcccaaaatgttctagata

SEQ ID NO: 129366 - DNA, 486 bp, Homo sapiens
ttattgagcatgaactctgagccaggtactgttctaaatcctcgagagatggcagggaccaaaacacagtcctgctttcatgaagcttagattctagtaggaagaaacaaactataaatagacaaatcacacagctagtgaatgtaagtaaataggtgactggctgtgttgccatatacttctcatttaatccgcttgccattttggtttagcaaagaaacaagaaacttgaaatagtgtgggagtacatatttgccaaggggaaaagcagaacttttaaaagctccttcagaatgttcttttctctttcttaaaatggaaatcactgttcttttagctgcaaaagtaatacatcttgaaaaaaatacagaaatgtaaacaacagaaatctacaaaatagaaaatatctcataatttcatatccactgttaaaaagtctaatcattatagacttccccctgcatatacatgtgtttataatataaa

SEQ ID NO: 129367 - DNA, 395 bp, Homo sapiens
ttgatcacctgttagctgattctccccattagaagagaggctttacacagctgctgagataatggttttgctccctgctgtacccccaccatgagtctggcatatagcagatgtccaataaatatttgtagaacaaaggagcagagtgaagaaagcaggcagagaggagctcctcccatgcccgggccacacagtggaaggctcctcccatgcccaggccacacagcggacggccgtcaagcagagcacttgcaacctctgctatgctgccccccactagcacccagctcccttcctcacaggaacatggaagctcagagatttaaggacttgcccaagggaacaagaccaggcaggggcagagctgggtctggaacacaagttttcagactccc

SEQ ID NO: 129368 - DNA, 558 bp, Homo sapiens
cagtgagggaaggaacaggtcagctgttgcgtgtccagagggccgctctgctggtcaggcacagtccaacagtgcaggagttatgatgcgggcccccagggccccagtctggctgcatctgtttgcagtccagcattgggtgccctgggaaaggccagcagatcaaggaaagctcagatcagaccagccccaggtgatagggaagaccaccctgcagagtttacatctgggctaaagttcccctaggggaacagtctcctatgggagcaagtgcagcctagggggattggcattcctggccatgctccaccacatatgctcctgtaacacaccctttgggctccacactggctgagtgctgctcctaccacttatctaagccgctctccctgtcaatgaagtggctgtggtggttgaggggtctcctcctgctgggattccagaggcctgtggtgaaagcaggttgctccttgccagttcaactcacctgttctccaggagtcgctggggtccatgaatgagtcccgatgtgaagtagcccctgtgcagagttcccag

SEQ ID NO: 129369 - DNA, 727 bp, Homo sapiens
gagtcatcctattctattttataaatgttagaaattctcagtgataaaacatttctaagaagagacagtagaaaaacatcctaaattaagaggtttaagaaatgtctaataaagaggaaagaagattaagaaacattaaaagcagaaacaatattttgtctggaactagccactgatttgaacattttggagtccattaagataatttaaatgtaaattatgtattaaaaagttataattttacagaaatagagaaatgaaaatagatgctggtgaaaaaaaaacaggtcacaagagaatgtaagataagatcagaaaaagaataaaatataaatacttatatataaaaagatctgaaattcaatatactagttatgcttttgattgggaaaatattaattttgttgctgaatttattttctacaatgtatatttattatataataatagtaggaatttattttatttaaaaaaacaaattcagtttttctcaattttttctatactagagtcagtgacatttctcttttacataaatgtaaaacattattataatcataaaattatacccattttctttcattatatttgagaatataaattctttgtattaaacaaaaaacatttaagagaaacagtatcaaattgagtcaaaactgaagtcttattactttataattttaaatatgtaaaatttctcaaactactctttgttgaaaggctgtga

SEQ ID NO: 129370 - DNA, 233 bp, Homo sapiens
agtgtaacagtatgtatgcatgtcttttatgctgaagatggggctgtaattcacactgtttccacagttgagagcatcttccacatgtggtagattaaggtgaaactgcatatgggtggtggtgaatcatttttctgtaggctgcgtggttgattgctagtgttaccgaatgtactttttccacttactgaagggtccatcattatttgaatcatctttctttaactttctag

SEQ ID NO: 129371 - DNA, 295 bp, Homo sapiens
tctgggtgggaaagagagagaggaaccaagggatttacccttgagccctctgggccagagtgagagcccggacatacttccagcctctgcctagaagccccaggcagctggggacaagtccctggccctctgcagcctcaggtttctgctcccggggcctcagtttccccaaacctcctaacatggtgaggatttgcttctccccgggccctgtgggcaaaatctgagaaggttccatactcaaatgccaggcaaggtcttggagcgggtgaagggggacttcccggtggacacc

SEQ ID NO: 129372 - DNA, 96 bp, Homo sapiens
ggtggtagaggtgggagaaaatctgctcataagtagacccctgcagttcaaatccgtgttgttcaaaggctaactatattacatagtgatttgtgt

SEQ ID NO: 129373 - DNA, 366 bp, Homo sapiens
aggcatgatggtgtgcacccacagttccagccacttgggaagcctgaggtgggaggactgctggagtccaggagttcaaagccctcggcaacctagcaagacctcatctcaaaaaagattcacggccgggcgtggtgaggccgtgaatctttgggaggcgaggcgggcagatttcctgagcttaggagtttgagaccagcttgggcaacatggtgaaaccctgtctttactaaaatacaaaaaattaaccgggcatggtggcgtgcgcctatagtcccagctactcagggggctgacacacgagaattgcttgaaccagggaggcagaggttacagtgagccaagatcatgccactgtattccagc

SEQ ID NO: 129374 - DNA, 251 bp, Homo sapiens
attctcctgcctcagcctcccgagtagctgggatgacagatgtgtgctaccacgcctggctaattttttggatttttagtagagatggggtttcactgtgttagccaagctacctgtcttgacctcccaaagtgctgcgattacaggcgtgagccaccgcgcctggccacttttctccttcttgaaagtgggattttctctttatcattgtttgattattgtataagtattatgattggcattttgcaatt

SEQ ID NO: 129375 - DNA, 391 bp, Homo sapiens
gaggtccccagagtcgccaaaaccatagagacaggaaggagagtagagggagccgcgggctgggaagggactgggagtgtgcgtttgatgcagacagagcttcagtttgggaaggcggagagctctgcggacagagggaggtgaccactaaactgtgcccttaaacagggttaagatgatacactttatgccatgtgtatcttaccgcagttaaaaattaaggtcgggcgtggtgactcacccctgtaatcccagaactttgggaggccgaggcaggcagatcacctgaggtcgggagttggagaccagcctgaccaacagggaggaacgccatccctactaaaaatacaaaattagccaggcatggtggcgcatgcctgtaatcccagct

SEQ ID NO: 129376 - DNA, 276 bp, Homo sapiens
ttaatttaaatcctaatttttcaaatttgttgcatataccatgcttaaagtttttcacacttcataattaatttatgtatgttcgtttataaagtggaagcagatatctgttctcagtactaactagcttattctgtcttatgtcaaccctgccagactttgggagagaaagtatttgattagaatagtatgggcatgcatttatctctgtagggaaaggtggaaaggcttctgggaatccacggtgtgccagggcattgtaggtaattgaaatgt

SEQ ID NO: 129377 - DNA, 379 bp, Homo sapiens
cctctgcctccctgacacttctctctcctggcctctttcctctttgcctaccttcttcctttctcaaagaagagtgtttgcacctttctctccccttgactttctctcactggtgacacccttatccggtggcctcagctaccatctgtgtgtaccccacctacttggggccactcctccacagcggctccaccttcccgtgggcagtgccatctgaaggttcccaaatcagggtttcttcaggagcaactttcttcctcattaacccagtggcttagcagacatctccctttggtgccctataaaacttcagactccaagtagagtgtcccactgtgaattcagcctcttcctccacccctgaactgctgtctttcct

SEQ ID NO: 129378 - DNA, 275 bp, Homo sapiens
caaaaaaaaagtaaaataaaattaaatttattcacttatatttttctttagtgaggaaaccaaaggaaaagataatttaggttatattctgaaagaaataaacagtcactggctttctggttcttcatgtaaagaagattcaggacaagatatttcttttgaaaaagataatcttgtaaaaatgagtgtgccaaagaagttgacattttaagtaagttaatattttacacaaaagctcttcttctgttacctcttatgcttactggaagaaagca

SEQ ID NO: 129379 - DNA, 325 bp, Homo sapiens
gtagcctcaatgtgccagactcaagcgatcctcccaccttagcttcccaagtcttagtaaccgggactacaggcatgtgccaccatgcccagctaattttatttttttgtagagacaaggtctcactatgttgcccagccttggcatcccaaagtgctgggattacaggtatgagccactgtgcctggctgaagaggtgtttttgagccctgacagacaggcaaactttgctaatgtcatgacaaaaaaaaaagtgaacagtatacaggcatatgaaggattttaatgccagcccattttttctttttggagtcagggtcttgct

SEQ ID NO: 129380 - DNA, 960 bp, Homo sapiens
tacatgaaggtttttctttttaaatttcctattaaaagaatcagagatggagaatcctatttattttctcattattagcataagggaaaaaaagaagaatagaaaattagatttcttactccttctctttgaaattttttttttgagacaaggtctcattctgtcacccaggctgcagtgtagtggtggaatctcagctcaccgcaacctccatcctgctggattcacgtgattcttgtgcctcagccacccaactagctggacttacaggtgcacaccatcacacccagctaatttttgtatttttagtagagacggggtttcaccatgttggccaggctggtctcgaactcctggcctcaagtgatccgcctgccttggcctcccaaagtgctgggattacatataggcctgagtcactgtgcttgaccctctttgaactttttaacaactttcttgggggaacagacaggagaagtactcaatcttcacaaaaaccactgtattaatgagaaaatgttttttacatttggaggtccataagaacttatcagttagtacaaaagcaaaagtgtggattttgcaatggcaattaatatttctagtatataaaagtgtccaaagcaggaaatagataaatcctataaagggactcttaagaccaaatttaaggccacactgttctcaactacaagatggaatggctggagcccagagcaaatgagggaggtccaacagagtttggcacagatgaactgatgggccaggcaggacaagcccagatgttcagtgggcgaaagaaatcctcaagtcttgtgaaaagcaccttagcaacatcattaaagaacgcagctattttctgcctggtggcctaggctggaaataaggaaatctgatcaagctatagtttggaagacagaagtaccagagagacactgatgattttcacctcagctgctg

SEQ ID NO: 129381 - DNA, 115 bp, Homo sapiens
gtactattttagacaagacagtcagggaaggttttgctatagatttgagtaaacatctgaatgatatataaaagcaagccagcaaaaatctagggtaaaatacttccaggaaaat

SEQ ID NO: 129382 - DNA, 707 bp, Homo sapiens
tatggtgatgtgtacctgtagtcctagtaaattaatcaggaaagctgaggtgggaagttcacttgagccgaggaactcagggttatagtgagccatggttgtgctactgcactccagcgtgggcaacagagtgagaccctgtctctaaagaaaataaaagaaaaaagactatattattgtaccaaagatagaaaactgtcctgggtttaactatgtcgagagatgacagtatgttggtctccagtgtaataccgttctaaggaatgtttgggagtgatttgattatttttgataccttatggattaactttataatctagtacattatcattcatctattaaataatgagcaacttctgtgggctagacctcagaagattcataaataaggaaaacatactatttttcctttgatgagtgacttactggggagatagatgagaaaatacttgtatacactgcagtgacatggttgctctgataatactggttactgtgcatggagagaatgagcactttaatgaacctgaggagcagaggaaaggaaagcaaagggtgccagagtaggaaactcttcttaaaaagtggttgctaggctaagacgtaagaataactatacattatatcactaaggttgggaaggagagcattcctacacaggtaaaatggcatgtgtagagtacacaggagcagacaggttcccccac

SEQ ID NO: 129383 - DNA, 480 bp, Homo sapiens
gggccagggctggggataatgggaggcgtgtttcgtcagcccaagagcatcgttaagtggccatcaggaaatcacagggctggaggggctctcaaatgaagcatcaccggctttattcttttagcaaatgtgtatcctgcaccaggcgctattctaaggaccggaggttggtagctgtgccagtctgggcctgtttgcccttggggtccgttccttgtccttgctctgatctgctgggtgtggtcgggagccaatctctgtaggttcttgtgtcccaggctcccgtgtcactggattcaacccgtgggaggagctgctaggaggttggaaggcaggaggaatggagaagccagtgtttctacctccctcagtctccagaggccactctgatggcacctgcaactcctccgtggctccagctcccactggacggaccctatggcctgtcctctgttggcgcttccagcccctgggcctcag

SEQ ID NO: 129384 - DNA, 634 bp, Homo sapiens
aatttaaagaatatttgttacttaaaattaagtactttcaaaataatgtttggttaagtagaagcttaaatttttgtttttcttcttttcctctccatatctgttatactatttcacttacaaaataaatcttcagccttaagggatgtttgggatagttttacaggattatggattttattcctaaaatagatctgaatgctacaaaaagtgaaactttttaaagataagattgtcatcaagtggtggtattttaaagctttacttataagcggtaataattaacctttgaaaatcctgctgtaataaggtgttgagagtgatctagctttctttggaaggtttttggtgttcctaatcattcccagcctaaattaaccccaaggaaaatgagaacttcaacctgacctctcattgttttgccaattcctacgtttttttcggtttccttttggttcttttatttctgttccttctgttcagtttaggggaaagaataaacttataaagaaattcaccttaagaaattagggccttgtcacatatacaccatggaatactatgcagccataaaaaaggatgaattcatgtcctttctaggaacatggatgaagctggaaaccaacattctcag

SEQ ID NO: 129385 - DNA, 741 bp, Homo sapiens
tttccaggaacatgctcagttttaagacccgattaagatcaggcacagcaggccaggctaagaggggcatgtgtgaaatgcagttctataccagagggaatgagggaaagtccacatgctcaccagcgaggcctctcgctgctcccagcactttttctgcttctgtcacacagtgctggatactagagtcaaattctgctttccctagtcatgaggctagaggagtctttctgcataaacttaagagcccaagagaaaaagcctatagatattgatatttagggtgttccaaacaaaatttacagctgactcacaatcaccctcccgtaagatccaccagttcagaagcactgatcatgcacacagaacatccggtcagtttttagtgtctcacttttcaatttaaaaagacagctaacgatcaccagatatttgagaaaagtttgaaacatgaaaggcagaaattaaaagagacaacaacagcactagaaactcacaagaaatagagaaaatatagggagcagaagaaaacttcacaaaacctgtaattactagtctaagagagataagagaatatgttgcattaataaaataaaagcaatgtgcaacaaagaggagtttcagagactaagaaagaacttttggaaattaaaagtgtgatagaagaataaatcagtagagggtttggaatatagaattgaagaaaacttacagaaccttgcagaaagtcaaagaaagaaa

SEQ ID NO: 129386 - DNA, 666 bp, Homo sapiens
gggaagtaggtgatgttgggagtggagagcaggctctgatgcttcctgggcagagcttgaattccaatctgaatctacgatgcgttcactgtaccacagagagcacagagctgggatatgtgtggaaagggcctgaatagctaggagctaaatcaccctgggcaagctttgaaaccacctcagttttttcattagtaagaaggtaatgacattgcctggcgacatgcctcagcataattccatgacaattgcatgagacaatctgtatgaaaaatcctttgtcctggaaggggctgccttttatggataagaagaaatataatattactaggaaatgctgtgagcccatggcaatgctggactaagaaatcctttgaaccttagccaggggaatgaaaaagctgctcatctctgaaatgtcaaggttttgagatttcccctgtaccttttctaatgaccgcattgaagttgtacagaatgaaacaagaaccagtctgttttgttttttttttttttatagagatggggtcttgctctgtcacctagcctgaagttaagtggcaagatcctaactcactgtagccttgagctcctgggctcaagcgatccttctgcctcagcctcccaagtagctgggactacaggtgcccagctaattctttaaat

SEQ ID NO: 129387 - DNA, 554 bp, Homo sapiens
tgcagtaggctgaggtgggaggattgtttcagcccaggaagtcgaggctgcagtgacctgagattccagcagtgcacgtcagcttgggagacagagcaagaccctgtgtcagaaaaaggaaaaataaaatcagcaaaagcatcaagaacaaaacacagggacacacaagacatacagcagagtgcagggtaagagaaagcccccagggtgtcttgtcttagttatgacagcagtgattctcaagtggcatcccagaggactatggggttcctgaagtgtgtttcagcagatgagtgagatcatttttccaacgacagatctgaatagtgatgaattttcttcataggaacaaactaagacaatacaacatagcacaaagggtgcagaagattttagagaaggtggactctgtctgcaatggagcctcttccacggggagcattaggcattgtgcagtgggttctcaaacatgttggccttgggaccccttcagcacacagctcaaagttattaacaacccgcagaactttcatttctgtgtgttatagttgtct

SEQ ID NO: 129388 - DNA, 394 bp, Homo sapiens
catttccgggaaactgtcatcccccttcgtggacagcctcctggttctttggtcttcctgagatctctttttccattcctaatgagctatcgctctcaaggctacacacattgtcctttatcatcacccataactgctccatctccaaaatcatcaacatctcagcttcactctctcatgggcttgttcaattatttcaactataaatgtgttaataacgtcttagtcttcctgtagtggagtcctcagttcatcattcagtaacacaccttgcaataccttagacttctttttccctctgacttttcataactgtcaaaatgccaactccaataaagccaattattgactttgttcttacctaaacccaagtcgccaaatacatacagaaagt

SEQ ID NO: 129389 - DNA, 287 bp, Homo sapiens
ccaccttaaggcatcctgcatccccaccatcttttctttatagggaagacaacctttacctttaagctgtcttacctttacactgtctcaccacctaaccaagagcgagacctgcttcacttgaaatagttacaagtttgaaacaactgatttagtagtatcattttttctataatcatcacattattcatcattccatttctagtaagttgtacagtgtctgacacctaatagcacataattgttggatgaatacatgtaccctaaattaagaatagcacatttta

SEQ ID NO: 129390 - DNA, 710 bp, Homo sapiens
ccttctttctctccctccacagattccacaccagtgctttccctcgattcggtctccctgaaactttcgtccgttagatcttcatgactgtctacttatttggttgtctcagctgaatatcactttctcaggtagagctccctaaacatacaaactaaagtagatgaatccatttctctctttcaacacacatctgatgtcttttcttcagtgcactatgactctctaacattatcttctttgttaaatgcttattgggttagtgtctgtctcctccactcttgtaacttccttgagagtcgggaccctctctatcttaatcaaatagaatgatttgaacctagaatggaacccagtacacagtagctgctgagaaaaataagtgtggtttacacaaataaaccagggtatgggaactgatcactgtggggatcctggaaagcaagaaggggctcaagttccagcactctttcattttgatgtcacactagaccccttctcctcctggtgagaaatacaggcaaacttctttctccttcttctagttggaagaagaattcatggataaaggaacagtgatttaagaaaaaggaaatctttttattaagagtcatctcttttgcctgggcacactggctcacatctataatcctagcatgttgggaggctaaggcaggaggattgcttgagttcagcagtttaagaccagc

SEQ ID NO: 129391 - DNA, 372 bp, Homo sapiens
tcagtcggtaccacaagctgactcttccacatcgctgacctcttccatgctagaaggagtaggaagttcaatggcaggaaagaggaagaaaaacaaaacagaattggcacacacctgtgatccaagctgtcctcgaggagccccctccccacctgtgcccagtgatcagttctagggctttgccccacatgtccaaacaagggggtcctacaggaaacgcccggtaggtggagacactgggcctcccccccaggttccgcaggggggctgataaaggcgcagagcgggcggcccctgcaggatgggtgggagtccagcccccggggtcactgggagccctgggctaggaacaggtggcctccccgggagcct

SEQ ID NO: 129392 - DNA, 396 bp, Homo sapiens
ggcaaacttcattgttgtctcattttaagaaattaccatagccaccccaaccttcagcacaaccaccctgatcagccagcagccatcaacatccaggcaagatcctttaccagcagaaagattacaactctctgagggctcagatactccatcctgttttccagaatggaaacttacattcctaccagcagtgtgtaagggtttccttttctccacattctccccaacacttacctttcatctttttgacaactgccattccaacaggtgtgaggtgatatctcattgtggttttgatttgcatttccctgatgattataatgttgatcaccttttcttttctttccttccttccttccttccctccctctctccctccttcctttctttcttttt

SEQ ID NO: 129393 - DNA, 270 bp, Homo sapiens
ctgggtctctctttgtctttcacatgagtgacattttgaaatatgaaggccgattattttgtagtttgtccccatttgtgtttgccgggagtgcttcctgaccacaatctgaaaactcctcacgtcctggctggctcaacttcccgtagtgagtgagacgttgcctgttgtgcctgatgctgagaagaggacgaggagatggtggtggggttgccagatcctggggacagtagcctcagatggccagccatgggcagacaaagctgggca

SEQ ID NO: 129394 - DNA, 211 bp, Homo sapiens
tcttagcgtgtttttaatattatagatgcttttcgatcttaccctaaaatagcacataaacattttatacatatgtgggataaccattaaaaataagtataaaccaatcactcttctagagatacatataaaaaaggtcatctcctctcaatggaaacaaagattttctgtattattgagaagcaatttacatagtttaatttcttgtatg

SEQ ID NO: 129395 - DNA, 335 bp, Homo sapiens
agcctgaaggaactttctataggagtaaattacacttgaagacacatatgctgcaggtcccatgggtggtgagtgacaccaattcttcacacctcttccaacggtcaccctcatcacctctgtagctgccaaaatcttgagcaagaaaagatgattaaacttgcttaatagccacaatgtgtgggtgatacctctccatttagtgaaaaatacatgttggtgtcagtagatttggtcataatgataacagagcatttgaaatgtcttcattgactccacataaattaatctgttatttctttcaaacagtgtctgaagtgtatatgcacaaaatt

SEQ ID NO: 129396 - DNA, 446 bp, Homo sapiens
tcagtctgggaatctcgagagagctgacaagcagggcggtggggggtggccaggagctgacatggctttctggtaggcagccccacatcctgcttcctccctgtgctgagtgtaatcacttctgccccttcaggaaagtacttcacacccgtggcatagagccaacagtgaggtggattccgggtcctctggatgcctgggatggtgagatgcttgagaaagttttggcagtttgttcagacttggggactctccagtctgccttcctatcacccagcaggaatgcccttcccttcaaccctgatacctgggcacttggcctccacctgaatacccttggtggtgagcagctcactacccctctgaagacagccagtcccccgtgctccatgttccttgtcacctgctatcttatgactgcatcctgaatccgactctggcttctg

SEQ ID NO: 129397 - DNA, 1163 bp, Homo sapiens
ggttctcttttccaggttctagctcaaccctgtcctgtgctccagcactttcagtgataggcagcccactccattttgaggcaatccatcttattgacttagggttctagttaaaagaaatgtaaaaaaattaaagtcaagtttgtctcttagtcactatcattcaccagcccttttctgaacttgtacaaaataagttcattctctcttctacaggagagacctccactatccaaatatgaggagcttatcatcccaaggctccaggtcttctcattgctaaatatagcaccctgggctaaatattcccagggtgctcagctgtttctcaaatgcagaggaaatgcccgatacaccattctccttcacagcatctttaccaccctgccacttggcctttttgaacccccattagatggtgagcattttccttatctgattgctttcccctgtcactgggctgtcaatgggactcttagaattggacttagaagcacgtgggctccccgacaatgatctggacagccttgctttgaatatagtggatcttttgcttttcttgctttgcttgcagagctcaaggaaacatattttctgatcttgtcatcttttgctaaaacatactgaaagttaattaatagtcatggctgtgaaatcttttctctggtttgtttctgccttatactgatttctaaactatttgcaaatattatttttgattgtaacagtatgaaagggattgagagtcctgcctacactgacttataataaaagatgccatgaatttacctgagaatctgagaaggtctattgctctcattctttaaaaactttttttttgttgttaagtatctgctttatgccagtcatccattctcagcacaagagaaaaagaagcagtgataacaacaaagattcttttaaccagaatagaacttacaattcagttgaaggaaccatacaataaacaagtaaacaaatatatatatgccatagcattaagtagtatttgaaaagttttattcaattctgaggagcagtaactcatgttatggatgaatgattgaagttcaggtattcatttgtggtgaagaaaaataaagataaaaaataaaaaataaagataaaagaataaaaataatatgaagaaaaatacagtcaca

SEQ ID NO: 129398 - DNA, 212 bp, Homo sapiens
atccacccctcttggcctctcaaagtgctgggattataggcatgagccgccgcgccctgcctgtttctgccattctttaagtcccctggcacatagcctcccaccctactcccaattctcctcttcctttcctgaagcttacatgccaccaccctccccatgcttccctttcttgaaccagacttctgaaatactacccagtcagcccccag

SEQ ID NO: 129399 - DNA, 465 bp, Homo sapiens
agtcgtggtgtggttatatggtggcagtggggatggctgtaatggattggtaatgatggaagcaattttggaggtggtgcagctacaatgattttggcaattacaacaatgagtcttcaaatattggcacccatgaagggaggaaattttggaggcagaagctctggcccctgtggcaatggaggcctatactttgcaaaaccatgaaaccaaggtggctatcggcagttccagcagctgcagtgagctatgattgtgccactctactccagcttgagtgacagagggacaccctatctcttaaaaaggtggggagggtggctgtggttacctgccatcatctttaagtttcttgggcattaagcaagctggaagccagtttaatagctatccttatgtcttatgtcttacttttcatccttgtggatccctttggaaggaactaaatgtgttggcaccattttc

SEQ ID NO: 129400 - DNA, 521 bp, Homo sapiens
ttggtttttaaattgaatatctattaagcacaaggtaacaattcttaccacacacatcagttttattatttcccttttacaaataagacacagatgggtagtcagatgtctttgaggtaacacagcaagtagttaaactgggttaagtgattaacccaggttgagtatggttccaaaatctcttacagtgtcaggcaggctacatcagtgcagtatacgtacatcaggtttcacgaaaaattttttccagagaaaacacaaacccaaggaaccttcagtaagtggtgccttatattagtggtttttagcaaaaggaagaaacttaagtgttttcctgctgcctgacaaaagtgaaaaacagtattttggtttttattgaagttagcatgtatgtttgtagcttgcataaaatagtactgaaatccaattgattatgaattcttggactaacagaacctggatgacaaattagaggttctggcctggttgctggcttttttagttgtcttgggtgtaaattt

SEQ ID NO: 129401 - DNA, 748 bp, Homo sapiens
ggtaatgatttctcaaatgttttgagtttttagtatttgtttattatataaagttgaaatatgtactatcatgataattataatcaaatagagaggtcagacttgaattttatatttctaccactgacatgctttctgtcaaattaacaggttttttttaaataaagttttgacattggattcataaggactgatgtctgtatcatactacaaatataaactgtttaatttaatgacaatgcctaaaccaggtaaccggagtgaagacaaatgaaattcttccttttgtactggtcattgtgtgaaggcaatcatagacacaacctgtgtcctgggatgagatatgtgaaatggatgcaagtcctcaaatgttatcattttatgcattcaaatggatagtcagaagacccataaggcccctaatttagaaattcccacagttctcaataaagtggctttccactagtttgagttgtcaccttttccaaagacttgacaccacatcttcctcaatgaagtaattctgcttcaagcaggtagattttcatattcatggcctacaggccagatttcaaatgctctttagtattttctttatgtcatagcacacttggcttttgggtagtttctgcctcattttcatactagctttgtaaagatttctgtagtatgtaagagaactctaaaattgaggcttatgtaattaaatgagatatagtttagacttatgaaagaacggcatgaagta

SEQ ID NO: 129402 - DNA, 438 bp, Homo sapiens
acagagagatgtttatgtgccccactggaaaggcggagaaaactgcttcaggtttcaggtgaccaactcagctctcccagccacaggccctggagatcgccctaagggctaagggagccatagctcacacccctgcaactttccaaccaagttgggaagctctgatctggaagaaatgataaatttggtaatgggttaagtctagaggagggaggcaagggcgtttggatttcaactcttcacctggtgtaccattttatcaaagtgggagtgtattatacttagataaatatagcttctaaaaacctattgggagaggctggctttgactcagactggagggagtaaggagtaagatgggagaagggtattggggagtagaagtagaagtgatgaggtgactatactgttgaaggaatctcactgacgaatagtatt

SEQ ID NO: 129403 - DNA, 702 bp, Homo sapiens
atgttaagtgttattatatcgggtgacatgctttttattttttttcttttaaaccaggaaacataaagctagattaaatatggctgtttataccaaaaatagagtaaaataaaatcaaataactaaaataaaagctactgagtaaagtttccaagtacagagacaattgctttgaagtactttgtttcacagggggacattttttcttctgagggaggcaatataatttatatatatttgggaaaaatatttttttgcatggtcctttacaaagaatgcacttatataatgcttttatctctataatttccctgaaaattcttgattttatactatcgtacttgaataattattctctcattagctaggacgttatcagtgaaaatttttgtattaatatcgatgtgtatcgatgccccgttctaaagctatttaaataagtagtttattccctcatgcagaaaattgctttagtttgaaaaatcttaaataattagtggtgtttgtcaatgtgattgtggtagtttgtggttgtagctagtaatttaaaagatagtgtagtacagaatggagctagccaatttccttattattcatctaaaatgtaatgcattcttttgaattattgccaatcaacacctggaaatatatgagcctgaagtaagcttcgtaaaataagagtaacgtataaaaagtgaacaa

SEQ ID NO: 129404 - DNA, 491 bp, Homo sapiens
aaaggcattccttagctaagctaatactggtccagctgaattacttaactgtgatttgactcagtgtaggaatagcgtttagaaacctagagtgatggaggattcacttggcactctcaagtttcagctgtcttatctgggcttgagcaagggttggacatcagttcattgaaaatgagctttttctggcaaggcctctgcaaacgttttgtcatttcaattaagtgagagttctttgctcccggtaacaaatgtgttgatggcaaagctgacgtttgcttatgaaaatgaaggaactggacttgttgatattgcagaagaggggacagcttgcttctttgggagcattcccttcaattatttgaaattattaatgcatcccctcctcctcctcaggatggtggtgaatcacgatttatgttcctgaactcgttcactttgtggagctcttcaagttaaaggaccctaattgaaaagattataatttctta

SEQ ID NO: 129405 - DNA, 244 bp, Homo sapiens
ccccttaatcccatcaaaaccagccaccgcatcctgcagaatgaacgatctgagtaccccttaatcccatcaaaaccagccaccacatcctgcagaatgaacgatctgagtaccccttaatctactcaaaaccagccacgacatcctgtagaatgaagacgggttatgtcattgacaaagttgtattgtaagtcatcattccttcccttcccttccctccttctttccttccttccttccttcc

SEQ ID NO: 129406 - DNA, 370 bp, Homo sapiens
tgttctgaggatcccctccagtaaggtgtgcccagagtgttccaagcagaagaaagaagaagtacaaagtccctgatacactaacaatcttggtgtgttcaagggacaggaaaaaggccggtgtggctggaatttggtgttcaaagcaagagaggagagataaaggaagatgagtcatgcagagccttttgaaggctgtgggtaaaatgtatgttatacggaacttagttctaaatctagttgcagtggattaacctggagagtgatgcaaactgagttttactctggaaaaacactgtgactgttgtgtggagaatatgctcccaagtgtagaaactagatcaccttgcatgggccaagagagatggtg

SEQ ID NO: 129407 - DNA, 490 bp, Homo sapiens
aagtgggtttctggtagagaacacatatttgcatattatttttatccactcttctagtctatgtcttttaattactgtatatagaccatgcacatttaaagtgattattaatatgtttgaattattagctatattttataactgttaacatatataacatattgtaacatgtaatgaacattttttgccaagtactgtgcatcaatggacaatgtcaagaaagcagagagacaacctacacaatggaacagaaccttcacaaattaaatatttgacaagggaatttatatccgcagtatgtaaagcaccccagaactcaacaataaaaacaagtaaacaacccagttaaaaaatgggcaaagggccaggtgtggtggctcacacctgtaatcccagcactttggaaggccaaagcaggtagatgacgagatcaggagatggagaccatcttggccaacatggtgaaaccccatctctactaaaatacaaa

SEQ ID NO: 129408 - DNA, 250 bp, Homo sapiens
gcagcatttgataattctaaaagtgagtggtaaaatacctcaaagattttaactgtgtttatatctcttaaaatattgttactcttaaaattttgcttgatacttcatttattcagagtgcaaagataatttcagtatacaaaattgaactgattacaaattcataatctatcagaatctaagtcatatgtgatataatcaaatctcaaaaaattagtattctcagtttaaaatattgtgatgttcccaa

SEQ ID NO: 129409 - DNA, 743 bp, Homo sapiens
attctataggtcactatttccaaagtgggtaaaatatattaagtggtacacaatgtttttaatttaatcattatgtatttatgttaatggaaattaagaaaatataggtagcacatcaaattcaggacttaatggctattgcttatcctaactaaatgtatttgagtttaaaaaaatgttaaaaaaagactcgctaacagttattgatggctcattatttatcaggcattgtgaaaatgttttatatatattaactcacttaccctttacatgaacccagtgaactattaaatactgttgttgtattcacctgatatgtgaggctaaaaaggcatagagaggttttcatagctaataagtggtgggtttaactccaggcaagctgaccaggacctgtattctcaactatcgtaccttaagacagagggttaatgtgcaactgcagcaaaaattgtgagagtgataggcaaatggcttgtttgtgaaactaaagcagtagcattagaaaaaagagctgttgaaggttttttggagtaatactataaacatactgtttgatatgtaaattgaagtgatggtagtattcagaatgcattttgagggagtggaattaaatttaggaacaccaattaataattgactatataggtctaatttggagaaaagcatttgaactagggttttacattttaggagaaacggagaaaaaggagctaagactacaagagccattgtgcagagaa

SEQ ID NO: 129410 - DNA, 287 bp, Homo sapiens
tgctgaagtcaggatacctaataatggctaaatgtaactgcaagcacctctgctgcggccagtataatttactgtttttagtagtaagacttttaaccccaaaaccatgtaaactaatggtgccattctcaaaaactcaaattgctcttaaaaaacacacaaaatggaagtcaactgtctacagcatgtaggcgacttcattacaagattgtgatggctatacaattatggctaagtatccacgcatcaatttctattttcactttgcaggcacatggtatttccag

SEQ ID NO: 129411 - DNA, 232 bp, Homo sapiens
aattaccctcccagatcctctttcaaggttaatggactcaccatgcacccagccaggaattctgtaagcaccttcaactgtttctttctcccatctaccacaaataataaagaaggtcgccaggccctatcagttctcactcccaggtgtcttttgagtccatgtgttccagagtaggtgttcaggaggactccatcatctcctacccacactaaccccaagggtttgcatg

SEQ ID NO: 129412 - DNA, 698 bp, Homo sapiens
ttcctttataaaattgtatttagaaatttgttatatgtgtctatgcaaacgttttaaaaaatgtaaaaatgtggaattccataatgctgcttactgatttacagatataaatacatccacgtggacttgcacacatgcaggtgcccctcgccctatacaatttcaccatctgcacttgctatctgaacgcaagaacaagaggttttggagagaaagggatactcgttaacctgtatgtgtacatagcttttgggttatggtttgtcttacaaaagaaggatattatacatatttcctgtatcttggcttaatcaatagcacttcctagaaatcttactgagtcaactggtatattctaattaattctttgtgctggctgcataatattctgtggtgtagaggtgtagcaacaccatattttattcagccattctcctattgatggacacttatgttatttccagttttttgatgctataaacagagctgcaataaatattgttgcacatatgtccactttactaaagattttatttctccaaatagaattttatttctagtctccaaatagaattttattatctacaatttcatttaagctgcccttccacacacatattaaggtcatcgacctggttatatgtagtgcgtgtgtgtgtgtgtgtgtgttgttttgtttttgttttatttttgatgtt

SEQ ID NO: 129413 - DNA, 811 bp, Homo sapiens
acccaagctggagtgcagtggcaccatcatagttcactgtagcctggacctcatgggctcaagcgatcctcctacctcagccttctcagtagctgggactacagccgtgcaccaccatgcccagctaatttttttttttattattttttatagagacagagtcttactatgttgtccaggttgatcttggactcctggcctcaggttatccacctacttcagcctctcaaagtactgggattataggcatgagccacagtgcccaactcccaaattttttattgctatattcagtaacatgaaattactgtcaaataatgtacttttgcctattgttttcattattgtattattaatatacttacagtaacacagtagtgcttttacagccttgtacaattccatagacaacactctgccctactgtgtaatattttaattggaattctcttttgaaagataaaattaagagttggccatcatttccaaacaccatgaaaatatgagttgaagaatctgcttctggccagtgcttaataaatgggaaccatttccctatttggaatgttttttatattgttattaaattagatctttttttgagtctaattcaatgtacagttgaagtacagggtattatgtctctcaacattgggcccatttcacctagaaagcattcaagaagcccgggatatataataatttggtgtgctgctgtgtgtgtgtgtgcattgtatatatatttgtgcttacggtattctccaatcttttctcccaaatctgcttttttttttttaggaaaagaaagcta

SEQ ID NO: 129414 - DNA, 780 bp, Homo sapiens
taaacaatagatagcttaagagagaaaatttccctaaatgtgaaaaacagaacaccgaagaaccaagaatgtttcaaataaaagttataaaaatgttatcttcagatgttatttcatatcatataattaatttttaaattttgtttgatcttaatttgcagttgcaggaacccattaatttctttcttagagttctggaaaatttttattatgttcataaatcttagagttattagaaacttatatttaagtatacttagacttttttccatcaatctgagtgcaaatacttttactgaaaaagaaaaacaataactgtgggtgacagagacttaaaatagcaatggttaaaaatctaatggaagtttaattagcaattgacaggggactttggttattttttatggatacaacataataaccagaattatttctgatgtcatatcagatttttaagattttcatacaagtttggaacatttatatcaataacatacccataaatgtaactgacaataatacttctcatataatttactaaataatatgaatcatttattatctacacaaatgaatacatacatcctttgaagatcttcagggcaccaacaagaaagtttctaagctaactttaggttaaaaagacttaattttgaatttggatattggggaagcctatgaaagatgcactttcaagcactattaagtgcttaaaacacttgatcaaaacaagatcataagtcgcggtgaaacaatagttactcatttaatcagggttat

SEQ ID NO: 129415 - DNA, 317 bp, Homo sapiens
gtagctgggattacaggcatacgccaccacacccggctaattttgtattttttttttttaagtagagatggggtttctctgtattggccaggctggtctaaaactcctgacctcgggtgatccacccacctccacctcccaaagtgctgggattacaggagtgagccaccacgcccggcccgatttttcagttttaatattcatgatggttatgtgattttttttattacttgttggatcagtcagatttgctgcatagttgaatttctgtgatgaaaatttctgtagttgaaaaatttttttcccttaagtaacct

SEQ ID NO: 129416 - DNA, 610 bp, Homo sapiens
gggtatgtcaaaagagcacaggagccaacctgaaagagctctcaatgtccaaagctagaaaaatttgagaaaccaaagaaatgataggttcgcatagcccacagaataatatatgtatatatcccttgaattcaaactggactggagggaaggagggaagaagacaactctccctgatagaagaattccaattaataaatgtagaatgaagaaaatagaaaataactattagcaatattttactaataattgttgtaggcaaaatccactgtggatgctaaaatcagtgaatgaaagtttgagcagaaacagggtatctgcacagtctcaaagtatatccacaccaagatactagattctgttatattctcgccaaaaatacataacctcaatctaataatgagaaatcagagaagcccaaagggagagacattctacaaaacaactaaccagtactcttcaaaagtctcaaggtcatgaaagacaagacaagactgaggaactgttacacactgggaacactggcgagacataatgtacaaaggcaatgtggaagccaggtgtgctggttcatgcctataatccctgcactttggcagactgagacagg

SEQ ID NO: 129417 - DNA, 185 bp, Homo sapiens
gctccgttgacgtctgcacgatagagacttcctaagctctcaccaggagtagacgctagtttctggtataggctgcagaatcatacgccaaaatcaaacctctttcctttataaaagacccagtcttggatatgtccttacagcagtgtgagaacggactaacacagtaaattggtactgcaaag

SEQ ID NO: 129418 - DNA, 357 bp, Homo sapiens
tcacattagtggaatcatacgatatggtctttgggattggcttctttcactcagcattatgttttcaaagttcacctaatattgcagcatgtattattagtttattcctttttatcacaaaaaatattccattgtatggataaatcacattttattcattagctcactgacattttgggttgtttccactttttgactattattagtaatcttgccatgaacatttgtttacaagtttttacatgaaacatgttttcatttctcttcaaatgaattacctaagagtgaaattgctgggtcagctctacgttcaacattttaaggaactgcccaacagttttccaaagtgtctgcacc

SEQ ID NO: 129419 - DNA, 508 bp, Homo sapiens
tttcctggacttggtatggagccaaagggtaccttccccactggccctgcttttatgccctctttagagtgcatagagagatgttggtaggcccatgtctctgctagaggggcctgtgggttgggctgagttactcgccatggacagtggtggggtcctggaacccaccagctgagatggtttgggcggttctagtctgcacctccccagagaggtcatggcagagaggccaggcacagaggaaacccgctgagcctgcttccttagttctggcagatgggtcagcccccacaggactcaggattcaatttagcccggggttctggctccatctcccacagtgccggtgccagtggcctcctaagtactgtttggccaaacctggctctgactgagacaaggagccttaggagtagtagggacaggagacacagcaaactagggctcagagccaccctggaaccccttcttcctccctcttcatgcatgaccaaggtttctgtatttg

SEQ ID NO: 129420 - DNA, 718 bp, Homo sapiens
gctgttttgagagtagtaaatactggggttggggacgtggttgtatggatgcttccagtgggcaggggagtcctttctgtggttctagttgtagatgagattgtagtgtggaaggttgtgtctgtggctgacacagaggagggtgtcactgtcactatgggagtttcccttgcagtggtggtagagggagaagatgtcatggctgacgttcctttctcagtagtggtcatagagtaagtactggtgacggtggtcactggcttctgtgtcacgggagtcgaggtgtaagagctggtgaaggccacctgcgtcgtggtcacacagatggaggtggggtgggagatggtgattataaagctcgttggatacacgcactcagtggtggctgaatagaccaacacggtgggtggagtggtttcaaccttgaaggcaaacttggacgtcggggtggttgaggtgttggaactgactggagagttgagcaatgtttcagagatgagtgtgtcatggggggaggtagtgagtgtcataggtgcattttccctgtggccaggagcaggagaggcgagctgggggacaccaagtggccacccagccaggtctctggagtgtggagaattgctgagcacagcgctggctgcttctgctctggggaaaggcacttgagagatggatgtggccgtggataaagttcctgcattggcggcagagcagagga

SEQ ID NO: 129421 - DNA, 271 bp, Homo sapiens
ttaacaggtatcctgtcaaggaccttataggttgtctcgtatcttttgctatgaccagtagggctgtatgtagtaaacatccctatctgtacatctttgtgctgaagattgcatatatctgtgggataaccacttaaaactggaatttctgggtcagctggtatgggagtatgtcagttgctttgtagaaattgctacattgccccctggagacactcatgctaatttatacccccaccagcatgacacagcagtgtctgttttcctgtta

SEQ ID NO: 129422 - DNA, 274 bp, Homo sapiens
ttgtgaggcacagaaacagcagaaaattcaaaaggagaaatcagagtgtcaccacatcaggagtggcttcaggccaagaagggacctgatctaggctctgaggagctgtaggatttggacaggcagaaaggagaaggaaaaacatcccactgaagtccctgctcaactaactcacaatggttcttgtgacatttccacagatgagtctcctggctgctggtctgtgatggtattactacttttactgtccagtgatataaaaagcaggtttcac

SEQ ID NO: 129423 - DNA, 370 bp, Homo sapiens
cagataaacaatttgctttgttgaagtcagcatgcatgtgactctaaaaagcattagtccagtgaggtaaaaaggagcatttactgagtgtatagagagacctcacagtatcgacggatggaacacaaagagttgctgggtttcacccaaattggccagaaaactggggaattctcagggacagggtggcttgtccctctgtgtcccccttgtctttgcttctcagccagctccagcctctcccacattctgtctgtcttcctcggctccttcatcctgtgtgaggcacaacatggctgctctttctggatctagacaaggaagaccactgagctccagtactcacaatcaactggcaatacacactaaa

SEQ ID NO: 129424 - DNA, 785 bp, Homo sapiens
gaagggtttcccacacttttatgtaagttttgccactgagagccctaccaggttttcaccaaaaagattggagaaaaaatcccttatgcttctggcagagggagaaaaaagcaactgttttgaaatacacctgggacattctgttcttaacaagaattaccctcaaaaccaaatagtttactagagtctaacaaatggtttttaccagagtttaagcaactgagaggaaggaaaatatccaacttcagcctctctctagatttcaatgtggcagggggaagaacaatactcaactgcaacccactccaaacttccacattgtattaaggacatacctagctctagtcccttgtagcatttctgtctcaccaaagcagaggagactgaaaaggatttgttaagtcacaacacagaggcacaagctcactaaaaaacagaactaagcacaggactatagtacacttctccacacacaacttacaaatgcatcactaaagtactgttgaatgcaggttttttcacccagtacatcacatccagcttttaacacacacacacacacagagacacacacacacactacacagtattctaaaaagcaaaagagagtttgaaacaacaagaaaaaataagcataagaaccagaatcaaatatggcaggaatggtgaaattatcagaccagaaatgtaaaataaatatgactatcgtgttaagagctaatggaaaaaacaccagacaatattcaagagtagataggtaatgtaagtagagaaatagcaattct

SEQ ID NO: 129425 - DNA, 232 bp, Homo sapiens
agactgggtaatttataaaggaaagaggtttaattgactcacagtcccacatggctggagaggtctcaggaaacttacaatcacggcagaaggagaaggagaagcaaatccttcacgaagtggcaggagagagaaaagtgaaggaggaacttccgaacacataaaaccatcagatctcgtgagaacttactatcacaagaacaccatgggggaaattaccccgtgatccaat

SEQ ID NO: 129426 - DNA, 467 bp, Homo sapiens
  misc_feature (27)..(27): n is a, c, g, or t
tctagaggatcccagcggcgccttttntgagatggagtgttgctcttcttgcccaggctggagtgcaatggcacgatctcggctcacctcaacctccgcctcctgggttcaagtgattctcctgcctcagcctcctgagtagttgggatgacaggcacgcgccaccacgcccagctaatttttgtatttttagtagagacagggtttctccatggtcaggctggtctccaacccctgacctctggtgatctgcctgcctcggcctcccaaagtgttgggattacaggcgtgagccactgtgcccagccttatctgactattactgtaacagtggccaatcaaaattccttcttttctttttttttttcccttgagcctagaatttccttaatggaggggagaatctagcaagcagttgagtcaaagggtgtagattatactacagtggtaaaaaaagggcggccgtt

SEQ ID NO: 129427 - DNA, 113 bp, Homo sapiens
cacaaaaaggaggaaaaggaaatagagctatataggagtaacatcttcacatctcagtgtgattaagttagcataaatctgaagctggatctgataagatgtatatgggaagc

SEQ ID NO: 129428 - DNA, 225 bp, Homo sapiens
agataaagcagtaatatgtaactatgttaacattagtaagaccaacattttcagtgtaaggaaaagatatatacagatcaaataaaagttggccaggcatggtggctcacacctgtaatcccagcactttgggaaatcgagatgggaggatcacttgaggccaggagttcgagaccagcctgggcaacgcaacgagaccccccatctctacaaaaaatttttaaa

SEQ ID NO: 129429 - DNA, 414 bp, Homo sapiens
ttaatgtgttcatctcttaaatgcagccagggtgtggtggggagagaaaatatcctccccagcggtgagggacctcactcagggtcaacttgggcagtgcgccgggtctccagccctctagtgagcttgctcttctggtctatgtgctctgggcagaaagctttgagaaaagggggggaacgagccttagcagcccccgttccaagcaacaggtctccaacttgcatggggccagagcatcagaaggcatgctgctctttgaggaacgcgtggaacactcatttagcacatttatgtcacaaaatgcataattttgtctgaaatcagcaaatgtcttttcttagcttccaaaaacaaacaagtggttactagttgttcaaatgtcaagaacattcttgaggaaacctttgaact

SEQ ID NO: 129430 - DNA, 269 bp, Homo sapiens
aaagatacaaaatcaataaggtaactgtacaccttgagaaaatagacaagcaaaataaacctaaagttagcagaaggaataaaataatgaagattagagtggagataaaataaaagacaatagaaaaataatagaattaataaaaagctatttctttgaaagtatcaaaattgacaatcctttccctaaattaacgaagaaaaaaaagaaatatgaaaatcagatattaaaatggggacagtaataccaatgattcagaaataaaaagg

SEQ ID NO: 129431 - DNA, 685 bp, Homo sapiens
gacagttgatagctaaatgaggaagcatgttgtcatttactcttatacataatccatgtgtttcagcctgaattgcctaatctcagtccctgaacgtgtatttggcatttcctctagcgcacttctgttcaactctctaaattatttttgcttctcttttctttttaatccaaatatattattgcccatttcatttaagaccatgttgtgaatatatagtaagcatccaacatatttaattagtcgaaaaccttcccctctttcattgtttttactgccaacatcagtctgttgcaacagaaaaagaataaaacggattaacggcctccagaaaatataggcatttaagatctctcataaaagagatatcaaatcttatcacagtgaaggcataaaataattattttctgctagtgtctatgggagacactcaagtaagaactgtggttttaggttgactatccattcaacaagggatcaaaaacaaacaactcaccctcccctcaactcatcatctaaagggactaaattcacattttgagtacaaagctgtcttggggtgacagtttgtagattaagacatgcaaagacctaacattttttcttctattccttctgaagaaacatctataatttaaaaaattataaccttccaaccagaaaaacaaatattaattttacattt

SEQ ID NO: 129432 - DNA, 239 bp, Homo sapiens
cttcatctttctagtgagaacatcctcaaccaaagtgtttggccaaacagcatgtacaaatgggtaatatattgtaatgtacacttgggatatttaatctatggttcacatacatatttaatatgttactttaatttaaatattttatacttattaacatgactttttcctttctcacatttcatgaaacaattttgttaaaactcttcatacgcatctttaacaccaatgtgtatgtt

SEQ ID NO: 129433 - DNA, 624 bp, Homo sapiens
aagccagatcttagatgagttcacattttccagaagccaatgggaagaaatgcattccagcaacagaatggcctacaaagaagaagagtgtgaaggaagaaggcatatgtgggaacacagctgaactgcatggaacaagatgtaaccagactatagctcaagaactcttgagtgaggccaggctcggtggctcatatctgtaatcccagcactttgggaggctaaggtgggcagataacctgaggtcaggaatttgagaccagccttggcaacacagcaaaatcccatctctaccaaaaatataaaaaattaaccaggtgtggtggtgtgcacctgtggtcccagctactcaggaggctgaggtgggaagatcacttgaaccagggaggcagaggttgcagtaagccgagatcgcaccactgcactccagcctgggtgacagagagaaattccgtttcccagcactccccagaaaaacctaaatggtaaatgaggctgaaggtaggctgcagaaagattgtgaagggccttatatcccatggcaaagaatttggaataaacagcacagaaaggattacatgctatatacaaagtacacaaaaggtaaattcagggaagaaagag

SEQ ID NO: 129434 - DNA, 564 bp, Homo sapiens
ctctctgcctcacaaaaatattgccatttttttctgcctctttgttttcttggcctagtgaggttgtcagaaggattgttcagtggggtccctgggaaggaaaaggaggggaaagagaaaggtgatgggggtactctctccaaagcatttacctatcatgtatcactttttatataaaggttttcctaatggcctagtccttggttagcacacttccctcacagattcccacacagaacctaagcccttgattactctattaagggctgtgatttcgggggggccctgagctgaactacaaattcctcaaggggaaggccctgtcctgtggcctcccccagatatttaacatggattgaaaccctgagttatggaagggcagccagagccagggagaggccacaggaaagaggaaggcaccatgggattgtccctgtgccgaggatgtacctccttcccccaccacccctgtcagtagtgctggtggggagtgttatccctgcatgccagaaagggaaaggccatccaggccgtacagccagtaccttcaggagcagagctggt

SEQ ID NO: 129435 - DNA, 686 bp, Homo sapiens
taattagaggcgtgagccaccacacctggccaaacaagctttgttttttttacctgaccttagactaatggaaatgtagcatttccctggtcaaacctttacgttgctgtgaagctaaacaaactaagaaatcccttcttagttggatatgttggtgaatgtctcttgattctcacaacaacccgacatgggtccagtctgatttatgaatgtcatctgtccttactctgtgcacaggagtgcaactctgtgagatgaatgcacacatcgcaaagaagtttctcagaatgcttctgtttagttcttctgtgaagatatttccttttccacaacaggcctcaaagtgctccaaatatccacttgcagattctacaaaaagagtgtttcagaactgctcaatcaaaagaaatgttcaactctgtgagatgaatgcacgtttagttcactggaagacatatccagattcctagacatgtgttaacagtaaaactaaactaaggataatggccattttcagatcagtgcatttgattttgtttacatgtcctttctaaaaggaagcccttctattgctcaaagcatttttgtgaaacactcatatagaggataaatgtcttgttctggcattatactttttcaaaatgtattcactgacttaatctcattggaaggtgtatactgagaaa

SEQ ID NO: 129436 - DNA, 145 bp, Homo sapiens
gttatgttttcattctcattcagttcaatggattttctgattttccttgtgacgtatctgtaacccatgtgttatttagaaatgtgttgaccaggcatggtggctcatgcctgtaatcccagcgctttgggaggccgaggcgggt

SEQ ID NO: 129437 - DNA, 415 bp, Homo sapiens
tatagaaatggtatattttggtggtttctctttctcaccaacagagcttattaatccaaacaggtctctaactgcaaatccagccaatgaaacatgaggttcattttcagggcagattttaggaaaatgttttctcacgcctaagaaaaagccacaggaagaaatggccattcggttttctgaatatctggatgtgacacctgaaattgctgtagccattttactaaagataaagctgaggctggcagagtgaggagatgcaaagaacctgtgtctccttgacacggttgcgtctccaatcaactctaaaagttgcccctcctttggatttcctgttacaggagataatacatttcctcatttcttagccaatttgaatcaggtttttattacttttagctgaaaggctaatggc

SEQ ID NO: 129438 - DNA, 412 bp, Homo sapiens
taaaaatacaaaaattagccgagcatggtggcaggtgcctgtaatcccagctacttgggaggctgaggcaggagaatcccttgaacgtgggaggcagaggttgcagtaagccgagattgcgccgttgcactccagcctgggcaaaaagagtgaaactccatctcaaaaatgaaaaataaaaaataaaagaatattaaggataaactaaaatactgagaataaaaatgtgtgtgtcccattgagaaaacattttctgagtgcccactgagctccacacacaatgggaaagcagaagaaggatggaagtagtagaagcttgcattctaatgagagtgttagacgactcgactgtaatgcacaggaaaaagtaaatgctataaaagaagaagcctaaatcaagggttacaggagg

SEQ ID NO: 129439 - DNA, 334 bp, Homo sapiens
agtctctagtgactttctgatgggagcgcctctgcttcatcaaggattggaggcacttagctctcaacaaacttaggtcgctttttttcctccacagttttgttacctcccttatttgccaggcttggctttgagtgaatcttggcttttttggggttgtggggggctctctgattcattcagcagatcttcactgagtggcagatgtgtgcaaagtgcttgggatgccaaagacaagtgtgtcgtctgtatttagtgttgggacagacagtgattgagacaacagatttaatcttcactgatgacagtgatgatgccacgaaagacatgggcg

SEQ ID NO: 129440 - DNA, 225 bp, Homo sapiens
tgctatttattaattacttagcctatcacctttgtgcatatgcacaaagtacaggtcactcactgcactatgggagcaagagattggaaacaaatctaaccatttgtttcagtcccttcccgctactataacaaaataccttagactatgtaatttacaaacaaggaaatgtattgctcatagttctggaggctgcaaagtccaagatggagacaccaatagatt

SEQ ID NO: 129441 - DNA, 502 bp, Homo sapiens
catcaaatctagaaatcatcttctcttattttatatcgtattacagcattgatatgtatatgatacatatacattgatatgatatgcttctatacccggtctgtcacaccgtgtggatttcctcagaggctcctagaaggccctgctgtccaggctaggaggtttctggcagccccaagctccctggcttctgcgtgaaggtgtgaatagaaccatgctgttaagtgggggtttgcagaaaccagggtttgacctgggagagccctaggcagcaggggatgatcaagtgatcaagataatattttaatgcaaaatttgaaaaatcaaaactaacggatgaaccttgaacagagtgtgctaagtggaaaaagctggtcattaaagaacatgctttgtgtgattccatttttatgaaatgttcagaataggcgaactcatagagacggaaagtagagtagtggtctcctggggctgggaggagaagggggttacagtttgatac

SEQ ID NO: 129442 - DNA, 1257 bp, Homo sapiens
gttcctcctctcccctcatgaagtttttctgccaatttgagaattactctggttaagtggtggctcagaataattaaatgcttaagatttaagtgctgaaatgtgttacctaaagatttggatgggaacttccttgcctttgtgaagggagagtattgaatatacggatgtgtgtcaagggtctctggaagccttcgtgctgaatcatgaccactcaccatgctggaaagagaactggagggggatgacctagagctgaccctggaattctctttcctgaagaaggtctgatgccatttaactttggggtaattcacctgtttctaataacagctacacctgtgtcccgagcattggactggatgctgccatatagcagctcatttaacctttgtcccatctgcagatgaaagaacaggggcccagaatggctactggtggagccaggattcaagtctgggttgattgacttggattttgtactgttaacccctatgctgcctgactttctcctaacatcacatctatgggtgatttaacacagctttcccacccttttgtttttcctgcaaaattaaccattggaccaaaagccaaagcatcttcttctccaatagctacttggccctccagaagactgtggcacagtgtgagatgctccccagcagcttccaggtctcacctgtggccttgatgcctgggtgaacaaaagcctttcttttggtttggtacctttgtatttctgaatctttagtaaaagcgaacattgttttaaaagtatctttttggactagctcatacatttgatatggtttggctctgtgtccccacctaaatctcgtgttgaattgtaattcccagtgttgggggagggacctggtaggaggtgattggatcaagggggtggatttccccccttgcagttctcgtgagggtgcgttctcacaagatccggttgtttaaagtgtgtagcacaaactgggtatggtggctcaagcctgtaatcctagcacttgggaggctgaggtgggcagatcacttgagcccaggagttcaagaccagcctgggcaacatggtgaaaccccgtctctacaaaatatacaaaaattaggcaggcatggtagctcatgcctaaagtcccagctactgtggaggctgaggtgggagaattgcttgagcctggaaagtcagagctgcagtgagctgagattgcaccacttcactccagtctgggcaacagagtgagaccctgtctc

SEQ ID NO: 129443 - DNA, 1209 bp, Homo sapiens
gtgcgcccgccccctctggggcggagagactcagcccctgcccctcagcggataacctgggactgaccgttccctggggatccgacgggccccagaggacccacgcctgagccccgtgcgactcgtggcctttgggctagaagccatggacgccttcacccgcttcaccaaccagacccagggccgggaccgactcttcagagccactcagtacacatgcatgttgcttagatatttgttagagcccaaagctggcaaagagaaggtggtaatgaagctcaagaaactggagtccagtgtgagcactggtcgtaaatggttcagactaggcaatgtggtacatgctatacaggcaactgagcagagcattcatgccactgacctggtacctcgcttatgcttaacattagccaacctgaaccgtgtgatttatttcatctgtgacaccatcctctgggtgaggagcgtaggtctcacctctggcatcaacaaagagaaatggcgaacgagggctgctcaccactactactattctcttctgctgagccttgtcagggatctgtatgaaatctccctgcagatgaaacgagttacatgtgacagggcaaagaaagagaaatcagcatcccaggatcctctttggttcagcgtggctgaggaggaaacagaatggctccaatcctttctacttcttttattccgatctctgaagcagcatcctcccttgctcctggacacagtgaagaacctttgtgatatcctgaaccctttggaccagctggggatctataaatccaatcctggcatcattggacttggaggtcttgtgtcctctatagcaggcatgatcactgtggcatatcctcagatgaagctgaagacccgttagggtgtttttaggcttggaactagtacctactttaaaagatggcctcttggtgggacagacatttgtataagtcacaggccatgtcatactgtgcttaagttcttgttcatgtgagcatttaacaacctgtgatgtgggcagagatgaggccaagaacggagaagggaggagcatgaagagttgtatgtttttggagtgctggagtgacttgtgaatttctgaatattttcccttcatctaacattgattgaacatctcttatgtgcatagtgggagcttagtatttgctgaatgaataaaaattgaaaggaaaaaattta

SEQ ID NO: 129444 - DNA, 723 bp, Homo sapiens
  misc_feature (645)..(645): n is a, c, g, or t
  misc_feature (707)..(707): n is a, c, g, or t
  misc_feature (718)..(718): n is a, c, g, or t
gtgcgcccgccccctctggggcggagagactcagcccctgcccctcagcggataacctgggactgaccgttccctggggatccgacgggccccagaggacccacgcctgagccccgtgcgactcgtggcctttgggctagaagccatggacgccttcacccgcttcaccaaccagacccagggccgggaccgactcttcagagccactcagtacacatgcatgttgcttagatatttgttagagcccaaagctggcaaagagaaggtggtaatgaagctcaagaaactggagtccagtgtgagcactggtcgtaaatggttcagactaggcaatgtggtacatgctatacaggcaactgagcagagcattcatgccactgacctggtacctcgcttatgcttaacattagccaacctgaaccgtgtgatttatttcatctgtgacaccatcctctgggtgaggagcgtaggtctcacctctggcatcaacaaagagaaatggcgaacgagggctgctcaccactactactattctcttctgctgagccttgtcagggatctgtatgaaatctccctgcagatgaaacgagttacatgtgacagggcaaagaaagagaaatcagcatcccaggatccttgttcacntggtgagagaacaaatggtccatcttctctcttttccattctaacactctcctgtctgaccntgaaacttgtnattct

SEQ ID NO: 129445 - DNA, 691 bp, Homo sapiens
  misc_feature (691)..(691): n is a, c, g, or t
gtgcgcccgccccctctggggcggagagactcagcccctgcccctcagcggataacctgggactgaccgttccctggggatccgacgggccccagaggacccacgcctgagccccgtgcgactcgtggcctttgggctagaagccatggacgccttcacccgcttcaccaaccagacccagggccgggaccgactcttcagacaaaattgacttgtgtctgtgagtgtgttctgggaagagagaagagttaaacataaggcaatccatcagataatcctcaatcagcctacacagttggtacagcgagctctgggctagaagatccaggctgaggaggaggatggagaaagattgagatgtagagcctctgggttgagagggacctctgaaatgaactcatctagactgctgccatggagatggtgctctacagtagccctgtcaatcgctggctggcttctgcctagaaaaaaaaagaaaaaaattacccgggctgtggtggtggcgcgcctgtaatcccagttacttgggaggctgaaggcaggagaatccctttgaacccgggaggcggaggtggtagtggagccgagattggtgcaactacactccagccggggcaacagagcaagaatccatctcaaaaacacaacacacagagaacgcaagcacacgcacaacgacaagacactn

SEQ ID NO: 129446 - DNA, 555 bp, Homo sapiens
caggaggctgaggcaggagaatggcatgagcccaggaggcaaagcttgcagtgagccaagatcacgccactgcactccagcctgggcaacagagcgagactccttctaaaaaaaaaataaaaacaggctgcattattgcagaatttgttttcattacctttgtgttaaatttccatgacatgttctaccctttggctctcctgtagaatgactgttgcagaattttgcttttgtaagagttgctacatgagaaatggtcttggaaatgttgtctggaggcatgtgtttctctttcccttacttcctgaattaagttttatttggtttgtaaatcattcttctcaatttttttttttccatttcagagccactcagtacacatgcatgttgcttagatatttgttagagcccaaagctggcaaagagaaggtggtaatgaagctcaagaaactggagtccagtgtgagcactggtcgtaaatgtaagtaccctgtttcttgagggacagtgactcctggtttagaatcctcagcctcagaccctgtaattcacgga

SEQ ID NO: 129447 - DNA, 2725 bp, Homo sapiens
gtgcgcccgccccctctggggcggagagactcagcccctgcccctcagcggataacctgggactgaccgttccctggggatccgacgggccccagaggacccacgcctgagccccgtgcgactcgtggcctttgggctagaagccatggacgccttcacccgcttcaccaaccagacccagggccgggaccgactcttcagagccactcagtacacatgcatgttgcttagatatttgttagagcccaaagctggcaaagagaaggtggtaatgaagctcaagaaactggagtccagtgtgagcactggtcgtaaatggttcagactaggcaatgtggtacatgctatacaggcaactgagcagagcattcatgccactgacctggtacctcgcttatgcttaacattagccaacctgaaccgtgtgatttatttcatctgtgacaccatcctctgggtgaggagcgtaggtctcacctctggcatcaacaaagagaaatggcgaacgagggctgctcaccactactactattctcttctgctgagccttgtcagggatctgtatgaaatctccctgcagatgaaacgagttacatgtgacagggcaaagaaagagaaatcagcatcccaggatcctctttggttcagcgtggctgaggaggaaacagaatggctccaatcctttctacttcttttattccgatctctgaagcagcatcctcccttgctcctggacacagtgaagaacctttgtgatatcctgaaccctttggaccagctggggatctataaatccaatcctggcatcattggacttggaggtcttgtgtcctctatagcaggcatgatcactgtggcatatcctcagatgaagctgaagacccgttagggtgtttttaggcttggaactagtacctactttaaaagatggcctcttggtgggacagacatttgtataagtcacaggccatgtcatactgtgcttaagttcttgttcatgtgagcatttaacaacctgtgatgtgggcagagatgaggccaagaacggagaagggaggagcatgaagagttgtatgtttttggagtgctggagtgacttgtgaatttctgaatattttcccttcatctaacattgattgaacatctcttatgtgcatagtgggagcttagtatttgctgaatgaataaaaattgaaaggaaaaaatttaaaaagacccaatcgcactgatcattgaacaccagtatacaataactttagggtcatatggatcattggtttcacgattacagtaggtctggtgcatggcactctcagatctagtagaggctctgatgtcagtagcaggatggaggagagctgggcttacagcctctcaacttgttggcccttataccatcactgcactcatgtccttgctctgtgcagaagtagaatcagaaaagcatcaggcaccttcatggtataaattgtgtctatgggtgcagtgaataagcaaaaatcagaagcagaccggagggacttataaaaataggtacagggtcacaatgggtgcctatatgtagcctgtgacagataagaagctgacagtgagacaaacaaaaaactgaggctagagcctcattcctctgactcctaatccagtgttctctccatgctctcccactgtcttcagaattgagtagaaatgtgatcccctcctgaatcctgttttttgcctcttactctcccataatttggaaatttccttgtccagtggtttatattcttttctagaaaaactaaaactgggtggagtgtggtggctcacacctataatcccagcactttgggaggctgaagcggaaggattgcttgaggccaggagttcaagaccagcctgggcaatgtagtgagactccttctctacaacaaagtgttaaaaaattagccaggcatggtggagtatgcctgtagtcccagatactctggaggctgaagcaggaggatcacttgagcccaggagttcaaggctgcagtgagcttccaccgcactccagcccgggtgatagagcaagaccctgtgtcttaaaaaaaaattaagacagtatttagacttatcagttagattgttttatttaaatccttctaacaatttaggcaattctacattaattttcatcaaaatttatccagtcaaaaaaatttcatgaatactccagatgtaagagagtcacaattttctacgataaatcagacatcttatttctagggtgattgagggaggtggaaagcgcaggaggaagccagtgaagaggacaatggaatgctgagtcaatgacattgacttgtgttcctatctgccatcttgggtgtgggtctttatatgtggttacagatcctttagtttgagggaggtgaggtagagaaataggatgccagcaggtaggaggccgatgtcagtcctcccagcaaagctgtgtcatttatctgaatggaaatgagaaaataaatatgtactcaataagtcacatttcccagaaatgtgattgagattctcaaaaaatagactcagattcttggctgtctgtttaaccaatcacgatatgggatttgagaaataaaatttagggaattttaagagacatgaaagctactaggtcagggaaaataaaaagcttaaataactatttttattgtccagatcctctactgtaatagattaactatgttcaataaatttctag

SEQ ID NO: 129448 - DNA, 2452 bp, Homo sapiens
gtactaatgaaataactgttcactattgtgggttctacttgcagggttcagactaggcaatgtggtacatgctatacaggcaactgagcagagcattcatgccactgacctggtacctcgcttatgcttaacattagccaacctgaaccgtgtgatttatttcatctgtgacaccatcctctgggtgaggagcgtaggtctcacctctggcatcaacaaagagaaatggcgaacgagggctgctcaccactactactattctcttctgctgagccttgtcagggatctgtatgaaatctccctgcagatgaaacgagttacatgtgacagggcaaagaaagagaaatcagcatcccaggatcctctttggttcagcgtggctgaggaggaaacagaatggctccaatcctttctacttcttttattccgatctctgaagcagcatcctcccttgctcctggacacagtgaagaacctttgtgatatcctgaaccctttggaccagctggggatctataaatccaatcctggcatcattggacttggaggtcttgtgtcctctatagcaggcatgatcactgtggcatatcctcagatgaagctgaagacccgttagggtgtttttaggcttggaactagtacctactttaaaagatggcctcttggtgggacagacatttgtataagtcacaggccatgtcatactgtgcttaagttcttgttcatgtgagcatttaacaacctgtgatgtgggcagagatgaggccaagaacggagaagggaggagcatgaagagttgtatgtttttggagtgctggagtgacttgtgaatttctgaatattttcccttcatctaacattgattgaacatctcttatgtgcatagtgggagcttagtatttgctgaatgaataaaaattgaaaggaaaaaatttaaaaagacccaatcgcactgatcattgaacaccagtatacaataactttagggtcatatggatcattggtttcacgattacagtaggtctggtgcatggcactctcagatctagtagaggctctgatgtcagtagcaggatggaggagagctgggcttacagcctctcaacttgttggcccttataccatcactgcactcatgtccttgctctgtgcagaagtagaatcagaaaagcatcaggcaccttcatggtataaattgtgtctatgggtgcagtgaataagcaaaaatcagaagcagaccggagggacttataaaaataggtacagggtcacaatgggtgcctatatgtagcctgtgacagataagaagctgacagtgagacaaacaaaaaactgaggctagagcctcattcctctgactcctaatccagtgttctctccatgctctcccactgtcttcagaattgagtagaaatgtgatcccctcctgaatcctgttttttgcctcttactctcccataatttggaaatttccttgtccagtggtttatattcttttctagaaaaactaaaactgggtggagtgtggtggctcacacctataatcccagcactttgggaggctgaagcggaaggattgcttgaggccaggagttcaagaccagcctgggcaatgtagtgagactccttctctacaacaaagtgttaaaaaattagccaggcatggtggagtatgcctgtagtcccagatactctggaggctgaagcaggaggatcacttgagcccaggagttcaaggctgcagtgagcttccaccgcactccagcccgggtgatagagcaagaccctgtgtcttaaaaaaaaattaagacagtatttagacttatcagttagattgttttatttaaatccttctaacaatttaggcaattctacattaattttcatcaaaatttatccagtcaaaaaaatttcatgaatactccagatgtaagagagtcacaattttctacgataaatcagacatcttatttctagggtgattgagggaggtggaaagcgcaggaggaagccagtgaagaggacaatggaatgctgagtcaatgacattgacttgtgttcctatctgccatcttgggtgtgggtctttatatgtggttacagatcctttagtttgagggaggtgaggtagagaaataggatgccagcaggtaggaggccgatgtcagtcctcccagcaaagctgtgtcatttatctgaatggaaatgagaaaataaatatgtactcaataagtcacatttcccagaaatgtgattgagattctcaaaaaatagactcagattcttggctgtctgtttaaccaatcacgatatgggatttgagaaataaaatttagggaattttaagagacatgaaagctactaggtcagggaaaataaaaagcttaaataactatttttattgtccagatcctctactgtaatagattaactatgttcaataaatttctag

SEQ ID NO: 129449 - DNA, 1291 bp, Homo sapiens
cctggctcttgtgtttatactcctgggggaactgtcccaagagatccatcctgctcttttcctgccaacccagctagtccccaattcacctgctcttatcaagatcatctggccccccatagcatgctagacaaaaggcagctggaaaggacaggccagacctgagctagccaggcctggcttcctcattcctctgactcctaatccagtgttctctccatgctctcccactgtcttcagaattgagtagaaatgtgatcccctcctgaatcctgttttttgcctcttactctcccataatttggaaatttccttgtccagtggtttatattcttttctagaaaaactaaaactgggtggagtgtggtggctcacacctataatcccagcactttgggaggctgaagcggaaggattgcttgaggccaggagttcaagaccagcctgggcaatgtagtgagactccttctctacaacaaagtgttaaaaaattagccaggcatggtggagtatgcctgtagtcccagatactctggaggctgaagcaggaggatcacttgagcccaggagttcaaggctgcagtgagcttccaccgcactccagcccgggtgatagagcaagaccctgtgtcttaaaaaaaaattaagacagtatttagacttatcagttagattgttttatttaaatccttctaacaatttaggcaattctacattaattttcatcaaaatttatccagtcaaaaaaatttcatgaatactccagatgtaagagagtcacaattttctacgataaatcagacatcttatttctagggtgattgagggaggtggaaagcgcaggaggaagccagtgaagaggacaatggaatgctgagtcaatgacattgacttgtgttcctatctgccatcttgggtgtgggtctttatatgtggttacagatcctttagtttgagggaggtgaggtagagaaataggatgccagcaggtaggaggccgatgtcagtcctcccagcaaagctgtgtcatttatctgaatggaaatgagaaaataaatatgtactcaataagtcacatttcccagaaatgtgattgagattctcaaaaaatagactcagattcttggctgtctgtttaaccaatcacgatatgggatttgagaaataaaatttagggaattttaagagacatgaaagctactaggtcagggaaaataaaaagcttaaataactatttttattgtccagatcctctactgtaatagattaactatgttcaataaatttctag

SEQ ID NO: 129450 - DNA, 936 bp, Homo sapiens
gtactaatgaaataactgttcactattgtgggttctacttgcagggttcagactaggcaatgtggtacatgctatacaggcaactgagcagagcattcatgccactgacctggtacctcgcttatgcttaacattagccaacctgaaccgtgtgatttatttcatctgtgacaccatcctctgggtgaggagcgtaggtctcacctctggcatcaacaaagagaaatggcgaacgagggctgctcaccactactactattctcttctgctgagccttgtcagggatctgtatgaaatctccctgcagatgaaacgagttacatgtgacagggcaaagaaagagaaatcagcatcccaggatcctctttggttcagcgtggctgaggaggaaacagaatggctccaatcctttctacttcttttattccgatctctgaagcagcatcctcccttgctcctggacacagtgaagaacctttgtgatatcctgaaccctttggaccagctggggatctataaatccaatcctggcatcattggacttggaggtcttgtgtcctctatagcaggcatgatcactgtggcatatcctcagatgaagctgaagacccgttagggtgtttttaggcttggaactagtacctactttaaaagatggcctcttggtgggacagacatttgtataagtcacaggccatgtcatactgtgcttaagttcttgttcatgtgagcatttaacaacctgtgatgtgggcagagatgaggccaagaacggagaagggaggagcatgaagagttgtatgtttttggagtgctggagtgacttgtgaatttctgaatattttcccttcatctaacattgattgaacatctcttatgtgcatagtgggagcttagtatttgctgaatgaataaaaattgaaaggaaaaaattta

SEQ ID NO: 129451 - DNA, 2599 bp, Homo sapiens
tgcctagaggacttcaacttcgacggacgcattcacccgcttctcagccagacccagggcgggacgactcttcagagccactcagtacacatgcatgttgcttagatatttgttagagcccaaagctggcaaagagaaggtggtaatgaagctcaagaaactggagtccagtgtgagcactggtcgtaaatggttcagactaggcaatgtggtacatgctatacaggcaactgagcagagcattcatgccactgacctggtacctcgcttatgcttaacattagccaacctgaaccgtgtgatttatttcatctgtgacaccatcctctgggtgaggagcgtaggtctcacctctggcatcaacaaagagaaatggcgaacgagggctgctcaccactactactattctcttctgctgagccttgtcagggatctgtatgaaatctccctgcagatgaaacgagttacatgtgacagggcaaagaaagagaaatcagcatcccaggatcctctttggttcagcgtggctgaggaggaaacagaatggctccaatcctttctacttcttttattccgatctctgaagcagcatcctcccttgctcctggacacagtgaagaacctttgtgatatcctgaaccctttggaccagctggggatctataaatccaatcctggcatcattggacttggaggtcttgtgtcctctatagcaggcatgatcactgtggcatatcctcagatgaagctgaagacccgttagggtgtttttaggcttggaactagtacctactttaaaagatggcctcttggtgggacagacatttgtataagtcacaggccatgtcatactgtgcttaagttcttgttcatgtgagcatttaacaacctgtgatgtgggcagagatgaggccaagaacggagaagggaggagcatgaagagttgtatgtttttggagtgctggagtgacttgtgaatttctgaatattttcccttcatctaacattgattgaacatctcttatgtgcatagtgggagcttagtatttgctgaatgaataaaaattgaaaggaaaaaatttaaaaagacccaatcgcactgatcattgaacaccagtatacaataactttagggtcatatggatcattggtttcacgattacagtaggtctggtgcatggcactctcagatctagtagaggctctgatgtcagtagcaggatggaggagagctgggcttacagcctctcaacttgttggcccttataccatcactgcactcatgtccttgctctgtgcagaagtagaatcagaaaagcatcaggcaccttcatggtataaattgtgtctatgggtgcagtgaataagcaaaaatcagaagcagaccggagggacttataaaaataggtacagggtcacaatgggtgcctatatgtagcctgtgacagataagaagctgacagtgagacaaacaaaaaactgaggctagagcctcattcctctgactcctaatccagtgttctctccatgctctcccactgtcttcagaattgagtagaaatgtgatcccctcctgaatcctgttttttgcctcttactctcccataatttggaaatttccttgtccagtggtttatattcttttctagaaaaactaaaactgggtggagtgtggtggctcacacctataatcccagcactttgggaggctgaagcggaaggattgcttgaggccaggagttcaagaccagcctgggcaatgtagtgagactccttctctacaacaaagtgttaaaaaattagccaggcatggtggagtatgcctgtagtcccagatactctggaggctgaagcaggaggatcacttgagcccaggagttcaaggctgcagtgagcttccaccgcactccagcccgggtgatagagcaagaccctgtgtcttaaaaaaaaattaagacagtatttagacttatcagttagattgttttatttaaatccttctaacaatttaggcaattctacattaattttcatcaaaatttatccagtcaaaaaaatttcatgaatactccagatgtaagagagtcacaattttctacgataaatcagacatcttatttctagggtgattgagggaggtggaaagcgcaggaggaagccagtgaagaggacaatggaatgctgagtcaatgacattgacttgtgttcctatctgccatcttgggtgtgggtctttatatgtggttacagatcctttagtttgagggaggtgaggtagagaaataggatgccagcaggtaggaggccgatgtcagtcctcccagcaaagctgtgtcatttatctgaatggaaatgagaaaataaatatgtactcaataagtcacatttcccagaaatgtgattgagattctcaaaaaatagactcagattcttggctgtctgtttaaccaatcacgatatgggatttgagaaataaaatttagggaattttaagagacatgaaagctactaggtcagggaaaataaaaagcttaaataactatttttattgtccagatcctctactgtaatagattaactatgttcaataaatttctag

SEQ ID NO: 129452 - DNA, 669 bp, Homo sapiens
cattggaaaaactaaaaaattatattctaattttataatattttgatcttcatttctaaatatagagcatggattgtgatgatagtagcgttgatgataaaaatccattgctatcttagctaggtaactaactatgacattttttatctccttcttttagactacatgccacatatttgtagttaatttttttatgtgcctgtctctttccctaaattgtgagctctttgatggcagaatctgtgtcattcatcttatcttcatgcctggcataagcctgacatatagtggacattcactgtacatttgatggattgaattttgttaaatgatggaaggaaagaactttatcgtatcatgattttagtgtttatcaggctcaaaacactacactgaatcttatggttagctaaaacagtttggacataggctctatgctcatgcttcttgtatttggctgacttagagaatgtgagtgtttactgctaacttactgtgaacttctctttcttagagtttggatgtttaagggctgttttctatcaggcacgttcctgaaggctcactcatgattttgagcctgggatagctaactgtaatgtcgtcatcaagtcagctatggtatctagattacatctaaaacacatatcatcttgtatacagtatcat

SEQ ID NO: 129453 - DNA, 291 bp, Homo sapiens
actgctggtcttatcaaattcaaaccccacttccacccccacatctgtgcgcaagaatgttcacacacgcacacacacacacacaaacacacacacatttctgcaatatttcatcttcttaggccaggaacttatcatgacgaaccaaatgcaatacctatttcctgaccaaagctgttattcaatatctctatcatttgagaaatagtttgatttcacgttgacaagggtcacactgaggtcttaagagaagtaacaattacaaagcatcctagtccctgtgaaagggtg

SEQ ID NO: 129454 - DNA, 130 bp, Homo sapiens
gatgttcacagattcttctgtacctaaacttgtagtctggatactctaaaatcccttcttggaataagccagaccacttttaaagctggccctggacttggtcttatgggcactctgtgaaagtcctgtt

SEQ ID NO: 129455 - DNA, 379 bp, Homo sapiens
agaaaataagtgattactggccctaaaataagaagagttattttttgggcatctcatactattttaggtcaattaatttactgcctcagctgtaggaaaaaaggcatttgaagtatatttcaactcagaatcatgaaggggcttatttctccaccccaaagcataattaaagtcaaaatgtaagatttaagtagatcactgcaatctattttaaaatttcagtaacactactgtgaaatattcctttagttctttgttggactttcctctggatcattatcgatactccaaaagtcatcttgaatatatgagaagtacattagaaacttagcagtggcatcttctttctgtcttctatgtctcacaacaaacaaaatcc

SEQ ID NO: 129456 - DNA, 300 bp, Homo sapiens
accagaaaaatgaataggagtgattcaggaactagaaggtaagaaggcatttccggctgctggagcagatgtggaatggcattgtctgatcaggaagactgaagaggttttgtatgcttgcaagggaagcatgtgggggacaattgaaactagacagattggcagcgactggattatcaaggaccgggagtgaattggacttaatgctgcaggcaaaagagagtcttggaagggttttaaatagagaagctcagtggcagctgtgaggagagtggattataagagaagaagaaggtggag

SEQ ID NO: 129457 - DNA, 403 bp, Homo sapiens
ctagctaggcaggatcccactgagctcactgatggtgagttgttgtgggcccaggtgcgtactgaggtaccatccaggagctagggactggagtcgagaaaccttagaagtctttctggtgttctgctgtcctgcagctgtgctggcactcaaaccagaagacacagtacttctcacctttctttcccatttctactggcagaggagcctcagcccatgaccgccactactacaggctcatggagaatactgctgggctaccaccaatattcagttaaggccctagggctcttaagtcagtttgtggtgaatagtgccagcctgggactcacccttcgggacactgggctccccgctggcccagaactggtaaagaaatgctaagagccaaggcctggaattg

SEQ ID NO: 129458 - DNA, 503 bp, Homo sapiens
tgagatcccatctcaaataaataaataaataatcattatttctggcgcctttcataaagattaataaacaaaatctactcagcagaaatgtcaaaaaaagctgagtaacaaggtcacttacagcatgcctctaacacccaatggcctgatgtatgctatgttactaagagaaccacttaagatcacctttgttctccagctcctgcttttaacaaatagaggacttctctctccaaacagggtgatgaaaataaacgcctgtaatcccagcactttgggaggccgaggtgggcagattacgaagtcaggagattgagactatcctggctaacacagtgaaaccatctctatttagtagccgggcatggtgacacgcacctgtaatcccagctactcgggaggctgaggcaggagaatagcttgaacccaggaggcggaggttgcagtgagctgaggtcatgccactgcactccagcctgggcgacaaagtgatactccgtctc

SEQ ID NO: 129459 - DNA, 106 bp, Homo sapiens
gtttaagtgatagagacagagacagatgttaaataacgcagtacatcaagggctgaggaggccttgaagaatagtggatggagggtgcctgcagtgaggtggtggc

SEQ ID NO: 129460 - DNA, 222 bp, Homo sapiens
tgttgacctctgtgcccaagcctacatccagaaatccaccatactgacaatgccatgacagtaagaaaattttgattacatcattaatcaggaaaaaaacagaatatttttataaaacatataattcatcctaaatattttccaatgtaaggattagtattcaaatgattggagagtaattgattaccatctagtccatcttaaatgtgcacattctaaaat

SEQ ID NO: 129461 - DNA, 394 bp, Homo sapiens
tgatctgcctgcctcagcctcccaaagtgctgggattacaggcatgagccaccacacccagcccttttcattcttctaatagtgatttggaagagtcaaattttttaattttgaggaagtctaatttatcaagtttttctttcatcatttgtgttttttgtgtgtgttctgtctgagatatctttgccaaacccaagatcgctaaggttttcttttatgttttgtactagaagtttataaagttttagctgttatgtttaggtctatgattctttttgagttaatttgtatatattgtgtgacatatggatccaggtttatttacttgtggatatccagttgttccagtgccattagttgaaaagactttgtttcttttcttttttcttttttt

SEQ ID NO: 129462 - DNA, 586 bp, Homo sapiens
tgtctcctgctcggggtcagaggctgtagctgtgtggacaggagggggtgacaagtcagagacaaacacactcttgctgatggcaaggaagctggctgggccacgtgctccgaggcccacaatgagttcgtggcaaagaaaatgtccaaaggctccctgagaaacggcctccactagagcaccctccatcccccccttgacctctgtggaagagctgggtgcagggctcagaggaccctgacttgtgcccagcctctggcctggctgccctcccgtccctgaccaggagctgtaggagacgagcagcccccttccctggaacccaggatgggaggcagccttggctggcagctggcagccaggggccatgcttcctgtgcccctcatgtgacagtgatgctaaagctttgccacgccaggacggtgcaagctggcatgaaggctacaggcctggcaggtctggtgcggccactctgggaaccgtcccctgggagatgagcgagcattcaccaaccagtgcagcagggcctgtggctgtggccgaggtgctccctgtggcatttccaggaaaccagacaccaaggtg

SEQ ID NO: 129463 - DNA, 442 bp, Homo sapiens
gtcatacaatttttaaatcacccccaaattgatataataaatattattgttgatgttcttattattatttataatatgaaatattttaagttcataatactggagccattctgagaaagttcctaaaatagactactgcggaagcccattattgccatggacctgatatatttacatctataattttaatgaggatgtcataagattaaaatttgtgatggacatttgtgatctctctcaatgatgatctctattatatctacatacattcatttctttattaatagctcatccatgcagaactcaattatccaacaatctcattttattgataacaaatgctagaaaaagaaagtatcagaaatggctttgaaacaacgtttgcattgaatctacaaacatttttctggggatagcccataaaggcattaagcaaaaaaaa

SEQ ID NO: 129464 - DNA, 367 bp, Homo sapiens
acttggacagcaacagggagactgaactacaagaagcagcaagagagaatctgcttcccccagtactgtgtgctgagctaagctgtcctgggctttagctcctgggaaaaagagtgtacaagagatgagagagagagagctgggtttgttcagacccaggatctcctttcactttggatatattgaggccaaacaacagtgcacactttgtcttttaaggaaggctcagcacctctactctctagcaaatatacatttcaatgacctggagccacatccttccatagcaggcacttatccctttggggaaggaggacagatcatgaaatgggaacaagagaaggaagaaagggaaagaagagtccta

SEQ ID NO: 129465 - DNA, 547 bp, Homo sapiens
ggttgatgtgaagattaagtaaatttataacataaaatatttagtgctgtacctggcacacagcaaacactcaagaaacgctattattattactgctaagactagtaaaacaccgcgggcaggaaagaatggaggattactgaataaagccctaatgcagacagaagttactactatgtcactcccacaaggaaacatcaaacatcaccactcccaggagcctcctcagaagcaacctgccagccctgggctggtcattctctgatagtatcagggccgttttgtcccactttcctccgtggacttgagctcactaagggcagccttactgcaccctcccccaccccatcctcagcacccagtggtgtgcagcagggttgtgggaaatatctgccagacagacatgcttaagatgtggcccgagtcccttcccctttctggagaggcctgcttcactgggaaggcaactctccaatgccatagtacaaacccctagagagcctgcatcccttccagtcccatccctgccagacactgggaacgcaga

SEQ ID NO: 129466 - DNA, 238 bp, Homo sapiens
attcctgaggcagaaccaattgacccggcttgtcttcccaaagcaggccacacgatagaggtcaatggtagctacccatggatgagccatttagtgtagaagggcctcttggcacaaccgaaaaagagcaaagccatctgaagctattcagtgtggaagcaaaagctctccccagattgcaagcgcactgctgtgttacagcagaggccacactgggtatcagtggaagcaggggcat

SEQ ID NO: 129467 - DNA, 457 bp, Homo sapiens
gaactaggtggatggtatggcataaacaaagatatcatatggcataaacaaagataggaaggggaagagatgtttccagtttggaatttcaagtgaaatgctaaattatggagacatgaaagaaaaaaattttaagataaacttgtaaaaagctgacagatattaccctggggtctgaccctataattaataaagaatgtttcctaaataaactattttaacataatattaggttgatgcaatagtaattgcggtttttgccattaaaacctagatcgatatgtagaaaaacaagcctgtataaagtggtaaataaagattcatcttataatttcaaataatgtgaatatagcataaaaggaagagaccaacacactgaatcccaaatatacaaagctaaatgtgttgcctgaggaaggaagaactttggaagagctttgctggtccaggcacagtt

SEQ ID NO: 129468 - DNA, 894 bp, Homo sapiens
aagtcatgtatgcaacatatctggatgatgggtcaactttgtttaatagattagcatcatttacactgaagttcgtggctctgagcttcgttaaagtgagacctttgtccacattcccaggagggctttttctcagggggttctgaattttaccatgacgtaattcctaaacagttgtgattagtgctaaatgttatcataaacacacacacacacacacacacacacacacacacaccccgtgtgctgtgtgagcagctagtatatagtatacttacaacacctttagaaatacttaatgttcttcttactatctgtacatcttactatatatatcatatctatatctgtagaatataagagctttataactacttataatatactatactttcttctaccattcacctctcatagcaactctctcccagtcgttgtttgatcactatatctccacaggcgtggtctcccctcttttgagtctctcatacataactctttcgtgtgtctcgagttaatgtgtagattggggctttctatatttctacaaactattcatttaattacagacatacttttatttcctggaaggtattataccgagatatcacttcgagaagatattgctgggctacacagactccagggacacgtgcatactagagcgaatatatcacatataagagcggagtcacaatatacttttgtgggcttctcaccgatgtgtattataaaaacgttatggtaccacaccctattattggtacgtgtgttaactagacagttgtctctagagaacaacgaagtgatatcattacctttgagctgacgaaaactaactttagtggctacaaagccatcaccgcagaacaatcaaacaacaaacatagttgg

SEQ ID NO: 129469 - DNA, 371 bp, Homo sapiens
cgaggttccaaaagtacaaaagtgaaagctgtcagacctcataagctctaggtatagaagtcacatggcacaatttccaccatattctatcagtcaaaacaacaactagactggcccagattcaagggggagaggaaagagacctcacctactgatgggacttctggcaggtccaaatgtggatgagactcctatagagatctgtgaactaaaaggacaaattgcctgcccaccacacacaacatgcaagggtatgacacgaacactcccttcaaggggatgttgagaagcacaaagcattcgctgattcagagcaatcctgaaatccaggcctatactgtcagctcccttgactccaggatcaatcaaca

SEQ ID NO: 129470 - DNA, 1059 bp, Homo sapiens
gagaatcgcttgaacctgtgaggcggaggttgcagtgagtcaggatcgcgccactgcactccagtctgggtgacggaggcagactccgtctcacagagagagagaaaaaaaaaaggaatgaggtgtggaggaagaaatcccagctgtcgaatcagacagacttgggttcaaattctgtcctgctacccaggagctagatgttcccaggcaagctgctcattttctctggcttctgtttactcatctggaaaatgcagctatgaagtatcctaccaagtgcaaaatatcctaccaagtgagattgccatcagaaataggatttggaagcttccagcacagagcctggtgcatagtaggctcttgaaaactagaggtaatattactgtttcagggagaagtactagggtggagtacccagtgaccttcttatcttggctcatggctctccatgcttaaaatcctcccatggttgcatgggacccaaagtctgaatttaccatgtccttcaaggctcatgcatgggtcttcagaccaccacttccttacttctttgtttcagccccgtgtctcgtgtccttgtgagcacatggagagtgtgtgttggactatttgtaggctccattcttccttgtctattagaaaggcagcagggctgctgtctgtctcactcgtcactgcagcccagcctgtagcccagtgctaggcatctagtgggtgctcagtaagaatgaatgaatgattgaatgaacaattgcgggaagaagcaccagcaatcctgagaagggagaggtctgtgaaggcgggagtcagcagggaaggccctggggctccatcctcctccttctctgggtcacgcttccccttagcattgtatgcacagcattgccaggtgcttctcagtgacagcagctggagaggtggctcaagcccatcccaaacccatttcccactcttggaggctgctccaggcgggtagtttttcagagctcagcagcctcctcaggctgctctcacactggcctggcttcgttcagagtccagccctccatctgagaagcc

SEQ ID NO: 129471 - DNA, 406 bp, Homo sapiens
tgtacttaatcttgcaggtaaagtagctctttaaagtagttaagtagtagctaaatagctcttgaggaactgctaaagaatttctaaaaagtggatgacatcatatttgtattttagaaactcaagtctggtgatattgtcagcaatggattgaggaacacctgagcaagggaccagtcagatgattacagtagtcaaaatgaaaagtgactggggcctaaatgaaggtagaagagatagataggagacagagatagataatcgttttgagaaagacttaagatagaatggaaaagactgctgttggattgggagttaggattgaaggagagggcagaaccaagtaggtcttctagtgttctatttggagtagatgatggtattacatgtaggaatataggaaaag

SEQ ID NO: 129472 - DNA, 309 bp, Homo sapiens
agctggaataacaggcgtgcgccaccacacccagcaaatttttgtagttttagtagcgacggggtttcaccttgatggccaggctggtctcgaactcctggcctcaggtgatctgcccgcctcagccctccaaagtgccgggattacaggcgtgagccaccagccagacatcaaattttatatggattatctcattcattccttagattcatcctgggaggtacacgaggttgttagcccatttacagagggggaaactgaggctcaaggaaggaggggggattttaacccaggcaggcagccctctga

SEQ ID NO: 129473 - DNA, 925 bp, Homo sapiens
ttaaaagaagttaatcacttatgtctttagatgaatgcacatttacatgtagacatatagcttagaaggtctatgaactctggaaaactttgtaattttgagttggtctggcgaaaatttctgggccttttccttataattggttacagagataaaaactctcttcctccccagtacattatcatcttgttattgggccatgagaaatagcagcctgaccctcagttcggtccagatactcagcttggtctctgttgtgcctggatcacagttcaaattcttctcgtatcacattttgttgtctcatcattccccgactctgctttctttccaaggtgttaattcctaaaaacatttattttttaggaataaatgccactttgttttagcatctgcttctgaaaaatccaatctgcgacaatcctcttcagatgggttgaagcagaaggaacaagccatgctcacagggagcagggttctccctctccctgtgagtcacagttactttacaattcactatgcttcatccttgccccagagccttctgaaaataataaactctcattaacccagagaaatgacaatgttgcatcaattatctctgtgaggattccacagagcctgaagccttacattttctaccaagggcatgaaagaattttagctgctgctcaacttcggaaagggaaatgccttgaaagtaaaattgaaggggaggtgggatccattcagacactgaaatatttctcacattctaggttacttaaacctatttttctagtttcttcagtagaatttttagtacactttgaagttgtttttgaagtttgagtgcatacgaaaaaccatacaattacattgttcttttctacacctttcatagattgaacacactcatgtaattgtcatccaggtcaagaaaaaa

SEQ ID NO: 129474 - DNA, 364 bp, Homo sapiens
agcgagctgcagctcaggggcgagctgctaactcaggggcgagctgctaactcaggggcgagctgctaactcaggggcgagctgcccaggaagccttcctggatttcacagcttggagcccactgtgccaactctgacatcacatattagtgtctggtcccttgcaggcaaggcccggctgtcatccccattgttttgcagagcctgccaccctgcctagcactgagtgggtgctcagtcaatatctgctgataggatacaggctcctagtgcctggaacagtgctggatgctgggggcacgtggtaaatgtttgatgaattcattgaagtcagcactgtggattggcagcagctgccacagag

SEQ ID NO: 129475 - DNA, 258 bp, Homo sapiens
tgtgacttgcacgtatacatccagatggcctgaagtaactgaagatccacaaaagaagtaaaaacagccttaactgatgacattccaccattgtgatttgtttctgccccaccctaactgatcaatgtactttgtaatctcccccacccttaagaaggttctttgtaattctccccactcttgagaatgtactttgtgagatgcacccctgcccaccagagaacaaccccctttgaccgtaattttccattaccttcc

SEQ ID NO: 129476 - DNA, 436 bp, Homo sapiens
ttacttcaagagtttagagtagcagtttggggatagcaccaggagatatcagctgtaatggcttggagaaacagtgtaaaccggcagtgtaaacaagagcagggcatgtgtgagtagttgagaatggtgaataggagtatgactagacagaagatagtagggatgacaagttttttttgggggtacagtctaagttggtctggtgtctggaatgagactggggcctaataaaaaggagtgtctatacagcagctcaaatgggctgtaccttgtagcattctgaggacaggtctgacttctgagaagggaaagtggtaaagtattgtcagtcctttttaagttggtggctgagcttggtgaggtgtgtttttaatagaccattagtctgtcactgaatactaagaacctgagaaaatgcttggctgatttgactaat

SEQ ID NO: 129477 - DNA, 705 bp, Homo sapiens
gttctttgaaggtgccttttatctggttaagaaatttcttttttctagtttgctgagagttttatcataaataaaggttagattttatcaaatatttttctgcattatttgatacatgtggttttgtttttagcctgtaaatatggtgcattacgttaatacatgagtgtggacctagctttgcatccctggaataagcccctcttggtcatgaggaattgttttcttttttatattgctggattcaatttgctactttgttgagtattttttctttttctctcagtgaaagattgatatgtctaaaaaaaatgtttttgtctagttttgaaagtgtcagggtgattctggctgcataaaatgaattggaaagtgcttcctcctattttgttttctggaaaagattgtttcaaatttgtgttatttcttctttaaaagtttgataacattcctccagtgaaagtgtctaggcttgggattttctcctttggaaaattttttttttactacgtattcagtgtattttgatataggcctattcaagttaattatttcttcttaggtgatttttggtagcttgtggctttcatggaattggtcctttttatctaggttgttgaattatgtgcacagtgtgtcttgtagtattctcttaccttttaatgtctcagtgggctgtagtaataacctctctttcattcccga

SEQ ID NO: 129478 - DNA, 198 bp, Homo sapiens
cacctaggcggactcctaccccttggtccctctgacctccagccttggaaagcaagaaaccaagccaggggggcttcagaggcagcctggcagaggcctgaaagttctttcaagaactcctaggaatgaatattctcaacacatagaagaccctccaaggcaccctacacactaacccacaaagcagccaactcccta

SEQ ID NO: 129479 - DNA, 390 bp, Homo sapiens
ggtctcaggcgggtggatcacgaggtcaggagatcaagaccatcctggctaacatggtgaaaccccgtctctacgaaaaatacaaatattagccagccgtggtggccagcacctgtaatcccagctagctgggaggccaaggcacgagaatcgctgaaccaagggggaggaggttgcagtaagccaagatcgcgccatggcactctagcctgggcgacagagcaagactccaataaataaaagaaaaagagtaaaagaaaataaagtgggagggggatatgcatgctctaagatctatctaccacagattacaggcttttcacccttttgtggaaatgacaaaacctagtatgttcctacctaacagaggagggctgagggaaggtgagg

SEQ ID NO: 129480 - DNA, 360 bp, Homo sapiens
ctagcacagtgaaaccccatctctactaaaaatacaaaaattagctgggcgtggtggcaggcgcctgttatcccagctactcgggaggcagaggttgcagtgagcccagatagcaccattgcactccagcttgggcgacaagagcgaaactctgtctcaaaaaaaaaaaaaaccatttaaagatatgaaagcaagctgggtgtgttggcttatgcctgtaatcccagcactttgggaggccgaggtgggaggtcaggagtgcaagaccagtctggccaacatggggaaaccccgtctccactaaaaaataaaaaaaaacattagctggggatggtggcgggtgcctgtaatcccagctac

SEQ ID NO: 129481 - DNA, 557 bp, Homo sapiens
gtttaaatgaatgtgggaagtaccgtaagatagcattgcctttctttatcagctatacccaccacctgccaccctcctgatcatcatgactcattgtcttgcttttcttcatagtgttagcatatatgtttccctaattaatccatggtttcattttttaactgtacctcagtgggatcatatatattcttaagcactagcttttttgctcactattattatataattgttaagatagctcttgcattgagataaaggacttgagtgaaggatcatggagatttcttcggtgaatatttattttttgtattctggtcaaattgacaataatgcctatataccctacaacatttacatagattagttttgctagaacaatttgtagagttagtactgctgttctcaaagtgagaaaaaggttggattcattcagttcaattaaatccttagcttcatatggaaagtaacttttcacatagccacattgagatacttgctggatagatttcacttagctgactattgtagaaaagtcattattcaaaataaaatggttt

SEQ ID NO: 129482 - DNA, 310 bp, Homo sapiens
aatcccactcacatctataaatctctatatctgtatctttatctacctatctctatcttcaaaagaatggaaagcagttactcagatacttgtacacctgtgttctctccccacccccccttttttttttaataaatgggctctcactgtgtttcccaggccggagtgcaggggctgtttataggcacgaccccctgctgcggggctgtccaccggcatgaacccctgctgcgaggctgtttataggcatgatccccctgctgcggagctgtccacaggcacggacccctgctgcagggctgtccacagg

SEQ ID NO: 129483 - DNA, 346 bp, Homo sapiens
gtagaatgtagatttttacttttttctgtataattttctatagtatgttatttttttttaccatgacagcccgttattttaattaccaggaaaagagttattcccattttgaaaataagtttgacataaaaattaaactgtaagaaactagggaaaatttttttggcaataaaatagaactcttacaaattcataagaaaaacattaaaaccccaatatatagtagacaatttataaaattggatattcaaataattaataaataggttttcgaaagtcagacttaccagacaaaaagaaaggttcattaaatcaatgaaataccatttctgttttcattttcatc

SEQ ID NO: 129484 - DNA, 111 bp, Homo sapiens
ttgtttatccctgcagcacaaggtagcattacagcccctcctgactgatctcagaccccttttctgcctctttgcctgacccccttggggttggcatcttcctgtgggtgg

SEQ ID NO: 129485 - DNA, 313 bp, Homo sapiens
ctcaggtgacctgcccgccttggcctctcaaagtgctgggattacaggcgtgagccaccgcgcctggcccctagaattttttgtagaccttttccccttgatggaggcacccctaccctctggacctttcatcacagcctctctttgctcacatgggtttcagacccttctcctttcctttgggaagtctgctctggcttccctgtttccaaatccttcgttttccacctggagctctacaaaggggccaggggcttcccctcactccagcctttctagtccacacccagaactcttcagatccttgacccca

SEQ ID NO: 129486 - DNA, 273 bp, Homo sapiens
gtagcttctgtgattgtcacggggactgccttctctttttggtttctttgtgaaaggcaccttgtgcaccatcagcagagtggctgctgaggtggtcacacttctcctctgggacgtgaggatcagcgcactgtttgcttaaacgggctgttttgtctttgatattttggtgagttttttttttcccctttgacaaagtgtgatcatccgctcaggaacgaggtgcccagtctgtgcacggtgactggaagagggaaggtggcccttgaccga

SEQ ID NO: 129487 - DNA, 326 bp, Homo sapiens
atacatacacataccacattcacaacacaccacacacaaaaccccacaccatacccagaaacatctccccatacacccagcccatcaagcagagctggctgactgcgtacacactatgtgatgggggatactgatgcactacagagggcctccaaaacacatgaaaacctcataggggctggatgcggtggctcacgcctgtaatcccagcactttgggaggccaaggcaggaggataacgagggcaggagttcgagacaagcctggccaacatagtgaaaccctggctctactaaaaatacaaaaaattagccaggcgtggtggc

SEQ ID NO: 129488 - DNA, 391 bp, Homo sapiens
ggcaacagggtctcattccatcacccaggctggagtgcagtggtgtgataacagatcactgcagccttgacctcctaggctcacatgatccacctgcctcagcctccggagtagctgggacgttctgagccatcacaactggctaattttttattttttgtagagacagggtctcgccatcttgcccaggttagaacctgccttttactaagactcggtttccctatctgtaaaatgggagttatgaggagtaaaagaaatcatttatagaaagataaatgattatctttaaaatgttattaagatgttatcttaataacagagttctgtgctcaagcagaggagcaggcattaacatgaccaacagaaaaaaagggcgggcgcaggcaga

SEQ ID NO: 129489 - DNA, 721 bp, Homo sapiens
  misc_feature (714)..(715): n is a, c, g, or t
  misc_feature (718)..(718): n is a, c, g, or t
gtaaatttcagtaaatttgagggatctaattatggggtttcagtagatcctggggatttattgcattattcgaaggaaataaatgaaagaatcagcaaaacatacagacacacatataaataattaaagatgaagaggataaagctggattaattgaggaaaatgctatcagacaggaatttttggttctgtaattctgaaacactgcaatgcattaagaaacctgtacatcaagggtgtcacctgtctagggtagggtaatatagagtagttgttctcaaatgcgagcattggagtgacctggagggcttgtaaaatacagaaggtcacctacattctcaggatttctgattcagtaggtttggtgtggggtctgagaatctaaatttctaataacttaatttctgtaggttccaatagtttcccaaatcatgctgatgctgcctcctgagaaatattttcagaatcactgagaaaaatgtatgaaatagttaatgtccttgctctgtgtcagtggtaagttccagtttgtttattttattgagaaaaagaaggtaattaattaattaagcaattaatatttatttatttatatttgagatggagtctcactctgtttgttgcccaggcggaggttgcagtgagctgagattgcgccattgcactccagcctgggcaacaagagtgaaactccatctcaaaagaaaaaactanntanaac

SEQ ID NO: 129490 - DNA, 671 bp, Homo sapiens
  misc_feature (664)..(665): n is a, c, g, or t
  misc_feature (668)..(668): n is a, c, g, or t
gtaaatttcagtaaatttgagggatctaattatggggtttcagtagatcctggggatttattgcattattcgaaggaaataaatgaaagaatcagcaaaacatacagacacacatataaataattaaagatgaagaggataaagctggattaattgaggaaaatgctatcagacaggaatttttggttctgtaattctgaaacactgcaatgcattaagaaacctgtacatcaagggtgtcacctgtctagggtagggtaatatagagtagttgttctcaaatgcgagcattggagtgacctggagggcttgtaaaatacagaaggtcacctacattctcaggatttctgattcagtaggtttggtgtggggtctgagaatctaaatttctaataacttaatttctgtaggttccaatagtttcccaaatcatgctgatgctgcctcctgagaaatattttcagaatcactgagaaaaatgtatgaaatagttaatgtccttgctctgtgtcagtggtaagttccagtttgtttattttattgagaaaaagaaggtaattaattaattaagcaattaatatttatttatttatatttgagattgcgccattgcactccagcctgggcaacaagagtgaaactccatctcaaaagaaaaaactanntanaac

SEQ ID NO: 129491 - DNA, 270 bp, Homo sapiens
cgccctgtcctttgatgggcacagctgcagttggcaatgttggcttgtcctactaccagaagtgagtctcttttttggaagtcactttccccagctattgccaaagccacaaatacagcacatgagaaagactgaggaaaagtgaaccgtgctgagggcagcgctagccttcatgggggctgtacagggcacaaaatggcattggtatcgatcacacagagattttgttggctcagttagcctggaaactgggggagggtttcgtttgct

SEQ ID NO: 129492 - DNA, 260 bp, Homo sapiens
gtagctgggattacaggcacctgccaccacgcctggctaatttttgtatttttagtagagacggagttttgccatgttggtcaggctggtgtcaaactcctgaccttaggtgatctgcccacctcggcctcccaaagtgctgggattacaggcgtgagccactgtgcccagccgcatttgcttttgaggtctcatcccattgtatagattgttccctgtcaatggcatttccagcactggtgagaagagaggcaaggcag

SEQ ID NO: 129493 - DNA, 474 bp, Homo sapiens
agcacagatgttgccgtggcagttacttccatctgtgttactcagattggttttaatccttgagacttcccttggggcaccttgggaggctgaggcaggaggatcacttgaggctaggagttggagaccagactgggcaaaatagcaagactgtctctacaaaaaaattttaaaataggccaggcgtggtggctcatgcctgtaatcccagcactttgggaggctgaggtgggaggatcacctgaggtcaggagttcaagaccagcctggtcaacatggtgaaaccccgtctctactaaaaatacagaaattagccgggcatggtggtgcatgcctgtaatcccagctactagggaggctgagacaggagaactgcttgaacccgagaggtagaggttgcagcgagctgagatcgcgccactgcactccaacctggaagacagagtgagactctgtcacaaaacagaaaaaaaa

SEQ ID NO: 129494 - DNA, 176 bp, Homo sapiens
cctgcctccaccccggcccctagcacacacctgagcatcctccacccaatggccaaagtgattccttacaatagaaagcagactggggccctcctcttcttggaagcctcactgtcttcccttccctgggagtgagatccaaagtctttgcttgacccacagggtcctgtacctgg

SEQ ID NO: 129495 - DNA, 395 bp, Homo sapiens
tggatggacgacatttggcccaatttcgtgtctctcatttgcttccaccttctgcccttccatcctgggacagccctttgccagatactgcatgaggttcttgcactttccagcccctaaaactgtgaagctctgagcaaaataaactttgcttcttttgttttgttttaagacagagtctcactgtcacccaggttggagtgcaacggcatgatctcggctcactgcaacctctgcctcccaggttcaagtgattctcctgcttcagcctcctgagtagctgggattacaggcacccaccaccacgcccagctaatttttctatttttagtagagacaggctttcaccaggttggccaggctggtcttgaactcctgacctcaggtgatccacc

SEQ ID NO: 129496 - DNA, 152 bp, Homo sapiens
actttctacataaagctcacacatcactgtgggtcaaacacaaatgcttctcattcttagtttagatacactgttctgacactttttctaagaaggcagaaagagaagacatttatcacttcccatagttagaaactagttcccccacattc

SEQ ID NO: 129497 - DNA, 644 bp, Homo sapiens
tcccctctgtatttggatagctggttgctcaagttccaacccttacatgaggtttttctgtatgattttctcctttatgttttggaggcacactcgggaacgttctcgtttttttttgtttgttttgcaatgtggctatttttgactttacaaagcattggaactggcatcctcccattcttgtgaactttctctggatctgtaaatacttggtatttgttttcttccttgtacatttcaggggtggtttttatatttaactttgactaagatacactcacatgctactctgagagtacatgcttcggtgtctcttttttctttgccttcagtaaaaaggataagattcagggaaggtttatgaactcactttatgggtcagacatgtgctggctgtggagagcatacagcaataagaaaggactgtctctaccctcagatacctttctagaggttaaagaaatgcaccttgatcattatcattgtctctaatggagtaaatggaaagggtagtggtagaatggttaggagtttagcctcaagtcagatctgggttgaatccacaaggatttgtattccttatctgtatagcagcctatttccttatctgtgcattagggacattcaaaggattaaatgagata

SEQ ID NO: 129498 - DNA, 558 bp, Homo sapiens
ggcagcatccatattcctacaaaacacaattagtatcatcatagtatttttcttcatataatcactcgctccctctgtctgagtactccttccctcctatttatccctgaagcagtgtaaatagctttcccacacctttaataatccaaagcttttctttactttcctctcacacctccctccagccttacatattaaataaaatcttgccataaaaatagcagctggtaagccaatatgggatgtttccttaacattctacacagtttaccatatgtactataataaagttgctgggctgaaagatatatttttccagcctttggttattcttctgtaagctctggacataccactaagcaaaatcttattttggacatcaaccaccagaaactgagtttaaatatgataattcacaaaacaacggacagatttttttattataatttaagttctaggatacatgtgcagaacatgcagatttgttacataggtatacacgtgccatggtggtttgttgcaccatcaacccgtcatctacattaggtatttctccta

SEQ ID NO: 129499 - DNA, 2755 bp, Homo sapiens
aagaaaggagcttagctaagaggtctttgtttccagaggacccaagactaccagactcctgtgcagtctgcctgtctgcagagcctccaatcacggtttaaagtggtcttggcctcccagcccccactgctgcagccttcagagccagcctctggactcagcgccaggagcctcctctcctgctgccctggtacctgtcatcctagtgtcacctatttgttttgcacagcattctggagaacatgtgcctcacaaagtgatcctgtttttctcaccctccaaagctgaggtggctaagggaggcaggggtgagagagctcactctctaaaccacaggcagggcaaggtgcttctaggccgtgtcccctccctggggaatggtcactactcctcagcatggccacaggcccctgtggttttgggagtttgctgagtgactggaatgggctgaccccagccgtttccctgctgtggaagcagcaaggtaggggcactgctcggtggtttgtcaagctcagaggcagccacggatggttaggaacaggaagccacactgctaaggtgtgatgagctagaagggagacatcctggacttcaagtgagacaagtgcagaggaggccactccacttaggaccttcctcttagacctgcatgagcacgtgtttcacttaagcacattgggtccgaattgtggcgcatgaacccagctgttaaaccaggtaccctgggactgccctctgcctctcagagccctacctgtcctggacttgaaggcgagcatcaggcaggccttctcagcccatcttccaccaggagtgcagagccagggtgctgagaggagcagggactgtaactacagtaggaggcaactttgctggtgtcattcctgctcggattgactttgtgctccctcccatccacagctatggtagccagtatttccccagcagctctctagtggggaagagtggctagaaccaggccattctcagtcgaatttaggaagaccaagactcatgttcctgacaggacggtcattccctcatggcatcactgactcagttctaattcctcccctcctgtttcattttggtttgaacaacctgtgcctgcagctgtttcttccaccttcctggagctcacaattggagcttcatgttcagtcttgagctcctaatgtttccagacagggcaggggataggacagccataatctatgaaagctgtgaaacaaaccctgggttatatagacctcagatggtctcatctgaaggctttgcccacttcccagtgagcagagggtttggggaacaaagaggtagctgaagagtggtggtttttccctgtatcctgattttcagaaagggctttagtctctgagctgtggctagtagctggctggctgaccaggggacgggggtctaatagggtgtctgaccataggacacctctcgtgtttggccttccctttcttgtgtgtttgtgtgtgtgtgtgcatgtacacacacaaatctgtatccccaggagtgcctcctgcagtcactgggggctcttccgtggtgcaccatcccatgagagcagatcagagggctgtggtcaggacttcctcccgagctgccctccctccctgggatgagtttcctctccacctgctccaaggtgccttacgaggtgcagctcttcacctggccacatggcatccatcaccgtgttgagaaatggtgggacgttggctggatattgtgtgctatgaatctgatttgtccaaatctggacctcagccaagccacctgtggtggaaccttgcaagtcaaggtcatgaacaaatttcttgtaactattggaaataaactaatgaggtagaactgtcatatccaaatggaagaggtggttggtactgttacttccttttgctgtcagagggttgttgacaatggcaaggggggatgttagtgagatccaggtggtggtggcttcttggtccactcagcttgcacacatgcaagaggagggtctgtggcccctcagccgtgctggtggcctccttcctcaagctttaacttgtgccctccctggcaacagggagtcatgggttaatgtcacctgtcatgcctctttcttcagggaaaatattaaaaggctcaaatccaagctgtgacttcccttagacagtgtaagcctgtagggtgcagccccaagtttatgtccaaaggctgcctcagaaccctggagggagcagcgcccagctggcagctcactctccccttgcagttcactggccttttcgcagccaggctaagataggcagtgcaaggagcttcccactggccagagcagctgccttgtagaatgtggggctggcttttagaagtttcacacgcttgcagctaagagtgcagagctctctgttttacttcgtgaaacattagcagctctgaggggcttggcttttggtaagggacttatagtctgacttgccacaagcaccttgagctcctgggttggttggtggttggttggttgggttgttttaaatttgatttttcttttcctgaagtttgttagaagtcagacctatgcaaggaaaaccatggcccacttcagcagccatccagtgggggtgcttaatcggtggtggtaggattcatggaaacgtttttttgaaatgaaagagaagatgatgtacttacattgtaaaatggtttacaataaagtttggcatcttattacagttttttttaaaaagaaaaaaaa

SEQ ID NO: 129500 - DNA, 216 bp, Homo sapiens
tgtggagagagcaaaccatttcattcagtcatctaacattgattgagcacttccatattccaggcactatgctaatgctgaagctcctaggatagataagatggaatcccttaagcacctcacaatctactgggggaagatcagatgttgatgacttatagtgccataacagaagcttatactgagcactgtgggagtccagggaagggactgatt

SEQ ID NO: 129501 - DNA, 428 bp, Homo sapiens
ctatgaaagagacaggtgagaggttcctatcagctgttaatcagttaaccaacagtgggtgagcatttagccagtgccagggacagtgacaggcactgaagataccaatactaaaggtgtggttcttgcccttaaggagttctccaacctagtgggggtgagatataactaagcaacacaatgtgttaggtgatgtgatagaggtaagtatattccttatatttccttaggtaacatttcagaaccggcgaatcctgggtgacaagcctccggtttctctctaaggtactgctgtccagtagaactttctgtgatgatggaaatgttctatgtctgctctgtccaggacatggtagccacatgtggttactgagcacttggaatgtggctactatgattgaaaaactaaaattttaatttaatttaaa

SEQ ID NO: 129502 - DNA, 179 bp, Homo sapiens
ttctctttttttgaggcagggtctcagtctatcatccaagctggagtgcagtggcatgatgtttgttcactacagcctcgacctcctgggttcaaacgatccccccactcatcctcccaaaatgccaggattacagcattttgagccactgtggccggcccagtttttttttttttttt

SEQ ID NO: 129503 - DNA, 420 bp, Homo sapiens
ttttttggccaaggttgactatagttgctaatctaattagtttgaatttatgactgtgctataaactatggagtttccttgaaccagattaaaattagaagaataagttttcctttttattctttctgccacaagattcttttttaaaataatgactgtttttataaaaggcagtttaactctagcatatactggatgatttgttaaggtgatgatagcccaaaatccttccgaatgctcatttttatcagcataatctcttttagcaggttgggcatggtggctcatgcctgtaatcccagcagtttgggaggccttgcttgagctcaggagttcgagaccagcctgggcaacatgacaaaaccccatgtctgcaaaacatacaaaaaaattagccagttacaatgatgtgtcccagct

SEQ ID NO: 129504 - DNA, 123 bp, Homo sapiens
gacaaaaagcaaaaaccttatgctaggctctgtgctaaatgcctatctattaattcattcaatctcaccataggaaagatagagtctattattattaccattttacctaagaggcaaatgagg

SEQ ID NO: 129505 - DNA, 279 bp, Homo sapiens
agtggcacctatgttcagtgttacccataaagacacaggctagcaaaagcatttggggcaggattaaaacttattctgtgtagcctggcaagaaccaagctttgcacaacaggaagagctttcttaaacagaggcatttatggaaattataattgctctaattttgaaacatatttatctaattttctctttaccatgttacacaaggaaatatctggtgcctactatgttccaggctctagcaagtgatgcaatggatacagaggtggggaagcaaca

SEQ ID NO: 129506 - DNA, 389 bp, Homo sapiens
gtaaaaggcccagcagaggcctctgaactgctctcttagcaaaccattcagtatgtggcagctatggtgaacttttgaaaacacagaactgatcatgtctcttccctgcttaatattcttcaatgatttcctattgcttttaagatcaaattcaaaagacctgaaacaccctctgtgatatagctcatagaactatatgtcattgagcagacaattttaacccatgggattagggaaggtcttcttcggaaaagtttcccatgctgaaacaagaagcagagaagaaagaagaaccatttctgccttggagcccaaatgtctaaagaagcaagaggttaccttgacaaggctcagtgaatgacaattaaccaattagctttgctactccc

SEQ ID NO: 129507 - DNA, 315 bp, Homo sapiens
ggctgaggcaggagaaatggcacgaacccgagaggtggagcttgcaatgagccgagatagcgccactgcactccagcctgggcgacagagcgagattccgtctcaaaaaaaaaaaaaaaagtaaaagcatatgtatcatgataaaatggacactttacccatcgcctgactttgtgttgaattgggcaagagcctcctcccgtccacgtgggatggccttcctgatgtggctctccaagaccatccctggagggcataaaacctcacaaatgcatcaggccgtgtgctggggatggggcatcgtcacgccaggtc

SEQ ID NO: 129508 - DNA, 275 bp, Homo sapiens
tctgcctccatttttgttttccatcttgatgaaaaatcccatttacacagtcacaggtgaaagagaacaatgatttctgtgatatttgcaatgctgtttccatgggcctatggatagttcctgtgtgttctttatagaaaagctttccttacaacaatggggagcgacatattagggtgccacagtagaggctggggcggggctcaagcctataatcctagcacttcgggaggcttaggtgggtggatcacttgaggtcgggagttctagaccag

SEQ ID NO: 129509 - DNA, 854 bp, Homo sapiens
atcttgaatcccatgaggtcgccattaccatgttcattttatatggaggaaattggactcagaagtttatgtggcttggcctgaggttacacactcacacatagtgctttccatgatcttctactatattctctttagcttgtattattttaatagaaaatgaattaagaatttatgaactagtttggacacataaagagataagctttcattttctgcattcactcatatgagtatctcactccccagaaatgaggaataaatgagatgctcttacatttaaattgaaagtggtaggaataaaaatttaataagaataatgtagtgcccttttgttccaagtaccagaagaggcctacaagttttatgccatgtgtttttctgttatgaagagcttgttatgctgctcttgctatgctgctgaaagcaacctaaagggaagtttgacactttttagattttttttattttatattattattaccatgttcaaaatgtgacatatccccaaagatattttggtggtaattcatccaacatactgtaaatgttaaagtgcttcctatatcattcatcccctaaatggaaacagatggccctaggagcttttgttaaactttaattatttatgaagcttgcttttcttcttaatattttatgaaatgctttgtatatgtaactgaagcagatgttgtcataggtattttctctaggatagtaactctgaaggtagctctactggcctttataatttgtttgtgtgtgcttgctttttgtctccataaggaaatgccttccaattaataacaaagttcatttaagaattcagaaaaataaatttaaaaaaagaattc

SEQ ID NO: 129510 - DNA, 225 bp, Homo sapiens
  misc_feature (220)..(220): n is a, c, g, or t
atgggccgacaggcagcacatgagatagttgctcagtcactggcccagagcggaccttctggcttttcttctctgcctgattgctggctggccatgtgccgtacccctggctgatgtctggggtggtgagcaccagaggcccctgaggaagaccaccccatccttcctctgccccttgctgtcgggctagtcggggctgtcgggctactgtcgggctagncgggg

SEQ ID NO: 129511 - DNA, 578 bp, Homo sapiens
ccaggatcacacacattagcaaccagtacctcacttttctccaaacactccacagaacgaaggtttttgtctacaaaacaaagcatcttttcctccttggagaactcccatacaggcttctcaacttggccaaaatgctacctcctccaagaagccttctcagattgcctctcccacccctcacttccaggaagtgaattgctcccttctgtcgtcttctcgagaagacgacagaaggaaaaggaagtttttcaagattgtggggtgaagtggagggagagagggaggggagagggtagacagggaggagcagaaggctgggaatagtgcagaaagttgacatctctcctttaaagatattctacagatcaactctgtctaagcccaggcctgatttagtcaggagcttttcttcttctttctgctttgtggtctgagaagcattgccctgttaaagcaccataagtttaggtcaccaaatgactataagtaggagcctccagaacggagataccattttaacaggaagccgtgcttttatagatgcaatggttctattaaagccgccttggagttct

SEQ ID NO: 129512 - DNA, 694 bp, Homo sapiens
ggaatcaatttgttacaaagttaactaagttgtattcatactcaagcttttcattttccacactggaaaatgctctcaagcaagaagatttattggtaaaataattcaactgaaatttccaaaatgaaatctgtctattgttattgcttatattcttgtaaatatactgcttccttactgtagtagcaggtacaaagttgttgaaagggccttgctacaaataaatgactaaagtgcctgtggtacttaataactagtttatacgttaaccactaatccattttgtctaccagacagctgaaagccttccaacttcagttagaaaagtccaaattgaatgttaaagggacatttattcatgtaaaatgtattacctggactgttttatgttcttaaattttgtaagggaagaaaaaaattcttcatttaatatgttgcttggtcattaaagttaggtcccatattccaaatgaaagttcataaaatgaactctatatatatatttcttagaaatcttgctgaaacttgatcgtgctgaagcttgctatgtttagcttttaatttatcaaaatgacatgaaataattgtgaggaaaagataaaaacattaaaaaaaaacatagcatagtgattttgccacttaaagggacctgggtgttgaagtaataattaacaagggttttctctatggaatt

SEQ ID NO: 129513 - DNA, 538 bp, Homo sapiens
aaccccacccccaggaatgtaccccagggcacactcctgggtccctatgaagtagcatgtcagtggccatgcagcacgacacagatgtaagtaagggcagagatgcccagactatccctcgggagggactggtcaacaacttaggctgctgccactaaggaatgacacgcagttatatgccttggggcagatctaaagacgtgaatgtgggctgggcatggtggctcacacctgtaatcctagcacttcgggaggctgagggcagatcgtttgaggtcaggagttcaagaccagcctgggcaacatggtgaaacccccatctctactaaaaatacaaaaaaactagcagggcgtgatggcacatgtctgtaatcccagctgctcaggtggctgaggcaggagaatcacttagacctgggaggcagaggctgcagtgagccaagatcacgccactgcactccagcctgggcaacagagtgaggctatctcaaacaaaaataaaaacaaaaagacatgctgctaaaatctggctgggcgt

SEQ ID NO: 129514 - DNA, 230 bp, Homo sapiens
cctctttctctatcttgtggaatagtgtcaacaggattggtaccaatttttctttgaaagtctggtagaattcatctgtgaatctgtctgatcctggacttttttttgtagctaactttttcttaccatttcaatcctgttgcttgttattggtcgttcagggtgttagtaacaaatgcttgttcctcgatgctgcaaagaaatgcacttgaacataaatttaattttct

SEQ ID NO: 129515 - DNA, 122 bp, Homo sapiens
ccactgcttagtcctgttaacttcatatctttccaaatgtcagaaggaacacagaacagaaccttcagagtacctggtacatcgcatagctcccttaaccacttaaaagcttgtttttaaaa

SEQ ID NO: 129516 - DNA, 256 bp, Homo sapiens
tttccccctgcctttggactcaaactgaaaggccttaggccaactggcatttgcactagaactacgccattggctttccctggttctcaggcctttggactcagactggaactgcaccattgctgctcctgggcctccaccttgccagtcgcagatcttggtaattgtcagtttccataattgcataagccattgttttatttctcttactaatgttttatattcttcagtaaaatgtcttgcctatctttaatta

SEQ ID NO: 129517 - DNA, 282 bp, Homo sapiens
tgcttaccagcggctggggtggtttgaggaaatgacaggatggaagaatgttagtcaaaggatatatagttaggaggagtaagttcaaggaatctgttgtacagcatagtggctatggttaatgatgatatgttcttgaaaaatacaaagagtagtaagtgttcttaccacaaaaatgacaactattcaggaggctgaggcaagggaatcgcttggacctgggaggttgagccaagatcgcaccactgcactcccgcctggaggcagagcagactccatcgc

SEQ ID NO: 129518 - DNA, 291 bp, Homo sapiens
cggcaacctccacctcccggtttcaaaccattctcctgtctcacaccaccactgcgcccggcctggaattatcttcttacacccctctcagctcaaacctaaccaactggaattttaaacattgtaggatccactcagaaaaggaactagaaaaaaaatactttttctgtattcccctggtcatctctgaagaaactatgtttgtaaaatttactaatatcagccgggcaaaatggctcacacctgtaatcccagcactttgggatgccaaggtgggtggatcacttgagg

SEQ ID NO: 129519 - DNA, 486 bp, Homo sapiens
cgcggcgaggtactttccacagggtactttccacaggttagataaatgtttagtgcttatttctcatatttttaatgctatacaacttagaatcttaaacttttttgtgtgtatcacaacatagaacagagatatacttagtgtgtatcatatgacatatgacatgattttgaaataaagacaacaaactgatttcaaacctaaaactttaataagtattgagtaattaccagaggacaattagtccagaactgtctacattgctcactcatgggatttaatccagtggacaattttgttgttgttttgagactggatcttgccctgttgcccaggctggagtgcagtggtgcaatcacagctcactgctgcctcaactgcccaggctcaagtgattctcctatctcaaccaccccagtagctgggactataggtgtgtgccaccacactgcgtttttttttttttttttaattatttgtagagat

SEQ ID NO: 129520 - DNA, 692 bp, Homo sapiens
ggtcaggctggtcttgaactcctgatctcgtgatccacccaccttggcctcccaaagtgctgggattacaggtgtgagccaccctgcctggccgattaaacttttcaatagctatatctactgtatggactctattaatgtacataattatgcccagaagagaactatatgtcattattaaatttatggttagaatagttgatctatacttttttctccttagcattcctttagctgtgcttccagagctgctcagaaacatgagttttgcttaataatccatagcagagctgaagtcaagaggggaaggacccacaggacttcagctggatctggttgggaaaagctcaagattgggaaatggaactttggtaggcacatgtcagtatgaaacatttgcctcacagccccatacatgattaacctttactttgcaggggaaaggctcacagtcttactgcagaatgagaataaacctcatttcagtggtttataaactcttaaatgtaacagaatataggcctaaaattagacattgtattcagtctgagctctgccacttaagaattctgggactttgggcaggctgcttattatccactaacctcaatttcttcagctcctaaaagggcagttgtcatacctatattatggcactgttttgaagaagaaatgaggtaatgcctaaaagt

SEQ ID NO: 129521 - DNA, 527 bp, Homo sapiens
atgatctttcttatttgataaagtttgtgactatatacttactctgatatattgtaaaaattattttatagcgtgatggataaaagactttagtgagtttgttgtaaatttaaatgtaaagaatgtattttgagatttttttctgcccatcctttatgttcaggaaattctatgccaatctgatatttatgttttagtataatgtttacttggacttcatagttgaatataatgatgaaatacaaattgcagctgtccattttttaagtgtttttgtgtctggaaatgtatttttaagtgtgtgtataccatctttttattgtggctcccaaaacactccgaactcaagagcagctcacagaggtttaaagtatttatagtgaatagtgacccatttcataggtaggattcagatggttttatatcttttgaatatttgctttgggtttggtaactcaatgtcagtaatttcagtggtattatatggttaatgatgcatgtagtttttctattagtagaaagtagaa

SEQ ID NO: 129522 - DNA, 366 bp, Homo sapiens
cacaaagcagtaaacatcctgttcccaccgaagatccccaagtgtgtgggtggatgggtgtgggaagggatgaggtaaagagagaaaggcagtgaagtgatcattaccttatcactgatttaaaatacttattaatggaggaagccaaaggtgaccatttaaaatccttttctatagtcaatgaataatacattcgtataaatcatgtttacttactttttcattcatctaacaaggattttttttttttaagacagggtcttgctctgtcacctaggctggagtgcagtggcacaacctctacctcctgggctcaagcgatcctcccacctcagtctcccgtgtagcagggactacaggtgcaca

SEQ ID NO: 129523 - DNA, 473 bp, Homo sapiens
gtagctacgactacagacatgcagcactatgcctggctaatttttaaaacaattttgtagagacagggtctcactctcttgcccaggctggtctcaaactcctggcctcaagcaatcctctggcctctgcctcccaaaatgttgggattataggcgtgagctactgtgcctggcaccatgtagactttcatcctgagcttcctgttctgcttctgagtgaccccctccatcctcccaggatagtcacagtaatgccatttcacagaggagcctgtatggtggacgaggctttcacctacatcacctcgtttaattctgtgagagtatttatcatcatagtccccattttaagaagcagaaaccaagtcccagagaggcaaagtgacttgccaagcatcacacagcttgtgcctctgagtccactgagctccaagctcctcaggagcaaggctgtgtatacccagcctactgga

SEQ ID NO: 129524 - DNA, 443 bp, Homo sapiens
cgcattgcatgtatacacgagcaggaaactgtcatgagctattataaaactaccaaaccataaaccattagaaccacaaatcagccaaggcgggatgtggtggctcacgccggtaatttcagtacttggggaggctgaggcaggtggatcacctgaggtcaggagtttgaaaccagccgggccaacatgatgaaactccgtctctactaaaaatacaaaattagcgggatgtggtggcacacgcctgtagtcccagctactcgggaggctgagacaggagaatcgcttgaacccggcaggcggaggttgcagtgagccgagatcacccctttgcactccagcctgggcgacagaacgagactctgtctcaaaaaaaaaaaatggtggaaaatcattactctagggaagaagatctcaaacggtagggatgctcgtgccgggta

SEQ ID NO: 129525 - DNA, 1105 bp, Homo sapiens
gcctggaggcaatggagcctcctccgacacacccaggcctgaggttcatccggtgactaagcccactctccctcaaggccgtggtcaccggtcagtcaggccaggtccctccctggggggtggcttcctgatgggtcacctgaggcagatgccacagagcagcaggtgcctgggcttccagggtggccccaacctgcggtggcctggcctggactcatcgacctgtgaggagtctggccttgtgtgccacgtggagacgaccctttccacccctctgccagcttccccaactcttccatctcctcccatgtccatccagtcctagtcccaggaggcctgtctcaactccccacctgcagcatcagacctgggagacctgccttggtttctgcctgcagtgtgatgccttgttcatgccaccttacgatttgtaggtctctccacgtgcccctttgaccctgagatggggaactgcttggcacctcagccatcactggtagcagttgggctttccttggttattgcctggtgtgagcgttggcctgatccatcctccctccatttggagttattcctgttttccggatcactggctcagcaccattcttgcctctccaactcctcacacagatggaagcaaatacagatctgcattttcaaggctgagcatccacataggtggacactgtcaggatgcgtgtgtgtttctgtttctcgccaggcaagttctgagtttgatactacactgcacctctctccatatcctcctccatacccaactcattactgggcagagcaggcacatgggaagtaagaaaggagtcgtcttgttgaactagaaacgttgtaactgatctgttttctaagcctgtgtttggatattagatgcagcgttaatctgcatttgtatatttgagatttggcaacaggaatctaactggctttcaaacaaacaaacagtactgaactgctttgtgtctgcttaaagaatacttatgagtttttattaacatatgcagttttaattgtaactattattgcttttcttattacaaatgcagcccatgataattacataaaaattaagcacaagtaagccaagaga

SEQ ID NO: 129526 - DNA, 214 bp, Homo sapiens
cagggatttcactgagtcaagccagagaactaagaccctgagatacttgacagtcaagtgagacttcaggtaaaacctcaaactgtcactcatcagactggagctgtacttctttaagccattgatgctaggataattaattaccttcctgccctgatgtttcttaagttggagaaagagaattaaagagaatgaaaatcagaatcacattaac

SEQ ID NO: 129527 - DNA, 423 bp, Homo sapiens
ctcccctgatgcttcattcttatggaaaggactggcactgctccaactgagggctaccactggtttggaggactgctaagcatgctgagagtgctgcttcttctccagggctgtcagcatgccccccaagtccaactgcactggaagctggctcttctttacattatttttaaaattatcttcaatccttggaggctcttgaactgtcaggacttcatattttgatgtagatttttctttctttatggtgcctatgcccttctcttctccatttttttcttttcttcctcttctttttctccttcccccttttccttttcttctcctgcttctcttcccgattttttcttttcttcctcttctttttctcttttcccctttcgctcttctccccattctcttccccattttttccttctcttc

SEQ ID NO: 129528 - DNA, 319 bp, Homo sapiens
tgaagtacccaggatcagagcagagctgaaggagagagagacactaaaaacccttgggaaaaaaaaaaacctaagcggggagctccttttttaaaaaaattaataaaatagctagaccgccagctggtttaataaggaggaaaggagagaggattcaaatggattcaataaaaagggataagggggacatcaccactgaccccacagaaatacaaacaaccactagagaatatatgaacaactttatgcatgtaaactaggaaatctagaagaaagggataaattcctggacacatacaccctcccaagactgaaccag

SEQ ID NO: 129529 - DNA, 223 bp, Homo sapiens
ggcacggtgctgagcatgttatattttacatcattatctcatatccttgtaagatatttctccatttttacaatggaagctcatggtggcagaatccctcctttaggatcacaggctacagctgcaagggtaggaaggtgaaccccattcttgtagctatcacatgttaatgcaggagattttatcctttggggttaaaggatttatgtggggagggacaaaa

SEQ ID NO: 129530 - DNA, 1163 bp, Homo sapiens
cagctccagttttgttggttgatttgtttaaattcagagatttaaaaacatcccagacaagacagtttgattatggagactgtccccaagcagattggtgtgctggtggctgctgtgcataacagattccctccagattggcttacaacagctacttcattctgtgggtcaggaatttggatagggctcagctgggtggtggttctcctggggtattctttggttgtggtcagatgtcttccagggcatcattcctatgaaggcttaatgaattaggcaagctgtccaagatggctcactcgtgtaatgacagttgacgttggctgtaggctgggaactcagctgggttgatgactggaggagcttatgtgtgtcgtctccggaatggcagcttcagaggagttgaacttaagtggtgattggcttcccccagagaaccaggcagaagctgtgttacctttttgagctcttagctcaggagtcacatagagtcacttctgtgacactgtgttgcatcaaagtagtcacaaacccactcagattcaagagaagggagcatggccctctccctgcaaccccctccccccccgccttgatgaaaggagtgacaaggtcacattggagaagagcttgtggggtgggagatattatagccatttttgggaaatatctgcataaaatgagtttatgcatacatgaaggactttattttcattggctttaagttgagggtttttgtttttgtttttgtattggagatgggttcttactatgttgcccaggctggtctcaaacccctgggctcaagtgatcctgttgcctcagcctcccaagtagctgggactacagctatgtgccagtgcacccagcttgttttttttaaattttaggatagataatggtacttctggctttatttaaataatttttttagggaaaccattgtatttatacatgcatatatttttatatatacaaatatgtatataaaagtatatgttttacattttcaatatatatataatatatacatatatgttatatacgtatatatattgcaccctactttaaaattgactgataacaaaattggtaattttgtataaaatgcccaactgtgcattattaataaaagtatgtgaatgactctaaataaacagaag

SEQ ID NO: 129531 - DNA, 732 bp, Homo sapiens
aggttttataaaagaaactcagattttgcctatatcttctttagaacatttgatctttggtggaagaaagcaggtcatgaaagtatgacatgaaatgtgccatcacctagaatggatattgattaaatggtttgaaggtagatcctcctcttgtgctctttaggagaaatctattctaaaaatgaaagttatttttcagtattaatttcttccttcaatatctatgtaataggtaagatatgtccattttatagttcaagtataataagaaaccagtctttgcctaggaacagttgagcacagtataggggatcataatagaagcaaacatcaattgaatactttccatgcactaagtgctggagaggtaaaggagtaagaatgagccccttgtgttcaaggagctctattataaccaagtagacagtcagatggtgagtaaatgagccatggttgttggtggtaggttcttagcaccatctttttcctatacaatacgtgacttttttttttttgtctcatgcacttttttattctagctgaaatagaagcttaagaaatgatttaagtgggaaattaaatgagataattgatttagagatgagttaaatgtttgtgttgtattctaacagtttaagggttgctagtattactgactctattacactgcttattatcagttgtttaaagaaacttttgaccaggcatggtgactcacgcctgtactcccag

SEQ ID NO: 129532 - DNA, 508 bp, Homo sapiens
atgtgtagggcagtgtctgtcatggtgtgatagtcactgtgtctaggtgacaccattggtgatactgagcgtgtctcagtctatgcgtgacattcactgtaggtatccacgtgtggtatccactgtatgaattcaacaatgtgtgacgctgaatgcattctagtgtgatacgtgtgacacaacgtgggtttatcttgtgtgatacaatttgagcatttgtgtgtctatgtgacacagtgtgaaatgccacttgtccataacaatgtgtgctgtaacacaggcaggttgtattattattattttttttcttttaaatcaatgtctcgctctgtcgcccggctggagtgcagtgtgcagtggctcactgcagcctcaaactcctgggctcaagcaatcctcccgcctcacctcaccctcctgagtagctgggactacaggtgcctgccaccatgcctggccaggatgcatgatcccccctacatgtatctatgtctttgtgtggcattct

SEQ ID NO: 129533 - DNA, 427 bp, Homo sapiens
ctgcatcgcgcttgtcctgcctcgctgcttgtcctgcctctgctgcttagtctgcctctgcggtctttttctccttcttcctcttctcttctttcgctgcttgtcctgcctctgctgcttgtcctgccctgtaaaaatgaagcccattattattcatgccgtggagtgaatcaacgtaatccatccacttcccatccagccagctgctagccaagacccgctggctgtgaggtaacaggaactttatctgggactgaggaaaagtgggtaattttggctgcaggacccaaccggggcttcggcggaaagttgtggaaaggatacagatagcagaggcctggaaagggtatgtggaaggaagtggcagataaagcagatggattacgtgttacattagagaaaaagtgtcaaaacaacattatagcaa

SEQ ID NO: 129534 - DNA, 302 bp, Homo sapiens
tctaattttccttaggttatttaatctttcctaatatcaatcaactgtagttccatggttcataatatggtatttatggctaaacaatgaaaagttcctgaaccagacctgatgtcttacaggtactgcaaacttaacaagtatgtattagacacttggatggctaatccaatacccactcccaatcctcctctctctcctatctatcttcaccataaagttaaatactcacttctccaatgccccttgcagttactggtaaccattccactagttatggccaacaagatgtaagctaaaat

SEQ ID NO: 129535 - DNA, 353 bp, Homo sapiens
attctgtaagtgaattgcgggctcatgggctggatgatatcaggaagaaaatagtaagaatcgggatgaagcccatgtaaaggaaagttagagaaaaagggtttacatacccaaagacagaagcactgagagacttcattatagtctgcaacttgccaattagcaagtcaagaagaatttgttgacttttgatgtgtgctgggagctgagctacttctcagctctggccacacggcagaatcaccaggcccggccacaggccaattaaattagaatctctgcgggtggggcctcagcattaatattttttaaaggctcacaaggtcttttgaattgcagctgggatcgagact

SEQ ID NO: 129536 - DNA, 660 bp, Homo sapiens
tgggaagctgacaattcatcagcatgtccggaaggaaaataaggaggaggagcagaaatagatgaggctggatatagaagcagggctgaagctgtgttgatcgtggtaaagagttgtgattctatccagaaggcaataggtagcattctaaacagagatctcttaaaacaagagtcagcaaatattttctgcaaagggctaaatgttaaatattttaagttttccaagccatatggtctctctcttaatgactcaggtcttccattataccatgaaagtaaccagagacgttttttaacacatgtattggctgtgtcccattacaactttacttacaaacgcagactgtgtcagacctggtccatgcatggtagtttgccacaccctgttttagaaagctcaggtttatgatgtgatggagaatgcctacaagagctcttgttttaaatggtagagtgaatatacactggaattctatactgcttgacccaagcttttgatagcaaaaggtagaaaagacagatagtaaacagatagatagatgataggaaggtagatagatagatgatagataaagaaagtacatagctgttccagaaaacagaaactgataatttcatgaaccaaaagcagagtaatatactttagaaaggaagcagg

SEQ ID NO: 129537 - DNA, 419 bp, Homo sapiens
gtcttgaactcctggcctctagtgatcctcctgcttcagcctcctaacatgctgggattacaggcgtgagcacagaaaaaccaacattgtattgttgagcttttaaggtatataggtgtaaaatatgacagaagtaacgcagtggatgggaagacattacatggaactgtagtaagtcttaaccttgtcagtaggttcttggaaattccaactttaagcaaaacatcattcaaataatgtcatttcattcaacgtcttttcattacagcattgaggagacaaaattatactttgtttcagttaaagttggagtttccaagaacctatcagtgagttaagtgaggacttactgtagggtcttgcaagcttctcctgttttacatgaagtaattcagtattaactccaaatatattatgct

SEQ ID NO: 129538 - DNA, 420 bp, Homo sapiens
aggctcgtcctcctaaccctaagtcctgtgcacagagccctgtagccgcccctacccagagcaggcactgacaagcccacccatttctagtgctgcccaaggtggactcagcccacaaaggccccagccccagcctttgcggataggtttcctccgtggtgccaacaactcttgtggatttgaaagaggcaacctttttcctcgcgtttctaaaggcctatgaaaagggcacgtcgggaagtgcacataagacgttgaacatcgttgcatgagatgttgaagaagtacaagatttcgttcttccttccattaaagtacaatctccctggggagagacacacaaagtacacaattagagaccagtaattctcttccagatcgctcccggtgccttttcctagctaagcagcctctccctgc

SEQ ID NO: 129539 - DNA, 740 bp, Homo sapiens
cattctgcatgctattttgctctttagtagcataattgtaaaatgaggcaataaaaccagaaaagatataatatttatacctgtgtaggcacttcacatgataaaatgtcacacgagactgtttactccatgctggttatttggataacgccccacctgcctagtaacaggcggtgctgagtcttgcataaatcttggaaagaaggttagggttaatatagtgagttcttcagtaggaaaaaaaatacagcatatgtgataataataatggcgactctttgattactatttttgtaccggcactgtgctaggcccttggggacagagtgtgacaaagagggagataatataagtgagtacctttcatgtgtcagctattctgctatacattttacttacaatatttgtaaaacttataataactctgccaggtaggtggtgttatctccatgtatatatgactgattcttgtttatctcataaaaaattctaacgacctcattggagttctgttataattatcatgtttaaactttggtgcttttttttaagtttaaatagtcttttttttttgagacaaaaaaaattaatgagaagagacaaagaaacatcaaagagctttttcctctgattgctgtgttagaacttttgcctgaaaataggttacattccttctgttttcagctgaatcctcattaactttacattttaatgatgtccagggcaaattacaccattta

SEQ ID NO: 129540 - DNA, 198 bp, Homo sapiens
gagctccgcctagggacctgagtgtcctcttcaacactctctctcccaatggggattcgtgcagcagaggagagagaaatgcagtcctttcccttcttagtcaccaagatattccaggggccaggagcgcgtgggggtgcgaggtttccctttggccaggtgggctctcaagccagacccagggagggtggggcctct

SEQ ID NO: 129541 - DNA, 887 bp, Homo sapiens
acttgggttccagcagatgcacgactccttggaccctgcaggtctccagggcagcagcctggagtgtgggccccacagtccaaggaccttccagtcaagtgccaccgcgtcctttctgtgtgaccctgagctagtgtctgaaccctcctgtgcctcagtttcctcttgggtatgatgggaattagtgcccacctcctagggttgcacagagatggaggtgaggtgagatccacaaagcccagtacctggagggcacctggtttaactacgctgctttccctcccacagggactggcggactaagatggagtgtacagcgcggctgccagcccagtgcaccactgcccatgacgctctgctgaccctgcacaggaacctcacaagcactacgcctgatgttaggcgcctccatgactgaccctcaactccagcctttcacctctaaataccctgcacccgccacaaggaagtgagcaaagcccatacaagcccctgcctgcaaggacctgacgctgaaacagggaaacatagaccgtcagttagaaaacaagtgagcagggatggcgacctcagacactggtgaacgccataaagcaatgctgctcagtatgagccccagagagcagcaggcaggacttggaaagtgttcaaaaggcagagtccaggacccactcccaaccttctgaatcagaactggggtggggccagagattccgacgcacattcaagtttgaggaccacagagataagggatgggacaactaggggggcagagatgctttttaaattttttttagagacacggtcacactctgtcacccaggctgcagtacagtggcaaaatcatggttaacggcagctccgaactcctgggctcaaggaattct

SEQ ID NO: 129542 - DNA, 252 bp, Homo sapiens
caaacttgcacgtcctgcacacgtatcccggaacttaaaaaaaaatcccatttattatctgaccagatacacagtactcattcaaagccaaagttaattaacataactagtattgatcttcttacctacgttattaccctgttcctttctatggtctacttcttcatttccttaatctagcctggtctaactactggatggcagataaaggcatcatccttcaagtgcagtaagggagtaggaaaaacttgt

SEQ ID NO: 129543 - DNA, 427 bp, Homo sapiens
tcaccccaaggcctgacaaagcaagagatggaatgttaccagagcccagagaggctggagctttggagaagggtgtctagaagaagctgtagtgatggaggacataaccagtcccagaattctgctgaaatgggacaatgggaaggaacaaggaagaaattccctgatttcactcaacacacaccctccaatcttttttcacatctcttgtttgacctgaccagaagccataaggcaaagaagctcaccatctgacatcattctgatcaataagatgtagggagaagtctgttataggcatttccgggaaattttggctttcctgttgaaagctgtcaggtatggatgaacagttccctttattcctcctttccttccgtccatgaatgaggatgtgatgacctgaacagcaactatattgcaatca

SEQ ID NO: 129544 - DNA, 792 bp, Homo sapiens
caactcaacaactatctgtttaaggccaaaggcctgagaacctggcgggggctggtggtgcaattcccagagttgaggggccagaaaatctggagttctgatgtccaacgacagaaggaaaagggtgtcccagcttcaatagagagagaagtctcctctgctctgcctttttattctatctgggccctcagtcaattggatgatgcctgcacacaatagggtctcactctctcgcccagcctacaacagtggcgcgatctcggctcactacaacctccacatcccaggctcaagtgattctcctgcctcagcttcctgagtaagtgggattacagtgcctgttgttacttcattcagaagtctgaaatttgatatgctttcctaagaaatagtcccaactaatgtcctacggaaactagcgaaaactccattcatctaagaaagcagtggaaatagataagaaacttacacattgcaagtcagatatctgcactgatacccaagagcaaaatgtacagagctcagtggggaagagggtacagaagaaggaagatcaatctatctggcagaagaggatgagaaaagcttcctggaagatgtgacccttcacacagaacaaaggctacacctatgtatcctctgcaagctccaatttttataaattcatccattctgtaaataggctatatttcatctgaagagcctatagaataactttggcctgtaaatcagttaagattccaaatccatgtgattccaaattgaagaaaggactcaggaaccaccaattgg

SEQ ID NO: 129545 - DNA, 274 bp, Homo sapiens
tagatattccctttcttcttgtagaaaattgcttaacatgattctcctttatcacaaataagtaatatctcaacatatttagtacaatttgattttccttcacttaaattcccctaccagattgatgttccttacaacaaaatacttaatatccataatccatgtaatggaaactgttaataacaatattggattgacagattccctgacatgcttgatgactacaatttagggaaaggatagaaaacatattcgtcatggaaaaacaccacca

SEQ ID NO: 129546 - DNA, 959 bp, Homo sapiens
gaacttgaattttatgacaagaagatagataagtcaatcatgtggatcccatgactggaggggaccgtggaaagataacgctgttcagaggaagtgaatctaattgaagggactcaacaatagcatgtatgccaaaaaggaaaccacagaactgaaggtggaaatgtttggatggggataaaaggagaaacaaacagaaatagatactaagataattggaggacacagatgctgctttcttagttcagactgccaaacatcaaaagcaagttacagtagtgccagaggtctccaagaatcaggacactaacatgagtctctttctgccagaagcagagcacctagtaaattcttgctctactcacaattgcgtttactagaatattgaaaaaagattgtcagatgtaatttttatagatttcaggaagtcagatttcagaatgttccaaggaaaattatctatagtgcttaaaagggacagggcattctcaaacatgaagtttcaattgtatctcaaagggtcctgctgaggaagaatgaagcggcttcagcaatcagaaagcggctgcacaggttgttttctgatatgatcaaagtgtgggcagagatgaatgtcaagtctttcacatgagaaaaatgaacctcggccgagtgtggtggctcacgcctgtaatcccagcactttaggggactgaggcaggaggatcgcttgagcccaggagttcaagaccagcctgggcaatatggcaagactccatagctaaaagtaaaaataaaaataaaaaatttaattagctgggcatggtggcatgtgactgtagtcctagctactcgggaggctgaggcagaaggattgcttgagcccagaagttcaaggctgcagtgagctatgaagctatggagtgccactgcaccacagcctgggcaacacagtcagaccatgtctccaaaaaaaaaaa

SEQ ID NO: 129547 - DNA, 678 bp, Homo sapiens
agcgatttcctttcccctgggtgtttgaacctttgctctgctccttgcttctctgggtattaaggggactcctgaaagcccccattgtcttcagcctctttccacccccttccttggggctccccaagaagattgttgcctgaactctgtagggcaagaatgagaagcagtgcccccaagacagtgcctacccttgtcatttacccaccatcctcatctcatttatccttaagtcccaagaccaaagcaaagaacacatgggctgttgaaggcttccacaggactgccctggtcagtgggaaagcagtaatgctttctagctgggtaaccccttggctgagttccatctgcactgtggccagggtgcgtggtgagacatgcttttgccatttgccctttgaactgccaacaatcccaatgtagcaaatggatttaaagctgattgagttttagatttctttcctttaaccagaatattctagcagcttatttttatagttctgcttgtatgattctctttttaacagatggaatcacagccttttctgcagtatatatctgatgaatttaaaaactgatacatcaagaatattcttttgtatatgtctttcttgctgtgaaaatttatggcctttcttccccctatcttcgctctgtaattattaggtgcttactata

SEQ ID NO: 129548 - DNA, 361 bp, Homo sapiens
taatacctaaaattccaccattagagattaaccagacctattcctggaggaggtaatctttctgctgcttttgatccagacagtttcaatgttctatgaaagcactttgaatacaagactctacagaggtgtaaggtggtgttagatcatttgccatttgctcctctgtgcaagcttaggttttattaggacagaaggaagagggcataggaaactggttgtctaagagagtgggaaagttgtggccccaaagacagagaattgagagactggcctgaggccagagatactctttacccataagacagacttgcccagtgccagcactgggcaggttctgttctctacactgcattcggct

SEQ ID NO: 129549 - DNA, 581 bp, Homo sapiens
ggccccaccagtggggcgcaaggagcctcagctgtttgagtcgggtgattcagggcccatggggtcaaggctggccctggggggcggcctctggaggcagcggagctggtaacaactccctcagcctccctcaaaccaggacgagggccgccttgggctgctccaagccctgtggggtgtggaggcccctgtggccagggtccaccctccaggccacgccctgcccctcggtctccagacctcacatgaggattagtcaaactacgagaggcttcaggggcagaggaggtccagcaaggtgaggaccctgggcaggtttgtcccctcagccagggaaggcgtgaaaggaagcagaggcaacgtcaggccccgggggtcccagtccggagctcccagggattcccactgggaccctggatcagggcctgcccgggggctgtcacctgtggactgaggctggctcccttcccacacctctggggatagagggcagacaggccctgatgatgagcaggtggctccaatacccatgtcctcccctgggggagagggagcttcaggcaagagtgactctcccctcc

SEQ ID NO: 129550 - DNA, 568 bp, Homo sapiens
ggtgcagtggctcatgcctgtaatcccagcagtttgggaggctgagacaggtggattgcttgaggtcaggagtttgagaccagcctggcaacatggtgaaactctgtctctactaaaaatacaaaaattagccaggcgtggtgctgggtgcctgtaatcccagctactcaggaggctgaggcaggaaaattgtttgaatctgggatgtggaggttgtagtgagccgagatcatgctactgcactccagcctgggcaacaaagctggggactcactctgtcccttgaaagttgtgtggaactccagcaaaagaaactaaatttataagaaaaaaacagacaaccccataaaaagtgggcaaaggatatgaacagacacttctgaaaagaagacatttatgcagccaacagacatatgaaaaaatgctcatcatcactggtcatcagagaaatgcaaatcaaaaccacaatgagataccatctcacaccagttagaatggtgatcattaaaaagtcaggaaacaacagatgctggagagaatgtggagaaataggaatgcttttacactg

SEQ ID NO: 129551 - DNA, 349 bp, Homo sapiens
gggagtgttggctgggaaggggcaggaagcaactttccaggacactgaagatgttccatatcttgatctgggtgttagttacacaagcagacatatggaaatattcaccaagctctatgcttaagactggtgcacttgaaaagcttttttttgttttttgatttttgttctttgttttttttagagacagagtctcgctctgttgcccaggctggagtgcagtggcacaaacatagctcattgcagcctcaaactcctgggctcagatgatccccctgcctcagcctcccaagtagctgagaccacaggcatgcacaaccatgcctggctgattcgaaaaagtttttgt

SEQ ID NO: 129552 - DNA, 289 bp, Homo sapiens
aggtgcacgccaccatgcccagctaatctttgtatttttagtagagacgggttttctccatgttggccaggctggtcttgaactcctgacctcaggtgatccacttgcttcagcctcccaaagtgtgggattacaggtgtgagtcactgcacccagcccagttagttaattttaattaggatttttctttctgataactgtcagtattcttggaactcttttatgcacccgagttaaagaattttttgaactgaagcccaaacttcagtgttattttttgcttttgtcc

SEQ ID NO: 129553 - DNA, 608 bp, Homo sapiens
ctggagtgcagtggtgcaatcatagctcactgtagcctcgacctcctggactcaagcaatccctctccctcagcctcctaagtagctgggactacaagtgtgtaccaccagacctggtgaacttttcagttatttttctttaagagacagagtcttgctatgttgcccagctggtcctgaatccatggcctcaagcgatcctcctgccttggcctcccaaagtgcttggatcatagatgtgagccacctgcctggcctccctaaaatgttaccaggcattccaaccaagaggagagccatcctttagatagaagatatagaatttttgaccaggcacagtggctcacacctgtaatcccagcactttgggaggctgaggcgggtgaatcacttgaggactggagttcgagaccagcctggccaacatagcaagaccccatctctactaccagtacagaaattagccgggcattggccgggcacggtggctcacgcctgtaatcccagcactttgggaggccgaggcaggcggatcacgaggtcaggagatcgtagaccatcctggctaacacagtgaaaccctgtctctactaaaaaaaatacaaaaa

SEQ ID NO: 129554 - DNA, 181 bp, Homo sapiens
ggtggcttaaacgtgatggagtaacacaggagagaggctgccagtcaagggtgagccctcaccctggattaggtttgtggaatgtatcaccccgacacagaggcagcaatgtcagctcacatctgtttccagactgcgcagctcagatgtttcgctgaaggatggatttcaccgaagctgc

SEQ ID NO: 129555 - DNA, 186 bp, Homo sapiens
ttaccccaagtctccaaggccccatttctcttcccttctgatctggctctggcctctcttgtggctttagtccagagaactgagaacactctcttccctctcttcctccctcctcttttcttcttccctcccctcttctctggtatcttgcaactctcaatttcctgcttcctctcaaattccaac

SEQ ID NO: 129556 - DNA, 303 bp, Homo sapiens
tgcctgccttggcctcccaaagtgctgagaccacaggcatgagccactgcacttggctagacatcacttttagatcatgatgtacaccacctgtctcctttccctggcccatggcagacattagtaatcaaacacaatgcttttttcccccacggagctctttgctcaccttacccgtcacctgtccagacctcatggctcccctggccaagtgctagaagaaacagatccttgtaactccatcttccctccaagtaaaacaggacctttatatctcctctctcttaccaccagccatggcag

SEQ ID NO: 129557 - DNA, 476 bp, Homo sapiens
tgggattacagacgtgagccactgtgccctgccagcactaagtattgactgtcttgttttcagatcagagagaaaacttttagaaaacatggttctagccctagttgtttcttaattagagtttcttcagctttagtatggcatctgaaggtgattgcatcatatttcataatcacccagctgaactatttgctgtttagtccagcactgggcactgaggctaaaagatctttaatccaaacagcctcagcattcacccaacctgagcctatgggaccccaagcagatctggattcactgtcacttaccatctacccatctgaccctgtcttcctatgacagacagaaataaaccctgtagctatttcaccccacctacataccctgcacccctcctactccccgtccgactttcctggctgagaagttggcactgccctctggagcaggccctgtcaccagtgcacccctcactc

SEQ ID NO: 129558 - DNA, 354 bp, Homo sapiens
gttctgagcacatcagagatcttccctgagattttttagcttgaacccaaagagtgctagagtcactcactggtttagaaactataagaaagggagcttaggattcagtggtagctgtgtttgccaccatgtaaaagggtctgatcagtagggagagaaaaataaagcaaacaaacactccaggagatagagtgagtgtcctgattgcatttgaatcttctattctagttcttcatgtggtttagctgcatgtggcctatctcatttggttgttctacagttcctcagatttgatgagattttctagtatccttgcaataaaattccttttctttatggtagtacagggctgcc

SEQ ID NO: 129559 - DNA, 546 bp, Homo sapiens
gctgagagaggaatcttacatattctcactgcacacattgaaaaaggtagctgtgtgaggtgatggatgtcttcattagcttgattgtggtaagcattccacgatgtacatacctgtatcaaatcatcacactgtgcaccttaaatatgcacaattttcctgctcttgatgtgtgtgtgtgtgtgtgtgtatatatatatacacacacacacaatttttacttgtcaatatacctcaaaaatatacctattaagtactcataaaaattaaaaattatatttcaataaagctaggagaaaaaagccccactggcccagacgagcgcctcaaggcgcaggtgtggcagagggagagagacgacctcttctgaagccaaaagcacatcttcagggcacccactctgttggtctatgtggctagcacagctgaccaaatgaggctgtggaaccagtgaaagcacacaggtagccgaggtcaggaatcggcaccatcactcctggagagagggcgtcttacccggcaagagtgacccagcaggttggaagc

SEQ ID NO: 129560 - DNA, 344 bp, Homo sapiens
accagctccgggaacagggaatgtgggttatgcagtgcttccagctcagtatgttactcagctacagcagtcttcatatgtatcaatagcaagcaactctacctttactggaacatctggtatccagacccaggcacggcttccattcaatggcataatcccatcagagtcggccagtcggccccgaaagccctgtaattgtacaaaatcactgtgtttgaaattgtattgtgattgctttgcaaatggtgaattttgcaacaactgcaattgtactaattgttacaacaatttggaacatgaaaatgaaaggcaaaaagcaataaaggtgattattttttatt

SEQ ID NO: 129561 - DNA, 542 bp, Homo sapiens
tccttgaggactcagtctcaccacaccagtgctgaataacctttcttccatgataagaagaaagactaaagctagcttggggtaacagctctggatgtttttttttcctctccccaggtggggatgggtgttggacacaataagcattttatttctgttttttcttggaggcacaaattaacattttttcctacccaggggccatcataccctaagctgtgctgatttttaaattggtctatagagacaactcgtttcccatgttcggctgatgctctccatagctacccaaaagtccatttatttgtaactctaaagcaatgactcccagccacagcaatttcacacacacccccactcccgctggggacacttggcgctctctggagacactttggttcccacagctggtgtgggggtgctattgatatccagtgggtaacagccgggggtgctgataaagaccctacagttcacaggacagccccccaaaacaaagaatgatttgacccagaacatctcagtgccaaggctgagaaact

SEQ ID NO: 129562 - DNA, 521 bp, Homo sapiens
ctgggatcaaagcaaattaaggcagcagaggtgggaagaaaaatgtgagagacagtttcagaggtgaaatcaactgaattcagtgactggctgcagatgtctaactgatatagggcaggcaggcttagcctgggagggttcttggcttcacccaggaaagaattcaagggtgagccagaggtgagcggcagtgtgcagcagaggtactgttccttgtagagcagggctaactcataggcagtgtgtccagagcagcagcatatgggctgttggctagctgtatttatatctacttttagttgcatgcaaattaagaggtgggttatttagaccttttagaaaaggggtggggcgtttctagatgcatagaagataactttcaggtcattcccatggcatgttgccacggcatttgtaaactgccatggcactgctgggagtgcctttatgttaatgagcagtgagggcaactggaggtcactttcatcaccatttgctggtttcagctggcttcttcactg

SEQ ID NO: 129563 - DNA, 301 bp, Homo sapiens
agcactttgggaggctgaggcgggcggatcatgaggtcagaagtttgagaccagcctgaccaacatggtgaaaccccgtctgtactaaaaatacaaaaattagccaggcgtggtggtgtgcacttgtaatcccagctactcaggaggctgaggcagaagaatcgcttgaacccaggaggcagaggttgcagtgagtcgagatggtgcctctgcactccagcctgggcgacagagcgagactctgtctcaaaaacaataataattttgtattctataacataaacagcatttggaaccgcat

SEQ ID NO: 129564 - DNA, 842 bp, Homo sapiens
ccgaacattttctgtttaaagtgttaacctttttctcagtttgccatttatttcctttcggctcttttttcttcatttggctgccaggtcctctggcagtgacattatttcctaaatacttcttcatctttccatttctaggccttgggagggcccatggcccccacctcctctgattgcatcccatgtctgtatcagtgcagcaacaatctcagcccttcctgaagtatcactagcctgccccacacattcagtccacgaaattatacagatgcgtattgggcaacagtccaggccttccactttccatctgtattttccatgactcccctatttgcacaggggtgtctataagtgccctggatgcctgctgatggctgtggctctgctccaagtcaagacattgctctctatctggctcctttcctactgtgtccctgcacagagctcacagtgcattttacattgtaaacatctgtttagttttatggcttccttattagttcctaagccctgtgaggaccgagaccatgcctgaggtattatccactctatccttaatagctgctttttaattaatttattttttgagacagagtcccactctgtcaccaaagctggagtgcaatggcacaatctcggctcaccgcaacctccacctgccaagttcaagtgattcttctgcctcagcctcccaagtagctgggattacaggtgcctgccaccacacctggctaattttatttttgtatttttagtagtgatggggtttcatgatgttggccaggctggtctcaaactcctgacctcaggtgatccacctgcctcggcctcccaaagtg

SEQ ID NO: 129565 - DNA, 437 bp, Homo sapiens
tagccatatgaaaaaagtaaattttgattgtttcaacataacatacaaaattgattcattcttgaaagacggtagatctaaatataaaatttaaaacaactacattttcagaactgggctgttcagtatgacagccactaggcacatgtgagatttaaattcaaattaattgaataatttatttcctctgccatactagccacatctcaagtgttcaatagcacaagtggctagtggtcactgttttgtacaatgtagctatggaacagttccatcactgcagaaaatcctattggacaaaatttttctggaaaataatgtaagagaataccttcatagtaaaaagaggtcgttaaagaatataacaggccaggcatggtggctcacacctgcaatcccagcactttgggaggccaaggcaggtgaatcacctgagg

SEQ ID NO: 129566 - DNA, 302 bp, Homo sapiens
tgctgggattacaggcctgagccaccgtgcctggccaatactgtattattttaatcattttaaaatttttattgtttgtctccacttaacattcataacctccacaaggatggggagttttgtctcttgtattcagtgtcggtgcttggcgtgtaataggaacttagtaaatgtttgttgaaggaatgcatctagaatgatcctcatctctaatttgggtgattcactggctggtgacactcatccaaggagggaaaatgggagaaggatgagattatgagtttgtttttggacatgttaaa

SEQ ID NO: 129567 - DNA, 469 bp, Homo sapiens
gaaaaccaagattcaaaactttcgattgccttttttacgcaaaccaacagtaacaggcaggctacaccaagaaggcaataaggctgccaaaggtaaaggagtagggaggaaggagggaaatagagagagagagaagttaacttagaatatttagctgctgggggctgccattacagcttggcccaggataaagaggaagatttcattcttaggtctcaataaagttgttgacacaggcaccaagggatgcatgatcagctataacaggatgctgggagcaggctactgggagtagctctctcctatggttttgtcctgagggtgacgaaggtggagccacacaggttgctgaaggccttctcctagagaggctggggtgctggccatgtgttctgagggctgacctggctggtgaacccattgctatgactgaatacaaagccaggaagttgagtcactcagctctaaa

SEQ ID NO: 129568 - DNA, 301 bp, Homo sapiens
tggacccatgtattctgactctggggagacagtaccatggaaggctttatgactcaaagcgtacaccttgacctgtgagtcagaattcctttctaagggttgtcccccatttggccctataactgagttttcagtatgcgattccacttttcatgtagatccactgcttctgagtgatggggtgtgtgatggaaccagttgatttcaaggacatgcttccattgttgcacttcctctgcagtgaaatgctttgcttgtttagaaactctgttgtgtggaggccatgactactgataaagca

SEQ ID NO: 129569 - DNA, 586 bp, Homo sapiens
gaggttgcagagtatcttaccctcaagtgagataacatgtgcctgtgcttgtcatttccacaataggcatgcagctgctttcttgagatggtttacttcattacacaatttctttctaatattagaccataggtttttctttattgtggtaaaacattatatagcattaaatttaccatattagccatttttaagtatatagttcaatagcattaagtacattcacatcattgtgcaacacagttctagaactttttgtcttgcaaaactgaaactctataccaactaaacattaatttttgcctctccaaccccctagcccttggcaaccacatttctactttctgtttctatggttttgacgcttaagatacttcatatggttagactcctacaatatttatccttctgcaactggcttatttcacttggcataacttgaagttcacccatgatgaggcatgggatagaatttccttatttttaaaggctgagtaatattccattgtgaatatactccacattttctttactcattaatctgttgatgaacatttgggtggcttccacctcttggctctgtgaa

SEQ ID NO: 129570 - DNA, 717 bp, Homo sapiens
gaaaaaccaagggatttttcccaaggttatacagcaggacacttgtagagctgataatggagcacttgtttgcttccagtattgtttggtagcatttttaacatacaaaaaaagtgaaaagtacatctagctaagatactgaaatgttcaccaagttgggaagcctattaatttgaaaaattattattattttaatcctggaggagaaagaatttgcgttttcctgatcagaacagaaaatgcaagatccatgccatgtgcttgacattttgccttgatagatgacttttgtcacaggcctgttgtggcagagcagatggtcatgctacttggagtttttccactcatttgatatttccatgaagaaacaatttgccagaagccagccgtagttagagttgtgctggagatgacgggaaacctggattagcacagacttttgcttacaggagctggaggatatcggttcagccctttctgctgggccagtcaagagttccctggattggtaaactgaggaacagtttagtcttgtgatagttggagtggagctataattataccactgcactctagcccgcatgacagagaccctgtctctaaaaaaggaaaaagaaagaaatatagatatcttgggacaaacgacaaataatttgacaataatctaaagaaaaattgaaggaaaatagctaagacattattaggataactgataaa

SEQ ID NO: 129571 - DNA, 717 bp, Homo sapiens
agcagtgctgagcgctgcggggctgcagcagcagccggcgatgcggagaccctgcaccactgctccgggcggcgctcgcgtcccgacggccacctcctggcggctgcgcgcagccggcgccgagatccagacggacgcacggtgctgattggtgcagtgagtgagtctccggctttatttagaccaccgtttcttgacgactgtacttcattggagttgagggctcggagcagcaggcagccttccccgtgggaaggatgacaaatggggagtgctgcttctaggtgctcgtaccaactggcttcgtgcgtcctgggatgggcggtgttcacaggcgcttcggggctgagcgcccaccaagtgtggcgcgcgcttttgggaaactccgtggaagaccaggacggacccctggagggttaggaagactttgagaccagccaggggaagccgtgtcccgggccctgactgtggatctcctactctgaaccacggactccagtttggaaggccaggctgcctttcggattggggggtaaggaagggatccccagctcaggcagccttttgggctagggcaaggggacctctggaaccacatttttgaatgctcccacccatgatttctgggacagctactggagacaaatagaggctcgaaggtgtcgggagaaaggctgtgttcctgatgtcatgtagttgaacttggatgtggaggaa

SEQ ID NO: 129572 - DNA, 431 bp, Homo sapiens
ggagtactgtcactatttttataaccagtgttctactttattttaggtgtatcttttcttatttaaatgtcagctaaactttctttttaagatattgaatgaaagatgcccatccttcaggtttcgtttaagcaagaatccccattctcaaataatataatataaactttccaaattcttaagtagatcatctgagattgaaagctaagtttaactttctcaaagatattttagccgccatgacacctagacaaagtggtatattaaattctgattaatttggtcctaaagcacctaagaatcattcttactttcttatccacaggggttattaagttttcacattaaaaaaaatccaacagtgaataatactgcattggggttactgtaattgttaagtaaaataagaaatacaaatctttagttagatc

SEQ ID NO: 129573 - DNA, 419 bp, Homo sapiens
caggatccctgtgtctgtgtggtctgtgctggcgtgtggtctgtgcagggctgtgactagtgattatcatatgttgggctggaattgaaaaccactccattttccttttctgggtgataggagatggaaacagcttcaacttggggacgggtttcactcctgcaacctccctggccgctagaaagacctagggactttctgtagggctggtctcactgccttcctcttcactggctcctacctttaattttgtcctatccttcccttgtcatctgcgtctctgtcactggctcttctcctgtctctacattcaagttttcccgggaatcagtccttgatccttgatttttcccttcgtatgtcatatcctgtcctttctcctaatcaacagtcccaaatctttaactgtctgccagaca

SEQ ID NO: 129574 - DNA, 166 bp, Homo sapiens
caagagtacaggggctaaccccagaattctactgtgtttatcagtgattacgcataaatatgtacaaacagtatacagcattcaatctgttgactgatttccattttagcaactcgcatttttagtttccctgatgttcaagttttgaggtattactaaatactat

SEQ ID NO: 129575 - DNA, 1693 bp, Homo sapiens
tcccagtcgcaatgcagcaaagcagaagcagacaactaggcacaaagcaacagagttttaaagttttcttctcctgctactacttagcatgtcttacatgaggagtatttacctttgtttagccaggagcagagatgcatcctgaatgtacacgatggcttctaacttggcagcgtgaattttcagctgagcaggtactgctcggagacttgtaaccaaaccgcctctgatggagcacggctggtctcccaccatgtgtgtgaatagtttgggggcttcttatgccacgctgctctacctgcaggaataaaggctaggacaaaggagaggatgcttgctatggtttgtctggctggggcctgtgcgagcgactcaccgcactgatgctgtgtgactccccagctcacatttaaggctggtcacggggctggcgcagatccccactcctcagttagcgcacggtttaaaggagaaaccagactccctgacctaaatcactcccagtcctctctggatgcgggacagctgtcgactagcagtgacacaaccagccatcaagtggagaatcgttgcgactgcagtctgtgtgcaggtggagcccgggagaatgacagtctaatttcggtcatccaacggcttttccttattttcctaaataatcgtgctcgctaagtatacagttgtctggattagcctgcctgccatgcagtcctcatcaactctggctggaaatcagggtgccaggcaagccgcctttagccctggctcctttctgcgtgatgctatgcagctaggatgggtcatgctgacaacaaagaaggaagcagaaagcatcactttctcttctcttgtgatgttagcggaacataactcttcttcgcagtgatgcccttgtgtgtggtgtatgtgtgtgtgtgtgtgtgtgtgttttaattcatctaatcgaagagcccaacaaatatcatcatggatgtgatttttaataatttggaaaaaacaaaaaaagacagcctgtggagacagcgattcgaaacagcggcacatttaggttattgccaatttgaaatacttggtttgtgaagctgagccctaagggacaagctcggtaactgaggaagagatcgtagataaagaaataaaaatgacaagcgtaatggaggctctgcgaagggactgtcagagcatcagttcatggatggcaatttcaccaggctgagattgaataattcatagattgaaattaccctgctttcacctttcccatttaagccggcatgatctgaatctctcataaattttcaagataaagtaaaatgccaatttgaatctgaagagcttttaaaaccagatgctgcatccctgaatctttcggtatctttcacaattatcctatgagaacagcacttcatcacgaagcaccattaccagggaaaattacggtgattacaatagcaacaatagaataccatcaaatgatctctaatttacctaatttgctaagactgactgtacggttttgatatccattgtatgtcaccatgcccggcacccgtgaagctatctcgcactggaacaaaagtggcatcgtgtgtgtgtgtgtgtatgtgtgtatgtgcacgcacaccctgctaccttaactgtgaatgcctagcaaagaacattctcctaggttacaatatttctttcctttggt

SEQ ID NO: 129576 - DNA, 386 bp, Homo sapiens
  misc_feature (48)..(49): n is a, c, g, or t
gaggcgactctaagatcccccacggcaggtgtactcaaccggcagttnnactccaccggcagttgtactccaccgccaggttgtactcttctggtggctgctagcaatccttggctttctttggcttatggaggagtcactctaatgcctgcctctgtcttcatacaacattctcctttcttttatgtgtgtctgtgtccaagtttccctcttcttaaaaggacaccagtcatattggatttagggcccattctaatctggtatgacctcgtttaacttgattatatctgcacagactccatatgcagaaaaggtcacattcacaggctccaggtggacacgaatgttggggggccactgttcaacccagtacaacctgccggtgg

SEQ ID NO: 129577 - DNA, 486 bp, Homo sapiens
gcatgaaaccaaaaatcgtcaactatgtatcaattgaaaacaatcatcctctgtggcccttctgaacagaagacggttggtttgatccccaccacccaagcccttcaagccttttaagaactgatgagtaaatccctatcttactggaaaaataccatgggaggggaaaatagcacctccaaagacaaacaaaaccatggcctgagttcaacaccccagcagcggcacgccttggctgtgtgactctgagtaaatcaccagcactcactggctgtgggtttaggcaagttgttcagcctctgtgtacctcgattttctcatttataaaatgcggataatattggtatctctttcaaagggttgtactgaggatttactgaaatagtgcaggacaggcaattagagtaataactggacccacagtacatgctcagtaaagcatcatctattggagggtcccctgcttccctggggattggcattacg

SEQ ID NO: 129578 - DNA, 872 bp, Homo sapiens
aacatatcaactctttcataaaaacagcttaaaacataaacatgttgtataactgtgcaacaatattttctttctttttttattttctaatttagagacagagtttgtctctgtcacccaggctgaaatgcagtggtgtgatcatagcttactataaccttgaactcctggactcaagcgatcttcctgcccctgcctcctgagcagctcgggctacaggactgggccacctcacccagctaatttttaaaatttttttatagagataggggtcttactttgttgccaggctgttctggaactcctgaactcaagtgatcctacgaccttggcctcccaaagtgttgtgattacaggtgtgagtcactgcacctggcatattttatgtctttttttctagctaatttatttatttttattttttacttttttaatttctttgttaagaacgaagacacaaacacattagcctaggcctaaggcaaggtcaggatcatcaagacatcagtaggcaataggaatttttcagctccattggaaccactgttatatgtgcagtctgtgattgaccaaaatgtcattatgtagtgtgtaagtcttatctgtgtgatgatggctgtcaaattcatattgctagctcaaaactttgctttcaacttcagacatgtatatctaattgcttaatcagcagctccaataattgacacctcaaatgtagcatatcctaaactgagtttttaatcagcacttctcccatgtttgccaaatctgtttcttttaccatctttctcacctcagtaactggcaacgtaataattcacttctctctgacagtccatatacatgctgttaagaaattctgttggctccat

SEQ ID NO: 129579 - DNA, 912 bp, Homo sapiens
ggggccgggcggggccagcggcgcattagcgccttgtcaattcggctgctcagacttgctccggcctccgcgtccgcgcccagcgacgtgcgggcggcctggcccgcgccctcccgcgcccggcctgcgtcccgcgccctgcgccaccgccgccgagccgcagcccgccgcgcgcccccggcagcgccggccccatgcccgccggccgccggggccccgccgcccaatccgcgcggcggccgccgccgttgctgcccctgctgctgctgctctgcgtcctcggggcgccgcgagccggatcaggagcccacacagctgtgatcagtccccaggatcccacgcttctcatcggctcctccctgctggccacctgctcagtgcacggagacccaccaggagccaccgccgagggcctctactggaccctcaacgggcgccgcctgccccctgagctctcccgtgtactcaacgcctccaccttggctctggccctggccaacctcaatgggtccaggcagcggtcgggggacaacctcgtgtgccacgcccgtgacggcaggtcctgccagataagctgtaggggctcaggccaccctccctgccacgtggagacgcagaggccgaacccaaactggggccacctctgtaccctcacttcagggcacctgagccaccctcagcaggagctggggtggcccctgagctccaacggccataacagctctgactcccacgtgaggccacctttgggtgcaccccagtgggtgtgtgtgtgtgtgtgagggttggttgagttgcctagaacccctgccagggctgggggtgagaaggggagtcattactccccattacctagggcccctccaaaagagtccttttaaataaatgagctatttaggtgcaaaaagtgaa

SEQ ID NO: 129580 - DNA, 1802 bp, Homo sapiens
ggggccgggcggggccagcggcgcattagcgccttgtcaattcggctgctcagacttgctccggcctccgcgtccgcgcccagcgacgtgcgggcggcctggcccgcgccctcccgcgcccggcctgcgtcccgcgccctgcgccaccgccgccgagccgcagcccgccgcgcgcccccggcagcgccggccccatgcccgccggccgccggggccccgccgcccaatccgcgcggcggccgccgccgttgctgcccctgctgctgctgctctgcgtcctcggggcgccgcgagccggatcaggagcccacacagctgtgatcagtccccaggatcccacgcttctcatcggctcctccctgctggccacctgctcagtgcacggagacccaccaggagccaccgccgagggcctctactggaccctcaacgggcgccgcctgccccctgagctctcccgtgtactcaacgcctccaccttggctctggccctggccaacctcaatgggtccaggcagcggtcgggggacaacctcgtgtgccacgcccgtgacggcagcatcctggctggctcctgcctctatgttggcctgcccccagagaaacccgtcaacatcagctgctggtccaagaacatgaaggacttgacctgccgctggacgccaggggcccacggggagaccttcctccacaccaactactccctcaagtacaagcttaggtggtatggccaggacaacacatgtgaggagtaccacacagtggggccccactcctgccacatccccaaggacctggctctctttacgccctatgagatctgggtggaggccaccaaccgcctgggctctgcccgctccgatgtactcacgctggatatcctggatgtggtgaccacggaccccccgcccgacgtgcacgtgagccgcgtcgggggcctggaggaccagctgagcgtgcgctgggtgtcgccacccgccctcaaggatttcctctttcaagccaaataccagatccgctaccgagtggaggacagtgtggactggaaggtggtggacgatgtgagcaaccagacctcctgccgcctggccggcctgaaacccggcaccgtgtacttcgtgcaagtgcgctgcaacccctttggcatctatggctccaagaaagccgggatctggagtgagtggagccaccccacagccgcctccactccccgcagtgagcgcccgggcccgggcggcggggcgtgcgaaccgcggggcggagagccgagctcggggccggtgcggcgcgagctcaagcagttcctgggctggctcaagaagcacgcgtactgctccaacctcagcttccgcctctacgaccagtggcgagcctggatgcagaagtcgcacaagacccgcaaccaggacgaggggatcctgccctcgggcagacggggcacggcgagaggtcctgccagataagctgtaggggctcaggccaccctccctgccacgtggagacgcagaggccgaacccaaactggggccacctctgtaccctcacttcagggcacctgagccaccctcagcaggagctggggtggcccctgagctccaacggccataacagctctgactcccacgtgaggccacctttgggtgcaccccagtgggtgtgtgtgtgtgtgtgagggttggttgagttgcctagaacccctgccagggctgggggtgagaaggggagtcattactccccattacctagggcccctccaaaagagtccttttaaataaatgagctatttaggtgcaaaaagtgaa

SEQ ID NO: 129581 - DNA, 442 bp, Homo sapiens
acaggacacgaatgaagcctccttcagtggctctgtggtgcggccctctcctggactccctgcttagcttggcttcccctctgcctgcagtcctgccagataagctgtaggggctcaggccaccctccctgccacgtggagacgcagaggccgaacccaaactggggccacctctgtaccctcacttcagggcacctgagccaccctcagcaggagctggggtggcccctgagctccaacggccataacagctctgactcccacgtgaggccacctttgggtgcaccccagtgggtgtgtgtgtgtgtgtgagggttggttgagttgcctagaacccctgccagggctgggggtgagaaggggagtcattactccccattacctagggcccctccaaaagagtccttttaaataaatgagctatttaggtgcaaaaagtgaa

SEQ ID NO: 129582 - DNA, 1760 bp, Homo sapiens
ggggccgggcggggccagcggcgcattagcgccttgtcaattcggctgctcagacttgctccggcctccgcgtccgcgcccagcgacgtgcgggcggcctggcccgcgccctcccgcgcccggcctgcgtcccgcgccctgcgccaccgccgccgagccgcagcccgccgcgcgcccccggcagcgccggccccatgcccgccggccgccggggccccgccgcccaatccgcgcggcggccgccgccgttgctgcccctgctgctgctgctctgcgtcctcggggcgccgcgagccggatcaggagcccacacagctgtgatcagtccccaggatcccacgcttctcatcggctcctccctgctggccacctgctcagtgcacggagacccaccaggagccaccgccgagggcctctactggaccctcaacgggcgccgcctgccccctgagctctcccgtgtactcaacgcctccaccttggctctggccctggccaacctcaatgggtccaggcagcggtcgggggacaacctcgtgtgccacgcccgtgacggcagcatcctggctggctcctgcctctatgttggcctgcccccagagaaacccgtcaacatcagctgctggtccaagaacatgaaggacttgacctgccgctggacgccaggggcccacggggagaccttcctccacaccaactactccctcaagtacaagcttaggtggtatggccaggacaacacatgtgaggagtaccacacagtggggccccactcctgccacatccccaaggacctggctctctttacgccctatgagatctgggtggaggccaccaaccgcctgggctctgcccgctccgatgtactcacgctggatatcctggatgtggtgaccacggaccccccgcccgacgtgcacgtgagccgcgtcgggggcctggaggaccagctgagcgtgcgctgggtgtcgccacccgccctcaaggatttcctctttcaagccaaataccagatccgctaccgagtggaggacagtgtggactggaaggtggtggacgatgtgagcaaccagacctcctgccgcctggccggcctgaaacccggcaccgtgtacttcgtgcaagtgcgctgcaacccctttggcatctatggctccaagaaagccgggatctggaagcgcccgggcccgggcggcggggcgtgcgaaccgcggggcggagagccgagctcggggccggtgcggcgcgagctcaagcagttcctgggctggctcaagaagcacgcgtactgctccaacctcagcttccgcctctacgaccagtggcgagcctggatgcagaagtcgcacaagacccgcaaccaggacgaggggatcctgccctcgggcagacggggcacggcgagaggtcctgccagataagctgtaggggctcaggccaccctccctgccacgtggagacgcagaggccgaacccaaactggggccacctctgtaccctcacttcagggcacctgagccaccctcagcaggagctggggtggcccctgagctccaacggccataacagctctgactcccacgtgaggccacctttgggtgcaccccagtgggtgtgtgtgtgtgtgtgagggttggttgagttgcctagaacccctgccagggctgggggtgagaaggggagtcattactccccattacctagggcccctccaaaagagtccttttaaataaatgagctatttaggtgcaaaaagtgaa

SEQ ID NO: 129583 - DNA, 958 bp, Homo sapiens
ggggccgggcggggccagcggcgcattagcgccttgtcaattcggctgctcagacttgctccggcctccgcgtccgcgcccagcgacgtgcgggcggcctggcccgcgccctcccgcgcccggcctgcgtcccgcgccctgcgccaccgccgccgagccgcagcccgccgcgcgcccccggcagcgccggccccatgcccgccggccgccggggccccgccgcccaatccgcgcggcggccgccgccgttgctgcccctgctgctgctgctctgcgtcctcggggcgccgcgagccggatcaggagcccacacagctgtgatcagtccccaggatcccacgcttctcatcggctcctccctgctggccacctgctcagtgcacggagacccaccaggagccaccgccgagggcctctactggaccctcaacgggcgccgcggcgcgagctcaagcagttcctgggctggctcaagaagcacgcgtactgctccaacctcagcttccgcctctacgaccagtggcgagcctggatgcagaagtcgcacaagacccgcaaccaggacgaggggatcctgccctcgggcagacggggcacggcgagaggtcctgccagataagctgtaggggctcaggccaccctccctgccacgtggagacgcagaggccgaacccaaactggggccacctctgtaccctcacttcagggcacctgagccaccctcagcaggagctggggtggcccctgagctccaacggccataacagctctgactcccacgtgaggccacctttgggtgcaccccagtgggtgtgtgtgtgtgtgtgagggttggttgagttgcctagaacccctgccagggctgggggtgagaaggggagtcattactccccattacctagggcccctccaaaagagtccttttaaataaatgagctatttaggtgcaaaaagtgaa

SEQ ID NO: 129584 - DNA, 312 bp, Homo sapiens
tggaggtcattggcagaggtggtgggggagcatcttggagactgtccatcacaggagacaaggaccagaatggagagcttcaaggtccagtgttttatctggttatctgtgtctgctgtaacaattcactacaaattttgtggcttaaaacatttgttcttaggttctggaggtcagaagtctgaaatcggttttctggtctggaatcaaggtatgagcagagctaccctccctaccaaggttctagggtagaatgtttcctcgtcttttccagctgtgagaggtacagaccttctattccttgcctcatgg

SEQ ID NO: 129585 - DNA, 416 bp, Homo sapiens
tggcaggagagtgggctaaagaggtaaaatgaggctacactgtgaagaaccaaggaaaatactggggtctgtttgttttagaaaattcacaatttggggcggagtgcaatggctccccaaaacacttacccaccagctgcacgtgagaagccaaaggtagtttatgtgaaagggctttggaaataatcacgcaccaagtgaaggcagaggacacaccttgtcagcttagttctcagcagcaaatcatctcttttccaggataaccctccctgattcttattgaaatctctttgctgaccacactaagctcttctctctcaggggcagtgggagccgtggagagtggaatagaccagctgtctgtgacctgcgagggagtccaatgtcggaatcactccccagccattgcactccgg

SEQ ID NO: 129586 - DNA, 603 bp, Homo sapiens
aggcgggcagatcacttgaggtcaggagttcgggaccagcctggacaacatggtgaaaccctatctctaccaaaaaatacaaaaattagctgggcatggtggcctgtagtcctggctacttgggaggctgaggcacaagaatcgcttgaacctggcaggcagaagctgcagtgagccgagattgcgccactgcactctatcctgggcaatagagcaagattctgtctcaaaaaaaaagttgtaataattagaaatttgaggaaaaatgtatacaccctcaaccaaatctaaactaaatgactacagagtattttattaggaggaaggggacagtgaaggggaatatggaataagataatacgaaaggaattatctctaaaatttacagtaataagttgccataaagctagttagaaaaagtacacattttactgctgatctgtacaatcatctttatacctacatttcctcatttcatcaagacttctctgaagcatatctgaaaataaacaacactgtaactgctttcttttcccacctaacctggaagttccccaaaggcataatctaagtgttattctctccatattatgcttaaagtat

SEQ ID NO: 129587 - DNA, 466 bp, Homo sapiens
aaaccaccagaagctaggaagaggcaagggaggattcccctgcagccttcagaggaggaatggccctgctgacacctcaagtttggacttccagcctccagaagtgtgagaaaatacaattctgtttcttcaagccacccagtgcacggtactttgttacacagccctgggaaaccatgtagccaaccatggtagtcccatcctgttggcccagtccttgccaaggaaccataagaggaagactgctgggctggatttggagaaaggtttctgatctttccccacctgtgcctagatgtgactctagtagttgctgcagtcatcttatgagagcctaagggacaaagcccctgccaaaaaggacagagagtggatggaaagaacctggtggcagaagaccttgctgagtggccatttcagctgagctgcttgtcctgcctctgcactccctgttatgtgaaacaat

SEQ ID NO: 129588 - DNA, 399 bp, Homo sapiens
cctgtggtattactagtgaacacaaagatgaatctgggcaaacgaaggtgtttccccttaatttggaatttggagtagatattccaccacagactaaacatgacttggaaatatgtacactgctgaacactttatgtaaatagtttattccgtggtttagtaattttctctgtggaagctttgctggatttggtttttaatctgcatactataaaaacatttcattttatctgagttttaaagctcacttgatctttaaggtacaagacaaatgccaagtgtccaaatcagatattaaagcaatcttttccaggccacttgggcttttgtgtttctgttgttgtacctcttacctgataaaggagagctattcaacctcctcatcttctgttgctttta

SEQ ID NO: 129589 - DNA, 440 bp, Homo sapiens
ggccttcccttctgtcggacatgaggctcgggtggaccctgggctgtgcccgcgctgcccacacaaccgctggggatgtggagtgaatgagaccgggtgctcctcgtcctgggagcctgggaatggcaccttctgccacatcgtgtttgcgttgtgattaaagggtttccagatgagcggcccctcccgcgctatctacgggtccccagatgccaccagggtacttcgaagaggcagcggccttgagcccatggaggcagagcctggggcgacgtggtcatgagagggggaagcctggacccccaggtctgtggaggcaagagggattcttgtctggagctgaaggcgcacagccctgctcgccttgactcaagctcctgacccccagaggcgtgggaataaacgcctgtggtctcagagccccagtgtgtggaggtttg

SEQ ID NO: 129590 - DNA, 364 bp, Homo sapiens
cagcccgtgcccatctaagcctcatacacagcaggtggccggagcctgcacaaggccctctccccagtgacatgatggctgctgctgtcaccaggtggcctccaatcctgcccacccccaggctctcaggtggggatagaacattcgtgtggccacttcacctccagatccacaaaggccgctgacgtgctggtccaggaacccacacagaagggcagtgcaggaggagggaaggtacctgcagtgtggctcctggggacatgctgccttaagaagggcgtccttctgacagaagccagctcagatgaaggaggagagctccagaagatgtgagcgggagcctggcccccaggccggacacctt

SEQ ID NO: 129591 - DNA, 251 bp, Homo sapiens
tgcaggtaccaggagtgttctggcacagagattatgatcctttgggggtctaccctatgtgctgggttgaggaagcagatgcttgggaaggagagatgcctggcttgatttagctgcttctggccaggcacagggcatttgtctaggggctggcaggaaggggagcctggcagctagtggagtgcacatgggtgcactgagttgcaaagtggggcccttcgtaatgcaagggtctagatcttccatgaaag

SEQ ID NO: 129592 - DNA, 401 bp, Homo sapiens
gaagttatcaccctttttctacaaatctctgcataatctgccccttaatttgcatgtgtttaaaagtgggtgcaaatatgagtgtggaagctactgagctgcagctctcagcacactggggtagccctgctctgcaggagcagtcacagggctgtgacactgccacctctagaaagctgctttcttctatcaccgcttgcccttgaattattccctgaatgaagccaagaaccctcccaggctaagccccaatttggggctcgcctgccctgcatcagggagacatgtcagctgaggagtaattgaccagatttctgctttagaaatatggcagtggaggcaggagatggcatctgaggcccaggctggggagaagggtgctgggatgagaacctggagtt

SEQ ID NO: 129593 - DNA, 519 bp, Homo sapiens
aatccagctgtctctctgaaaactaaatatgaaagactgagatttagtcaactttgctgagatttaatttacatataataaaatgaatcattttaactgtgcagttcagtaagttttgaaaaatgtctatacagattcatgtaactgccaccaaaattgagaaaggacacttccaccatctcaaaagattctgtgtgttcctttgtagtaagtctcttctaccccatccctagacaacagctgatgtgctgtcattgtacacatatattagctttgcctgtcctagaacttcatgttaatgggaagcatcctgtatgtactgttttgtgtctggcttcttcagtgtatttttgaaatttatccacattgttgtgtgtatccaaagtgtgttctttttcattgccaaataatgttctgctatatgaatatattacaaaatatttgtctgtttatctattggtggatttttgcattcgttccagtttggggctattatgaataaagcttctgtgaaaattc

SEQ ID NO: 129594 - DNA, 120 bp, Homo sapiens
gtagctgggactataggcgagcaccaccgcatccagctcattttattttttgtagagacgaggtgggaggtggggtgtggggagtgtcttactttgttgtccaggctgctctcctactcc

SEQ ID NO: 129595 - DNA, 463 bp, Homo sapiens
atggagatcaccagctggatatggcaagaaagttgccccagtgcagtggtggtgacgtaatggaggtaccttgacagatgggaacagcctctgtgaactgcaagtctggtttccagaacctgttctcatcccttcaggcctaatggtgatgacactctgctcccacctcattctcgtattactgaagttcagtgtgcctgctactttccactagtccttgactcactcattgctgctcagtttctaagaagcctgcccagttttaacttcagtggctatctgatttctggcctggtgcttttagcattcctataagtaatacattgcacttttactgtgaacacagagacaaagcatatcatggggacaccactgaaaggtgcatgacatgttagccaagaaccggatttgaaatcaggcgaacctgtggtcaaatctgtacatcttaaattttgtgtttttt

SEQ ID NO: 129596 - DNA, 538 bp, Homo sapiens
tctcactctgttgcccagtttagagtgcagtggtacgatgttggcttgctgtaacctctgccttccagctcattcaatcctcccacctcagcctcccgagtagctgggattataggcgtgcatcaccacacccagctaatttttgatttttttgtagagatagggtttcgctatgttgcccaggctggtctggaactcctgggctcaagcaatcctcctgcctcgggcttccaaagtgctgggattacaggctggagccacagcacctggccaaaatactgtttcagtgtgattggaaaccagcaactcagtacatggccaaagctgataaaaatgaagaacttggatcctggaatattgactcagggtaactttattataacaaagctaagactcttgtatgtccttgctgtgtttaagaccctgtatgttgattcttgcttattaaattgaagaacgagtttagatttttagttggtgcctatgtgggaaacctcacaaacagcaagacaggaataaagtagacccagcccatttg

SEQ ID NO: 129597 - DNA, 626 bp, Homo sapiens
tctgagtttggagttaaagtcttaaagtttgaaaaagatcaagaaaattgatctgttagtatagttatattttccccatgattaggaatctcaagagacaaatgaacttcaggaaacagtgatgatggctaaataagttgcccaggattcatcataaagattcaaactgaaaagattgatagttaaataatctgctactttataataattcgacttcacattttataaccttttattgtgttaaaggatgagaccaccactgaataacataaacaaaaatcacaaagctgaatgtattgcttacttaagtaagtgagtgttcccggtccagtacattctcttctagctgatcatatgtagggtttttgagatggttggagctcaagggttggtggactttctgaggcaagtgagagtcgacatccactgtagatgtgtggttactaaggtgagactgttgctgactggttggcgtgtagaagggtgttcactggtgtgagtctttatcaggcagctttcagaggtgaagaactgtcactggttgactggcaggagttcattgtggcaaactttgttcatttttttttttactgaaatatttttcatttattcatttatgatgtggc

SEQ ID NO: 129598 - DNA, 387 bp, Homo sapiens
ttttttttaagtctatatcctttcttataatctctaaaactaactcactcttattttagaatagagttgttcttataaaaatgacgtgttattttttaaaattaagagagagagccgggtgtggtaccttacacctgtaatcccagctactctggaggctgaggtgggaggactgctggagaccaccaccaggagtctgagactagcctaggcaacatagtgagacccagtcttcaaaaaactgtttaaagaaatggttttggggtcgggcatggtggctgaagcctgtaatcccagcactttgggaggccaaggcaggtggatcacctgagggcctccaaaagtgctaggattacaggtgtgaaccaccaggcctgggggtaccga

SEQ ID NO: 129599 - DNA, 340 bp, Homo sapiens
gaagtgtagttttgggcggcaggaaaacaggtggatgtccatactgttactccctagacccagggcttataccacagggaaagggtccgcgtgccccagcaggacaattacgggcaccttccaggagaggcaagaaagctgtatgtttcatcacctgtaatttgtgcgataacatcaaggttgacatgttcttatgtgaaggacggtgaattaagtaggaatcgggggtgttcatgggactgggctaatcagaagtcagcatggcgcatttgcacctgagatgcagtcactttttttttaagatggagtttcgctcttgttgcccaggttggagagcaat

SEQ ID NO: 129600 - DNA, 684 bp, Homo sapiens
gcatggaaataagggattggggtgcaaagataagaggtcagggcatggaattaagggatcggggcacagagataagaggttggggcatggaaataagggatcagggggttcttgccccctagaaaagtggtacttgccactaagggtgaaaggtgctcagtaggggagcttttgagccaggatgagccaggagaaggaatttcacaagataatgtcatcagttaaggcaagaacaggccattttcatttcttttgtggtggaatgtcatcagttaaggcaggaaccagccatctggatgtgtacgtgcaggtcacaggagatatgatggcttagcttgggctcagaggcctgacactttgtgtctggctttttttcacttaggataatgtttttgaggttcatccaagctgtcacatgtatcagtacttcattcatttttatggttgaataatattttcttttataaaaccagtgacactatatttaattattaaattttttaaatgagtctagagtttaaaagacagtttgttaggtgaaattaagtgatttagaaaggaaagagaaaataacagaggtagtatattagaataagcttctagttgacaatatatagctaacatatggatgaataatattttctgttgtgtgtatataccgcaatttatttattccttcatcca

SEQ ID NO: 129601 - DNA, 729 bp, Homo sapiens
acagatacataaaaatgcatatattacaactaatgttcaagaaggaattgaataatttataacaaaagaaaaggtctagtatctgttataagcagaatatatttatcaaacaaaagagttttaccactcttcactgatttcataaatgtccccatacgtttggtattagctatcatttaataataataggtaccatttataaagtaactataatgtatcaggcttatactaattatttcacagctttatcctcatttacctccaatcctttacaaagtaggttatttgtaataacttagcccaagtcacacaactgataaatattaaagccagaatttgaaattagcttccaagcccttactcccctttgacctataaatttcacttacaggaatatattcaaatcattcatatgacatgcaaacctctggatgatctaatctcaaactattctagctgatttacagcattcttttcttctgtgactactccatccacactggccctctttgatttttggggatacaccaaactctttcccacctcagggtttttataatcgtgctgtcccctcccatcttcactctgttgagataacttcttactgtaagaactgcataagcagtgaattaaatatcacttcctcagagagagtggggaatggagacaagtattccacagaaagtagacagcgtatagcgtttttctaagccctagaggagagaaagt

SEQ ID NO: 129602 - DNA, 769 bp, Homo sapiens
ggttgattctgaaggtgaaattgtggcccagtggccacagtggtggtctgtgagtatctgtaacagtgacatttttattactttctggtaataaaaatgcccacatcattgtagtgttaggaataatagatgctaacaatataatgctgttgtgtttttcagttttttcccccaagtgtttattataggaatttcaaacatacagaaaaattgaaagaataatatgttttctaccctagattcaacaggtgttactattttaccatatttgcattatcaatctacctacctacctacagtgcacatacatgtactatttgaaattaaatggtagattttatgacactacttctaaatacttcagcatgcaagattgctgtttaaaaattttttttaatcagttattacttgtgttatcttgacaaatgcattttcacttaaatttataatctgtactaacaagtaggttatttggttctagtaatccctcccatgtaccaaaatcagtttgagggtcaccacttatactgtggtatatttcacgaagatttagaatagcaggttttttttcagagcctagcttctttggcaaaaacttaaagagacttcggagacacatttctaaacagcattgagcataattcttaaaacatttcaatgaggttagaaaaatcttttatctttttatatggcttataattgatgaaaagttagaaacctttctgtacataaagtaacaactatatcagtggtttacaatatgggataa

SEQ ID NO: 129603 - DNA, 740 bp, Homo sapiens
gtctttcctcagttgtgttttccccatgtgggtttgttttgggaaagcagtggaggggaattcctcttaggttgaaataacttttagagcgatggtgccacagtttacaaatatttttagaaaaatcctgtcagattcttgggaacttcagactaacttcacatctaaagttctcttttcttttcttttcttttttccttccttccttccttccttccttccttccttccttccttccttccttttttttggtttttgagacagagtcttgctctgtcacccaggctggagtgcagtggcacgatctcagctcactgcaacctctgcctcccaggttcaagtgattctcatgcttcagcctccctgagtagctgggactacaggtaccctccactacgcctggctaatttttgtatttttagtcgagatggggtttcgccacattggccaggctggtctcggactcttggcctcaagtgatccgcctgcttggcctcccaaagtgctgggactacaggcgtgacccaccacgcctggcctaaagttcttatttaaaaatttttcttctgatttgttagtttaagaaggtaggtttgaagcagtgaccaggaattttcgggaaatccattaaggaataaattattcagtaaaacagtctcaaagtgagggccagagtgcaggacagaggcagagagagatggtagcagtttataaagagaagatacttgattagagaaatc

SEQ ID NO: 129604 - DNA, 168 bp, Homo sapiens
ttacacctccctatttgggtcatgaaacataatatgtttcgaatgagaaacatactagaaacttgcatggcacacctggtcatggagtgttcaggaggtgttgtcctcatcccacacggagcaggtgcaccggctgctgctatacttctgctgtgacatccttcaggg

SEQ ID NO: 129605 - DNA, 371 bp, Homo sapiens
gcagactaaaacccaacaaatgggagagggatgaagggaggggaaagctaggagatggcttatggattgccccaatactattgatttattttgactgcctttgggttcttgtgagatggctttacactcttattttgtgatggaagatccttatatgatctcttaaccttttagctagagtccaacatagtttagttgggtttcatctgcatctatattgtatccaccatcttattaatatccaaactgtatctttgataccaaattgcagtattatttatatgatattcaaaaattaattggacttttctgtttagatgtgtttttgctaatagtttcatatgccatgtgcttatgtattatcggctttt

SEQ ID NO: 129606 - DNA, 794 bp, Homo sapiens
gtggtcacgtgttagagcagctgaggcaattcccaggaaaaaggcagccaggaggagtgaaggattcatgtttcaaaaatctaggaagggaaaagaaatgaggatctgattagaccgatcctaaaaagccattttactaccccctgagaaactagggccaccatggtagaataaaaatatttaaattattcttccaagcatttacctaaggactgtggaagaggccaaggatgtggctggagaaaaacagggcaagtggaggtattggagggacccaccaaaatgaaaagcagcctgtccagagctgtaggagttgaaacagttttctgggatgatgatgacaggctatgaaaaggacaggaaggtacctgatgggcgagaagcttaaggcaacaaccgggaaactaggaaaccgttggcccaggttttgtaccaattgtgctgaggtcatccaggcaaaacctcaagaatgaagacatctaatttcaagaagggacaaagggatccccaataattgggaagtcacatcacaccttgttcttggctaatacacaacagaaggtgaagtatgttttccaaatgccccttgtaatgaaacagttattgaatgtcttcccaggacaaactgggaaggagagcacccatctaccgccgttcccgcagtcctgcagtcctgcaggtgggccagtcctgccaacactccagctcccctcacagagcataaactgaatcaggtggccgaaccaccggaagccagagtccccagtgtccgcgcccacacaggggtgggtagg

SEQ ID NO: 129607 - DNA, 158 bp, Homo sapiens
gttacctactggttgcatttttggttttggttttgcatttttttcttcccacaaacactggctactctttgtcctaccccctccaccatgatgaaccatgtggaaactatttaaatcaattaatgtctttctcatttttcgaacatgtatgtgccacc

SEQ ID NO: 129608 - DNA, 324 bp, Homo sapiens
agtgacacgagagagagagagagagagatagcgagcgtgcatgccacatgcatgtcctctctcttgctctctctttttcttagctgggcctgatggtgtacacctgtagtcccagctatccaggaggctaaggtgggaggattgcttgaacccaggagttcgaggctgcagtgacctgattgtacgactgcactccagccctgtctctattaaaaaaaaacaagtccttctccaagctgatctgggcacttgatttctacccttgtggttctggcttagtaaaggtcttcagaaatgacacaatgttagtttcctgtggctgct

SEQ ID NO: 129609 - DNA, 651 bp, Homo sapiens
cagaagcctattctgcgtctattaagatgatcatgtgaattttatttttagttctgttcgtatgataaatcacatttataaatctgcatatgttgaagtaatcttacatcctagggataaaacttaatttatcatggtggattagctttttgttgtgcttcttaattcagtttgctaggattttgttgaggatttttgcattgaagttcatcaaggagattggcctgaagttttctttttttgttgtgtctgccagcttttggtatcaggataatgccggcttcatagagtgaattagggaagagtccctcctcccccaccttttttttttttttggagtaatttcagtagaaatggtaccagatcttctttatacacctggtagaattcagctgttaatccatctggtcctgggtttttttctggttggtagatttttattaatgattcaatttcagaactcattattggtctgttcagggattcagtttcttcctcattcaatgttaggaggttctttgtttcaagaaatttatcaatttcttctaggttttctagttatgtgcatagagatattcatagtagtatctgagagtttttgaatttctgtggagttggtggtaatgtcctctgtgtcatttctgattgtgt

SEQ ID NO: 129610 - DNA, 562 bp, Homo sapiens
gctgctgtaaccaaatatcacagactgggtggcttaaaaacagaaatttattttctcatggtttccgagattaaaagtctaagagtaagtgtcagcagatttggtttatcttggggcctctctctttggcttgcacatggtcatcttcacactgtgtcctccctctcatggcctcctgtgtataggtatccttggtgtttccttttgtattcagatttctttataagagcaccagttagattcagggccactccagaggccttattttaaattaatcgtcacatatttaaaggccctgcctccaagtacagtaatgttttaaggtattatcacatatataaaggccctgtctccaactgcagtcatattttatggtattgggagttaggggacacaattcagcccataagaagtaataatgggccaggcatggtggttcatgcctataatcccagcactttgggaggctgaggtgggaggatcacttgagcccaggagttcaaaactagcctgggcaacatggtaagacactttctaaaaaaaaaaaaaaaaagaaaaaaaa

SEQ ID NO: 129611 - DNA, 496 bp, Homo sapiens
cctccactattagggtaaaatctaccttggatagagaacctgtttgggaagaggaaggaaggaagcaagatgggtgggtgaccctgatcttctctgaggtatcagttgcatcatctcaggcctcctctgcctgatccttctgtcatctgctccattagctcctaggcttttgcaaaactggaaacccttcatctggagccctcaagagcagtactacttaatatgccaatcttcaatgagataagaagcatatgtaccagaatgtaagactgatctcttcatcaagaaaatcttgtatgaaaaaatgttagaactagacagtgtgtttactctgacataattgatttacattcaggcttcatataagttttctatatagtgaccagccagtaacacagtttgcaaattggcagctaatctgcagaccatacttggagtagcagtgctctagagctgcctttcattcagaagcagttgttgaggtcatggagttgtt

SEQ ID NO: 129612 - DNA, 802 bp, Homo sapiens
gtcatatgtgaagtaagggatgttgcctcatgctacaaaaggaatttattcaaaaaatgatgctgacgtttcaacacttgatgtattatgtcctaaattcatagttgtaattattacctaaattttgttataagatgaggtaaacttatttttataatttttccttttttaactttaatttttgaaagtaaatgcttaatcagatcttttaaggtgagaagtgtctaagtaacattgtaggaccaatgtatgggatgggagatattttgtggccatttttcaaaatatactctacctcaataagtatcctaaacacctattaaacttataaattattttcagtaaacttgcaaaaaaaaaaaaaaaaaaaaaaaaaaaaaggtgtgtggggccgcgcccttgggcccccggagaaagactttttgtgagacccatgcggtgtggggcggcgcggggcccccagagtgggttcagcgtgaacccggcggccccaaaaaagcgcggtccccccagaggaaagaatccccggggcaccagagagacacaaagcggcggcgtggggagctctcctccacgcgcaaaataaaaaaaaaagcgcgccccgggggggggcaacaaccacgagcgcgggcggcccctctgggaagccaaaaactccgccagaggatggggagagctctcacgagagggagggccaacactataggcgggggggactctcaatctaccaaccagcaggggaaggcggccacccagaggggaggaagcgctgcggagagaataactagaaagatataagccc

SEQ ID NO: 129613 - DNA, 518 bp, Homo sapiens
agaatctgaacccttccttgctcagtaatataaagcattaaaagttgtagaaacttccttggtaattttatatggtgctgtatcccagactttatgcaactcaaatccttagtgtactgaatcagatcaatttgatgtagcattccagaacagtgtttgcatgcaggaaagcgtgagatccttgggacaagtgctattttaaactctcttatgagactgaggattccttttccattgcattgtttgcatttgttatttctctggttcttagcacctgcaccagagtaaacaaaagaaagggggaggagtgcatcaaattagtgccgctgttgcatataagcttttggaagacttaatcttagatgaagttaaatttttaaatttcttcagtctatggagttaattaatgttttcacttctggtagcataatgaattaagaattgtatatacttatggccgggtgtggtggttcatggcctgtaatcccagcactttgggaggccaaggcgggcagacc

SEQ ID NO: 129614 - DNA, 424 bp, Homo sapiens
agtggtgggaatacagacatgcgtcaccacacccagcctaaaatttcttaattacatataatttccagcacaataataagtaccaaacacatgacagacaagacaatatgaatgagaataaggagaaacacaaaaatcaaaacagatcagtattttggaattatcagataaagattttaaaataagtatgcttactatgatcaagtacacacaagacaaaattctaaattgatgcaaagaaccaaaaactataataataaattaaaattccagaagtaaagcggaaatttagaaatcagtcaggcacagtggctcatgcctgtaagcccagtactttggaaggctgaggcagatcgcttgagaccaggagttcaagaccaccctaggtaacaaagtgagaccccatctctacaaaaaaaaataa

SEQ ID NO: 129615 - DNA, 218 bp, Homo sapiens
aatgggagatagagtttctgtttgaggataggacaaaaggtttgtgaagagttatagagtcaaggacagaagccaaagagagcatttgctgtgtaacatgtttgcttgttaaccagatcagcaaagcattttaactaatggaccattatttatgatctagaaacaattttgtgaaagcgatttcttagtgatgctgtttactgtgatcacatttgccc

SEQ ID NO: 129616 - DNA, 356 bp, Homo sapiens
ccccaagtgatccacccacctcagcctcccaaagtgctggattacaggcatgagccaccgtacctggctggctttgggttcttgaagggaaaagaaaaagccccatggcagaccggacctgactgacgggcaggaaatcttaattccagacctgctttcacctcctcactgccggacctggagccagggctggctgtctcagggcctctgcctaccattgccaggaactctctgttgccagtctgtatttggagaggctgaagggatgaaggtcctacctcactctggagccctccccacagggccccagcttgcacctcgtgcaccagctccttagggggcagtgtgcacccctg

SEQ ID NO: 129617 - DNA, 772 bp, Homo sapiens
tcatttgtctcttgatcttgcctttggtggttgcatccttagctggaccccatgagacacttaccttgctttcacagaaatcactcactctgtgaaagaaatgagagtaaaggaagggaaagaaaattaaggaaggcagaagtgaacatggaagagaaaaacaataagaaagaggaaatagaagggccatggttttgaaatacaacgcctggaaaacagaaaatgaaaacagaataaaggaatgaaattgtaaaagctatgaaacaaagtaatgagagaaataaaatcttaactctgaaaaaaatagatgtgatttatgacaaatatcaggaaagtgactcaagagcatcctgaaatctccttgatagtaccgaagggagacctgggcttcttatgatcactgacatctgtaaaataagaatggtagctgtaaattttgaaacgatgaaaaataaccttgtagcaggaatcaaagggagagtttgatctaatgttggccagaatgagtcaaatacattcacttcgctaaagtgctctgcgttggtcagccgatttttctttttttttttttttaaagtaaaatctttttttattattattatactttaagttttagggtacatgtgcacaatgtgcaggtgagttacatatgtatacatgtgccatgctggtgtgctgcacccattaactcgtcatttagcatttttcagattctacgagaccattcaaattccagctctgcttgatattctctctctttgtagtgttgaga

SEQ ID NO: 129618 - DNA, 216 bp, Homo sapiens
atttgtaacattcttttcagaagttactccaattataaaattaccagacaattcaagaacactaaattttgcattttgtgttgagatgggttttgaactgatagagctgagcaggaaaagtgctgcagctgagcagagaggtcagccacgtgctttggaaggaaaggaaacagtggcataaatgaatgggctctgcgatgacaagtctgttaagca

SEQ ID NO: 129619 - DNA, 126 bp, Homo sapiens
tgctgggattacaggcgtgagccaccacacccagccggagagggacttcttgagggctgctcttgtgacctccataatgcagagaatgatcagttcacaccaaacttcctgggccaggctagaggc

SEQ ID NO: 129620 - DNA, 149 bp, Homo sapiens
agaactgccttattctcaaggccaacgcttcatccttcagggtcaccaaccctaaaaggcatggatttgaagttcattgaatggttgccaatggactttgactttaccaagactttagtcatttccccttgcatttcaattaaagtcca

SEQ ID NO: 129621 - DNA, 331 bp, Homo sapiens
catgtgtcctgtcctgcttcactcttgtggtgagcctgcaaaataggctcatttcacggttggagaaacaggcacaaaaaagggccaaggtcagacagccaggacagagtgcagctggactttcctcttgaatctgtctgactccaaagcccatatcttccccatccaccatgctgttgtagtttgtgatgatgatggatgacaaaattacttgaaatttcctcctggtacattctgaatcttacacagtactgtgtagaccctgaagaccagcactcaccatctattacgagctctgatattccagtgttcctcttaaattctttattcc

SEQ ID NO: 129622 - DNA, 116 bp, Homo sapiens
tgtagatgccaaagaggtactgaatttcttagaacccaagtgcacacaagtgaacttcaggaagttttgcaactttttttccagaaagtggtgggcagccacaggaccgaaggaaa

SEQ ID NO: 129623 - DNA, 345 bp, Homo sapiens
gaggtagatcttattaaaatactgctggcttcacattgcatctctgctcaagagcctgcaatggtttcttattgttcttaagaactaagatttagtcagtgctgagtaagtgccaggcagtatgctaaatacatctcagtacttcatcagttcaaagaaacagatgctatcatcactcccattttacagatgagaaaatgggagctcataaaaattaagtagtttggaccaaattcacagtgctacataggcggtgaaattgaggtatgaaatcaggccaacattaattctttctcttaaagtagaagttttcaatccttttgtgtttgttttaaacattagcag

SEQ ID NO: 129624 - DNA, 473 bp, Homo sapiens
gggccgctgggcttacctggatccctagtgcgtgtgaaggtgtaacacgcctgatataaacagaagagacatttagccacaggttttcagaagggcacgctgctccaggggacatgaagcagcatgctagaaccagccaagaataaaggtgtcctccgcgtccctatcgccccttcgtgctcgttagaaagagcaaaaaggcgaggccaaaactgaggccaagccttctatctggtaacccaaaaactagaaaggcagaaaagcaaccagaggcgggaaaagcccaaccaggccagaggaaatacagccgctgccgagagccgagaagttcagaagctccgcttgttacctaaaaccagatggggacagagacgccacacctgggcccaggcgtgtctcgccctcggtccctgcagaactgaggccaggaatgacaggaattctcccttgcagctcccagcttaggacagtca

SEQ ID NO: 129625 - DNA, 689 bp, Homo sapiens
taccagcatctcttatttttttactttttaatataggaaggcttaactcttaatatctaaacaccgtacttacaaaacaaattaggattaaaataactacatcaaaattattactaaatctcagatctcagcctaaatgtcacctgcgccttctcagagaggtgattactcctgattactcttctttataaaattagcactttccctcttcccaacctctagaaccttctatcaaatcacctgcttatcttctgtgcagcccactatgttttcttgtttataattcctctccctcctttagaatggcattctttgaattagaggatctctgtgcctattttattagaatatctgcaatattttttatagatcatcagaaatttaacagagtggaaaactgaaaggtgaagtgttccaagtcattaaagattaaaaagtaaccagaattcacgagaaagcaaagttaagttataatgattttttaaatggacataaggatcaatgggaaatcaagataaagcaaagctgaaattatggtattttgatggacttagtgtctagttttaaatgttttgttttgactgacagaactgaaatgctagactgtctgtttctatataggatacctggcaactgaagtaagacatatgatattaaaatatagccttttaccctgaaggatataacag

SEQ ID NO: 129626 - DNA, 346 bp, Homo sapiens
accaaggtagcccgtcaggttcaagaatgctggcagaatacaggagagtcctgggtcagagacaaaggacttgatcgctgtgcagcaaacagcatgagcaccagcatatttccgttagttccttttgaccctaagtcccatgggggtgatgctgatgggctcaggcaagtgtgggcacacagagcgaattacattgtgggagaggaccctaagcttaggaaactcaaagccagtaagcatggctgtcctttgctctggagggagacactatctccatcttccatagctgttccctagataaacatctttgaagctggcgcggtggctcaggcctgtaatcctacca

SEQ ID NO: 129627 - DNA, 327 bp, Homo sapiens
tgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtata

SEQ ID NO: 129628 - DNA, 390 bp, Homo sapiens
tatcaattggtgaacaggtaacaaatgtggtacaaccatagcctaaaattcagcaataaaaaggaacaaagaaccacactgctacatggtcgaacctcaaaaacattaaacacaggcgaccatacattgtaggattccatttaaatgaaatgttcaaaaaaggcaaattaatactggcagattattggttgcctggggctctgggttggaacagggattaactgtaaatcactacgaggaatctaactggcatgatcaaagtgttccaatattgatttgtggtgatggttgtgccactcagtaaatttactaaatatcactgaaatgtaagcttgaattgggttaatttcataatacagaaaacatacttcaataaagctgctttaaaaa

SEQ ID NO: 129629 - DNA, 391 bp, Homo sapiens
gcactttcccctccccgggcgcccaaggtctcctctgtgtccccagcctggcgcaccctcctcaaacacaatgagtgcattgtccacgggcagctcaaggtcaagttctcctggcgggcaccacccttcccacctgccgagtccacttaagcttgggtccctcccagactctgctctttgttccctgtgggcccaggctgtacttacagggcaggtgggccagccccacccaaagcgtttccccagctgccaagagtagcatgggtctagcattgttatatggccccgggctggaaatcccaggtgggggtaggaggagtgagaggggggtgttctcctgggtcttaagagattcccttctgcggggaaagatggagtccctgctagttta

SEQ ID NO: 129630 - DNA, 520 bp, Homo sapiens
agctctagaggacccctccataatgtgtgcccaggaaataaatgtttcagggcatggaaatctgagtacgtctagggacatgaggaatgaggagtacagaggggccatttccttttgaggacagtaagggaaacaggtagggcctggcacctgtgcacaaagctgaacagagcaggcctttaacacctcacagttcttcccgtgcaagggatggattttattttcataagggagacgctgacctctgggctgggcttgaagcaagaatgaagggtggagagagagcaggagagagggagaaggagacagagagagagagagagagagaggagaggagagagagagagagagaatgggagaaatgtacccagtctttactccctggagagagagagagagagagagagagaatgggagaaatgtacctagtctttactccctgcagagagagagagagagagagagagagagagagagagaatgggagaaatgtacccagtctttactccctgggtctggt

SEQ ID NO: 129631 - DNA, 257 bp, Homo sapiens
aaaatgctgggattgattataggagtgagctaccgtgccggcctaccttgcatttttattttacggagataatttctttccttaaacctgatgaagcaacctctactagcttccaacttttcttcttcagctttctcacctctctcagcctttgtagagttaaagagagttagggccatcctctagattagactttgttttacgggaatgttgtcgctgatttgattttctatccagaccattaaagctttcttcac

SEQ ID NO: 129632 - DNA, 334 bp, Homo sapiens
acaaagaggaatttcacacagggtcatagaaaagttggtttgagttttcctaccatttatcttacccattctgctcagtgagtcagacttacataatacatttctttctctgattttcttcagaaatccagaggcagcactttctcccacggaagtgcatggctgctgtgtaacaaccaagcactattccgcctctgtttccccttctccagcctgaacttagactgggcaagtaaaaaaagagtcacgagtattctaatgtgataccgaaatacagatgatgagattctctcttaaaaggaagaaaggatgcaaaggacaagatccatactaa

SEQ ID NO: 129633 - DNA, 380 bp, Homo sapiens
tgaaaagaacaccctattcaaaaaatagtgctgagaaaactcgctactcacatgcagaagaatgaaactggacatctgtcccactctatatataaatattaactcaagatagattaaagacttaattgtaagacctgaaattataaaaatcctaaaagaagacctaggaaaaactcttctgaacagtggcctagggtaataatttattaccaagacctcataagcaaatgcaacaaaaacaaaagtagacaaaatggacttaagaaaacaaaatcaacattctacacagacaacttacagaatgagaaaaaaatttttgcacactatgcatctgagaaaggactgatatccaaaatctccaaggaactcaacaaaccaac

SEQ ID NO: 129634 - DNA, 385 bp, Homo sapiens
aacattgtttccaggaccttgaggtgggaaccctgctgaagtaaatgagagccactgtagctggggtctagggaacagggggcacatggagtaagctgatgatggggcagatgatagaaggcctggaaagacttcatcaagattttaaaaacccaagtgcagtgaggagcctttgatgtgttttcaacacgttatcatcagggtctaaattacgtttctaaactgctactgtgactaatatttggaacacatgttatagagaagcaagagtgcaaacagggagaaggaagtactcagcaagagatggctatggcttggtccaggttcatggcagaagagatgatggaggtgaactgctttgagttatatgttggagttccatgtt

SEQ ID NO: 129635 - DNA, 371 bp, Homo sapiens
tgcgggttctcggaccaatatggagaaaccctatctccactaaaaatacaaaagactagcagtgcatggtggctcatgcctgtaatcccagcactttgggaggcagaggcgggcggatcacctgagatcaggagttggagaccagcctgaccaacgtggagaaacctcatctctactaaaaacacaaaattgccgggtgtgatgacgcatgcctgtaatcccagctacacagctaaggcaggagaatcgcttgaacccagaggcagaggttgtggtgagctgagatcacgccattgcactcaagcctgggcaatgagcaaaaagagcaaaactccatctcaaaagaaaggaaagcaaacaaaacctcacag

SEQ ID NO: 129636 - DNA, 139 bp, Homo sapiens
gaggtgaagagtgacctgctcagaaacccactgtgaaaaagcatcagtggcaatccatcaagtttaatctttcaactttttttaagatgaaaataaagataaatagcagttctggtttaaagcccctttatttctgcct

SEQ ID NO: 129637 - DNA, 102 bp, Homo sapiens
cagtgtgcagtggggtgattttagggatgatgacaccaagcactgtttcactgattccctgcagcactgtgaagcagctcctgctaatgtctgcactttaga

SEQ ID NO: 129638 - DNA, 276 bp, Homo sapiens
tgtgtcttacacaaagtttatctctcaacaaataaagcaatgtggtgttgtttagaaagttcacaaggatattaaaagaacgtttgttctacatctccaggaaatcacgtatttagcatttattgtcacaatactgaccctatcaaaaatgtaatgcattatttggctttgcttctttttagagagctcatgacaactcccagagatcttctatcaaagctcaccatctgtttaataatgtaccccccctttttttttttggagacaaagtctcac

SEQ ID NO: 129639 - DNA, 409 bp, Homo sapiens
ggaggaggatctaggagaaatctctgtaccttcccctcagataacgctgtgaatcagaaatgcactagaaaactaaaatctttaaaaggaaaatctcttcattcaaaatattcaaatcctctgtggaaacaaggactgataaagtgcgcagcctctccttccacaaacttctgaatacagaggttgaggcactctctggctggttccctcaggaccttgaggacgtcctcaagacctgcatcagactgcctttgtcatttccctgttcattaagatttccattaggagctgggcttctcaataaaacacaaatgtaagcctgaccctgtgctatctcttagcagcgctaataaaaggattagtgcaacaattttttttttttttttttttttttggaaagggaattcga

SEQ ID NO: 129640 - DNA, 459 bp, Homo sapiens
cctccacctcccaggttcaagcagttctcctgcctaagcttcccaagtagctgggattacaggtgcccgccaccaccggccggctaattttttgcatttttagtagaaatggagtttcgccttgttgggcaggctggtcttgaactcctgaggtgatccgcctgcctcggcctcccgaagtttatctttgtctcactgggttatttccagagacctgacttcacattctgaaattctttcatcagctgtttttagtcctttgttgatgcttttgaatgtgttttgtattccatttaatgaattcttcagttccagaatttctgtttggttctttcttataattatgtttctttggtaaatttcttatattccaaattgtttttctaaattatttgtattgcttttctgttttttcttatatttgagctgagcatctttaatatcactatttcaaattta

SEQ ID NO: 129641 - DNA, 737 bp, Homo sapiens
atatttaacattttcagtagagacagttctcattatgttgtccaggctggtctcaaaccaggcatgagccactgtgcccagctgagatttatactttaaatttacacattccactatagagaaatacaccaacaccatagagagcttggggaaaataaataaaaatagaagaaagaggacaaaatcgcaccactgcactccagcctgggcgacagagcgagactctgtctcaaaaaaaccaacaaaaaaaagaaattctaacagaaaaatattaaagttctccatcatagaatctttggattccaaagtcctggcccctcagcaatttgaaatagcacagcctagcatttctgcaatcacaacatattggaaacttgaaataactgaggcgggagaatggcttgaacctgggggatggacgggtgcagtgagctgagatcacaccactgcactgcactccagcctgggtgacagagcgaagactccatcccaaaaaaaaaagcgaagaaaacaacaaaccaaacaaacattgttggggccggcttggccttggaagaagttttcatacaacattcgctgtggcgcccgggccccagtaggttaggtgacgttggccatgcgtggtcccaaggaaactctgccccatgatagtggtgggttcccaccaataaaaaacgcgcggggacacgggggttctgaccaaatccagtgtgtcggagcatctgcccatcaccggc

SEQ ID NO: 129642 - DNA, 787 bp, Homo sapiens
cggtaattcatacagggccttaaagtcccatattagaaaataccaaatcagtagttaattcgaggattttgaaacatggatcagtgttttccagttttggggtattgtgacactcctagtagtgctaatggtgcatacattttaaagtaaacattgtttgctttgattcccttcccttaaaattatttaaatagattaagtcagggccaagaacctggatgaattaatgatttattgaatgagcattttttcatttagtcaacatgtattgagtcccagctaggtgtgtatgtttttttaagtcaaaggcaataccagcttcgtggccagatgtcttcacaagcactgaagccagtatccagaaatgagctcattattttgctccagcccctaaatttcatctcctatgttccctgtctctgcatgacataccatccacagggatagccaagacagaaacctgggtgtaagggcacaagttttattaaattaatactattaacaatagcagctgatgtttattggacatctacaacactgcagatgctttacatgcacttaatttaattctaagaaccacaaaaggaaggtcctattataatccatatttagtctcagtactgtgcactgaatctataaaagattctaaaagagctcagtctcaaaggaaataaacatgaaaacaagtaattgcagcacattatgatgtcttagcaggatactatagtagtgcccaagaggaaagcctgacttcctgctggggaaagaagcccttcagaggtaaatg

SEQ ID NO: 129643 - DNA, 386 bp, Homo sapiens
cattctgtattagtcctccttgatggggggacacatgccagccaggttacctgattcatctagttgtgattttattgacagtcatttctaccttgttggtatccgcagaggttgtcttgaagggggctgatgccttctttcactagctttatgtggctggcagttctgtcctgccactcttttcctcatcatctcagcctccctgcccatggcactcaagagtccaccttggcagaacctgcaactcttcagcgcctccctaatgaactccttgcaagggccccttggttaagttacagtagagaagtggttgcttaagcaagtagtttccggtaaaggcataaagatagcccataattgggtgataaaatacctggattgcatct

SEQ ID NO: 129644 - DNA, 164 bp, Homo sapiens
cctgtgatttgacccaagtgacaatttattgaaccaccagttttctcatcttaacatgaggtcaacaatgccaacaagatacagaattaaagcatggatatagagtaccagcacagaccttagcacgtagtagtctggttccttcctttctctcctgtgggaaa

SEQ ID NO: 129645 - DNA, 124 bp, Homo sapiens
agccaagagaaatctagaaagatgagcaggtaggaaaaagtatagatgatcttataataagagactctttggaagtgctaccaactgggatgtatccaggtatatgcacagagaagcgacgtgt

SEQ ID NO: 129646 - DNA, 312 bp, Homo sapiens
tttaactccttcttagactgtgagtgactgcaaaacagaaatcatggctttttcaccttcaatcacacaacatagtgatttagggtcagaaagacttgtgtccagattctaactctgatttactttctggtgaccttgagtaagtgacaacctctctgagcctctacttcctcatgatacatgggtgtgaaaattaagtgagatagtgcatgcaaagtgtttggaatccagccaggcacacagtatgagcccaatacatagaggttatattggtaatgccagaggacccccaggtatgattaacgctcagtc

SEQ ID NO: 129647 - DNA, 415 bp, Homo sapiens
cttgatatcttgatgattctgactttaggctcatgtttatactcctgagaagaggagaggagttaggaatgggggcttagtccttctatcttctcagaatttagaaattaacttaaaccatttctactagttgttcaaagtttttgtagcctctgcctgcaaaacaggttcttttttattttcatttctttcattatgatataaaataatacaggctgggtgcagtgactcatgcccataatcccaacacttcgggaggccggggcaggcgggtcacctgaggtcaggagttagagaccagcctggccaacatggcaaaaccctgtcgctactaagaatacaaaaattagttgggcctggtggcgagcacctgtaatcccaactacttgggagggtaaggcagggagaactgctt

SEQ ID NO: 129648 - DNA, 383 bp, Homo sapiens
tctgaccccatcccaccctttcatactcattttgtaccacgcctctcagatttatttccccaaaactttattggggcataagagacaaatagaaattatatgtatttaaggcatgcaatgtgatgttttgatatatgtatacattgtgaaatgattaccacaatcaagctaattaacatatccatcaccaaacatcatgtagttaccattatgtacattaagtctccagaacgtattcatcttataaccaacagtttgcaccctttgaccaacacatccccatttctccccctgcaacctacctttggtaattacccttctattctatttctatgagttcaactttcccttctattctatttctatgagttcaacttctaaag

SEQ ID NO: 129649 - DNA, 380 bp, Homo sapiens
ccagcactttgggaggccgaggtgggtggatcgcctgaggtcaggagtttgagagcaacctggccaacatagtgaaaccccgtctttaataaaaatacaaaaaattagctgggcatggtggcagagtcctgtaatcccagctacttgggaggctgaggcaggagagtcgcttgaacctgggaggcagaggttgcagtgaggcgagatcacaccattacactccagcctgggcaacaagagtgaaactctgcctcaaaaaaaaaaaaaaaaaaaaaagagagatggtatcaggtactgcaaattcttagagtagcttctgactttgctcagccttatttataagatttatctactgggaggctcattcaataggcacttga

SEQ ID NO: 129650 - DNA, 645 bp, Homo sapiens
ctttaccctgactcttgattttatgccttggtactttgagtagaatagggcaggtacagataatagtatgtcacagtggtctagaatctacacctttcctgcttgcagtatggtattagctagggtccattccatcacgaaagtggcagctcatcattttgggcagtcagaaaaataggcagttgttataatagctacattgttttttaaaaaacttatgcaagcaggtaagggttttttcacttttagaccagcatcttttctttaccgtagaatctaattattgtctctaatctaaaaggagatagaaaaatgtagtaacctaaaggaaacaaagaataagaaaaatatctactttttgtaagaatgggattttgcatataatttgatttactaggtgacctaagttaacagggaactgatttatatttttactggtattaatacattaaattcaggggtttctgtgttgttaaaggaattctgtgtcatttgaaacttctatgaatttagaaatgagaagacatcagtgatctaggtggctacttgtgatgattcctaattttgtaaggaaaataaaaaggagatggaaaaaggatttggaacaaccctgatgtgtttgttacaacatttcaaaatatgtct

SEQ ID NO: 129651 - DNA, 336 bp, Homo sapiens
tgaagctgtcagatggtaaacacctgaagtgtcatagtcgatggctgtccagtattctatcacatggatggactgttgttatatagtctattatattgcatttactggacatttaggttatttctgattttgggccaatctaagcactggtgagatgagtgtcttaatttgggtcactaatctttacacatttgccttagtgttgtcttaggataagtttttagaacaggactagctaacattttcaagcatttaccacgtgccactctgctaagggctttaagtatattatcagtcaggcatggtggctcacgcctgtaataccaacactttagg

SEQ ID NO: 129652 - DNA, 742 bp, Homo sapiens
caaaagggtaaacacatttgaaatattcaccaatactgaaaaccactaaccaaaatggttacactaattcacatcaacccttagatcatgggaaagggaccgctttcccatatctttgctatcactgaattttatcaattaaaaaaggtttttgaccccatgctaggtgaatgatactatctcctccacccatggtggagttcagtggcaccattatagctcactgcagactagatctccccagctcaggcgatcctctcacctcagcctcctgagtagctgggaccacaggcatgtgccaccatgcctgggtaatttttagaaattttgtagagatgaggtctcactatgtcatctaggctcaaactcctgggctcaagcaatcctcctgcctcagtctcccacagtgctgcaatcacaagtgtgaccactgtgcctggccactttttttttttttttataattgcaatgacatatcatttcatgttttgttggctattttttccttatgtcatgctatttgcaccttttgcccatttttctattggtgcattcaccatttcatatcaatttacacaatttcttcatgtaaactggcaatcagtcatgggcacaaacatttttcatactttgatttcttttgagtttgtttttgatacagaaattttcattgtaagagaggtacactagtcttttccctttgagacttctggattatttttcatgcttagaatcttcctgg

SEQ ID NO: 129653 - DNA, 276 bp, Homo sapiens
gacaattgttaacattttggcgtattttcctggtctgtatagatagggtgcatttttatacctttttgctcaccatttaaaaggaactcacagatgtcacgacatttcacccctaagtacttcagtatacatctcctaaaaataaggacattttccaatataagcacaataccccgatcacatctttaaaagttaacaataattctctaatgttatcaggcacccactttaaattcagatttcctccaaatgtctcttatcgctgttgaggggctc

SEQ ID NO: 129654 - DNA, 377 bp, Homo sapiens
ggtcattcatgctacagcaatacttgtctattaggtctgaggctagatgctttatacacaatatctcatttaattcttaatgaaataccctaagagggccaggcacagtggctcatgcctgtaatcccagcactttgggaggtggaggtgggcagatcacgaggtcaggaaatcaagaccatcctggctaacatggagaaaccccgtgtctactaaaaatacaaaaaattagccgggcgtggtggtgggcacctgtagtcccagctactagggaggctgaggcaggagaatggcttgaacctgggaggcagagcttgcagcgagccgagattgcactaccacactccacccttggcaacagagcgagactctgtctc

SEQ ID NO: 129655 - DNA, 667 bp, Homo sapiens
gggaggcgcccctcaacatgcgggcgcccttcagggattgccgctggggcttctgtgctccttactgaaaatgttaccctccattcacactaaagagttcttttttctggcccagcatagtagctcacacctataatcccagcactttgggaggccgaggcaggcagatctcttgaggtcaggtgtttgagactagcctggccaacatggtgaaaccctgtcgctactaaaaatacaaaaattagctggatgtggtggcgcacacctgcagtcccagctactcgggaagctgagatggaaaaattgcttgaacccaggaggtggagattgtagtgagctgagattgcaccactgcactccaacctgggcgacagagggagacttcatttcaaaaaaaaaaaaaaaaaaaaaaaaaaaaattgggggggcgccgggcccttgaaaaactttccaaagacccattccgggtggggcgcggcggagccccagagaggtaagggagcacaggggccaacaggcgggtacccacagaggaaaactccgtggcgacctagaacaaaatgggtcgtgggatcttcctccccccaaatacaacaccggccggcgggggaacacggacgtgttcggtaacaaactccaaaggggagctcgtgaagcaccacacagg

SEQ ID NO: 129656 - DNA, 415 bp, Homo sapiens
gcgcagcgcaggcaacggaacctgtgatctcctccaagccttttccatagagggggaaacggaggcacaggcagtcacacacttgtcccaggtcatacagccagcatgtagcaaggatttgaacccaggcctggctgagctcagaagaagctgagcaggaccggctgcaaaagccctccactcaaccaggtctgaacccatcggggccctgaagggggcatggctggatgccgtctgaggcagttcaggcctcttgtccatccttcctgggccagggacctggacgaccttgaaagtggctctgattggctactgatgacatcatcggagatgagggccaaaatgactgggcctcactcaattggtcttggtgcccacagctgggtctgtcggcatccccctgtgtgtctatgca

SEQ ID NO: 129657 - DNA, 333 bp, Homo sapiens
tgggctggggaggcatccttgctttcctggtgcctcctcaaagtgctgacacttgggggacgggaaggggtagaagtagggctgctcctttgggagctggagggaatagacctggagacagagttgaggcagtcgggctgtccaggttctaagcatcacagcttctgcactgggctctgaggagattctcagccagaggatcccagcctcctcctccctcttccccagcccaggaagagggctggctgacccctatatgtatatatagcacatagtaaaggaaaataggaacacagtaatataatttggatccttgtcccctctaaacctcag

SEQ ID NO: 129658 - DNA, 403 bp, Homo sapiens
ttgatgtcatcaatcatcatcttatgacagcctcttggtcctctaagtttcttgtaccagcacctgtgccaatgaagtagtggttttcactgtggtgggtattaatagtacagtatccagtctttgcttctcttactttcatttaacttgctcaaggcaaactaaaacctttcagcacctgcagctttcacgtcaatgccatttctgttttctttgagtcagtggcattcatgtatctcaaatatttttctccagggtctatgaaccaggagatgttgctttctgttttctgttacaatttgaggtctgtgctgaactccctgtttaaagcctgaggaacaagaagaatgctggttaaaaatccaggaaagtggtgataatgtagggagatctgtgatggtta

SEQ ID NO: 129659 - DNA, 519 bp, Homo sapiens
gcgcgcgcgcgcgcacacacacacacacacacacacacacacacacacacacacggcagaggaggcatcaaagagaggtggcagcatctgcaaggcatcactctggctttaggtagagatcagttgtcaaggagcaagatcagattccaggagaccagtggagttgttttagtgtcactttgtgaagaactgacagtggccaggaccaagggtgcacagtggggatggtgagaagaaatggaaaatctgggagctttctggagggcggagtcagctccactccataatggattggatccacagggaggggcatcaaggatgatatgaatcttgtaggtatggactagctactttctctcaggccacactgccatggggtgagaagtagattgaggtgtggacttggagacaaaaggagtagggaatgggtaaaagaagtctgaccagctggacgtggtggctcacgcctgtaatcccaacactttgggatgcagaagcgggcagatcacctgaggtcag

SEQ ID NO: 129660 - DNA, 385 bp, Homo sapiens
aacagatcacttgaggtcaggagttcaagatgagcctggccaacatggggaaaccccgcttctaccaaaaatacaaaaattagccaggcatggtggtgtgcctgtaatctcagctacttggaggctgaggtgggagaatcacttgaacttgggaggcagaggttgcagtgagccaagattgcgccattgcactccagcctgggtgacagagcgagacgctgtctcaaaaaaaaaaaaaaaaaaaactataaaacactgatgagaaaaattaaatagcacttaaatgaagctagagaaataccgtgttcatgaattggaagttgcaatattgttaagatgttaactttcctcaattttatccttaaattcaataaaatcccaatca

SEQ ID NO: 129661 - DNA, 342 bp, Homo sapiens
tggggtctcacagccaggaagcgggagagcggggattagatcccacattatcaggctccgaaatttagatgaattactctccatgcaggagtcaaaaaatatttgtttaaaattaatgtttatgaaatttgttccttggaaattacatttaggaagtttcagatttcattatccactcagagaagagagacattggaaaaatgccagaggccaggcatggtggctaaggcctgtaatcccaacactttggaaggctgaggtgggaggactgcttgagcccaggagttcgagaccagcctgggaaacatagcaacactccttctctactaaaaatacaaaaaa

SEQ ID NO: 129662 - DNA, 112 bp, Homo sapiens
cttatagaacataacctcaaatgaagatctgagccctacggcaattcagacacagaacctcaaatgaagatctgagccctacggcaattcagacacagaacgagattttaca

SEQ ID NO: 129663 - DNA, 1066 bp, Homo sapiens
aaaaatgctttatggcccagtgcagtggctcacacctataatcctagcactttgggaggctaaggcaggaggttcgcttgaggccaagagttcaaaacaagcctgggcaacactgcaagaccccaactctacaaaaaacgaaaaattagccgggagcggtgatgtgtgcctgtagtcccagctactcaggagactgaggtggaagaatcacttgagcccgggaggttgaggctgcagtgagctgtgtttataccactgcactccagcctgctgggtaacagagcaagactccatctcaaaaagaaaagaaaaaatgctttgctacataatgaggccaggcaaaaaaaaaaagtcctgtggaaatcatatagacaaacatttgcaaagctgctactgccattgtaccagtgttaaaatgtgttctaccttgcatcttttactgatttttatgacagattttatattgtaaccatttgagaactctgtaagtgctatggcttccttaaactacgatttatcatatgctcccagtgtttactttgagactgaatggcaaccagagaatgtaaacaaccaaggtgcatctggttatgttttaaaataaagattagcaacaagtcgatcgtagagaggagcccaggtgggaacccttcttaccaattaggcacatttgggcaacaggacacaggactggatccagtgatgaggcaggcctaaggggaaagtttcaggtggtcaccctaagaagccaatccagatctcgccactttttacaaagcgcgtctgtggacaccactgtggggcacttggcgtccatcacgaggaaggagaccccccaatagggccccaaaaggggggaaaaaacgggggagcacaccacggggagaggaccacacatactttaataaccagcggggcgagaacaaacaggcgcgggcggggccaacaccccaagcacaccaggaatgagcgagcggcacatttgtcaatagtacaccgccagcgaggacctcctacaaaaaaggagcgaggtcacgctggaggagcaacgagggcacaaacaact

SEQ ID NO: 129664 - DNA, 490 bp, Homo sapiens
tagccgggagcggtgatgtgtgcctgtagtcccagctactcaggagactgaggtggaagaatcacttgagcccgggaggttgaggctgcagtgagctgtgtttataccactgcactccagcctgctgggtaacagagcaagactccatctcaaaaagaaaagaaaaaatgctttgctacataatgaggccaggcaaaaaaaaaaagtcctgtggaaatcatatagacaaacatttgcaaagctgctactgccattgtaccagtgttaaaatgtgttctaccttgcatcttttactgatttttatgacagattttatattgtaaccatttgagaactctgtaagtgctatggcttccttaaactacgatttatcatatgctcccagtgtttactttgagactgaatggcaaccagagaatgtaaacaaccaaggtgcatctggttatgttttaaaataaagattaataaaagttttggtttttctctttct

SEQ ID NO: 129665 - DNA, 550 bp, Homo sapiens
tacatagcagctctccttggcagaaagtcagtttcatccctgggtgcagcaggagcagagctaacctgagaaatccaatattacacggaggaaagcccacaccacgagaggcagcggtgtgtatctggttttaataagatgcctgcttctaagaacctcaacttccaaaggcaagacatttgctacctgcaagatgtgagctataattcgaaaatctcctaattatggtcagtgtctgcttttgtagcacaggtgtttccagagcgtgggcatctagtcctcatggcaatcctgaagaggaagatagggatgtttcccagagggaaactcaggtgcagagaggtaggaaactgcccacacaggcatctttgattgagctatctatcatcctactcactttcccctcagtccacaaaaagtgggaggcagcttaccgaaatcccttgaattctaaaaaataaatgaacccttgaggcagctgatatgaggggaatgggcaggtgaatggtacagaaatatcagagggagatgagcaggaggcccccagagg

SEQ ID NO: 129666 - DNA, 918 bp, Homo sapiens
gaatagtcaagagtgtaagttccagtttttctgcctgctggctgtgtgaccttgagcatgccatttaggctcatttttcttatctgtaaaatgtgaaaaggatggtgttcagaaagttgtgttagcattgtaaaacttccctttgtttagagggacacctgtggtagagtagtcaagagtgtaagttccagcttttctgcctgctggctgtgtgaccttcagcatgccatttagggtcatttttctcatctgtaaaatgtgaaataacatcaagtacctcacaggattattgtgaggatcaattgagataatgtgttaacggttacttggacatggctgggcgcagtggctcacgcctgtaatcccagcactttgggaggctgaggcgggcggctcatgacatcaggagatcgagaccatcctggctaacaaggtgaaaccctgtctctactaaaaaaaatacaaaaaattagccaggcttagtggcgggtgcctgtagtcccagctactcaggaggctgaggcaggagaatggtgtgaacccgggaggcggagcttgcagtgagctgagatcgcaccactgcactccagcctgtgtgacagagcgagactccgtctcaaaaagaaaaaaaaatattaaaaaaaaagtacttggacattacaaagtactatacaatcaggtggttttaacgagttctaattttgagaaggagtcaatagtagttctctaatatggatcttcgctcggttgttgggtacataggcgcgtgcctggggttaaatgttgccccgcctcatgaggtgagggagttgtctgggccgggttttgggttttgcccacgttgggtcgggagacaaaaggtgtggggcgagcacatggagggttgtggaacgtgtctaaatgtggtcgtgtgtgtct

SEQ ID NO: 129667 - DNA, 295 bp, Homo sapiens
tgggtctggttacccatacgtttactttacaggagaaggcaggtacatgccatctcctcgacacccctgaattcagccatcatggaccacgtagagccagccttctggtctggtcctctctcagacatctgctaccagtgctgctcccaccgtcaccagtcgtgaccataggaatgtgcagtgggagtagggtcaagtggctgaaggacccccgcagaccggaggatgctgctgagggcacatgatactcaatccaaactcacaaaatgacgcctatttctcctgcccacgttgc

SEQ ID NO: 129668 - DNA, 603 bp, Homo sapiens
ttttctctccattactcacaggctgaggcaaagacttaacttttcctgaatacaaagtaaggtatttagaattatcatagacgtatattcagtgtgaaatgcatttgaaacactgccaccacctgcaaatatgtgccatccttcagttcctcccctgacgctgttcaaggcatctgggatatatcaatgagcaacaacaaagagctctgatctcacagcggtggaaagaggtagtgatggggagacagataataaacataaacaccagcgaatattatatttatgtcacaaggagatgaatgctatgaggaaaagtcccacctcctaaaaaaaagccaaaaaaaaaaaaaaaaacaaaaacacacttgggtggggcggggccctgggccctgcggaaaaaaggcacttcctgaagcaaccattccggtggggcgcgggcgggcgccccagggagagggtagcggtgaccagggcgccaaacagcgggctgcccaacgggaagaactccggggccagagaactttagggcgtgggctttctttgcaccaatttaaaaaaacgccggggggggcaacccggagcggctttgtgaaaaaccctgag

SEQ ID NO: 129669 - DNA, 188 bp, Homo sapiens
gatctgtggtgaaacagtttcatcccgaaaccactcccccactgcctcccccactgccccgcccatggaaaaattgtctttcacaaaaccggttcctttttggtgccaaaaaggttagggaccgccacattaaacaacaactcctcactcctctctcctcctagcccttggcaaccaccattttactt

SEQ ID NO: 129670 - DNA, 573 bp, Homo sapiens
ctgatggaagaaagtgacagagatcagtggtaataatgccatgttaatttactagccatattgatcaagattttgattatggaaaacagaatctacttgctggtagtaataggtttcttacaggatcttgtgtagtttatagaatatctggaagaggcaagcaaaccaagctttccttagccaggagaaacaaacacagtggaagagtgttccagagaaaacaactatgtcccctagtcaggtgcttggtgcccatgaaactagggactagatactagaacattccatcatcgaagaaataaatgcctccaccaccttagtaaccacaagagctacagagtttccactttgcagtgcttacttccaccaaacaagtgtatgtttgtttggtggaagggtagaatcatgaaatcctagctgcaagagagtctgggagatggagtctttagaattttcagcttctagtagaaggagatagcatgatgatgtgagcctatgtgttcacaaacccaaatgttgaataagcaaatatcatatattctaaagtgaagaattacatagaacattttatat

SEQ ID NO: 129671 - DNA, 221 bp, Homo sapiens
gccctcctctccctggggctagcacctacagtgctggctgagctggcctggcatgttcgtcctccagcagtggggacttaagttgtcctcggttacttcaggcagacccggcatcacctaaggcgagttccagagtggaatgcggttaagcaagagtttgacaagagtggggttgtgttggaagacactgccttttccttggtcagtgtctccaggtcctg

SEQ ID NO: 129672 - DNA, 446 bp, Homo sapiens
tcccagtaaatgtgcacagaattaaaaaagggaaagagccaaggctagactcccaggggatactaacatttaagaggcaattaaggaaagaaatctgagaaaaaggctgaggagtaaccagaggggtagagaaagaacactgtgaaaggggccatggaatgtgtaaggtagtgggaatgagtggtcagtaagtgtcaaaagccacaaagaaatgtagggaatggtgcaaagcaagttaaggaagctagaatgcatgtgcaagatatagtgagacctctctgaagcagttttcttatggaccaatggaaacaggagggttagagtcagataatgcagaactctgaccagcaggcagaggaattttagacagcaaagggaggaaatgagcttaaaaaaaaatgcccatactggacttaatgagtactaactatgtataaagtactctg

SEQ ID NO: 129673 - DNA, 1285 bp, Homo sapiens
cacgcgagaggagcctggacgggctgtcaggattctgtttatgctggggcctgagcacactgcacctttcccttgcggccagcggtggctgcatccatcacgcggggcaggcttccttcttgatcccttgtctccttgcatcccgtagccctgagtctacatattcaggcttcaagatacaatctccccagcgtgattgtttaataacagattttgtcaatgtgaaatcgaaggcaattttggagatgaatccctttcaatcaaaaagctggaaactttgcctagttgtcattctgggcatgtctttagatcagttttcctgtaacttccttctgatgaaaactcatgctggggaatccctttggcacgtctgcctctgccactccttcatctctgttttctgggtgagaccccggaggacacggatgggcagtctctgccacagagggtttggaggtgatggctcatgtggaaagagagtcagctgccaacctcaaaacaaacgtgggaagaagagggcgcagcacaggcccaaggcttagggcaagacctgctttttcaataggggaaatagtggacactctctgagttgcctgctgcgtcagcaccggtgtgggatgctgcttgggttagcaggttagcatgagtggctccacatgctagagggagtgagaagaggggtcccgatgtgccgtggactttctccacgccctctgctgggccatgtgcccgcactgtctgtgaaggagtccttgacccggctctgctgtgaggagggagcctcagaaccctggggcctcggtgtcaggactggagcagggccagtgctttgaggtaggagatcttttccactttgtggaccagagggtctctcaatagaactgccgaacggagttgctgaatcacacaagcagctgtggacagcacacctgtgaatggctgtggctgtgtcccagaggcgttatttacagaagagctgggtgccgggtctggaaagcccaggggaaccttgggctttacctgctggctttggcgaacagaaggtccccaaacctgtgtgcgctgatgggggctgacgacattaatgatgctgaaatgagctggcatgggagccggcagctggctcctgcctgaacagggtgctgctcagcggaaatccagtgtgagcctgtgtcttgcagactatttttgtttatagtctattagaacaaaatagtttgctggcagactattttttgtgccgattctttggtcatgtgattcacagaggtcccacttcagtaga

SEQ ID NO: 129674 - DNA, 541 bp, Homo sapiens
tgctgagccttatttttctggttaatatgttttgatacgatttctattctatttggcaagtctttcaacactacccttaagaaaaccttttaggccagggatgtggtggctcacgcctgtaatcccagcattttgggaggctaaggtgcgtggatcacctgaggtcaggagttcaagaccggcttgaccaacacggggaaacctcgtctctactaaaaaaacacaaaaattagccgggcatggaggtgggtgcctgtaatcccagctattcaggaggtagaagttgcagcgagccaagatcacaccactgcacttcagcctgggtaacacagtgagactccatctcaaaaacaaaaacaaaacaaaacctttttattacgcaaaatatcaaatgtatacaaaagccgagagaataacatctccattcagagagaataaacctccatgtatcaattaccagctacagcaatcatttatggcctgcattatttcagtcatactcccaactactgccccactccatccccagactattttgaag

SEQ ID NO: 129675 - DNA, 908 bp, Homo sapiens
cacctaactttctggcaacattcctgttttccaaaaaagcagctatcataaatcacaacacaattttctattgttccaggaaaataaataaatatatttttagaattttaatttgtgtatttaagtaatgccaacaacaaaaaagccaaattattctgttgattaatttcagtttattaatctatatatttggtgggaaaatttatacataacttcagtagataaactcacgaggtatgtaaagtaattagctcttagtattagctgtgaatttctagccattgtgaaggccaagtcaatttgttatgttgtttagttatattagttaacaatattaggaagaaaaaattatcctctcaaaaagtaggatttccaagaaaacatattacttctaatacagtgctttttataaataatgaaatgcttaactataatgtttagtcaaaatcaccaaattctacaattgatttgaaatctttattgttctcccaaatttcctgcactaaattgaattttctgtaggaaagaattaactttattttttatttgcccattaaaaacgcttatcattgtctaaatttgcatgttctactgaaagtgggaaatagtagcaaatatttgtcagcaagtatggacagaacatgtagttccaacaattaaattgatactgcaaagaacgagatttttcctagaactgtagggctgtaaagtggcgtcaggtcctgcatgcctttgaaattttctgagtccacaattcattatccaacccacttcaccctgctttaatccagttaattgagtcaactctagcaaaatttataattttatttgtatctgatacaaaaccacaaacatagtttcaagtcaggctattattatactggttcctaccacacaaccctcccagc

SEQ ID NO: 129676 - DNA, 701 bp, Homo sapiens
ggtttgcaggaaggaaaataagaagagggcaccaagacagtggcaggagcatggttaaaatgatagaccatggaacttaagctggataggaaaagaggtgaagatggtatagctgattaggagaaaatgaggagctaagggactacattgtctcatggtgggtccaagaacagagtagaagtaaatgagggggctagaaggatagaaagttgtggcccaagttgggggtttgaatttaatacttcaaaaggaagtccagagatggggccagaagtgggatggctagaaaggtctctggaaataaggggatcaagggaccaaaaagtctgggtgatgaatagatcattcatgtggatcctaaggtcacccaagatgatggcaggactaagccagatgtcagtcttcaatgaatgaaggaaatgtcaggagataagtagaaaacactgaggaagagaaggtaaggagcacacagcaagactgctgcagccttaaagaaataggggcttcttacacaagatgagggaatctggaggcaacagtagagataaagaattagccaggtgcagtggctcacacctgtaatcccagcactttgggaggccaaggtgggtggatcacttgaggtcaggagtttgagaccagcctggccaacatggtgaaaccccatctctactaaaaatacaaaaattagctgggtgtgg

SEQ ID NO: 129677 - DNA, 743 bp, Homo sapiens
caggagagtttaaaaaccttttctgctgcttgccctgtgaggtgtttaaacagaagaaccgtatttggggtactgtattttacatcctagccaactgaaaataatctataggctgggtgcagtggctcacacctgtaatcccggcactttgggaggtcaaggtgggcggattacctgaggtcaggatttcaagaccagccttgtcaacatggtgaaactccatctctactaaaaatacaaaaattagctgggcatggtggcacgcacctgtaatccaagctactcaggaggctgagacaggagaattgcttgagcctgggagacggaggttgcagtgagccgagatcgcaccactgcactccagactggctgacagtgcgagactctgtctcaaaaaaaaaaaaaaaaaaaaaaaaaaaaatttttgggccccccgcggccccggcgaagaagagtttctgagaacacacatcgcgtgtggagggccgcgcgaggcccacagaagaggcatagggtgaacacggggcccaaagggtgttaccccagaggaaaacccgggggccgcagcacaaagggcgcgggaattctcccccaagattataaaaaacgcccgcgggggaaaaccgcagaagcgttctcgtgaaaaattcccaaggtgggagctcgggaaggcatccaatacaggggggatcacaagcacaacaggaagccacaggacacccgcagattcaaatttagcccgt

SEQ ID NO: 129678 - DNA, 721 bp, Homo sapiens
attctttagttggaatatggattttcacagattcaggtttctgaaaacaaaatttaactgctgtcaattatataatttcattttgaaagcctatagtcagtattaattagattttcatttatttggtcatatttttatataaaaaactttataattaaagttttttttatagaacatcgtagatagctttatcagcataacattatgttattcctgcttttaatttttcttattctttggatagtatttccataaagtcatagttttacatgtaagtgtgccagagaaagtacatttgtttctagtatatgtttatgtttgttaaaagacattcacacagagtttggcatgattttatagtctgtgctcaaaagagcaagagagaaattgcaagatagtgcaggtcagaattgaaataatttggcagagtttggtgagaaagcttgcttagcagctgcctaggttaactttgcaccatccattcaaagcatagttcagttctgagatataaaaatatataaccaattaaatttagtttcccagaggtaaattttaaaatgtaaaatataactttgatttaccttgtaagtacattgaaacatcttgttattaagtacaaggatagttttatatttatgaggcagtggcttttatatacttccttttttccttcctttcttaattttacgtttttgaaatcttaatttgcattgacgtttat

SEQ ID NO: 129679 - DNA, 653 bp, Homo sapiens
  misc_feature (622)..(622): n is a, c, g, or t
agaatgaataaaaaggaagagagcttcagagaaacgtggaacaccattaactgctccaacatacacttagtatcggaaggagaggagagagagagaagggagaaaaaaattatttgttgaaataatggctgaaacttcttaaatttattgtaaaacattaatccacacatccgggaacttcagtgaactttagaataaatgcaaagagatccgcaggcaaatacatcatagtaaaaatgtggaaatccaaagaccaggagaaaaccttgaaagcaccaagtaaaaactacttgtacattttaaggaaagtcatataaaattctgatttgtcatcagaagcaatggaggccagaagcatggaatgacatattcaaagtgccccctaaagaaaaccccaaaacagaaaggttaaccaaggaccctatatctagcaaagtgatctttcaaaaatgaaagcaaaataaagaaattcccagataaacaaaaacagaatttgttgctaccagacccaccttacaagaaatactagagttcttcaggctgaaagtaagtgaccacagacaataattcaaattcacacacaaaaacaaagagcaccaataaaggtaactgtgtaattatnaaaaacaataaaaaggcatatttcttctctt

SEQ ID NO: 129680 - DNA, 1024 bp, Homo sapiens
  misc_feature (622)..(622): n is a, c, g, or t
agaatgaataaaaaggaagagagcttcagagaaacgtggaacaccattaactgctccaacatacacttagtatcggaaggagaggagagagagagaagggagaaaaaaattatttgttgaaataatggctgaaacttcttaaatttattgtaaaacattaatccacacatccgggaacttcagtgaactttagaataaatgcaaagagatccgcaggcaaatacatcatagtaaaaatgtggaaatccaaagaccaggagaaaaccttgaaagcaccaagtaaaaactacttgtacattttaaggaaagtcatataaaattctgatttgtcatcagaagcaatggaggccagaagcatggaatgacatattcaaagtgccccctaaagaaaaccccaaaacagaaaggttaaccaaggaccctatatctagcaaagtgatctttcaaaaatgaaagcaaaataaagaaattcccagataaacaaaaacagaatttgttgctaccagacccaccttacaagaaatactagagttcttcaggctgaaagtaagtgaccacagacaataattcaaattcacacacaaaaacaaagagcaccaataaaggtaactgtgtaattatnaaaaacaataaaaaggcatatttcttctcttaactcatttgaaaagcaattctataaaacaatatgtattcatgtattgttgggtctataacatataggaatgtaatttgctaataattgcacaaaggaaggcagtaggggcaaagctgtactggataaaggaaatgaatccagataattcatttctggattcttgaatctacaggaagaaagagaaatagcatttttttttaaggttaacataaggctgggcgcagtggttcacacctgtaatcccagcactttgggaggccgcggcaggcggatcacctgaagtcaggagtttgagaccagcctggccaacatggtgaaaccttgtctctactaaaactacaaaaaaaattagctgggtgtggtggtggg

SEQ ID NO: 129681 - DNA, 606 bp, Homo sapiens
ggagccactggacaaaagaatggttcatgtcctgggtgggatggagcatgatggagccaggacagcatgagatttcatcagactattcagaatagtgtgtaatttaaaacttatgaattatttctggaattttccatgtgatattttctgactgcagttgaccacaggtaactgcaatcacagaacgcaaaatcttggataagggggaatctactgtaaaatattaaggttgctagaattaccttagtatcaggacttctgcaaccaaggccatattacaaaatttaaacttccctcctttactcttcttccctctccatagctattgcttttgcagacatttctgtcaattatatttgagcaagttagaaccagtacattcatgacttcccttctctccgaaggcccttttagtggaatacaattctctcctcctgttactagttttcttctctaggtttatgaagttaattttgacctatgatttattttttttctccccttagtgaggtctttattttaagcacaatgcttatcctgttggtgaaagtttatgttactgaaacaattgataattggctcggtataattttgccacttgaaatt

SEQ ID NO: 129682 - DNA, 298 bp, Homo sapiens
ctgtatcctaccattattgttttctgagcattagcaacatgtttatcaacattctctactccacataatctctcaatatgctatctatatagtgccatatttattaatgtaaaaggggaagggcattttcttatacatggtacttctgatgaactacaagtaactcagtaaggaaataccatggaaatgattacctttgagaaaaaaggcagacagattaaaggcaaaggaggacagggccagattataaacattttctatgtggagatgaaattgtctctaggaaatcagtggggaa

SEQ ID NO: 129683 - DNA, 692 bp, Homo sapiens
cattttgtccattcaatggacatttgggttgattctaccgcttggctattatgaagagtgctgctatgaacatgagtgtgcaaatagcatgctcgttttgagaaaacattctggcagcaatatagttggaggatagaatgaagggtttgtatctctttgatgtatcagatgatgtaggttttttatgcaaacagtggtagctgtggggatggacatgctgtgatagatttgaaaaagaggcttatagagttgaaaataattccagattcacaattgtatgttgtgagggaggaggaaatgaggaaaaaggaggggttacagttggtttataggtagagaatgaataaagacatttgtattgaagactatgttttcctagggaaggatttgtgaggagacgctgtgcttgaatggacaggaagaggaaaacactgggaagaaacaaggggatgcacaaatatttcaacatccagacctaatttatatgcagggaaaaaattcagtcatggaaactgagggatttctttgtgaccaattttgtgtgttgtgtgttgtgtgtgtgtgaacttgcagcatgaaagagcgctaacagaagaaatgtcataagaggcttccttactttatgaagcaatttttagatagctagggtttaagtaccattattataggatcaaagattatatgtaatgcca

SEQ ID NO: 129684 - DNA, 693 bp, Homo sapiens
gaatatgatacaagtggcatcaggaaatgaggaaataatggaactattttttttaagtggaggtagtttgttctccaagggggaaaaatagaccatgaactatacacaaaagtgaatccagagattaaaaacagaaatatggaaaagctatgtactaaaatgcatatgaccttgggaatagggaaacattccttggaacaatttgagaaatacttagcggttctacttatgagtatgaatgctcaggaaatacgcactaggatatttactgtggcttgatttgtagtagccaaaaattagaaacaactgagaaagcccatcacgaacaatatgggaaattcttatgtaatactatatatctgtaaaatgcaacaaatgaaatccacatgtattaacagaaagatcccagaattgttgaggggggatcaagttgcagaatgatacagatagtacaatgacttttttgtaaatttgaattaaaagtttcctcataaaactcagtactatctattggtaatggatgcatatatgtatgtacatgtttttgaaacggattggaaggatacagaacaaactcttgatagtggtcacctgtgaagagtggagaagggaaaataatgagtgtgggaggtgggatgggtattggttaaaggggacttcagctttttatataaacatccacttctctttcaa

SEQ ID NO: 129685 - DNA, 380 bp, Homo sapiens
gctgagctggcactcaaactacacaagtccttccctcgaaaggcagaggaacctcaccccatagccaccgccccaagccacaaggagttctgtcagagtactgctactgctcatgttcccttagggctaaaggtctcttaagtcagcttgtcatgaatgctgcctcttcagggcagtgggctcccctctagcccaggacaggtccagaaatgctatcgaagaatcaagttctagaatcaggggccccaagaacctgcttggtgctctgcccctctgtggccatgctggtgcctaaggtgcaagacaaggtccccttacttttccctctgcttttctcaagcagaaggagttttcctctgtagccaccacaactggttatg

SEQ ID NO: 129686 - DNA, 517 bp, Homo sapiens
atctgcaagctagccaatgaaaaaagctggtaccacatccaagttggaaagcctcaaagccaggaaagctgacagtctgaggccaaaggcctgagacccccagggaggctgctagcctgagtcctggagtccagagaccaaagaacctggagtttgatgcctgagggcaaaagcaaaatatccctcactagaaggggatggggaactcagcacgctggctctgtttctcttactgcctgctttgttctggcagccgactgcattggatggtgcccacccagagtgggtcttactctcctcattcactgactcacatgccagtctcttctgtaaacaccctcaggaaatgggaagtacttacctggggcgatcacaagccctgatgaacacattctgacacctgatagctccttctccaagagtcctgagtctttgccaggccctgccttggaggacattgccataaagtgggaagataaagttccagggttgaaagacagaacctcagaacagaaga

SEQ ID NO: 129687 - DNA, 633 bp, Homo sapiens
ttaccaacattgaagcaaaaaagacagatgtcattcacaacaatgaatgatacaatagtaaacttcctgcctttatgtgtgtttctttcttgttaaattcaaactttagctctttgctatgtcagaaaatttttgcttttacatggctttgatgatttaaatgaagtgaatgagcatgaacgaaaataattcttaagtgaatgaaagtctgaggcttttgcaatagaaagtatataattagcattatttttggtaatgagctttattttgaagctgaaaccactgctaacaatgtttaaaattttttaatttccttgtttctttaaatgatttatttgggatactaacacagagttaaataactttgaattccattgtaagattcttttaaagtattttgtttgaaagtctttcatttcttctaattaggtagacaatctccatttgctgctaaggcaactctaccacttctctttttttttttctttttttaagacaggatcttgctttgttgtccaggctggaacatagtggcacaatctcagctcactgcaacctcagcctcctgagtagatgggactacaggcgagcaccactacactcagctaatgtaaaaaaaaaaagttttaaggc

SEQ ID NO: 129688 - DNA, 743 bp, Homo sapiens
gtactagaagttacagccagagcagtaaaacaagataaaaaatataaagggcatctaaattggaaaggaaaaagtcaaactgtccttatttgcagatgatataatctcctatttagaaaaacctattgactccaccaaaaaaactgtaagaactgataaaaatttcaataaattgcagtataaaaatcaacatacaaaaatcagtagcatatctatatgcaaacagtgaacaatctgaaaaagaaaccaaaaaagtaatctcatttgcaatagccacaaaaaattaaaatacctaagaataaacttaaccaaagatgtgaaagagctctacaactaaaactatgaaacattgatgaaagaaattgaacactatacacaaaaaaggagatattccatgttcatggattggaaaaatcattattgttaaaatgtccatactacccaaagcaaaatttatacggaactatgaaagattcagaatgaccgaaacaatcctcagctaaaagaacaaaactggaagtatcacattacctgacttcaaattatactacaaagctatagtaaccaaaacataatggtactggcataaaaacagacacatagaccgatggaacagaatatagaacccagaaacaaatctatgcatttatagtcaatttgtttttcataaaaggaccaatgacatacaatggggaaaggacagtgtcttcaatacatggtgttgggaaaattagatatccata

SEQ ID NO: 129689 - DNA, 195 bp, Homo sapiens
acctgtctcattcacaggcttctcccaaactaaaacaaacactcccttagagagctgtggcttcccactgctgcctatcatgggaggagcacaccacaggtgcacccagaacacgtctaatgacggacaactgggtacccaccttcaaaagcatgaggcatggctgggcgcactggctcatgcctgtaatcccaa

SEQ ID NO: 129690 - DNA, 590 bp, Homo sapiens
gggtctaagataaataagcattgcttatttgctgtaatgtttaccttatttaagtaagaaaaataaaaataaacattgcttcaaaatggataaagtgaaaactatcagaatactgcatatttatctatgcaaggaaatatgactgttgtcatggatatgcagtttggtatctcaagcaagaaggtatcagagaatgtgaatatggcatagtttataagatctgtgacctaataatcatacttctaagaaatgcgagggaataattttatagtcttgaagtgggaaaatgacccagaagccataaaggagatatattttactacttaaaactaaaaaacaaacagccaacaacaacaaaaaaaccccacaatatttatctaatatgtctaagaaattcagacatagtgaatttttttttttttatttgagatggagtctcgctctgcagtggtgcaatctcggctcactgcaacctccacctcccagattcaaccaattctcctgcctcagcctcccgaatagctgggattacaggtgcctgccaccacacctggctaatgtttgtatttttgctagagacagggtttcac

SEQ ID NO: 129691 - DNA, 157 bp, Homo sapiens
acagggtttctttctttcctttttttaatccatagatgaagaggggtgtgagtgtgtatgtatgtacatgcatatacacaggcaaacttcagagatactgtgggttcagtttcagatcactataataaaacaagtatcgcatttaaagcaaggcaca

SEQ ID NO: 129692 - DNA, 521 bp, Homo sapiens
  misc_feature (30)..(30): n is a, c, g, or t
ggtggcgttcagaggatcccctccagtaangtgtgccaagctggtcttcaaacagtcatttccccttggcctccaaaagtgctgggattacaggcatgagctatcacacccagcccaggtcttaaaaatattttcatattcttaaatttagattccacagttctgcttacgcaaacaatgaatagaatacacttaaataaagactgatttgcatttgagctgagctgaacatcggcctagtatggatacctagtgattctaattttgttaagctctattttctcaatatttcattgacatttcttatagatgagtagttgaaagaaaggtagacggtctagaagctacttgaattttgcctagtacctatgtataattgaagaatagttgtttgcattttaggcatatactgttgtctgcctaattttgatcatgaagcctgcaagagtgatatagggactctaacagcctcatctcagtgaaatagcataaccatttcatttcccctgccatagaagata

SEQ ID NO: 129693 - DNA, 588 bp, Homo sapiens
gtaattttacacacacacaatataaatgtatacacacacatatatgtggttttacatatatatgtaattttacacacaatgtaaaaaacgcaccccttctcccatataataaacctttccctggccaggtgcggtgagtcactcctgtaatcccagcactttgggaggctgagaccagtggatcacttgaggtcaggagttcaagaccagcctggccaacatagtgaaaccctgtctctactaaaaatacaaaattagccatgtgcagtggcacgcacctgtaatcccagctactcaggaggctgaggcaagagcatcacttgaacccgggaggcagagattgcagtgagccgagatctcaccattgcactccagcctgggcaaaaaaaaaaaagggaaactccgtctcaaaaacaaaagaaaaacctttcccctggatatcacttaaatggatgtattgtgatgtattgttttctgaaggatttatcctgtgtattggatcactcattcaacaaatatgttgagtaattttgtatgccaggtatagaatatgcaatataggttcataatttgcttttatggcctaat

SEQ ID NO: 129694 - DNA, 600 bp, Homo sapiens
aaaaaaataaaaataaaaaaagaaggaaaaaagggcagacattttcacaaaaatgaagtaaacctgtcatacctcaaagaaaataactgacagtgtttgctacctataaaacagttcaaaggttgggcacagtggctcacacatgaaatcccatgagttcaagattggcctgggcaacaaagtgagaccttgtttctaccaaaaaaaaaagaaaaaaaaatcagccaggtatggtggtgcaaacctgcgttcctagctacttgggaggctgaggtaggaggatcacttgagcccagcaggtagaggatgcagtgagccatgattgtgccaccgcacttcagccagggtgacagagtgagaccccatctcaaaataaataaaaattcaagctattaagcaaaaatggaattttgtaaaacttgtatctgccactacaagctctatagcttacaaataaatgcttacctgatgtcagtggcaaaagtaacaaatctgactttttaaaaaaatgtaataaaatgtgtcaacatttggaagatctttataactcagagaaccaatatttttttagaaatcacacatggccaggcgcagtggctc

SEQ ID NO: 129695 - DNA, 415 bp, Homo sapiens
ttataattccacaaacttttatagaatgccactatgtatcacacactggcctaattatctccataaataggcattttattcattttggcctgttcattaaattgcaggagttattttggagtcttgagcctattatctaaaatattagatatttttatcaactgtttgtcacctaaaaatttgacaaacatgttatttatgtaattatagaagtcattgagggaagatgttgaaagggactggaccaaattaaaagatagtagaaaccactggaatatggcttctcggctgtcaaattcttattctcatccagttggggctggatgtggaacaattatgacaaggtggaatttcagatatccaatatgacttaaggatagtgtggttcctcttggtaatgtttaagaggctatcc

SEQ ID NO: 129696 - DNA, 294 bp, Homo sapiens
gacctctatgggaagatgacatgcgaagagccgctaaaggtgtcaggacacaagagctctttgtgcaggcacagtgggcatcctgtggtgccgttttgtggcaggtctcactgtttattggcaggaacaaataaaaatagcaaaagtctcactctttaacgggagaggcaaaacaagcgtatgttccaagcataaagttgtgttttgtgctttgatgaaaatcgacaataatcgtagctaagatttattgggtgctgactatattgcattgttgcaaggcatgtttgtaagcgt

SEQ ID NO: 129697 - DNA, 551 bp, Homo sapiens
tttttttaatgaggcaaaattcacataacatacaagtccctgtatgaaaccatacacttcagtatcattaaatacattcacaatattaagcaatcatcatctctgtctagttccaaaacattttcattaacacccccgccccccaaaaaaataaccctgtatccatcaagcattctccatcccctcccctttcccccagctcctggcaaccacttacctgctttctgcctctatagatttgcctattctgggcctttcacataaatggaatcatgcaatatatataataaccaaaaggtagcaacaaccaagatggccatttggttgacgaatgaacaaacaatatgtgcggtatccatacaatggaaatattggtgcctactacatgtggatggaccctggaaacatcatgctaagtgagagagagccttggtattgtctcttctccccaggagattccaagatgcagccaaggttgagacccactgacaagcaatggatacgatcgggtgcagatgaaataaggcagccaggggcaggagggacgtctc

SEQ ID NO: 129698 - DNA, 806 bp, Homo sapiens
aaaacttatttatagaagacttcagaaagaataacaacactaggaaaacataatttgggctggccgtgctggctcacgcctataatccaagcactttgggagaccgagacagacggatcacccgagattgagagttcgagaccagcctgaccaacgtggagaaaccctgtctctactaaacaaacaaacaaacaaacaaaaatacataaaactagccgggcgtggtggcgcatgcctgtaatcccagctactcgggaggctgaggcaggagaatcgcttgaacctgggagatggaggttgtggtgagccaacatcgcaccattgcactccaggctgggcaacaagagcaaaactcccatctcaaaagaaacaaggagacagattttactctgtcatccaggccgaatatagttgacataatcataatgcagctttgaattcatgggctcaattgatgctcctgcctcgttcccccaaagtgctggaattataggcttgtgccacctcactgagctaattttattctttatattatatgcatttgttaacctgtttcacaataaataatactgtggtaacatcctgatgaatatattttatgtacattctagtttcacagcagtaaagattcctagtggtatattgccaggtcaaaggggtgtgtgcattctaatttaatagagcctgtgtacttgccctccaaaacattctagtctttaaatctagccatccttaaaattgtaaattcttgggacctgccaccagatagaagacttttaatatataatggcattaaaaattaataa

SEQ ID NO: 129699 - DNA, 830 bp, Homo sapiens
cttaacaacgtgccttaaaaattattgttcattggttaaaactgagtggtgtagatgtgcgtatttaactctgcccactgttgatggacatttaaattgtgtccatgtttcactaaaaaaaattgctgcatttgtgctatgaaaaaaaaccctatagagcactcaaatgtccattagaggtatcatagataaattgtggtgcattaccagcctggccaacatggtgagaccccgtctctaccaaaactgcaaaataggctgggcgtggcggctacttgggagactgaggcaggagaatcgcttgaacctgggagatggaggttgtggtgagccaacatcgcaccattgcactccaggctgggcaacaagagcaaaactcccatctcaaaagaaacaaggagacagattttactctgtcatccaggccgaatatagttgacataatcataatgcagctttgaattcatgggctcaattgatgctcctgcctcgttcccccaaagtgctggaattataggcttgtgccacctcactgagctaattttattctttatattatatgcatttgttaacctgtttcacaataaataatactgtggtaacatcctgatgaatatattttatgtacattctagtttcacagcagtaaagattcctagtggtatattgccaggtcaaaggggtgtgtgcattctaatttaatagagcctgtgtacttgccctccaaaacattctagtctttaaatctagccatccttaaaattgtaaattcttgggacctgccaccagatagaagacttttaatatataatggcattaaaaattaataa

SEQ ID NO: 129700 - DNA, 705 bp, Homo sapiens
cacatgtacagctgtcccctgtccccacacttgtacagcttcacccattatcaacataccccaccagagtggcacagttgttgcaactgatgaacctacattgatacatcgctatcacccaaagtccatagtttacattcgggttcactcttggtggtgtgcattctgtaggtttggacaaatgtacaataccatgatatctactgttatagtatcatacagagtagtttcactgccctaaaaatcctctgtgctccacatattcatcttttcttcgtaactccctttaaaaaatactagtttaggcctatatagagtcaattaaattgaaaccttttttcgagttcgatttctgcagggctaaatgaacattttatagaagacagaagaagtactaaatatggcctaacttcttctttcttttatattggagataggtttactaatatctggtgaataagaaccctaccccaatagaatgcattttatttcagatgtttcaactctcttttgattatcttcaaagggacaatttctcttaaaaaatcttattataattcttctttgtgcaatagtagatatatcagacatgttgtacccttccccccaatttacctgttgaaaaaatttgatagttcacctgggttcatgaagagaccaattacatgctattgaatattacctccagtttgtcttgtctttgtc

SEQ ID NO: 129701 - DNA, 439 bp, Homo sapiens
gtagctaggactgtaggcacgcaccaccacgcccagctaattttttgtatttttagtatagtcgaggtttcaccatgttggccaggatggtctccatctcttgagctcgtaatccgcctgcctcggccttctacagtgctgggattacaggcgtcagccaccacacccggccctatatgcattcatttttatgtaaaacatatgcatcaattcttttgtatgaaaacgtttggtcattactgtggtacaacagaagaccaggtcagtaccatatttttttttcatatgtacacggatttttattttgttttagacattgtcttacacacaatagacattcagtatttgttgaaattaatgaaagaaaagagaaacatgaaaacggtctgagaagacaataatctgctttttaatttatagacagcaattaggtcaaaca

SEQ ID NO: 129702 - DNA, 313 bp, Homo sapiens
tagttttctctgtctggacatctgcttttagcccttcttccaagcagggaggggcaggaggacaccatttttaaacttccataaccaattaatgcacaggctactttcagcaaatatgtccatcctttgcaagagaccaactcctacacaacccattgaaaacctctctttaatattaacagtggaaaagaaacatattacatagaaccccttcgaacacattattaagtagttggaatggttggtgtgattttaaagttactgaaaagatgaatcgaacattctcctctgcaatccaacaactctacaatct

SEQ ID NO: 129703 - DNA, 766 bp, Homo sapiens
cagaaagtttaattcattcattcaatcagtgtcttcttgggtgattacagggcactgaggatccaatcataataatacttagagtctagtgtggcaacagaggagtaagcagttacattacaaaaagtgtggtgtctggggatggttccagatgcagcaggtacacagggttcttagtagcaaacagcaaaagtcaatttgggcttaccatatgcagaaaggaaatttattacaatggtatgtgatagctgatgaaactccagaagggccagagaacaaggcttagaagttgggaacaatgcctttaaaagtcgtggcgaggccgggcgcggtggctcacgcctgtaatcccagcactttgggaggccgaggcgggcggatcacgaggtcaggagatcgagacaatcctggctaacacggtgaaaccccgtctctgctacgaacacaaccacacaacacatccagacacacgaccaccagctgtattgcgcagccacagacaccagcggcagacagacttatcacaaaacaccaacctgatgtgcgacgaccggcaggcaccagacgactgcagaagcgaggacagggcgccataaggtggtccctcaaaggaaactcccggcggctccgaacaaggaggaggggattcacaaccacacaaaaaacgaacacgcggcgaaccaccgagccttggcaacaacatcacaaggggagtaggaaggacaagggcgcatcacacaaaggaccacccgaccccagatataca

SEQ ID NO: 129704 - DNA, 347 bp, Homo sapiens
aacaactgtccttctctatctgggaatctagtggaaaacagcatattgagtttctgactaagagcaactgtacacctcaccctagaactgccagtattagtgatagacagtgctggtgtgcgcctgagagggatgaagttaagtgcttgtaaacaaagaaatgcaattaggttgccctaaagactgctaaccgcttcctgagagataacccaaatccagctatcaagaaaaacaaaaactgcttttgagaactgtgggtctctaaccccatcatgggcaaattacaactataaaggtgctgaaggggaaactgtccatccctgctgactctatcaatccgtggaccc

SEQ ID NO: 129705 - DNA, 409 bp, Homo sapiens
cggaccctgtctcaaggaaaaaaaaagtgatttaatttcgaaagctgcataacattttctgccctttgacaaacactgtagaatttttaccaaccaagttgtaggatttttgcaaaatgagattatactataatatatatatttcttcaacttttttcacttttttaaatgtacactcattcccaactttttttttccacttttcaggttttttttctcttacatattggacagccttgcatgtcagtttcattatttttaacacttcggtatggatgcccatagtaagaatataccttaccatctccttttcagcgtgatttagtattagggatgcatagtagggccatttcaatgctgaatagggctattttctgtgtcttaattgggggcttcactcttgaggctg

SEQ ID NO: 129706 - DNA, 725 bp, Homo sapiens
cagttcgttgaatccacagacgtggaaaccatgaataaggagggccaactgtgctcagttttttactatcagagaatttttagtgtgtggcattcatttttttcttgcatttcctattttcataagtcttaagtttgaaataccagcttgctcaattaaagcaggcttttgcttcagcagcattattttgtcttcactagaattatatgaagataaaaacaagctgggaaaaacttaggtggagttggaaaaataagattgaggaaaatacagatagtgatctttgtagtcattctcataaatgaagcttttaaatacatgaatttaactttagggtcagccctgctacacagttccttgctgtgaaaagttagccctgcgagtagaattctccaaattgggtcttcggaataatacaatgagtaattgagcattatccagctttggatataactcttgtacttaaaagactttagagcttatcattttatgtatttcatttatttcatttagatctatgagagattacatgcatttctgtgatttattagtcactaattttgttttaccatatctgtcattgacactatagataatcagaatttatgtatatttaataacttaacttttctgaccaccccaccccaactccattccctttgttttatgtgtctgttgacttacagtgccacttgaacagcatatcagtgcttcaactcttgatc

SEQ ID NO: 129707 - DNA, 455 bp, Homo sapiens
cctggctctgaacttaggggagggaggtatatggggcaggttggttactgacctggccacggttttcacaggcacagcagatcagagtatctgtaaaaacccctgaatctgcacacagtccaccatgggagcagaatttctactagctctggtcttcaaccatcaatgtttgcaccacagggtaccgactcctcaacccccatttctgactggttccctggtccctctggcagccatcctggaagcctgagttccccaacaggagtgacatctgctacgcaggccagggttatgggaactccagtgggcatacttgggccagaggtgcctgggggtcagaataggagcactgaagttcagaaggctcatggaagccccaggcgccaggcagtaatgccagttcttgatcacaagtgacatcagagttgggagacgggcctaagttcagagccagg

SEQ ID NO: 129708 - DNA, 469 bp, Homo sapiens
ctcgtgaacatcaggaagatgaaatgaaatggttcaagactggaacaataccattatctgcatcttgactcctgggagataatgatatctcctgctttcctctacagacctaccagttttctctgctttaagggaaaatccaaatgcatgagacctgtgcattcttctacataatcaagagtctggtttcttccatcggagtgtatggagttaaagtggtatactgtacatggcatggtgtgataggtgggaatatgagctactgggggaaaaagttcttacttctagccacttatacaaagagaggccatctcagtgtaatctgaaaaaatgctcactttataatgctgtatccaaggcccatcaaaaactaaatggatgtatttgtactaaaagttggggaaagttgaatatctaaacctctgagcaaatctttcttaatttagaaaataaaatagagcatcattgt

SEQ ID NO: 129709 - DNA, 510 bp, Homo sapiens
gcctcacagggtggctgtgacagttagctggactataacctccatcacctggcacgcatagtgtctcattgacctcagacacttggcgcccggcctgggtgcgggagttctccctgggagaagtctgagctcacagcttagcaagctcttgctgtactgcggaatttctctccctagaacgtgcgcggtgatctcctacttttgtgtgtatacttactctttcgtggacagtgtatatatatatgtatatatacatatatatatacacattttttttcccaaccccttttttttttccttttttttgtgtgtgtgtgtttgagatggggtctcgctgtttcgctctgtcccctaggccggagtgcagtggcactatctcggctcgttgcaacctccgcctcccgggttcaagacattctccctgcctcagccttccgagtagctgggattataggcgcccgccaccacgcccggttagtttttgtatttttagtagagatgaggtttcac

SEQ ID NO: 129710 - DNA, 358 bp, Homo sapiens
gcgagctcggcaccccgcccggtgttgcgccctctaaatttgaactaacagctgtgtagtgaggtaaatcagtattccataaacaggtattaatttaagtgctctgagtttattataccaaaagtatttattctacaacactggattaaagaacaaactactactggagctataattatactaaaacattgaaaataaatcacgaagatgactcaagcttgaaaaatacctaaataatagttgttataaatagcttttcactgcagactacacctccaactacttgtttgctttctttttgcttgaatttttttaaatacaacataaaaattccatgaagaatgcatagtctgtgcac

SEQ ID NO: 129711 - DNA, 129 bp, Homo sapiens
cctctttatatgtaacacatcatttctgtatctttattcccaaggaggggttttcctcctcctattccaacattatttcatctttggtaagtttgctcatcagtcagaattactacttgaaaatataag

SEQ ID NO: 129712 - DNA, 562 bp, Homo sapiens
ctgcccaaaagagttccacttttctttggaagcaaaagctaaaaccactacactggtccctatgagctgattctttggcctttgtgatcccctgactgactcttctattctttatttgatttgagttcctctctagccacaccagcttcacctgtgggttttagcactagtttttccccagggttagaatactaatccctagaatgccacctaactagcttcctgcttccttctagtccccgctcacacatcacattctcactgagtcctacactgaaaacaccattaagaacataattcctaaaacccaatctctctttacattctctaggcttctcttttttccataatgtttattgttttctaatatatcatttaccttgtcttcttttctattgcttttaatgctaactgtttatggcctgtcttttgctaaagtggaagctctgtgaagccagggtctgctttatttattcatgtatctcaagactgtgagacaatgtctgacatatgataagtactcaatacatagttgttgaataaatataataggtgtgtgaga

SEQ ID NO: 129713 - DNA, 784 bp, Homo sapiens
atgccgaggtgggtagatcacctgaggtcaggagtttgagaccagccaggacgacatggtgaaacccagtctctactaaaaatacaaaaattagccgggcgtggtggcatgcgcctgtaatcccagctacttgggaggctgaagcaggagaatcttgaacctgggaggcagaggttgcagtgagctgagatcatgccattgcactccagcctgggcaacaaagcaagactctgtttcaaaaaaataaataaataaaattaaataaataaaataaaatagtttttagccaggtttttttcttaattcatttttgataaattatatttttaaggacagtatatccaatttatctaagttttcatactttttggtataaattcatcagagcactgtctcttaaattttttttctgaagttatgtacccttttttgtttctaataatcttgatatctgtgtcttttctgtctctctctctccctcctcccacacccccccccactttctttctcttgccaggtgtttgttttattttcaaagaactaatctttggcttcatttattccatttttaattgtttctatagtgagttctggtctgttactatatccttcattctgcttcctttttcttttttcttcctggtctttctagtccaccttttttgctggcggttccagctttttgcagggaaactcagttcagtgtcgtgaccgagggtcttgcttcctttcctttttcagcctttcagtcagcacatttccaagggcattgactcaccatctt

SEQ ID NO: 129714 - DNA, 183 bp, Homo sapiens
tatacttgctatcctgttgttcatatgcatgctgtattcttcataaatcaagtcataatatgtacatgtgcacattttaagtgtaagaacaattgcttttccagactatcatggcaataaatagatttcaattagttgtaattgagagatcaagggaaagcgtcatctctttatttgaaaaag

SEQ ID NO: 129715 - DNA, 285 bp, Homo sapiens
cagcacttgagtagaaagcaacttattttagtatttttaagaactcaaaacatcaaacaccagattatttgcttttaaaattgagaatgagaaaaatgaacctatattcaaaagatatagcaaagcctgaaagtattgataatatcagtgtttataaggactggggcaatatgagaagactcatgcactgcaggagtgagatttaattggtataagcattttagagggcaatttgacaataggtatagaaagctttaaaaatgtgtgaatgccttttggccatta

SEQ ID NO: 129716 - DNA, 528 bp, Homo sapiens
ctagccggggcgacagagtgagactctatcttaataaataaataaagtttaaggtgcttatttggatgctgctagtccttggggcttttcctagagcctattggtttggactcagcccacataactctccaaccttaaagattttggaaggaaacttgatggctggtaatagccctgagtgattttcatcctgaagtttgaagtaagggcatggatgacaaccattggaagagtggaaagtgtgtttgttctagaggtctcatccaggtaagggaaatgttaaaacttctgcctaggcgtgcttgggtagatagaaggttgtatctgaaaataagtgcagagcaattgagctgagactggtctcctttccatctcgctgttgtcgtgaccagggttgtcatggtgcttgagtgaccttgtccctgatctgttgggcttgtgaaacatacttggcttgtcactgattttggatttcctcttctgtaccctgatgaatatcagataacatcttttggactggcacgtggt

SEQ ID NO: 129717 - DNA, 722 bp, Homo sapiens
cagcatcaacataatgcggtcaccagtggggagtgttttgcccctggcccactcagccccatagatggccgtgatgaagccactcccaaggatgccagtgatgcactctattccggagaccaccaaagtgaaggtgaccttgaacttggatatgtctttatctgtggcatctgtgttcaccgttgccattctctttgatcctgactttcaggtttctgcgccaagaatgggtaactgctctgcaatcttctgacccttgctcaatgttataatttctgccgccctcattaatggttatttccaatttttctccatttgtttatcacatgactacaagttagaggcttcacatgcaaataatgagaggatctggttactgggtctgtctcaatttttcataaagatacatttgtcttgggctttcagaagctcactggaaataatttgagacatgtttctagctcaacaccttcttaccttatttactttaagtccacatttacctgataagcaatgaatacaaggcctttttacttgtctcacaagatctctgttacctgctaaattatttgtaaaagctcatacagcttttaaaatctgttttccccacttcttttcttgtctctcttattttgggagagagttttattttgatagttaccatgtttgtgaataagaaattcccataagctcatatatgaacatcttttacttagaattga

SEQ ID NO: 129718 - DNA, 409 bp, Homo sapiens
tacaagcccccatgcaactattgcttttgcagatgagaagcaccttagagcaaaccagaggttgagagattcttgctaagtaatttttatgcatcagtcaattgttaatctggactacatgtagaatttcattgttaaactgcatatagatttttctttgcactcctctgacttcttgcctctttcctacattctcttgcttcttatcttctcattcctcagttcctgtccaggctgtcctcatcccactcaccatgacgtgtcccacaggcatctccacagccatactccattcatgtatttctattaaagtgctgtcaaatcaactcccagttttctttgatattaccccagaatctctttcaaataaaagttatgtggccgggcacggtggctcacccctataatc

SEQ ID NO: 129719 - DNA, 520 bp, Homo sapiens
gctgttctagaggatcccagcggcgccctttcatttgtaattgacatagaaatatatttaaattggcttaaacaacaagaagcagttactgctcgtgttactgaaaatgaatgtggttgaattcaggtgggaaacgatgcagctttcaaccaggcttcaggatctgctccctttaaatctcagctctgctcttctccatgctagcttcattcccaggctctttctctaactaaaatgtaagcttaggccaggcatggtggctcatgcgggaggatcgcttgaagtcaggagttcaaaaccagcctgggaaacatagtgagaccctgtcgctataaaataaaatgtaaatgtattgctatttttattttatttttttaatatggaacacttcatgaatttgcacatcatctttgtgctggggccgtgctaatcttctctgtattgttccagttttagcatatgtgctgtgaaccaagcactgtgaatgtaaataaaataaaataaaatatcactatcatga

SEQ ID NO: 129720 - DNA, 211 bp, Homo sapiens
tcatttccttttccttgcttatgaacaacgagtcagagcagcccagctgctcagagtgtggcttcaggatcagagcccagctcaagtcctagagccctttctgcacaagtcacccagcctttctttttccttttctttttctttttttttttttttttaatttggatggtgggggttttaaaaggaccaaaaaaaaacgagaaatagggga

SEQ ID NO: 129721 - DNA, 246 bp, Homo sapiens
tttttagtttcccaaactaagaaccttttatgtaaaccataaagaacagctctggatagatccagatttctttacggcttaaaaaaaaaaacttgaaaaactcttttttttttttggagatggagtctcactgtgatgcccaggctggagtgcagtggcgtgatctcagctcactgtaacctctgcttcctgggttcaagcgattctcctgcctcagcctctcgagtagctgggactacaggcgtg

SEQ ID NO: 129722 - DNA, 637 bp, Homo sapiens
gaccaaaaagaatccgttttacactgtgtccaaaaggccagcagatggcgcccagcaagcccaataggcaaaatgagaacatttgatgtaacattccctgcatccaagttattttaggcctaattttgcaggaagcaattaaaaaaacttgatggctttaactaatactatgctagatagaataatctgatggctagatccagctgtttgggaagttctaggaagcttgcttgcctttttgcccttaaccttactttgtgtgtgtgtgtgtgtgtgtgtgtgtgtgtgtgtgtgtcgagtgttgttctttctcttggcctttaagctactctaaaagattacagtatttataatgaggtagaagcatagcaagttctccctcttctgttcattaatctcttgctgtcattctatactgagaactaaattaaagaaaactgaactaacccagctaatctcaaccattagtaggtcacggatgtgtttttggaggatatagactcttttgccctctaatttttttgtttttcttacctccagaactgtaagatgccctctaattttggacaagtgaaatgacagctgttaaccttttatatacctgacatgaaaatcagccaaggacatgccacggggc

SEQ ID NO: 129723 - DNA, 762 bp, Homo sapiens
gctgagcagccaaacagtggcaatccttgcttaatcagcaggaagagatacaaactaataaatgcaggacagaagaaaatgctggaacaaagaaaaatcttttagagaaaagattaaagaactaagatccagaagagaaagtttatttcatgaatactgcaaaagaataaggcacaggggaataaaaggtagattaaagttcacaccacatactagtggtgctcttaaccaaaatagcattaaccagagtcagacacaaccctgaagaccatttggttcaactccttttgtttgttaactactgagaaaacaggaccagagaaagtaagtgatgtgcttagaagtggtattaaaagctgagtttgctccctgactattggttcaacactcttttcactaatataggaccaaagagcacctacatcatgcactgaaacatacatatatcacataagtcttctatttggtgtcagtggtgagggacacaaatgaattagatgagggtgatctttaactgttgttcttacttaattctgatcaaaaagtaaagtagcacctttgggaacctataactaaaacactgtggtaccggtatatgactaaacaaacagatcaatggaacagaagaaaaagtccagaaataaatatcaaatcagtggaaacaagcattggaacaattggatagacatctggaaaaaagaaaaaatttgatccatacttcacactatattggaacaccaaggaccagagttctaaatataa

SEQ ID NO: 129724 - DNA, 367 bp, Homo sapiens
gccgggagagtatgcggctgttgggattctggggtgtatttccgtggagtatgtctccccaggattaaagttaagaagctgccggaaaggttgttgccgctgacttcactttgtgtgcccaccagcacaggcacaagtcatagcagatggatggcaaactctgccatatactctgaggagtttcttaaattaatacgctaggagagaagtcataattaatgcttttagactttcgagccctctgcagcgtgctttgaaatactacaccggtggacactatgtcccttcctcctgggtttgaacacagtgtctgtttatacacagagggtgtttagtacctaagtattctataccagcacaagagagc

SEQ ID NO: 129725 - DNA, 839 bp, Homo sapiens
ggatgtgttgatatttggaaatacggttttggctgtgctttatctcactaaaaaattaactgacaacacccaccatacaacactagcctaatgaggtgtggaaaccaatactgattctgttctctttctcttgattgagagaaggaaccatgtaaagaaacccatcttattttccctctgccttgaaatttttctctatgtccaactgaatgtcttctctctgccttagtcatcattgttagaacttaaaggtacgacttaccctaccatcagctcccaggtcattagaggacaaacatttgggggattttttgtgtatttttgttgttgttgttattcttgttgggggatagtggttgttgggcaggaaaggggatttctagagcaaagtatggcacagacatttttgtggcttcctgttgcttttgcatccaaggatggcctgccctcattattttagtaaatgtgaaattccaaagaaacagtttcttgttttctagtatatatttgcactagctctctaatgcagccataacaaatgtcctttcttgagattttagctgagagtccatttccttgccttatcagcttctacagggcacctacatgccttggctcatggtccccttaaatccgtctcaaaaaaaacaagaattagcaggcatggtggcacacactgtagtcccagtatcaggaaggttgaggctgagaatggttgaaccaggagtgtgtggcgtgaaccaaatgtacaatggctcagcctgggtaaaatcgactgctggaaacaaaaaaaaaaaatttggggcgcccgaaatttacactcttgggcgccattaaag

SEQ ID NO: 129726 - DNA, 279 bp, Homo sapiens
ggtgccacagccatggcagactttggagcccgggcctgcagacccagtagccaagctctcaacccaggagcgatgggttctccaatcacaccttacagaaagcccccaccccacgaggattctggagtttcccttaacccctcgggaacacaaggggtgagggggttcattcctgctctacagatgggaacatgaggtcccgggaaggcatgggacatcctcccggctgcatggctattaagagtcagaactggatcagagcccacgtccctgtcactg

SEQ ID NO: 129727 - DNA, 309 bp, Homo sapiens
acctccaacattggggatcaaatttcaacacgaggtttaggaggacaaacatcccaacaatagcagtagcctttctgcaacctagctctgtctaatccatctcggctccgagagcaccacagtcaagcacaagctcctgaaggagtgaggccggggcagagcacactcagcaggatagaggcagtgcagccacagctcccccggccttcagggctccccagccggtggggctggcttcctgggctttgggggactcggcctcagcgtcaccctgagattccccccacagaggagcgtcgggtaccgagc

SEQ ID NO: 129728 - DNA, 349 bp, Homo sapiens
atggctgagatagagccttctaggcacagaaaacacgtgtgcgttggcccagaaacaacaagaactgagatgctcagttctgcagcagcacaagtgtggggagagaagaaagagaataaagccagacagcagcactggcctgaataacaatgaccttgaaagcttcagggaggaatctagattttattctgagggtaatgcggagcaattaaaggtatttaaacaggagtgacacaatcagatgttcacttttgatattacttgagttgggaaggaatgtttagtatatattaaaatttgacccaagagaaggatattaagagaaggaagtgcctttgcctataaaact

SEQ ID NO: 129729 - DNA, 239 bp, Homo sapiens
aaggggtgagaacatgttatacaaaagcagaagagaagaggtcacagtcaaagcctatagggagattctatcatcaacaaggatggttccaaccctagggcactaacgcaaagtaaagaagggattaaaaataagattatcccacataaaaccctagatctttaaattttacaactaaaatttgaatttccctttaaaaataatttgattcttgatgaaagttaacaataaggatagtt

SEQ ID NO: 129730 - DNA, 401 bp, Homo sapiens
cagctctcccctctcagtcctatgagccattgtctcccacaaggtctcttattggtcatccctgaccacagcatcacatactcttctccccacctcagctgaagggtcttcgactcccttcccttcttctcatctctgataagcaggaggactaacaccactgggtccctgggtccccagcactgtttcaagaagtttacataaaatatcccaattaattttccacaactgctctaaggaagttagagggagatgctgtcaccagcatgcccattttacagattaggaagttgagactagagagattaagtaccttgcctactgttacagcaagcaagtgatggatctaggaatggacacagaatgaacaggaaggaaaggagactcagtgtctctcccct

SEQ ID NO: 129731 - DNA, 389 bp, Homo sapiens
gaaccctattgtgaactggacttgcaagagatctaggttgcgcgctcctaatgagaatctaatgcctgctgatgtgaggtaaaagagtttcataccaaaaccacccccacctccgtggaagacaagaaaaattgtcttccacgaaaccaattcctggtgccaaaaaggctggggaccactggtctagaagactacaaccaattcagttgcagtggtcaccaggagtaaccatgtggcccaagaaggtatgtccagcttcctccttgcatcttgcggcacaacacctttgcggtatggtgcctgggcagtcccgggttgttaagggtgagagttctaaagccaggctgcccgtattcagagactggctttgctaaggaaccttgggcaag

SEQ ID NO: 129732 - DNA, 262 bp, Homo sapiens
aaagaagccagtttgaggttagccaggctgtcacaatttgaacattagaaagagaataataattacagctaagtggaataaattaagtctgtgataagccatgaattcataatgagatgcaaaagggaaagctaagatacataaaaagatagttgtaaaaaagggtgaaaataatagggtatccaatgtcttattatattaataactaggttggtgttaatacttaggtgttttgtttctcctgttaagtatatgtctattt

SEQ ID NO: 129733 - DNA, 308 bp, Homo sapiens
catttattaataattttattaccacctttctgcgtaactatctcctgagacgaaatgtctttgttagttaaattttcacttatatcaaattaatacctgcacagagctttaaagtgaaatcattttttcaggcctataacataagacagcagtgtcctgcttcatccctactcccgattttcacaggccagagctcactgctccaacgctttcaggtgtttcatctgtattcatacttcaaaaatatctaaataacatgcttactgtgctatgttttgatttctcagctttattttatttattttttt

SEQ ID NO: 129734 - DNA, 306 bp, Homo sapiens
gtagctgggattacaggcgcccgccaccacgtccggctaatttttttttttgtatttttaatagagatggggtttcaccatgttggctgcaaagctatcttgcttttctttgttgtgcaggtcacacctgggtcctgagctggcgccatcaccggagacgccaggtgatgtccattcatcagaaataatgagcaaagcagctgtggcttctaatcagcccatccctccagggtgtcagatggaggccaattagcggacgcactagacaaccaaattctgcctttccaagcaaaacatcagaaaatg

SEQ ID NO: 129735 - DNA, 318 bp, Homo sapiens
ccacccatggttacagcagcccaaacaaatgaaagcacttgtgatagaggaatgtggaagaaaactgataaaaagcaggagggtgttggttccgtgaaatgtggcctatttacccagtccaataatttgtgcccattaaaaacctgtcccagaaaggtatctactaacaaggaagcgaatcatgaacttcgaagtgaaaagagcaagtgatatcaggtttgcagtacagatccattcattacacagttactgagtgccaactgttcgcctagctctgtaaacaaaacaaaacaaacccctgccttcacaaagctggtg

SEQ ID NO: 129736 - DNA, 407 bp, Homo sapiens
caaaatataacttggacaaaagctaggcatagaatacaatttattgtgtttaataccagaaacccagtacagtttttcaagtcaagttttttccatattagaataccagttaaaattagtgtgaggctgtgttattattaggatatgtatataactatatgttaggtatgttattagaatatattatatatattattattatgatatataatgtcccttgtatgtaaccaatctcacattgttgctgttccttcccccttgtgggcacctttccccacttggtcatgctctgatatcccatgcaaggtagctcctccttcccaatgtcctccttcaccttctcaggctctgacacctttctgacactttcactgtgtagttccacccactggataacactttctcag

SEQ ID NO: 129737 - DNA, 683 bp, Homo sapiens
tacgttgaggtataatttacataacataaaattctcccattttaagtgtacaattcagtgatgtttagttaatttggaaaactatgtagccaacactacctaatttcagaatacttctatcaccccccaaagaagaaaatctgtgcccatttgtagtcatttctcattttctaatcttagggtactactaatctattttctgtctctatagatatgcttttttgggacatttcataaaattggaatcatttatatgctcttatgtttggcttttatttagcaatgtttttgaggataatccatgttaaggcatgtttcaatactttcttgtattttgaagagttcttcattttattaatttgtttacttcatggacatttgagtttcaaacatttggctgttgtgaataatgctgtgaacattcatttacaagtcttggtgtagacatatgtttcattcctctttggcagatacctaggattggaattgctcggtcatgtagtaaatttatgtttaatattttaagaaaccgctaaattgttttccagaatggttgtactgttttgccccctccctgcctgccttttttttatttgaggtagagccctgctctgtcacccaggatggagtgcagtggcgtgatcttggctcaccgcaacctccgtctcccaggttcaagtgat

SEQ ID NO: 129738 - DNA, 276 bp, Homo sapiens
tgcgaaaggtatgtttggaaacagtaagaagatcggaatggttgcagttgagtcatgcaggggagagtgaaaggtagatagattgtaaatttcttcaggtcagagaccagttctttatcttcttgaaccaccgaaaacgtagtgaataaaaactgcaattgaattttatagggttgtagagagctttgaattctaaaactaaagtgatcaaatccgtaaaggattttgaatagagagagaggtgatgtgggctaagtggtgattaggaagatttgt

SEQ ID NO: 129739 - DNA, 859 bp, Homo sapiens
ctgaataacatcatacttccttttgtttctccaaaaattgaatcaagatgccagggcaactaagattttcttcaatttgctaagttaaaggtcagtgtattcattagccaatggttctgtattttattcattttagtttttattcgttttcaaataatttgttcatattgttcaatattcaaaaggtaagaaatatgtactgtggtaattttccattccaccctagttcctcttttgacaaccaactattgtcacttaattcttaggcatccttccagatacagtgtatgcatttacaggcaaatacctatataagattttacccctttgtgtacataaatactaacatactatatatagtgttctgttccttgcttttttcattaacagtatattttggtggtaatttcctatcaatacataaagaacttccttattcccttcagaggcatttgaaccagagcaattccttcttgaatagaagctgggtaaaataaggctgagacctactgggctgcattcccagatggttaaggcattctaagtcacaggatgagataggaggtcaacacaagataccggtcataaagaccttgctgataaaacagtttgcagtaaagaagctggccaaaacccaccaaatccaagatggcaatgaaagtgacctctgcctctggccatcctcaccgctacgctcccaccggcaccatgacagtttacaaatgccatggcaacatcaggaagttatcctatatggtctaaaaaggggaggcatgaataatacaccccttgtttagcatatcatcaagaaataaccgttaaaatgggcaaccagcagccctcggggctgctctgccta

SEQ ID NO: 129740 - DNA, 247 bp, Homo sapiens
gggtagagcctggatcacgtgggaggacaggtcatgaagccctgagggtagagcctggatcatgtgggaggacaggtcatgaagccctgagggtagagcctggatcacgtgggaggacaggtcatgaagccctgagggtagagcctggatcacgtgggaggacaggtcatgaagccctgagggtagagcctggatcacgtgggaggacaggtcatgaagccctgagggtagagcctggatcacgtgg

SEQ ID NO: 129741 - DNA, 495 bp, Homo sapiens
gagtgattaatgaaggaatgaataatccagtgaattggtatcaattgatgagtgattaatgaaggaatgaataatccagtgaattggtatcagcctaattcttctccggcttattaaaatcaaagggggaaataatatatattaaaaatggaatactgcacaagcaaagagatgcccccaaagaagctgggcgcggtggctcatatctgtaatcccagcactttgggaggccgaggcgtgcgggtcacctgaggtcaggagttcgagaccagcctggccaacatggtgaaaccccatctgtactaaaaatacaaaaattagctgggtttatagtgagcgcctataaccccagctactcaggaggctgaggcaggagaatcgcttgaaccctggaggctgaggttgcagtgagccgagatcatgccactgcactccatcctgggtgagagagtgagacttagtctccaaaaaaaaacaaaacaaaacaaaacaaaa

SEQ ID NO: 129742 - DNA, 675 bp, Homo sapiens
ttgtctgcttatgtgttttatctgtttagtaccatgtctgacatgatgtgggtgtgcagtaaatatttgtttttgaaataaaaccctggttgacctcttctaattgttatatataaccttgcttgcctgaccagatttgttttgccaacatcagtccttcgcaagcttcagtggagacagagtaagaaccaaatgtctttaagatgatgacagcctacccctttacacttcttgttagggcctcatctaacccaacaccaatactggttgctctgtttccattgacaagccccttgcgggctgtgcgaaacaaaagttttgagacatagagagtctaaggtccaagatagagtgtaccttgatactttgctggggagtaggatcagaccagaaagaaagaagagttagccacaagagtgagaaaactcaatgacactccctctgaggtttgcaaagctaagggccaccagtttacctttaagccaaattttcgtttctctgtgactatgggtcttacagctgtattcaaaacctcagagaagccaacacattagagtccttactttgagacccccaactagctgaatgccaagaaaggcatttagtaactgaagggtatactcccgaggggctggatctaaagaaatgccacctttgatctagcctgtaacttag

SEQ ID NO: 129743 - DNA, 139 bp, Homo sapiens
ttcccttaaggggttatcgggtctccaatcctgttaactaaactcacagaacactgatgtattagccaggaagtcaatgcatacataatcttgaatagaaacctttcaccaacaataagacagggaaagtcaggttagg

SEQ ID NO: 129744 - DNA, 392 bp, Homo sapiens
tgttcactgaagagcagcctaggtgattcacgggtaatacttggagctacaacaaatacagcggtttctcaaatcacctaaagggatctttcaaaataaggatgtgttactctccaaagactcctgtcctggatgttgccaaaacaaaggatgctcagactctgacgcctggagctacagagcacccttggccctcggggtcggagaagacccagcaccaagacgtgcccaagcttccagcttcgcgctcagctgtgatgtcgccacggggacaggacacagcccatggtggcggcactgccaagagctgctgcttcagcccagtaaacacagagttgcttcacagccctctcctggtctctgtgcctgcaacgcagcttgtggacagggac

SEQ ID NO: 129745 - DNA, 503 bp, Homo sapiens
aggccctaatatgcaagaaattttcctattaaatctatctacattaacaaattattgatgaaacattaagaataaaaacatttctcagagtagttaatttgagtattgtttcctctctcaaatgcaaactcatcctaatgccaaatatactttcataaaaccacttacctaacttggcaaacagatctacattttgttagctttagtcatcaaagaaccaaagcctaagaactactcaacgtataaaggttgggtgtgtttgtgaatgaacatgaaaaaaaaatgagtcagaatgagtgaagacactcaaatcttttgagtaataacaaaattagcagctattccctattatctgagggacagtggcaaaaatggccagattagaagccataactgttagcataaacatgcaaccaaagctacgtctgttgattactcttataatcaaattcactataaatcccattccaaccatctacccatcccctgtggaaaatgagtag

SEQ ID NO: 129746 - DNA, 741 bp, Homo sapiens
ctgaaattcatgacattctctgttttttagtattgctaaaggcatggtttcacatatggctttctttgtgcttcttgctggactttggttttgggggagtaatgtatgggaagattcatatcctagtagttactattatcctccagacctagaaagtccccactacaacattttttgaactttagtgagacctccctgccatccattgatcttcactgtgttcctgttttcacttctttctacatctttttccgtgacctattgctgtagtcattttctcgcaggttccgtaaactcccctattgttctcatcattcttatttatctggaaaaactctaattgaaaatgacctcttcctctgtgttcaatctgcacatgaatatagctggagaaaatcatgtaggctgatttcactttaaatttatcatcacaggcctcacatgggcacttatatctgccctggaatttaactgtgcttctctaatacagctataagattctctaccaccacagcctggaaattgcttacatcttcctgaatccaaatctataaacctaatttgcatccataattttgtccttagagcagaggaggtactccttttcttgacattgaattcttccatctgagctctggattccatttatttcctctacttaatgagttttgctccttcagttatgccttctttttcttgttttgtcagctttaccttctctcctacatggttctcaccaca

SEQ ID NO: 129747 - DNA, 373 bp, Homo sapiens
cctgggagcgtctgagctgcagctaccaaccatatggttcccgttacaaaggccaggttctaaggcactctcttccccaccccgccctcaattctttgattttattctgcattctttcagtacgtgcacttctcttcccctttccagaggcatagatttaacggacgtagttgattcattcatttctctgtcactatttatgtgtggaacgggtcccaccgagtttgctctttgctcaacgaagttgcacaatgaagaaagtcacatcctttggtaaataattacctgttaggttgtctcttgctaagtcaggtttgatcttgggcaaaccttagaaaataggcactaaagaggcaatatgcatccagagcag

SEQ ID NO: 129748 - DNA, 297 bp, Homo sapiens
ccaggaggcggaggttgcagtgagccgagatcacatcattgcactccctagcctagacgacaaagcaagactctgtctcaaacaaaaaaaaaagaattaggattttgatttgttcattaatcgctcatttttctcttctctacttcatctatttctgcctttaactttattttttcttctttgtgcttttcttagtttactttgtttttcctttccagttttttgagttgggaatttaattcattattttccttctttcattttcactgacaaatatgtttgatgcaatgaattttc

SEQ ID NO: 129749 - DNA, 201 bp, Homo sapiens
attttgaccacaggggatcctggagccaatccccaacagatattgagggacagctgtttactactatcatctctgagttatacagatatgaaaactgagggaaagtgatagggaaactcatctaaagttaatagtggcagttgcgcaagtacttactgagcatcatgaaatggtgcaaatcccttccacatttttgtgttt

SEQ ID NO: 129750 - DNA, 358 bp, Homo sapiens
gctgtgtgcaggcttccagggttaggttgggctgcagccggttccccttgaaactacctcgatctgggggcaagtctgggctgacctggaggccgggcagggaaagggtctcccagaggaaggtcccagagcccaggagcacaaagcggggccctggggaaggaagaagagtttgccagagggggaagaaggcatgggggaaagagggccgggtcaccaggcagaggacaaaggctgagcacaaggacaaaggcttggaggagcagaatatcctggtgtgagacacggagacagatagcggcagagacagaggacagaggacagagaaggcaggggccagacggggcctgggcgtggg

SEQ ID NO: 129751 - DNA, 208 bp, Homo sapiens
tcccagcggccccctcagcctcagctgcctggatcaccagggcaggcccagcaggcaacgtcaggcggcctgccagactctccctcccagcctcgggatcacgtgtcgtgaccatggccatgcacctcgatctagggttgcagaatgtgggctgagcagccggggaacacctcctggccttgcgtgacccttgggctggccgcgggag

SEQ ID NO: 129752 - DNA, 394 bp, Homo sapiens
agtggtactagccaaatgctatagtcgaattagctaaccatctgttgtactgcctagagactttcacatatattatttccaaaagtcatattcaaaacatctagcaaccagcatagtgtgcacctaggccaatcagactaggcttcagccagctgtaagcagccagcacagctgggcaacctaggtgaattccagccctgttagttcatgtaaggtccccattggtgctaaacctgttttaccaatggatttaagaaggaacccaaagtgtgaaaattcaggcttcaggaagtgaaggggtggcctggatcaatcagctggtaaatgatagagaggagattcaaagtcagatttcccaacccttgctctctcctcctcccactacacaggtgcc

SEQ ID NO: 129753 - DNA, 243 bp, Homo sapiens
tttgtatttttagtaaagatgggttttcgccatattggcctggctggtgtcaaattcctggcctcaagtgatctgcctgcctcagccttgcaaattgctgggactacaggtgtgaaccactgctcccagacactgtctcatattttgtgaaacactcaacctccttgatctgttttgatagttgatagacacaggtacacataactgtttttctactgtaaggaaattggcacacacatgatg

SEQ ID NO: 129754 - DNA, 782 bp, Homo sapiens
tggggctggggaggaaaggagcttcaatgtgccattctggttggggagaggataggacatttctgggtccttggctgctgccggtagaggtatggggaggaaaaactctagagtgggagatgtggaagtggaaaaggaaggccctgtccaggcctggcctggtttctggagacagaaaactccccaggggacagagaggttacccccttgtgcttagcttctgccacccttcccttctctggaggagaaggctgccctctcctcagcaaccctggcctttattctatgcataaccactgcaagggcacccctggccaggctgaatgggtgggggtcccagggcacctgcaataatctcagaatggagggtatcctgggacaaagagggggtacagaaggtgccaggggggaaaaggtgattcctccatctctctctcacccaaatccccccagatcgaatctgacccttttccctggtctccattgtgctaaaccaccgaacttggaggagcctcatataaacatagcccccagccccactggctttccgaacccatcatgaaatagctggaaggtatctgaaccgttcccatagctccctcattattttcttccctgaggatcctgtggtttaggagatttttctcccaaaccagcctcatttcttgaagaagaattcattttcccatattaaattaactcaagctgagcttctgattgcagataaatgtttctaaggcctcaagtcaacttctagggcttgaaggtgggggaatatatgt

SEQ ID NO: 129755 - DNA, 762 bp, Homo sapiens
ggtgtgagccaccacgcctggccgtgtctttctttgtttatgaatagtacataaaataatagtgcatcttcaaattaatgacatttggatttcatataaatgatatttcatataacatttggcaagctataagcagtttcttgtcccacatagtactcttctacttttgttggcatggggaagaaaaaagtgttgaataggagataaattcatagcagtaaggtccatggtttgctaaatggtttaggcactttaaatgtcgttgtaggcatataaatttgtgaaaagtttcagtggaaaattcagcaacatctaccaagttataaattgaatatagattttgcataattctaattttagaagtatgtcctctggaagcacctgaaccagtgtacatgggtgttcatgagccactgtctggtactgaaaaaaataaattataataatccatatgtccatttgactaaatatactgtagtcaactcataaaatgaaatactgtacctacattaaaaagagtgaggcctatataaaaatgtggagacacagccacaaaatattatcaagtatagtaatatagaatattatattaatacatttgaatatgcaaacaatttggagatatgtaaaccattggtagtggttaaagggcaagaatcaaattatggataaattttgttttacatttgttatacttttatattatttcaaagttttacaaagataatttgcagtaaataatttatatttctctttactaca

SEQ ID NO: 129756 - DNA, 117 bp, Homo sapiens
ttgtgacatccaacaagtcagttagcatttttgtgcctcagtttcttatccataaattaggatatgatgattcaagtggatgacttacttcctaaggttcaggatgcgttctaattg

SEQ ID NO: 129757 - DNA, 473 bp, Homo sapiens
aaaaataaaaaataaataataaataataataataataaaataaaaataactgcaacaagcccctagattgacttgaagcctctgtctgaactgctggcgggatccccagcttccccccatgtgcctgttcatggcatgcagaggtcagccccttgctccaggcctcggaccagagtggccatctcgttagcataggacacaggacagaagcattgccctcaagtttcctgagacatgtttgcccctggaagcggtgattttggccatcattgctgcaagactgtcatcggggcagcatcttagcatcagcattgctgtcgcggggtgaggctgcctactgtgccctgccgcccggccttctgtgcttcctcaggagaaagaccagcagggattccagggggaggcctttgttagcagttgtagaagaaaatgtttcccaaagagctgagctgtttccctttctcttctctcct

SEQ ID NO: 129758 - DNA, 269 bp, Homo sapiens
tgctgggattacaggcgtgagccaccgatggccagccaagtctggggccttgagcagtgaaaggattgagttgctattaactgagatgagagagtggcaatagcattcatttgttcattcattcaataaaatgtttattgtatatctactgtgtctactactacttgagtctagcatatacagccatgataaacaaaatacaggatctctctccttcatggagcttaattctaatggaaggagcagacagtaaacaaatagggaaaata

SEQ ID NO: 129759 - DNA, 450 bp, Homo sapiens
cagttacttgtgattgactagaatttagggaaatggccttacctaaatttcatttttattacaacttagagaatttctcttttattagttatggcatcttttctttttttgttttttagaaacacagtgttgctctgttgcccaggctggagcacagtgggaccatgtcggctcactgcaacctctgctttctgggttcaagtgattctcctgcctcagcctcctgagtagctgggattacaggcacctgccatcatgcccggctaatttttgtatttctggtatagatggggtttcaccatgttggccaggctggtctcaaactcctgacctcaaatgatcctcccgccccggcctcccaaagtgctgggattataggcatgagccaccatgcccagccttagttatggcatcttaaacagcaatcaataacatttttttgtttgtttg

SEQ ID NO: 129760 - DNA, 180 bp, Homo sapiens
aaaaaactgacagggctgagggtttcatgagctgtggggaatgagagagaaaaaggagtgaggcatgattccaaggcatgcttggttgagttttataagacttccatggagaaagaaagggggaaatgagctccattttacattgaatttggttgcctaggaagagatttccaatccaaa

SEQ ID NO: 129761 - DNA, 180 bp, Homo sapiens
ctgactcatctgggaagtgagactgatgcgaggcttcaaggtgaagtgaataggaaggcccagcatgacggagcactgcatggcttcactattccctgctggcagacttcattcttggtgggttcaggccagatccaggggtggaagctgagattggagcaggggtgtgattagatgtcc

SEQ ID NO: 129762 - DNA, 555 bp, Homo sapiens
aaacctgcgagtcctgcacatgtatcccggaacttaaaataaaaaagcaacatgtatcccatgaaaaaaaatatggttctattttatcttcctcctgcctacccctgctctcctctccctccagcttggcatacaacaggtgctcaataaaggcttgagaaattgataagaatggaattcaaccttatatttgttctttctctgaaaagaatcttggtattagcttgactaatccttttgctccatgcaattggctagtgccaccttcatatttttctgatatcattaagccccagctgcctcttccctggagctcagggatactgcaggaaaaggggtctgctctctccacttcttctctcctccaaggtttgttttgaaaaaccctgctgccagggcaggctcccgtgttacgctgctcacaaaagcacacatcttccctgccagcctttgctcagttattttattccctctctaacaagtacttgtggagccttactatgtcttcagcacagttctaggttatcaggataagattggtacatataccaggtc

SEQ ID NO: 129763 - DNA, 350 bp, Homo sapiens
  misc_feature (93)..(93): n is a, c, g, or t
ctcgaccagctcgctgagcaccaggcgcgtaagatgagagctggaatagataggtcaggctacactcagtgatcgttttacgactgcgctttnttccttgcgcctgtaataactaatctttgaagaggaacctctactttactttttacatcctcaaaacaaccctgtgtagtaagtaataatattattgtgctgggtagagtggcccatgcctgtaatcccagctactcagaggctgagatggaaggctctcttgagctcaggaggtcaagaccagccggggcaatacaatgagaccttgcctctaagaataatatgccaggcaagatggttcacgcctataatcccac

SEQ ID NO: 129764 - DNA, 403 bp, Homo sapiens
ccgggctcggtggctcacgcctgtaatcctagcactttgggaggccaagacacaaatgtttacaatattaacctcatctgactcctataagctaggctgagccagtcaaagacttggcttttccacaagatctagttagtgttagagtccggcgagaggattctgccacagttcttcctgccaggtcactccacaattacctacatgtcgtcagtagaccttgttaggaagaagccttaaaggtccaccacaggccaggcgcagtggctcatgcctgtaatcccagcctggccaacatggtgaaactctgtctctactaaaaatacaaaaaattagctgggtgcagtggcacgtgcctgtaatcccagctactcgggaggctgaggaaggagaatcacttgaa

SEQ ID NO: 129765 - DNA, 1442 bp, Homo sapiens
acaaagaggggaccttcttccagatgccttcccagttgtaaccggtaaaactgttaccagatagtgtttgtacaaaaaaaaaaaaaaaaaaaaaaaaaaaaattacctttacagttgagggttgttgaggaaaatgattttctttgtaaatatatagcatcgtgtttggtttgggatgtagagtctatacctggctgctgattgcgtcgtttactacagctttttttaaataagatttttgctttaccatttatcataatgtagtaatgaagcaaaatggtcaaaactgggtgtgtgtgaacagagatacacccatattcgtgtatatacacatccacctacatgttttggtctgtggtttaagagactatttcaaggttccatttttataagctaaaacattctaagttaagatggaagaaagccctaaacacagtagattctgagtttttatgtgtattttaaccagagtttctgatagtactgtatctggctacctatatttccagatctaaagcaagaactactctaagtactgcatttggaatcctcctccattaggaatggccaggacaagtggagctagccattttcattacacggccatcccaatggacactggatccctggtccaactgtctaaaaggccagttgttcctttctgtggatgtggatgtctggccttcacctgaggtagagcggggactataaacacacatcaactttctttctgtttgctttcttttccttcttttcaaactcttaaactcaggcctttatgctgtgagtgactagtccaagaagcacacattttgtagtagtcctgcaccagccctgctcttgaataaaaaggaaaattactggctgcacccaaatcttctagtacttgagtaataagcatcaggcattggaagaggttttaaatttgcttttttgaggaaaagaactgggggtggattttggcatcgtagcatatcgattaaagaataatcaggacatcagatacattttaatacatagctggggccttatgttgtagatgaagcttgctgtttttagcaagttcctgggtttcacattcatttctgctgcatctagtagctccacacatttcataacctgatctctttatttgtatgcaaaaaatactgtctttaatacagagcagcatttttgtaacaaagagactcgctggagctatttggtgcttgaatgtgaccatcctttttacttttgctaagccttatttaaattttgtataccgtggaatatgtagaatttgtcaaatcattttagtgctgaaggtttttgatttcttgtatttgtatctgtagttgcagtttctttggtggctggtttgtattgtaagatggcacttgctgatataaatactaaggcactaagagaaaatacagataagtatttataagttgcttgggaac

SEQ ID NO: 129766 - DNA, 178 bp, Homo sapiens
atcaaggctgtttttttctatatgaatatccagttattccagctcaatttgatgaaaagactaatctggatttttcccttcgaatctccatttttcccattacttaggtccaaaagttgagagtcctttttatttttattttttattttttgtagagacgaggtctccacccaccttg

SEQ ID NO: 129767 - DNA, 354 bp, Homo sapiens
cctgtccagcctgtgctgtgagggacggtgggagcagtggccgcacgttccacttccccctgccatgtgagggaggtggggagatggccagggagtgagtgggcgccaggagaccagacctgccgagcccacactcgagcaccacgaccagcacagcaagggacctgctcctggtttttcagatgtcatcacactttcccacaggcttcccctcgatggcactgggcaccccctcagccccggccccaaacagcccattcaggggcctggccctgtgacagctccctgcccagctcctgggaaaagctccacgccagcacaagaaaggatggctaccccacattttgggatcct

SEQ ID NO: 129768 - DNA, 733 bp, Homo sapiens
tattttgagtttctttgttttatattgttgttctttgtagtcagtgtctattattttgtgctttttgaaagtctagtctctgctaggtgccatgagactgaaagttattaaatgtaacttcattgccagatgtaattacggtaagccttttatttgcattgcagtgacttcaacaaaaatggaagctcattctgctttataatattttattcttgggattgtaagcttgggaagctggggaaaaaagtaaaaatatattcttggggaagtataggactgtttgtagtcatgttatttgaaaattcaggaagtctttgttaagcataaatataattttacctgttacatttcttgctgtatctagaattcatgagcaggcaggactgaaagaattgccagttcctttcagctacctgctgtcagatgctgtaatactcatcctactttctgccaggtgcacgtaaaatctagtattacaacagattcacatgctggttctattgaaagccaggtgatggctgagctagatggtagagagatacacagtcttggaatcatactgaagctaccccaaatcctattttggctgaaatttaggaagggcagatgattgaatttcaagtgaattataataaatggtgtacaatgagaaatgccttacatgactaagaatttccatcatttataactttgtcattggaaaatataggcttttttcttcattaatcaaagg

SEQ ID NO: 129769 - DNA, 706 bp, Homo sapiens
gacatataacctaactatgctgagtctcagtttatacatctgtgataaaaagagggtgttttgaggattaaatttagaattataactggcatatcatgagcacttaatcattaatttttcttttctttttactttactttgtttttactgaacccttatagtcactttttgtaataccttttaatggcttacagtacatttctacattgcgaagtaattaaattgaatatattttatctttcctaccatactaaaagattcttttgtgcaagtgaccctatacattgggtgtattgtatatgtgcatattcattcagatgtggtgatataggatgggagagtaggggttgtatctcacaatacattcatgaaattatatatcccttcccttaaagtcctagaggagattaaaatacaacttttcaaaatatcatagaacatgactctattaagatactctttctatccaatgggacattatctaacttggacagattgcagaactaaatgcatattgaggtaaactttcaggatttacactatgctagacccattagttaaaatgtacatacctttttagcaaacccactaaagctagtaatcaggagttagtttcaaatgactagtattatatatttccaagcatcatatacctagaagaactgatactcactggaggaacccgaattccaaaagtcttcgcctg

SEQ ID NO: 129770 - DNA, 481 bp, Homo sapiens
  misc_feature (2)..(2): n is a, c, g, or t
antaattccctagagtctttttccaaacggaattgaacaatgccacaaaaactttctttactaaagaatatttgaaaataaaacaaagctttcagaaatccaactctgcaaaatggcccctaccaagctgcagaaaagcatttcatctttttggaggtttccgcagacatgcagctccagttacaagaaggcagttcccacacggtgcacacaggatggattacctgcactttgaggatgatagccgtggatggtggtttgacatggatatggtgatcatatatatttattcagtgaactgggtcattggattcattgttttctgctttctttgctattttttctttccgttttaggaatttcataccttactacaattgaccaatcataaatgatgtaaataacaattgcttaaacatttttaaatgtgctttgaagtttttttaatgttgcattatacaaattgttgatgtttatagaa

SEQ ID NO: 129771 - DNA, 363 bp, Homo sapiens
ggcaggggctggtgggagctggcggggatgtctcctttcccttcggagaaaagcgctcattcaaggttgcataggaaggaaagccaggttggggaccagccctgtgcagcttggggtccccgtgccttttggctgaaggaggaggttaaaagggcccagactgaaccccgacccctctgtcttagccccagactgttttctgattttagcactagatttggctgcccctaaagcccttagccctaactgaccttcctgcccagcccagcccagcccagcccagccaggccccagacccagtggcttcttgaatgttttggctgtgcagctggctccttgtcacctgcccccttcccaaccttc

SEQ ID NO: 129772 - DNA, 161 bp, Homo sapiens
tttataaatttctttctcccaaacaaatcacatattcctcaatggtataaattatctattagtgtttcttaactttgtccatcatattcatctgggatgttaaaaaacaaaaacaaaaaaacactagttcttgggccaattgccaaaaacccattccaaat

SEQ ID NO: 129773 - DNA, 489 bp, Homo sapiens
ggctggtctcgaactcctgacctcaggtgatccacctgccttggcctcccaaagtgctgagattacaggcatgagccaccgcacccagcccagaatccttcttaacacagtactccaagtgcccacagtccatactaactgctggagttgatgtgtgagactaagcctgtttactgtccttggcttagggaattgaggctcggagtttactgttaagagaaggcatattgttactgattgcagagtacttactatgagccaaatatgttagttgagaacgtttttttaaaaagtctattgtgagtgtttattacctatgatacggagttaggtgcctagtaaaagttcagtaaatatacacatgaagaagtacagtaatcataggaataaagataaaggtagtttgtgttggaaaagagttgggttacttctttctggtgatttttgtagagttgtcagcagtggcttgggattgactttctgcaggaa

SEQ ID NO: 129774 - DNA, 893 bp, Homo sapiens
gttaaataatacactacaaaattttgaaaaatttctagtcatatttaagcagcctcaatagggttatgattcttaaattttgcaaacacatcagatactttagctattttataatgaaaacagttataactgacctctttataaagaaaatgaattaataactgtagctgagctaggtattttattccagtgttggttgcagtatataattcattgcagtgcttactatatttcaccaaacagtggaatactgatgttttaactttagtttcagtccttggaatttgcattcaggtttgtgtattcatattccaaaatgctgctcattaaagagtaattataaatgtctataattaggaataggtcactattgttattactggaaacacacacacacatatatatgtatcacatcatatatatagtccaatttaccttttctcctcataaaaaaatattttagaactgtgtaatttctacatcataattaaatcaacatattctttcaacaattcacaaagtgattatgccacgttgtcaaatcttttgtgattcctgaaagttaaacaaatgtcatctttaacattttattgaattcaagagaaagcttaaaagaataaaaatgtattacccaaacctcttatttggcttaaaacataaaatccaaaatctctaatcatttggattcagaaccctcaacatctatactgaatgtctgaaaaacaaaaacacatcctgtctcgtactccagatataaaggctatcgatattccactaccaacctagcatttcatataacatgacccattaccaaaaagattgaaatttgagcaaatagagaaaggttttatcaaccatggaaataatcccaagaaattcagaatacacagtgc

SEQ ID NO: 129775 - DNA, 612 bp, Homo sapiens
tcattctttctatcctaactaaatattttgagtattaattacaccatccagcaaatgaattatctagtgccactttaagtatgttaatatattttccatatctcctttcaactttaagcacataaacggttaggaacaagtagcatgccattagagacttctattcaagttgatattcaggttgatatcaagtattttctaggtatgattgttcaagtagctaaaaaaaaagccattaatctaattaattgtttaatcctgcttacaagattatcttgaaaaaatgtgctggggagtatggtataatgaattacaggtccaagaatttgggttcagataccaccttcagtctttactaagctgcgtgactttagcaaagtgcttagtctctctaagcttcggtttcctaatctatgaggagggcctaagatatcaccacccatcatattcccccctctgtaccgcttattttagattctactatcattgtatatcacagaggacatttatcttgttcatctttacaatcaacacttagcaagacagatggtacttagaaggccccccaggtatctgttaaactagacaacctcagttcttgtgttaaaagta

SEQ ID NO: 129776 - DNA, 532 bp, Homo sapiens
ctacctcctttctagcactctcggcctcccaacaaattgcttatggttctctgcagaccccacactgtgtcctacctttgtgcctttcctcttcctggaagatcctccacacctcacagcccccctctactggctggcttccactcaacagtgagtctcagcttagctgctgtagcctcaggaggccttgactctctcagactgggttaagaggcagtgaggagtagtgaaaggagcctgagactgggcaccaggagacctgggtcttggttcatgctctgttccacctgacctctcaccttcaattcactttagtccgtgatgagaacccttgggtcaaatgggcctccccaagatgtcacatctttttctgagcgtaaggtgacttatgtccttccccaagcatctcctggccaataaactgcccttccttaagatccagctcagcttctacctcctgagtgaaacctcttcatcttcctcaccaggtgtaggctgagggcttctcttccctcctctgaactcccataga

SEQ ID NO: 129777 - DNA, 521 bp, Homo sapiens
attctcaagtcactgttgaatctgctttaatatctgtccaatctaatccccataatccagatcttcaaccgctcttttggcaagcagtctcaacctcttggggctccgtttttctgcaacctcaatattataagcttccaactatagattagtccaaccatccaccttctcctggactaactcaggccgatgaactcttctgcagaaaaaaaaaccacacacctgggacgattgaagccaccatagtatattgcctcaaacaagtttgttttatctttagtaatcctgtgcagtcccggtccctttcctccatcattctccttactgtatattctgaatgatcacccattcttcagcagatagcccgttttctccctttactgagaaaattgatggcaacaattatgttaaaaaaaagttcacgcctgtaatcccagcactttggggggccgaggcggatggatcatgaggtcaggagatcgagaccatcctggctaacagggtgaaaccctgtctctgct

SEQ ID NO: 129778 - DNA, 444 bp, Homo sapiens
gagtaggctgccgggaagccaagcgggcagccagtgccaggccaaacaggcaattagcacccacagaaaccccactgcccagcaattgctcaaggccatgaaactctgggcctgctgattcctgaggcagagggcaggtgaatcaggagcttgtgttgacagagagaccccaagtccttgagtaagagtcccacacaagcgcctggacttgaattcactgtgcccccaaggcgaggagagcactccggtttagacaacaaccaagccgacctcagcatcctcctctggacttgatttgtgctttcctcatttgatggttagagccctgccatagccacctccagtctagaccgctagacagaagatctgttttggctgccttctttcaggctattctctctctctctctccaatacatgccaaatgctaatttctcatgattcc

SEQ ID NO: 129779 - DNA, 676 bp, Homo sapiens
gggctgtaatgtagttatgggagatggttgtcatcattactgttatttattgagcctccagtatgaatcttttctagttggttacttgatagggctgtttgtttcctaaggctgacacaagcattttttcttccttcttgcactgtaggtgtaaattatacatagttttttcttcttaatattaaaatatgtgaatcattttatgctctgcatttagacatttaatctacagtaaacccaacattttgagcctgcttataataattaaaactttaatttacctttaattctttttttgaaagaatagtttacacagctattagataaaattgctgttgctaaatattgtgtaatttgcatatttaggaaaataggcatatagataagaaaaattgacccttagaatagcaaaaaaaaaaaaaaaaaaaaaaaaaaaaactgttgttgggcgcgctttgggccttggaaaaagattttcataaacaatttgcgttgtggggcgcgggggggccccagtagtggttaggttgacactgtggtcctaagccgtggtcctaggagaagaatgcgtggtcgttgacattagttgttggatttttctacccatataaaaaagcgcggggggacagcgcgtgttttttggaaaatcgaggggagtttcggaggcaatagggac

SEQ ID NO: 129780 - DNA, 535 bp, Homo sapiens
cctcccacctcagtctcccaaagtgctgggattacaagtgtgatccatgacacccaaggatatttcatcatatttctatttactgaaatttggtaactggcaaattgtgcatttgtcaaatttcagtccactagattattaccctagccctaatttccaaagaaagcattacagtttttctggaagaaaaacgattttggattaagggaattgactacaatacattggaccaattacaactaacaacttctaacacattcatcttttacacttgaaataaaattatcatttaaacttttaacacttaataggaatgttagtcaaagtgaagaaaactgaaagtgagatgttaactactgaaagaaataaagtaacaccttttataacaatgttccataagtctaaaaagtcagacaaaaaaaaaaaaacaactttaggaagcttaatataaaatgtatctgaaaattagctaacaggccaagctgctcacacctgtaatcctggaactttgggagctcacgcctgtaatcccagc

SEQ ID NO: 129781 - DNA, 395 bp, Homo sapiens
gtgactaccggtggaacttacggcaatctgttataaggaggcctgggacagaggctgagcagtaattatgtaagccaaggttctcttctcctgtaggttactgcaggaagtagttctcaaaggatgatccctgaccaccctgcagcagaatcacccggaggcctatcccagcatggaccaaaacaatcagaatatctggaggcagggcccaggaaggtacacatttaagaaactgcaattgatgcctttgcacagtgaagactcactactgtgaagcctctctgtgaagtctgggggcaagggttctcaaacctggagaccacacagggtagggaagagtgtgaaccgcctaaaatcctgtgtacttttataagaagagggtccagaatttaaca

SEQ ID NO: 129782 - DNA, 716 bp, Homo sapiens
atgttatggtataaattgttctattttacctctctgcctttggaagggatgttaaaatttcaacaagggacataaaaacttactggtttaaaaaaatcctgaatatgtcctgaatggtattgcctaggttttcttctaaggtttttatggttttaggtctaacgtttaagtctttaatccatcttgaattaatttttgtgtaaggtgtaaggaagggatccagtttcagctttctacatatggctagccagttttcccagcaccatttattaaataggaaatcctttccccatttcttgtttttgtcaggtttgtcaaagatcagatagttgtagatatgcggcattatttctgagggctctgttctgttccattggtctatatctcttcaggacataggcatgggcaaggacttcatgtctaaaacaccaaaagcaatggcaacaaaagccaaaattgacaaatgggatctaattaaactaaagagcttctgcacagcaaaagatactaccatcagagtgaacaggcaacctacagaatgggagaaaatttttgcaatctactcatctgacaaagggctaatatccagaatctacaatgaactcaaacaaatttgcaagaaaaaacaaacaaccccatcaacaagtgggcaaaggatatgaacagacacttctcaaaagaagacatatatgcagacaaaagacacatgaaaaaat

SEQ ID NO: 129783 - DNA, 554 bp, Homo sapiens
ctagggggaagaggaaactggggagtgactgctaatgagtccagggtttccttttgggacaatgaaaatgttctggaactaagcagaggtgatgactgtacagctttgtgaaggtacttaaatgccactaaattgtacacttttaaatggttaattttgtgttttgtgagttttacctcaatttaaaagaaaacaccagtactttgcacactgcagggtgcctctgctccacagtgcagattcctgacatcaccagacagaggctgagctccaggcccaggagacccaccctccatcccaggccatctcctgcatggcgggctgtatcccctccatgggaaaaagatgtgccttgcctcacaccccagacatccatggtgtgagaaaaagcaagcaggccttctttgggttcgtttctgaagggctagccacaagagtgctggcgagataacaggcagctgctacgggacgctgaccatgtgtcaacgcaccttccggggcattctgtgtcatccacattgcaaaggaggctgttactgtgccccattctacag

SEQ ID NO: 129784 - DNA, 240 bp, Homo sapiens
ccaaacagtgccaatggggatctcatatggttatggtgaagattaaatgagtttgtgtatgaaacggcatgtagtgagtacatcaatgttaagtgccagtggcaggaggaatagcagtattgttatagctggaatagtttgtatacatatttctttagactagatttctgcaagtgaaattgttgggtcatgtgactttcatagttcattcaacaattatcaaacacctactttgtactg

SEQ ID NO: 129785 - DNA, 479 bp, Homo sapiens
gcctatgagcttctacatgatcattcccttcaccctcattagctctctgactgtatctccgaccattttttctttcactagtctgctccaaccacactatcctttctttctgttcctcaaacacaccaagcttttcttcaggtagggccttagcttctaccctaagattgtcagagccagctcccttgcttccatcaggtctttgcttaaaagccaccttctgctttctttcatcactctccttcccagaacttcctattcactatctcctgctttatcattttatatggcacctataataatctgacatatatctgacacatacatatatgtcagattattacaggtgccatataacatgatatatatatatatattcttgtttattgactcttccaaccagaatataagttcaacaaaagcatggatttttatttgtcttatttcctgcacattgattgttaacctagaatagtacc

SEQ ID NO: 129786 - DNA, 262 bp, Homo sapiens
ggacaaagtagtacgtttatagtacttaaactatttgctgtcctttagtgtgaaattctgaggtatatatgcttaaagatatttgtaattcttttgtggaaaataatggctttatttatagcaacccattctgttcttgtgcatactgaagtatattgactttccacctagggaaaaaaaaaacaataactcagacttgtaaatgctttcaacggtgttactacttaatttccctcatttctgtaacatataagtgtataac

SEQ ID NO: 129787 - DNA, 347 bp, Homo sapiens
agcagttgtgactaattcatcttactatttattattttattcggatgaaaaatttacaattgtaacattatggcataaaaacagaactctgacgtgttagacaacatatttgacatcttcaggaatggctagctccaggtgctcagcaagggcaacaagaaatctatctttctcttggatttgctttttatctctgttgtccttactctccagcagactctactcatgcagtggtaaagatggcttacatcccctcagctttgcaaccccagtggagaaagggtgcctctttcagcagaagtcctaatgctgactctcatcggctcactctggacaaagggattact

SEQ ID NO: 129788 - DNA, 251 bp, Homo sapiens
cggggcaaatacctcaaaacctacttgtctcaaagaaagccttaagaaggtggcagcaccaccagtcagctagataacatttctacttcaaagtacctgtcaatccaagagcgactgacaggccaagagcgctgacaggccaagagcgactgacaggccaagagcgactgacaggacgccaagaacccaagagcgactgacaggccaagagcgactgacaggacgccaagaacccaagagcgactgacagg

SEQ ID NO: 129789 - DNA, 491 bp, Homo sapiens
tcaccacagtattctttccttccagaggatgcagccctcactagacaccaaatgccagtgccttgatgttggacttccaacctccagaattgtgacaaaaaattcatatttttaataaattacccagtctgtggtatgctgttatagcagcacaaaatggactaagacaagtggtattgtcttaaaaatcataaaattgcatgaggtcaataagtggctataaatgtaagaatatataggataagttataagacagtctaacatttaaaggtctggtacagttgcaatcttcaggaaagatgaagacaaatggacaagagaggtaaggaaaaacccaaattgggaaagtgagattgcagaatacaaaaaaagaaagtgattcaaaataggagaaggtggttacttgtttaatgcttctgaggtttggcagaggggtgggtgtaggtaatttagcaagagcagtttcagagtgggttgaagccatgtgggaa

SEQ ID NO: 129790 - DNA, 332 bp, Homo sapiens
atcagtatccgggatttaaggcattgttttctccaatttattcacttagttacaaatatttattgatatatcaggcattgttctagacactagggttaaatccatgagtaaaaaatatagaaattaacatcttcgtgagggacatggcagtgactaatattaggttggtacaaaagtaattgtggttttttgccattgaaagtaatggtgaaaaccacaattactgttgcaacaacctaatataaaggatcaaatgcgttatattaggtggttagaaagcactaaggttaaaaactaagcaggaaagtggtaaagaatgctaggagatgaga

SEQ ID NO: 129791 - DNA, 287 bp, Homo sapiens
gacagcctggggacttcccccgtgtcccgggggttcctgccgggcctcaggaagggtcctgatcagatggagaactcggtgacctgctcgtcttcaggagtttattttccagggtcctccattcgaggaaacaaggcaagggggactctgcggaggccatccgtcctggaagcagggcgtcaaactctgggcattctcagcccagctgtgtttctgggcccccattggatgaccctgagcaaactccttccgagactgacgttttcctctgtggagtggaggtgaca

SEQ ID NO: 129792 - DNA, 421 bp, Homo sapiens
tttttctttcactcctgtatcccttttccatggccaagtccagtcaatttcaccttgtaagtactgtctctgttccaatctgtttccacccttcactgcctcctcacaggccttcctgctgtcagacttgtccctttgaaatccatccttcacagagctgcccgtggagttgactcaaaacaaaactcaaaccattttcctcctctccttaaaatctttcaggtccacagatcttctattcccctttccaaagggtccacagaagccttagaactccagcaaatacaatctctcaatcactgacctgaaacatcaagtccaagtgccttaccaggcattgtggtctttcatgagccagtccctgaattccagccttctgacagtccccctcacacttatgcagtatattatcaacagacct

SEQ ID NO: 129793 - DNA, 574 bp, Homo sapiens
ctactcaaatagaatagaatttgatttcccatccaccagttggaatatctgtaccacttactttatctcccttacctcgcttctgcttttgtttcctggttataagaataatctctgttttttcaagtaagtttccctctcatagcttgtttagtagttaccagactgtgagactatgaagcctggggaagggcgtggagaggcacagaattcttccaaggtgctgtgttatatgctcgccaggaattgtctgtgtattgaatgaatgtaactagtggtggacgtatttgacgttggagagagggctatgcattctctaaactgtggtttctggagtgagatgacacaccacagacagtgtccaagacaatttattggaggtcaggaagaaatataccttttgtttatatcttacacttaaaaatataaaataatgtgaaaacttgatttttccgatctagaaagacacaggtgcctccagtcactgaacattcagctggtctcaggtctcctgtaagaagggacggccttcacatgtgaaaaggttaatagtgtcttcttcacagattggttg

SEQ ID NO: 129794 - DNA, 485 bp, Homo sapiens
tgttcaggaggctgaggctggaggattgcttgagcccaggaggcagaggttgcagtgagccactatcatgctactgcactccattctgagcaacagtgcgaaactctatctcaataaacaagcaagcaagcaagcaagaaaggaaaagaaaccagaaaagaaagaaaagaaaagaaaagaaaagaaactcttgtccagatgcttactgttgtgcaagtgatataatcatggaaagctcctggaagaggatgggatcacatctactgtaataaggtacctgcaccaaattgatcctggtgccagtccccaaagccttctaataaatccctgttttgctcaagataaccaatttctgttgtttaccgttacaaatgctgtctgatagatatgcttgttaaaaaatggggatagccactggtcatattgaaaatctatcctcttaacagtgacaggggagcacagttccactgcttcctcctagagca

SEQ ID NO: 129795 - DNA, 182 bp, Homo sapiens
ccaaagacaaatagccacagttgaaaagaaaaaaatcagaaatctaaaaacataatggaggctcaggcctgtaatcccagcactttcggatgcccaggcgggaagatcacatgaggccacgagtttgaaaccagcctgggcaacatggtgaaacaccgtcactaaaaaaatacaaaaaaata

SEQ ID NO: 129796 - DNA, 479 bp, Homo sapiens
gcctgttaaatttgtctccctcctctcttccttgccttcctatattctgttttctgcaatgcatccagagtgatcttttaaaaatattcagttagggcccggcgcggtggctcacgcctgtaatcccagcactttgaggctgaggcaggagaatagcgtgaacctgggaggcggagcttgcagtgagctgagattatgccactggactccagcctgggcgacagagtgagactccttctcaaaaaaaaaaaaaagacaaggactggaggaagggatccatctcaaggatccccaagcgggccacctcacagggggtccaggggggtaaccctatcccacagggcgtatcctagggacagacggggggctgaggtgcaagtgacaaggcgcttcagaaaaacgactagggaggtgaaaaatgattacaagagggtatactggattatgacagagggaaagctataccggtcagagattct

SEQ ID NO: 129797 - DNA, 339 bp, Homo sapiens
tagtggtgggaatttcgtaaacatgtgcatgggttaaaactcctagcactggagctgggtgcagcagctcacatctggaatcccaactctgggaaaataaggagggaggattgcttgaggccaggagttcaagaccagcctggggaacatagtgagatctcatcactccaaaaaattaaaaagcttagctaaggccgggcgcggtggtgagctcctgtagtcccacttactcgggaggctgaggcaggagaattgcttgaacccagtaggtggaggttgcagtgagccaagatcatgtcactgcactccagcctgggcgacagagcgagactccgtctc

SEQ ID NO: 129798 - DNA, 203 bp, Homo sapiens
cgtacctctgacagacatctttaagttctctttcttgatctctgcagtatctatttactgctgactccttcctctttaagactcccttcaatctggcatcatgctatgctgctcatttcccaactatctctctggctattcaatgacaaacttcacaggctcctcatcctctacctgcctttttacatgcaccatctttagag

SEQ ID NO: 129799 - DNA, 451 bp, Homo sapiens
atccacttttttgagttcccacacaggagtgagaatatgcactgtcttccagtggctggcttacttcacttaacatcatgacctccagtttcatctatgtttgaacagttttaatcaacatgaaattcacaagaaagcaaaagagtggaaacaggactgcagtcaattgccttgatcagaacctgatcaagaactagtcaccactttggaaaacaccatctatggaaatcctcctgctgctatttgagttgccaacacaacacaccagtgttggcagttctggtatctatctcaatgattacatctagagcaaacctgtgggtcttttgttccatccctaccttatcatttacctattaaaatgccatggtgttttaaaataagagttgctttcctgttacatttctgttttacattgcagttacagcctcaaatacatgttggaaaatta

SEQ ID NO: 129800 - DNA, 459 bp, Homo sapiens
atcatgtggtgctatcatgacatttaaccactttctcattctctgaaccatattttctaaccatctttaaatattgtgtaaccatctttaaaaagctccagaatcaattgcaagccaatacattctgaaatcatcagccacaaatttgcttttaaaataaataaacttttgacttagtcatgttgtataatgatgtaacacattaaaaaacacatggggctgggcgcggtggctcacgcctgtaatcccaacactttgggaggctgaggcaggcggatcacaaggtcaagagatggagaccatcctggccaacatggtgaaaccctgtctctaataaaaatacaaaaattagctgggcgtggtgagccaagattgcgccatcgcactccagcctgggcaacaagagcgacactccgactcaaaaaacaaagaagaactataaggcagaggcaatgtgga

SEQ ID NO: 129801 - DNA, 473 bp, Homo sapiens
gaagagattcaggagactcagagctgatcgtgggcaagggtaactttctagtgaggggtgaaggcaattgacaatgagcaatgttgatattttgaggtctcagagcacgtggaatggatgcacttcttgaaattaaaaaaacagttccctaaacaaaggaagacgacggaaatttggggtgattcttagcagcatgtctggccggcagccttgcaagtgatttatggggcccgtccccttccccctcctgcgctggctgaagtcaaagccatatgccctgtttctgtgcagaggcctgagctctacgaagcaggagcttcacccagacggggctggcggggagggaaccaagctgggccaccgggctgtcatgccagctcctaaaagtgggcatttgtttcctgctttctagaatcaagtcagtccaaaccttatggctgtatttccattaaaactgtcattggaatatcgca

SEQ ID NO: 129802 - DNA, 137 bp, Homo sapiens
aattttgccgtgagccaaaaactgctctaaaaaataaagaccactgaatgagtgaatgacataaccatgtacagacatgcaagaaacatggacaggcagatctaacctttctttcaatgtcccactactatcattta

SEQ ID NO: 129803 - DNA, 807 bp, Homo sapiens
tttactctttttgtggcagatgtgactgggattgcatttctgatttggctctcatcttggctgttgttggtatatagggatgctagtgatttttgtacagtgattttgtatcctgaaattttactgaagttgtttatcagctgaaggagcttttgggctgagactgtgaggttttccaggtctagaatcatgttgtctgccaacagggttacttttgtttcctttcttcctatttgaatgccctttatttttttctccctgattcttctggccaggactccccatactattttgaataggagtgagaggaggcattcttatcttgtgccacttttcaaggggagtgcttccagctacagtcttttttttttttttttaatgataaatacagtgatggattttgtggagtaatttcttataacattctttgggcagctgtaggtgaaatgttgaaataagattcagaaaataggattctgtaagggaagaactgtcacaagggagcaaaactcaaagcatgacaaaactgtcacgctttctaatggattatattggttgaatgattggtagaagaatagatgaacgtggaattctttagaaatttatttagtttataaaggccttttgataaggtttggttatgagaagttttaaaattatgttgcctagagtttattattttatcctgcagattaaacatagatcataggcttttgcattcaagtaaacagtaatggccttgacatccctagtcagaacttgtgatggaatagatggtcacctgtctttctcatggaagtgaaccaa

SEQ ID NO: 129804 - DNA, 815 bp, Homo sapiens
gaaaatctggagaagggtgagtggaggctggggatataactcttaggtgcaatgacttgttttctgctggtggtttcttttgcttgtgtgctgatgtttcccaggtctctgtccttggccttctttgcttctctctctgcccttttccctggagagtttatgcaagtccatggtttcaagttcactcagatgcttatgatttcttcctgcactcttctgttcccagtaatgatccactgtgcatctccatctttgtacataggcacctctatgcttcatctcaccagtggccttaatccttctgcaatcaattgtttcccctaaaaaaccctcttcctatcatggtatatcctctactttctttccagccttaccttcttctacttactcacatcttcctttctagcatgtagatcttttcttcattacctgcaaaatctcatatcttcatgtctttgtacatgctgcaccctcttccagaaatgccttccaccacttcctatttcctttgtcttcctagcaaacttccactcagcctcaaaccttaaatacccaagaaaaaagtcatgtaagtgttggtaaagtcctcccccacatcccaggatgaactagtcgttccccactttggattttcacagtccttcctgcatacctcaaatatggttcttatgacctgtatggccttgttttctgcatagtggtatccctctctggacttcaagctgtttatggcaaggaccgttgtcagccatttctgaatcctagctcagtgctcgggacattgcagatgttcaatacatttgcattaataattt

SEQ ID NO: 129805 - DNA, 451 bp, Homo sapiens
gggattacaggtgtgtgccattactgcccagctaatttttgtactttttagtggaagcagagtttcaccatgttggccaggctggtcttgaactcctgaccacaaatgatccacctgcctcagcctcccaaagtgctgggattataggcctgagccaccgctgggctgaggtagtcttgatttatattttttcagttttctgaatttgaactgaattcatttcaactttatatgaaactctaaacagcatgatgaacatgaaataaaggtgagctaatggcatattaatttctgaagtattcccattttgtcaaactaattagctcttagataggccatcttcaccaatatactaagtagtttcccctcccacctggtacaggaagtttaaaaatttgtgtatctccaaatgtcggtattcatattcaatccactaaactaggaaaaaatt

SEQ ID NO: 129806 - DNA, 221 bp, Homo sapiens
gccagtccctcaccctacttctttgtaactccatcataattatacctggtgtgattctctgacatgtgtgttctaagatgatctttgataaacgcctacttgagtttaagattcagcacaaatatttctcccttcattaaagccttgactacaagcagctaacttataatctcctctcctgcttcaaattcaacatagttctatttagtaattatttcttt

SEQ ID NO: 129807 - DNA, 202 bp, Homo sapiens
ccgcctcagccccagagtagctagggctataagcgtgtgccctcgatggcacctggctcaaaatctaatattaagaatgatgacaatgacaataattaaatggctaatttttaatgagtgaaaactcttctactactcaaccttctccctgaaaagttcctcttctgtccctaactaaagtctgtccgtgaaacactctcat

SEQ ID NO: 129808 - DNA, 437 bp, Homo sapiens
ccaagatcatgccactgcactccagcctcggcgacagagcgagacttcatctcaaaaacaaacaaacaacaacaaaaagccacataaatatcactggcacttcatataattaactgtacaaagtatttcctgttgtttgtcttgacaaacactttcataacacttaccatgtgcagatactgttctaaggactacaaatactaactctgcaatccctaatacaacctatgagtcaagtactattattatcccccttttacagatgagacaactgaggctcagggaaaggttaagtaatttgcccaaggtcacagaattggaattccaacagagagcagctgcctatggtgttctcaaagggagggcaatgccaaacgaaaacaagcaacaagactctactcagtggttgcgactggagagcggggatactctaggag

SEQ ID NO: 129809 - DNA, 425 bp, Homo sapiens
ccaagatcatgccactgcactccagcctcggcgacagagcgagacttcatctcaaaaacaaacaaacaacaacaaaaagccacataaatatcactggcacttcatataattaactgtacaaagtatttcctgttgtttgtcttgacaaacactttcataacacttaccatgtgcagatactgttctaaggactacaaatactaactctgcaatccctaatacaacctatgagtcaagtactattattatcccccttttacagatgagacaactgaggctcagggaaaggttaagtaatttgcccaaggtcacagaattggaattccaacagagagcagctgcctatggtgttctcaaagggagggcaatgccaaacgaaaacaagcaacaagactctactcattgcaagtgagcaaaggttctga

SEQ ID NO: 129810 - DNA, 306 bp, Homo sapiens
caggccaagaagagcagagaaacagagtcactgccattcaacagttcatgacaacttcaacaatagggccaccataatgagccaaaaattaggagcaattctcctgtgttttaaggaaccacaaagtctctgagagactgaagaagagagaacacccaaatgacaaattaaatttacctccagcaaggtgggattaaggctcacagaaatatccagcacactctcctcacatctactggggtccaaggcctcaacagcacagtctcctcaacctgctgctccagacatttcgcttttcttcctctg

SEQ ID NO: 129811 - DNA, 462 bp, Homo sapiens
agtacaattatcaaaatcaggaaatttgatgttggtgcaaaactgtgatctaatccttaaaccatattcagatttcatcaattgcctcaatgatagtctttatagctatttttcttatgctagtgtccagttcacaatcatgcctttcctttgcttgttgtgtctatttactctcttttaactttgaacagttcctcagcctttctttggtctcttttgccattgacagttttgaggaggccagttattttgttgaatgtccttcattctgggtttgtcttctgttttctcatgaccatatgcgggttaggcacttttggcaagcatattaccagaaatgatgatgcactttattggcatgtcatatcagggaatgacattgatgtgtctcattattggtgatcttgactgtgatcaattggtgatgacaaaggtgatggcttccaggttttccagtgtaaa

SEQ ID NO: 129812 - DNA, 282 bp, Homo sapiens
tttctttaatctctcccctgacatacagtctcgaatcagtaagtcctatttgttctactatcaaaatatatatagaatatgctaactctttttatattccctgccatgatcctaacagcaactactgtcattgctgtgttccactgcaactacatattaacccttctccttcctattattcatgccctcctaagacacattcttcctactgtagccataatgccttcttcaaaaaaatgtaactcaggctgggtgcgttggcccatgcctgtaaccccagaa

SEQ ID NO: 129813 - DNA, 568 bp, Homo sapiens
cacaactaatgaaccagtatcaatccgttaccattaactaaactccacatttattctgatttcaccagatactggtcatgtgttttgtagaaggccgctccgctggggttcgccttgtgtttttatcatggtgagactggggttatgggtttgggggggaaggccacagaagggaagtgcctttctcattgcctcattgcaagggtgcgtgtcaacatgacacatcacggatggtgccagccttgaccacctggctccgggagtgcttgtcaggctgctcccctgtaaagtcaccccctgcttccatactgcactcttggagtcaagcttccatactgcactcttggagaagaaggtatgatgcccgcctcctggaaggggagacacacaccactggggtagagttcttctgtgggaaatgtgcctcttctccccatttatttatttatttgtttatttctatcaatatgggctcatagaaatgtattttgtactttagttataatccgatagcacatgatgtattttgttactcaggttgttctagctttagccatttggggctctt

SEQ ID NO: 129814 - DNA, 701 bp, Homo sapiens
ctatacacatcagtttgtctgaaattgtatatttctcaacaatattgatctatttgtatttcaatatgttgtatgctctcatatgtctgtatctttgcaaatgatattttcttctctttaacgatttttgtcttaccctgctggtaaggaagtcaccttccctctcccttctgtatatccttgtcaaggaactatggaaattgaatggcataggtcttgatacaagaacctctcttttctctttataaaaaagtcagtaaatagtggtggaacattcaggagaaagttggggacatagagactaagaaggcaatgcagtattattaggacagggggtaaactaaggcatagaggacagatttgatgaacatattatcttttttatatacattataagaagtagaaggctagaaaagtgaacatgcttgctattgcacgtctcactttccaatttcatgaagaaagcaaaaactacttctactttattacttctttttgatgttaattggtaccacatagcaagtttgcattatagtactgagctttaaaatgcaaggatatactcatgtatatacacagacaataaataataggttcttttccacattcaggaagtgaaactcagctgtccgtacgacacttactgtccatatataggcatccctcagtatctgcaggggattggttccaggaccctcaca

SEQ ID NO: 129815 - DNA, 352 bp, Homo sapiens
tttgttcttttcttaaatgccctatgcccattttgtcattgggatattcatttctcctgatttagctactgaaaatattaactacactgggttacaaatattttccccagcttgtcatgtgtcttccccctcccccaccccacctgagcttattaaggggtaaatggtatacaaaaaaactgcacgtaattcatgcatacaactgggtgagtttggatgtatgtatacactcacgttgccatcaccacaatccaggtaataaacatatccatcacctccaagtttccttgtgtccctacgtgtgtgtgcatgattgtgtgtggtaagaatacttaacgtgagatctaccctc

SEQ ID NO: 129816 - DNA, 598 bp, Homo sapiens
gctgcaaacaaactattccagaaagtgatgtcttgaaacacaaccattctattttgcagtctgtgctgggctcagccgggcagtcctgctggtcttacccatggtccccaatatggctgcagtcactccagtagactggaggctgggcttagctgagatgacctgctttctttctttcttcatgtagtctcatggcttttctctctctccatgtggattcctcatgtgaactctccagcaaggtagtcagaatttcttccctggcaactcagggctgccaagaacacaaaagccaggctttcttaatgtttaagcccagaactggcatgtggccaattttttgtgttctgttggttaaagcaaaccgagtcaagaagagcctacacaagtagtaatattacaagtatgatgaaatatcattctcttcttagaccaaacagcatattcctccctccactcttaccctctataatgttttgcttttgggagttcctttatatgaaatgcctcccctctacttctccttctactgaaatcctactcatcctgaatccagctcagagctaactcagtgatttccttcatacatctctattat

SEQ ID NO: 129817 - DNA, 760 bp, Homo sapiens
gtccattcctaacaattagatttttttgtttttttgcttcccttcgaagtgagattatttagataactaacttctgctgagtacatatacatattgttcctgagggtaagaattaatttaagagccagataggagattttttttaaagataagtagacagtagaatataatttctagaagactcaagatgtacatcttcataaaattttacgttatcttaatttcatttatgttttaaagtaaaagatgttgcattgacataatgtcttagttataaaggtaaacatttttatttttaaaattatgatactactttatgcagtatttagaaccattttactaaagaaagccatttaccaccatagcagagagtattaaaatgttagtaagtccaaatggttgttttgttttgtttttctggagaaacttacttcgaatagtggtaactataggcacacaatttacttgtaataaagaacactaatggggagggtaggagtaaattaactagaaccttaataatgggcttttctagctcaaggaatcttataattgtccctgaaggtagttgtgaaggaagttgcaagatgaaatatctagatttgtgtagtagtcattccaggaaaaatgttgccttctggcaaactttggcatctttattatgtaaaatgcctttttaatgatagcatttgatgtcacctaattgggatagaactgaggcccgttaccagataattgctaaagagcctccgcgcagtgg

SEQ ID NO: 129818 - DNA, 625 bp, Homo sapiens
ccagaatgcacttggtctaagagtaaagagtgctacataaagattgatgtcagggcattgctgtggatttagtgaggtactctgaagagagtggtccagtgacagtctcgttttaaaagattggatgtaggtataggaagatgagttcttgaaatgaggactcagtatacgttgaatataacaaaggagtttgcattgaagaaagatcactatttaagcaaaacagatgttttgtccacagtccaaataatgtggtttagtaatagcacagcttatctctattcattttctcttttggtattctctcctgttgattcttatgtagtttttatatgaagtcaacttgaaagttgtttaaagacaattcgaggcttgctagggatgtgtgagggagatactttgagggcattattgaaaggaaatatttgatactggacagaaagaatattgtgaatcctgtagattattttaaggaaggagccttaaggttacaaagagtaggcttattgattggggtttgtagtggcgggtgataaaagctataacagtttctactaatagtgttgcactgtaatgatggaataaaaaatctttgggtccttagcaactggagatggggtagtga

SEQ ID NO: 129819 - DNA, 421 bp, Homo sapiens
acacaaggtgccagacacaaagagagtgagtcacgatcgtggtatgtctgacaggtagagcaacagtctgatgatccagtagacaagccacgatgcagagtccatcaaaaagtcagaaacacacatgcatgcttgtttgaacagctcaaggtttgttggatgcctgaaagtatgcctgtggactgatttggctgcacagccaaagaaagactgaaatagaaacgaaatcatccagctggccacactgttggaaccaagctctgagaaaaggtgggatctgtacagatattggaggaaggtgaccaggcaagacagtcagttaagacagaatcagctgaacaactgctcatgcattcaaaacaacttgattgaatgcctatgttctagacattcacatggtctctttctatctcatatacag

SEQ ID NO: 129820 - DNA, 371 bp, Homo sapiens
gaccttacctcttgtctgacagccctctgtgtacccatgtttaggatgtatgaatttgttacctattatcttccactaagattttctactaagcagactttcattatttcaaaataaacatatcttaaaatttatcttccaaattccttagacgttactaagcaaattctcttttaagtagtttttaaagcattagttatacaatgatagagtaatagtccatttggagttttataataacatagctacaaaaatgttgagtaataggtacgaattagataaatttagatctatgtgctcattcaaaatgtaaagtagtaatgatactggaaaatgctcctgatacagtaagtacaaaaaagtgtgacagt

SEQ ID NO: 129821 - DNA, 586 bp, Homo sapiens
tgctgggttcaagcaattcttgtgcctcagcctcctgagtagctgggactacaggcacccaccactacgcccagctaagttttgtattttcagtagagacggggtttcaccatgttggccaggctgatcgcgaactcctgacctcaagggatctgcccaccttggcctcccaaagtgctgggattacaggcatgagccaccgcatctggctatgatagtgctttttgataatgagctttaaaaggatactgagggatagaagctagagaataaggggaaaccaggcaagtgatatcttgctgatgacaagagaataaattgttgaaaatacatattcctttgtataaatcttagggtacatactgactcttttttattgatacatactagctatacatattttctgctgggggaacccgcccccagtatttcaacgtaggttctttctgttttccctaagtgttggctggtctgagaaaaaagagaaagagtacaaagagaggaattttacagctgggcctccggggatgacatcacatattggtaggtccatgatgtcctgagccgcaaaaccagcaggttttta

SEQ ID NO: 129822 - DNA, 429 bp, Homo sapiens
atgagggctctggattggaattgattaatatacattcatgggttaatggattaatgcattatcattggaatgggactggtggctttataagaaaaggaagagagacttgagctagcacattcagcccccttgccatgtgatgccctgtgccacctcaggactctgcagagtcctcacagcaagcaggtcctcaccacatgtggccccttgaccttggactttccagcttctagaactgtaagaaatgtatatttttctttataaattatccagtttcagatattctgttataaacaacggaaaacagactaagacactattctatccaaactcaagtgacatactgacagcatttgttcaaatcttggatttggggactccttgctctaggtcccatgtctgtgaggggaagtacttgactagaattag

SEQ ID NO: 129823 - DNA, 330 bp, Homo sapiens
ctatcctgaaactacaaaatgtacatgagaggaagaaaggaaggaaaggaaatggagaggtatcctgtgttcataaggtcaagattgtacatagtaaagatatagatttatttcatattgatctgtaagtttatttcaatttgtatcaaaatttcagtaagtttatttttagatatcgatgtttattctgaattgtatagaaagtcaaaggaccaacaatagataaaatatttctgaaaaaaataaatgaagtgggagaaatcactctcaataatgttacgacttactgtgcagctgctatagtcaagacgctgtgatcacaatagagaa

SEQ ID NO: 129824 - DNA, 298 bp, Homo sapiens
taaatggctgggtccatagtaagcactcaggagattatttagtgctatgattttttattattagtattctgtccagaggtaacagaatctgatgaagattctgccagctggtcaagttacctacacataagagcaaggctatattttctttttcttttttcttttctttgagacggagtctcactctgtcgtctaggctggagtgcaggggtgcaatcagctcacggcaacctccacctcccaggttccagcgattctcctgcctcagcctcccacgtagccaggactacaggtgcct

SEQ ID NO: 129825 - DNA, 266 bp, Homo sapiens
gcctggggtaattggggaggggcactggtgtcagtcttggagtccaaaggctggagagcctggagttgtgatgtcctgttcaagggcagaagaagggtgacccagctccaggagagagagagaattcaccatttcttcatctttttctacctgggcccccagtggatggatggttcctgctgacattgagggagaatcttcccactcactccacagactcatgctaaactcttctcaaaacaccttcacacagacacccagaaatc

SEQ ID NO: 129826 - DNA, 345 bp, Homo sapiens
ccgcctcctgggttcaagctattctcctgcctcagcctcccaagtagctgggactacaagcgtgcaccaccatgcccagctagttttttttgtatttttagtgagacggggtttcaccatgttggccaggatggtctcaaactcttgacctcatgatctgcccacctcggcctcccaaagtgctgggattacaggcgtgagccaccaagcctggctagcagtccccaagttttaaggaagcactgaactccatgacaggtttagtgcacagtgaacatctttcacacgagaagatcagaagatagccaccgcacctttgatccccggttctccactggcttgcag

SEQ ID NO: 129827 - DNA, 279 bp, Homo sapiens
cactttgctcaagctcccagcttggccattggtgctcctccatcctgcagtcctaccccttagcctgccacagcccttgacttttcaggcccaccttcagccaggcctcactctcctacttctggccaggctgttgcccaaattgccatctccagtgggtagaagactatttatagctcccactgcaaattggttcggagactgaacgctggtctcctgaaatagacctttagtgtggacagagctcatggcaaaccttcttgggtgtagggtactcag

SEQ ID NO: 129828 - DNA, 537 bp, Homo sapiens
ttctagaggatccctcaacggcaggttgtactgggtacatttcccctgatctcgtgttctggcctgtaccactgtcctgagaccacctttcctgcatctgtcatgactctggtcccacctgtgctagccccaggcccctgctcctattgttcaaccccgtccctgggagcaccactccttcccagggctctgggtctctgctcccggggcttgggaacatgcatgtccttggtgagaagaccacataaaagggcatggcctacttccaggagcctccctgattcccacttcgagataaaaataataaacacacacacatacagagggcggagagtgaggggggaattaagtggtgtagaagctaaggcacaaggatttacaaagcacagggctgcggtaacctggcaacctacgaaaggtgtgtcagaatgagtaggatgcaaatagacaagcaccagggctgggaacagtcagggctggacgggggaaggtcacaacgtgctggcctggttccttgtggcgctgagctgaggaggg

SEQ ID NO: 129829 - DNA, 825 bp, Homo sapiens
tgataaaagccagcatctccttatgataaaaaccctcaactaggcataaagaaacatacctcaaaataataaaaaccatatatgacaaacccacagccaacatcatattgaatgggacagagttaaaagcattccccctaagaactggaacaagataggaatgcctactttcaccatttctattcaacatagtacttgaagacttagcccgagctatcaggcaagagacggaaataaaggacatccaaattggaaaagaggaagccaaactatctctgtatgctgattatatgatcttatacctagaaaacccttaagactcctccaaaacactcctagatctaataaatgaattaagtatcaggttacaaaatcaatgtacagaaatcagtaacactgctatacaccaacaatgaacaggttaataatcaaatcaagaacacaatccgtttttacaatagctataaaaaaaaaaaaaaaagccccaagcctaggaatatacttaaccaagtaggtgaaagatctctacaaggagaactgcaaaacactgctgaaataataaaacaaatggaaatacatccatgctcagggattgaaagaataatattgtgaaaatgaccatactgcctaaagcaatcctatgaaattcctatgaaaataccaatatcattttcacagaattaggaaaaacaatcctcaaatttatatggaaccaaaaagcccaaattgctaaaacaatcctaagcaaaaagcataagtctggaagcattacattacctgacttcaaatcatactacaaggctgtagtaatccaaactgcatggt

SEQ ID NO: 129830 - DNA, 473 bp, Homo sapiens
taccatgccgtacccattaactatgtcttcttgccttcctcttgtctaaaacaagtgaaatttctttactcatccttctatgaaaaaacaaaaaacaaacaaaaaaaaaacactcttcccaattcattggtagctccagaatttctacacaggatgacccagaggcagtaattttgttggaaagacatgccaaagaacatatcttgagtctgtcttgcagagcagatgctgtgtttttgtttagtgttggcttctgtagggtggcctggaaggagtggtgtgctaattagctcagtcacagtcctgtgggctagtttttgtttgtttgtttgtttgcttgccactccagactttttctccactcttccctaccttgtcctgtacccaaagagggtgatttctgtgggctgtttactcaaagtcccttgtccccctgtaagaaaaccacaaggttggatcaaagagagacagag

SEQ ID NO: 129831 - DNA, 552 bp, Homo sapiens
gtcatgtctaggctcaccccgatgcagtccagtcatgcttcccctatgacttagttgtttgtattgtccccagagtcaagagtgtcccaagtctatgaatcttgctccagagcattgtaatttagcctacggccttgttcacacaaataaatctggcattagttccagctggcagtgatatgggcttggtgattcacttttaggcctcattggagtagagttaaagaaacttcattgtcagaaagagtgagatctctaccatgtgtcttctaagagtgttcagagtgttttttttttttagcgtgcagaagtcctaactttattcctagtaccctccattctctcttttttttattgaaacataagaattgtgcatatttacagggtacatgtgatatttttatacatgtatacaatgtgtaataatcaaatcagagtaattaggttatcagttacctcaaacatttatcctttgtttgtgctgggaacattccaaatctcttcttctagctattttgcaatataaaataaattactattgccaccttatga

SEQ ID NO: 129832 - DNA, 233 bp, Homo sapiens
agggctccaacctaacccttcctttctttcactttagatacactccctggactatctcattcacatctttggattcatttacaaacataagctatggtatctctatctctaatttagatgtgtttcctgagctccagatctacatagccaagagacaactgtaatctaacaggaacctcaaatgcaatacaaccaaaactcaagattgaattcaacatctcccccaccaacct

SEQ ID NO: 129833 - DNA, 383 bp, Homo sapiens
acacagtggctcactgtgctgagacaaagtggaagctgccagtactcttaaagacaggcctcagcactggcattgggtcacttctgatgtactcttttgggcaaagcaatcacaggccagcacaggtccaaggagagaggaaatagactcaacctcttggtaggagtcgtagcaaagattttgtggccagtgattcagttgcagttatctgctgctacctagcaaactaccctcaaaacacagaatcttaaaactacaatttattaacatctttcacaagtttgtgcattgcctagactcagctcagtgtttctcacttgaggttcctcattctgctcagttagttggaggctggggttagagtcctctgaaggctctagcgg

SEQ ID NO: 129834 - DNA, 179 bp, Homo sapiens
cacctctgtggcatacagtgtgttgaattgaaacaaagaagcaaaatgagctttcataaagtgactcagactaggtattattttaacgactttttacaaattatgtgagcaatcttcagtttgttcaagggtattttagttttcttggacttaaataaagtttctatttcagaatcatt

SEQ ID NO: 129835 - DNA, 456 bp, Homo sapiens
gcctgggtaacagagtgagacgctatctccaaaaaaaataataataataaaataaaaataaaacaaacaacaaaaaaaaggagaagaaaataaatataccataatgttgaaatataaaaatatagggggttctttctaaatgccaaacttcttagtttgcagaaagaaagggcatgtttccatgcaataagtttataaagcaaatagcatgttcaagtacaaaagactctttcatgaactgcggatgaaccttctgagtgctggacataatctcaagatttaaagttggtttacttaatatatcttctagaatacaatctttaggaaaatgttttggcatcccattcataattctctgtctagtctaaaccatagatacttattgctaatgtcatataaagctgtgtgtgtgtgtgtgtgtgtgcacgtgcacatacatgtgcctgtttgcacata

SEQ ID NO: 129836 - DNA, 263 bp, Homo sapiens
gaatataaccgtgtttggagataagatctttaaagaggtaattaagttaaaacatgctgctagggtgtaccctaatccaattcgcctggtctccttagaagaagagaagattaggacacacacagagatcccagggatgtgcacatgcagaggaaagaccatgtgagcacagtgattgtcacgaagaggccacgggagaaaccggcaccccactcttggatatctggccttcaaaactgtaacaaaatgagtatctgctgctt

SEQ ID NO: 129837 - DNA, 3942 bp, Homo sapiens
  misc_feature (2882)..(2882): n is a, c, g, or t
aacggtcgacggtggccgatagtggtcctactgtcgtgggactgctctgcgcgctcccggtggggcgcgcctgcgcattatgctggtctccatggcggggcctcggagccaagacgagagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaagctattaaataatagaagaaaatggaattgaatatgatgtcagcatggaacaatctaatgattcattaagagtcaaccataatgacggtgaagagtcaaaaaccagtgctcaagtatttgagcatctaatctgtatggactccagggattcttcctttggacaaaatgattctcctacagttttgcccatcactactcgtgaagcaaataattcactcatatcacagaatataccagggcccctgactcagacacagactctttctgcagagcaattccatctagtggaccaaaatgggcaggctattcaatatgaacttcagtcattgggggaatccaatgcacaaatgatgatcgttgccagcccaacagaaaatggacaggtacttcgtgtaattccacctacccagacaggaatggcacaagtgattatacctcaggggcaacttgtggatgtgaatagtcctcgggatgtccctgaagagaaacccagtaacagaaacttaccaactgtaagagtggatactctagcagacaataccagcaattacattcttcatcctcaaacatccttcccattgcccaaaaagtcagtgaccggaatgctggaagaaccccttctggggcctcttcagccactttcttctaatacacctatatgggcctgccgtcttaggagctgtgagaaaattggagattcataccgtggctactgtgtaagtgagactgaattagaaagtgtcctaacatttcacaagcagcaaacacagagtgtttgggggacccgtcagtctccaagcccagccaagcctgctacacgcttgatgtggaaatcccagtatgttccatatgatggaatcccatttgttaatgcagggagtagagctgtggtaatggagtgtcagtatgggccaagaagaaaaggtttccagttaaaaaaagtcagtgagcaggaaagcaggtcttgtcagctctacaaagccacttgtccagctcggatttacattaaaaaggtacagaagtttcctgaatatagagttcctacagaccccaaaattgacaagaaaattatcagaatggagcaggagaaagcttttaacatgctaaagaagaacttggtagatgctggtggtgttcttaggtggtatgtacagttacctacacagcaagctcatcagtatcatgaattagagactccctgcctcactttgtcaccttctccttttcctgtgtcttctcttgaagaagaggaaactgcagttagagatgagaattgtgcattaccctcacgtttacatcctcaagtagcacataagattcaagaattagtatcacagggaatagaacaagtgtatgcagtaaggaaacagctaagaaaatttgtggaaagggaactgttcaaacccgatgaggtacctgaaagacataatttatctttttttccaactgtaaatgatataaaaaatcacatccatgaggtacagaaatccttgagaaatggagatacggtatataactcagagattattccagcaacgcttcaatggactacagacagtgggaatattctcaaagagaccatgacagttacatttgcagaaggaaattcaccaggagaatcaattaccaccaaagtggaaacaaatcagaccaggggttctttgtctcctgagccaacccacttgctctcctcactctcctcatttcagcccaaaatatttacacaactacagggtttgcagttacaaccaaggtacacctctcctgatgaatcaccagctgtggtatcagtaaataaccagccgtcctctagtccttcaggacttctggatacaataggaagtgctgtaatgaataataattctctactgcttggtcaaagtcatagccttcaaagagatacatgcttaacccaaaacaatagtactgcctccaccatgggtaaccttccagaaccagatcaaaatctagttgcaatggacgagctggtagaagttggagatgttgaggatacagggaatctggaaggaactgttcatcggattctgttgggagatgtgcagactattccaatacagattatagacaaccactcagctcttattgaagaaaatccagaaagtaccatttctgtgagccaagttaaacaagaacccaaagaaccagcattgtctatggaagcaaaaaaactgtggactataagaaattatctgctacataaattattgaagcttttcagaatttacaactctggtgacttctgatgtcttagaaaggaaggtgaatatagtcaaagcgtggcattgagataattggactgaagaccagtttgatgagaagcttttatttaaaactgatatatttgttgccagttccatatttttaccttccttaagagatgttttactcttcttattttgtataatttttatgctctttgattatctaataaggccagtatttcaaaagctgttctgaatttatccacagtaatatagtctgaacacaaatagtttacttaacttatccttggaaatattcaattttggttattacaaaacagaaaagaacaacagcaacaaaaacattgtgtgaatntatgtttgtatgtgtgtatgtatatcatgaattttttttttaagttctgaaaaagaacttgttctctccttaaagttgtgaagaaattgttaattgccagacaggtaagaaaatgtttataatctatctcattaagaaagatgaagtattagattttacatcataacacaaagtccagcagctacatctgtggaaactgtgcagttgcattttagcctcttcccttccaatttttgtacttttaactacaaaccagtagtatactaatggttatctaatagaaatttaaagtgtcttggtaagtactgagaatttttacttgaattaatcagataagcaacagaaatcaacatatgtagcatggatttgtgctatattggaagtaaaacactataggcagaaagatgtagaaattaagagaattgaaaaagaataatagaattccttggtgtttacagataatttggaaaactttttgatgacagcagaggattttttcccccttattttgtaatgaagatccagcactggttaaaaaataatttgatttgtagttacatttttctatgccagagctcttactgaattgatgatattaggatttctagtattttaaggtaagtatttatagtttaaaatttagtttatatttaaaactttaaaacatctgatctgggatttttttgttaagtaagtatattaacttcaaataccaaattactactaagcagtatattgattataagcatctgttgtctaaagattggtactaggctggacatggtggctcacacctgtaatcacaatactttgggaggctgaggtgggtagataacctgaggtcaggagttcgagaccagcctggccaacgtggtgaaaccctgtttctactaaaaatacaaaaattagctgggtgtggtggtgggcacctgtaatcccagctacttgggaggctaaggcaggagaatcgcttgaacaccggaggcggaggttgcaatgagccgagatcgcgccattgcactccagcctgggtgacaagagaaaaactccatctcaaaaa

SEQ ID NO: 129838 - DNA, 2573 bp, Homo sapiens
aacggtcgacggtggccgatagtggtcctactgtcgtgggactgctctgcgcgctcccggtggggcgcgcctgcgcattatgctggtctccatggcggggcctcggagccaagacgaggttgagtagactcgttttgaattttctcccctctgctccggcggacttcccatgtcgccttgtggggctatcggcggcggcaggactgggggagtcagaggtctggcagcgctgtctgcgcagacctaccggacgctacctcccaacccccctgtcttcctcctgcctcctcctcctcccgtcacctcctgacccgccggagctccgagcaactgccggcctccgcctccagccgcagccggtcactggcggcgccttccgcgccaagcttgggggccttttcggggtcccacatggcacggcttccgacccccggcccgggacggggctcgcaggccccagaggggcaggctggagaaggaggaggttaggtgtcttcaggagggttgctgagcccaaggacgcgccatcgccgcggagaaggagccggaccccttgggcggagcgcccaatgtgtggtccctcacgccgtcccgcaccttgctttttagggttctttttccgctttctgagcccttttataccttacgtttagaaggggaaaatcatcctcccacaccttctccccgactttttgccttttttgtcttgaagttacccaaaggcctgtgtattgttctcaatggtcccaagaattactctaatatagttgtttttctgagggaggatggatggagataactatcctgatcccaatgtcactttttaaggcattcgcttcaagagacaagcagtttagaatcaggcagaactggattgcaaaatttatgggcagaccggtatgtgtgcaggtgaagacaaagctttccttttttacgttgtttaaagatgtcctactgtaaggtagacgcctaatgtttaaatgaacgcctaatatttaaatagagaatgagaagagatttaaacaattggaagaaaaaataatttttattagagagcaatgacaataaaagtaggactcttttcagtttactcacctttgtagctccgaatccgggccctggaaccagaattcctgggttcaaatcctgcctctgctacttgattaacctttttgtgccacacttttatcaactataagaattaactgcggcatcggaagcactcagtatatgttaattattatcatcaaatagttactaattccagtttaactagaagctttgccagcgtgaatagataagggagaatagccacattgagtggaggaataaaattagaaaacctctgtgctgaagtcccaggagatcacttattaggcttgagcttgctaatggaagtggtgatcgtttaaccatgtggttattgtagtggtgaggatttacacattaaataagtcttgggcatctgaagcttgaaacactttcttaatgaaatcttgccgttgaatctgtacttactggtaatatgtcattggttaaaatatatttataaaatgtataattgaccagcaggttaatacatttttatcattaatttaaatttatcaaaatgagaatatacagtacctgacagtagagtttgatcttaatttgatttgaaaattatgatcaggaaaataacctgaatatatgcttaataatataagactttcagtttgcaaaacagaaatcctgacttgactaaaatacacttttcatttgacggagacctttagttaaggaaagattagttttagcattcaacataactaaatacccagcattatgttttacggtttttttcaacaatgatttatgtgtcgtgtttggtgttgcctccaaacagtacctaggatagctgatgcttttactttgagtctttttctttagttggaacattaattgcaagcttttggttggtaatcattttttatgggatgtatttactatatggtcctcatggagacacattgttatctggagaaccacagtttggaaaatacatttctctttattataaagttttttgttttatatatataatgccacagtgtgataggatacaaagactaagcattagggctttggagtcttaattgttctttgtgtttttctttttttccaatttgattatggatccaagcctaatgcactctgtgatcttaagcaagtttcttgacagttccagttttcttatctacaaacagagacaagaagatctacctcagagtcattgtaaggattaaataaatttgtaaagctctcaaagagcagcctaatcccagcattttgggtggctgaggcgggtggagcacctgaggtcaggagtttgagaccagcctggccaacatggtgaaaccccgtctctgctaaaaatacaaaaattggccaggcatggtggggggtgcctataatccgagctactggggaggctgaggcaggagaattgcttgaacctggaaggtggagtttgcagtgagccaagatcacgccacttcactccagcctgggcaaaaagagtgaaactccatctc

SEQ ID NO: 129839 - DNA, 2037 bp, Homo sapiens
  misc_feature (1762)..(1762): n is a, c, g, or t
  misc_feature (1838)..(1838): n is a, c, g, or t
  misc_feature (1941)..(1941): n is a, c, g, or t
aacggtcgacggtggccgatagtggtcctactgtcgtgggactgctctgcgcgctcccggtggggcgcgcctgcgcattatgctggtctccatggcggggcctcggagccaagacgagagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaaggtttaatatatctttgccaagtccaagggtacaaagattttctcctgtgttttcttctagaagttttatcatttgatagtctgtgatccatttcaagttgatttgctatctggtgtgagatgatcgttgccagcccaacagaaaatggacaggtacttcgtgtaattccacctacccagacaggaatggcacaagtgattatacctcaggggcaacttgtggatgtgaatagtcctcgggatgtccctgaagagaaacccagtaacagaaacttaccaactgtaagagtggatactctagcagacaataccagcaattacattcttcatcctcaaacatccttcccattgcccaaaaagtcagtgaccggaatgctggaagaaccccttctggggcctcttcagccactttcttctaatacacctatatgggcctgccgtcttaggagctgtgagaaaattggagattcataccgtggctactgtgtaagtgagactgaattagaaagtgtcctaacatttcacaagcagcaaacacagagtgtttgggggacccgtcagtctccaagcccagccaagcctgctacacgcttgatgtggaaatcccagtatgttccatatgatggaatcccatttgttaatgcaggtacttttttaaagaattattttaaaaggttcagcagcagccatagtccattgtcaaaatgtgattttcctaaggtgataacatttttattttggtagctgacaattgaatgctaattgattaaaatgcatattaaattgaaaaaacttatagaaaatataatcaattactttataatattgcattttaatatatcaatgaataaataagacttctttcatatattatactgaaaaataaaatatcgaagtttccattaaacctatttaataaaatgttaaaagagcaattttattttaaatatgtacatcagctgtgtttttccccttcagattaaatattttagccttctctcttaatttgtattgtgggagaaatttatgtctattttatgtagcttgtaactctggagttactgtatagaatttgtatacaatctagagttatagaattctgatactaaagttctcaagcattaggtatgttatatacagtattctcagacactgggttagttgtttactaagggagtagagtttcaagcaaatctcttagactagttagagccccaaagaatctaaaactaagcgatttattttaggactatgagggcactaatttagctgaaagagttgcagtttcatcctggacctctgaggttaatgagatatacttaagatgagataaatgtaaccacttctgcctgagtttcatcagtattctataaaagaaatgcagcattaaaaataaatgagctgggttatttatatatttatttatttattttaaacgtggaggctcatgcctctaatctcagcactttgggaggccnaggcgagaggattgcttgagctcacgagtttgagacccacctgggcaaaacagggagacctcatctttacaaaaantaataaattacctggacatggtggcatggggctgtagtcccagctatttgggaagctgaggtggaaggatcacttgacccttggaggtcgaggctgcagtganccgtgatcatgccactgaacttcagcctgggtgacagagtaagaccctgtctttaaaaaaaaaaaattaacaaataataaaatgaacttgaaatcc

SEQ ID NO: 129840 - DNA, 4840 bp, Homo sapiens
  misc_feature (3780)..(3780): n is a, c, g, or t
aacggtcgacggtggccgatagtggtcctactgtcgtgggactgctctgcgcgctcccggtggggcgcgcctgcgcattatgctggtctccatggcggggcctcggagccaagacgaggttgagtagactcgttttgaattttctcccctctgctccggcggacttcccatgtcgccttgtggggctatcggcggcggcaggactgggggagtcagaggtctggcagcgctgtctgcgcagacctaccggacgctacctcccaacccccctgtcttcctcctgcctcctcctcctcccgtcacctcctgacccgccggagctccgagcaactgccggcctccgcctccagccgcagccggtcactggcggcgccttccgcgccaagcttgggggccttttcggggtcccacatggcacggcttccgacccccggcccgggacggggctcgcaggccccagaggggcaggctggagaaggaggaggttaggtgtcttcaggagggttgctgagcccaaggacgcgccatcgccgcggagaaggagccggaccccttgggcggagcgcccaatgtgtggtccctcacgccgtcccgcaccttgctttttagggttctttttccgctttctgagcccttttataccttacgtttagaaggggaaaatcatcctcccacaccttctccccgactttttgccttttttgtcttgaagttacccaaaggcctgtgtattgttctcaatggtcccaagaattactctaatatagttgtttttctgagggaggatggatggagataactatcctgatcccaatgtcactttttaaggcattcgcttcaagagacaagcagtttagaatcaggcagaactggattgcaaaatttatgggcagaccgagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaaggtttaatatatctttgccaagtccaagggtacaaagattttctcctgtgttttcttctagaagttttatcatttgatagtctgtgatccatttcaagttgatttgctatctggtgtgagctattaaataatagaagaaaatggaattgaatatgatgtcagcatggaacaatctaatgattcattaagagtcaaccataatgacggtgaagagtcaaaaaccagtgctcaagtatttgagcatctaatctgtatggactccagggattcttcctttggacaaaatgattctcctacagttttgcccatcactactcgtgaagcaaataattcactcatatcacagaatataccagggcccctgactcagacacagactctttctgcagagcaattccatctagtggaccaaaatgggcaggctattcaatatgaacttcagtcattgggggaatccaatgcacaaatgatgatcgttgccagcccaacagaaaatggacaggtacttcgtgtaattccacctacccagacaggaatggcacaagtgattatacctcaggggcaacttgtggatgtgaatagtcctcgggatgtccctgaagagaaacccagtaacagaaacttaccaactgtaagagtggatactctagcagacaataccagcaattacattcttcatcctcaaacatccttcccattgcccaaaaagtcagtgaccggaatgctggaagaaccccttctggggcctcttcagccactttcttctaatacacctatatgggcctgccgtcttaggagctgtgagaaaattggagattcataccgtggctactgtgtaagtgagactgaattagaaagtgtcctaacatttcacaagcagcaaacacagagtgtttgggggacccgtcagtctccaagcccagccaagcctgctacacgcttgatgtggaaatcccagtatgttccatatgatggaatcccatttgttaatgcagggagtagagctgtggtaatggagtgtcagtatgggccaagaagaaaaggtttccagttaaaaaaagtcagtgagcaggaaagcaggtcttgtcagctctacaaagccacttgtccagctcggatttacattaaaaaggtacagaagtttcctgaatatagagttcctacagaccccaaaattgacaagaaaattatcagaatggagcaggagaaagcttttaacatgctaaagaagaacttggtagatgctggtggtgttcttaggtggtatgtacagttacctacacagcaagctcatcagtatcatgaattagagactccctgcctcactttgtcaccttctccttttcctgtgtcttctcttgaagaagaggaaactgcagttagagatgagaattgtgcattaccctcacgtttacatcctcaagtagcacataagattcaagaattagtatcacagggaatagaacaagtgtatgcagtaaggaaacagctaagaaaatttgtggaaagggaactgttcaaacccgatgaggtacctgaaagacataatttatctttttttccaactgtaaatgatataaaaaatcacatccatgaggtacagaaatccttgagaaatggagatacggtatataactcagagattattccagcaacgcttcaatggactacagacagtgggaatattctcaaagagaccatgacagttacatttgcagaaggaaattcaccaggagaatcaattaccaccaaagtggaaacaaatcagaccaggggttctttgtctcctgagccaacccacttgctctcctcactctcctcatttcagcccaaaatatttacacaactacagggtttgcagttacaaccaaggtacacctctcctgatgaatcaccagctgtggtatcagtaaataaccagccgtcctctagtccttcaggacttctggatacaataggaagtgctgtaatgaataataattctctactgcttggtcaaagtcatagccttcaaagagatacatgcttaacccaaaacaatagtactgcctccaccatgggtaaccttccagaaccagatcaaaatctagttgcaatggacgagctggtagaagttggagatgttgaggatacagggaatctggaaggaactgttcatcggattctgttgggagatgtgcagactattccaatacagattatagacaaccactcagctcttattgaagaaaatccagaaagtaccatttctgtgagccaagttaaacaagaacccaaagaaccagcattgtctatggaagcaaaaaaactgtggactataagaaattatctgctacataaattattgaagcttttcagaatttacaactctggtgacttctgatgtcttagaaaggaaggtgaatatagtcaaagcgtggcattgagataattggactgaagaccagtttgatgagaagcttttatttaaaactgatatatttgttgccagttccatatttttaccttccttaagagatgttttactcttcttattttgtataatttttatgctctttgattatctaataaggccagtatttcaaaagctgttctgaatttatccacagtaatatagtctgaacacaaatagtttacttaacttatccttggaaatattcaattttggttattacaaaacagaaaagaacaacagcaacaaaaacattgtgtgaatntatgtttgtatgtgtgtatgtatatcatgaattttttttttaagttctgaaaaagaacttgttctctccttaaagttgtgaagaaattgttaattgccagacaggtaagaaaatgtttataatctatctcattaagaaagatgaagtattagattttacatcataacacaaagtccagcagctacatctgtggaaactgtgcagttgcattttagcctcttcccttccaatttttgtacttttaactacaaaccagtagtatactaatggttatctaatagaaatttaaagtgtcttggtaagtactgagaatttttacttgaattaatcagataagcaacagaaatcaacatatgtagcatggatttgtgctatattggaagtaaaacactataggcagaaagatgtagaaattaagagaattgaaaaagaataatagaattccttggtgtttacagataatttggaaaactttttgatgacagcagaggattttttcccccttattttgtaatgaagatccagcactggttaaaaaataatttgatttgtagttacatttttctatgccagagctcttactgaattgatgatattaggatttctagtattttaaggtaagtatttatagtttaaaatttagtttatatttaaaactttaaaacatctgatctgggatttttttgttaagtaagtatattaacttcaaataccaaattactactaagcagtatattgattataagcatctgttgtctaaagattggtactaggctggacatggtggctcacacctgtaatcacaatactttgggaggctgaggtgggtagataacctgaggtcaggagttcgagaccagcctggccaacgtggtgaaaccctgtttctactaaaaatacaaaaattagctgggtgtggtggtgggcacctgtaatcccagctacttgggaggctaaggcaggagaatcgcttgaacaccggaggcggaggttgcaatgagccgagatcgcgccattgcactccagcctgggtgacaagagaaaaactccatctcaaaaa

SEQ ID NO: 129841 - DNA, 4719 bp, Homo sapiens
  misc_feature (3659)..(3659): n is a, c, g, or t
aacggtcgacggtggccgatagtggtcctactgtcgtgggactgctctgcgcgctcccggtggggcgcgcctgcgcattatgctggtctccatggcggggcctcggagccaagacgaggttgagtagactcgttttgaattttctcccctctgctccggcggacttcccatgtcgccttgtggggctatcggcggcggcaggactgggggagtcagaggtctggcagcgctgtctgcgcagacctaccggacgctacctcccaacccccctgtcttcctcctgcctcctcctcctcccgtcacctcctgacccgccggagctccgagcaactgccggcctccgcctccagccgcagccggtcactggcggcgccttccgcgccaagcttgggggccttttcggggtcccacatggcacggcttccgacccccggcccgggacggggctcgcaggccccagaggggcaggctggagaaggaggaggttaggtgtcttcaggagggttgctgagcccaaggacgcgccatcgccgcggagaaggagccggaccccttgggcggagcgcccaatgtgtggtccctcacgccgtcccgcaccttgctttttagggttctttttccgctttctgagcccttttataccttacgtttagaaggggaaaatcatcctcccacaccttctccccgactttttgccttttttgtcttgaagttacccaaaggcctgtgtattgttctcaatggtcccaagaattactctaatatagttgtttttctgagggaggatggatggagataactatcctgatcccaatgtcactttttaaggcattcgcttcaagagacaagcagtttagaatcaggcagaactggattgcaaaatttatgggcagaccgagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaaggtttaatatatctttgccaagtccaagggtacaaagattttctcctgtgttttcttctagaagttttatcatttgatagtctgtgatccatttcaagttgatttgctatctggtgtgagcatctaatctgtatggactccagggattcttcctttggacaaaatgattctcctacagttttgcccatcactactcgtgaagcaaataattcactcatatcacagaatataccagggcccctgactcagacacagactctttctgcagagcaattccatctagtggaccaaaatgggcaggctattcaatatgaacttcagtcattgggggaatccaatgcacaaatgatgatcgttgccagcccaacagaaaatggacaggtacttcgtgtaattccacctacccagacaggaatggcacaagtgattatacctcaggggcaacttgtggatgtgaatagtcctcgggatgtccctgaagagaaacccagtaacagaaacttaccaactgtaagagtggatactctagcagacaataccagcaattacattcttcatcctcaaacatccttcccattgcccaaaaagtcagtgaccggaatgctggaagaaccccttctggggcctcttcagccactttcttctaatacacctatatgggcctgccgtcttaggagctgtgagaaaattggagattcataccgtggctactgtgtaagtgagactgaattagaaagtgtcctaacatttcacaagcagcaaacacagagtgtttgggggacccgtcagtctccaagcccagccaagcctgctacacgcttgatgtggaaatcccagtatgttccatatgatggaatcccatttgttaatgcagggagtagagctgtggtaatggagtgtcagtatgggccaagaagaaaaggtttccagttaaaaaaagtcagtgagcaggaaagcaggtcttgtcagctctacaaagccacttgtccagctcggatttacattaaaaaggtacagaagtttcctgaatatagagttcctacagaccccaaaattgacaagaaaattatcagaatggagcaggagaaagcttttaacatgctaaagaagaacttggtagatgctggtggtgttcttaggtggtatgtacagttacctacacagcaagctcatcagtatcatgaattagagactccctgcctcactttgtcaccttctccttttcctgtgtcttctcttgaagaagaggaaactgcagttagagatgagaattgtgcattaccctcacgtttacatcctcaagtagcacataagattcaagaattagtatcacagggaatagaacaagtgtatgcagtaaggaaacagctaagaaaatttgtggaaagggaactgttcaaacccgatgaggtacctgaaagacataatttatctttttttccaactgtaaatgatataaaaaatcacatccatgaggtacagaaatccttgagaaatggagatacggtatataactcagagattattccagcaacgcttcaatggactacagacagtgggaatattctcaaagagaccatgacagttacatttgcagaaggaaattcaccaggagaatcaattaccaccaaagtggaaacaaatcagaccaggggttctttgtctcctgagccaacccacttgctctcctcactctcctcatttcagcccaaaatatttacacaactacagggtttgcagttacaaccaaggtacacctctcctgatgaatcaccagctgtggtatcagtaaataaccagccgtcctctagtccttcaggacttctggatacaataggaagtgctgtaatgaataataattctctactgcttggtcaaagtcatagccttcaaagagatacatgcttaacccaaaacaatagtactgcctccaccatgggtaaccttccagaaccagatcaaaatctagttgcaatggacgagctggtagaagttggagatgttgaggatacagggaatctggaaggaactgttcatcggattctgttgggagatgtgcagactattccaatacagattatagacaaccactcagctcttattgaagaaaatccagaaagtaccatttctgtgagccaagttaaacaagaacccaaagaaccagcattgtctatggaagcaaaaaaactgtggactataagaaattatctgctacataaattattgaagcttttcagaatttacaactctggtgacttctgatgtcttagaaaggaaggtgaatatagtcaaagcgtggcattgagataattggactgaagaccagtttgatgagaagcttttatttaaaactgatatatttgttgccagttccatatttttaccttccttaagagatgttttactcttcttattttgtataatttttatgctctttgattatctaataaggccagtatttcaaaagctgttctgaatttatccacagtaatatagtctgaacacaaatagtttacttaacttatccttggaaatattcaattttggttattacaaaacagaaaagaacaacagcaacaaaaacattgtgtgaatntatgtttgtatgtgtgtatgtatatcatgaattttttttttaagttctgaaaaagaacttgttctctccttaaagttgtgaagaaattgttaattgccagacaggtaagaaaatgtttataatctatctcattaagaaagatgaagtattagattttacatcataacacaaagtccagcagctacatctgtggaaactgtgcagttgcattttagcctcttcccttccaatttttgtacttttaactacaaaccagtagtatactaatggttatctaatagaaatttaaagtgtcttggtaagtactgagaatttttacttgaattaatcagataagcaacagaaatcaacatatgtagcatggatttgtgctatattggaagtaaaacactataggcagaaagatgtagaaattaagagaattgaaaaagaataatagaattccttggtgtttacagataatttggaaaactttttgatgacagcagaggattttttcccccttattttgtaatgaagatccagcactggttaaaaaataatttgatttgtagttacatttttctatgccagagctcttactgaattgatgatattaggatttctagtattttaaggtaagtatttatagtttaaaatttagtttatatttaaaactttaaaacatctgatctgggatttttttgttaagtaagtatattaacttcaaataccaaattactactaagcagtatattgattataagcatctgttgtctaaagattggtactaggctggacatggtggctcacacctgtaatcacaatactttgggaggctgaggtgggtagataacctgaggtcaggagttcgagaccagcctggccaacgtggtgaaaccctgtttctactaaaaatacaaaaattagctgggtgtggtggtgggcacctgtaatcccagctacttgggaggctaaggcaggagaatcgcttgaacaccggaggcggaggttgcaatgagccgagatcgcgccattgcactccagcctgggtgacaagagaaaaactccatctcaaaaa

SEQ ID NO: 129842 - DNA, 4001 bp, Homo sapiens
  misc_feature (2941)..(2941): n is a, c, g, or t
aacggtcgacggtggccgatagtggtcctactgtcgtgggactgctctgcgcgctcccggtggggcgcgcctgcgcattatgctggtctccatggcggggcctcggagccaagacgagagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaagaagttttatcatttgatagtctgtgatccatttcaagttgatttgctatctggtgtgagctattaaataatagaagaaaatggaattgaatatgatgtcagcatggaacaatctaatgattcattaagagtcaaccataatgacggtgaagagtcaaaaaccagtgctcaagtatttgagcatctaatctgtatggactccagggattcttcctttggacaaaatgattctcctacagttttgcccatcactactcgtgaagcaaataattcactcatatcacagaatataccagggcccctgactcagacacagactctttctgcagagcaattccatctagtggaccaaaatgggcaggctattcaatatgaacttcagtcattgggggaatccaatgcacaaatgatgatcgttgccagcccaacagaaaatggacaggtacttcgtgtaattccacctacccagacaggaatggcacaagtgattatacctcaggggcaacttgtggatgtgaatagtcctcgggatgtccctgaagagaaacccagtaacagaaacttaccaactgtaagagtggatactctagcagacaataccagcaattacattcttcatcctcaaacatccttcccattgcccaaaaagtcagtgaccggaatgctggaagaaccccttctggggcctcttcagccactttcttctaatacacctatatgggcctgccgtcttaggagctgtgagaaaattggagattcataccgtggctactgtgtaagtgagactgaattagaaagtgtcctaacatttcacaagcagcaaacacagagtgtttgggggacccgtcagtctccaagcccagccaagcctgctacacgcttgatgtggaaatcccagtatgttccatatgatggaatcccatttgttaatgcagggagtagagctgtggtaatggagtgtcagtatgggccaagaagaaaaggtttccagttaaaaaaagtcagtgagcaggaaagcaggtcttgtcagctctacaaagccacttgtccagctcggatttacattaaaaaggtacagaagtttcctgaatatagagttcctacagaccccaaaattgacaagaaaattatcagaatggagcaggagaaagcttttaacatgctaaagaagaacttggtagatgctggtggtgttcttaggtggtatgtacagttacctacacagcaagctcatcagtatcatgaattagagactccctgcctcactttgtcaccttctccttttcctgtgtcttctcttgaagaagaggaaactgcagttagagatgagaattgtgcattaccctcacgtttacatcctcaagtagcacataagattcaagaattagtatcacagggaatagaacaagtgtatgcagtaaggaaacagctaagaaaatttgtggaaagggaactgttcaaacccgatgaggtacctgaaagacataatttatctttttttccaactgtaaatgatataaaaaatcacatccatgaggtacagaaatccttgagaaatggagatacggtatataactcagagattattccagcaacgcttcaatggactacagacagtgggaatattctcaaagagaccatgacagttacatttgcagaaggaaattcaccaggagaatcaattaccaccaaagtggaaacaaatcagaccaggggttctttgtctcctgagccaacccacttgctctcctcactctcctcatttcagcccaaaatatttacacaactacagggtttgcagttacaaccaaggtacacctctcctgatgaatcaccagctgtggtatcagtaaataaccagccgtcctctagtccttcaggacttctggatacaataggaagtgctgtaatgaataataattctctactgcttggtcaaagtcatagccttcaaagagatacatgcttaacccaaaacaatagtactgcctccaccatgggtaaccttccagaaccagatcaaaatctagttgcaatggacgagctggtagaagttggagatgttgaggatacagggaatctggaaggaactgttcatcggattctgttgggagatgtgcagactattccaatacagattatagacaaccactcagctcttattgaagaaaatccagaaagtaccatttctgtgagccaagttaaacaagaacccaaagaaccagcattgtctatggaagcaaaaaaactgtggactataagaaattatctgctacataaattattgaagcttttcagaatttacaactctggtgacttctgatgtcttagaaaggaaggtgaatatagtcaaagcgtggcattgagataattggactgaagaccagtttgatgagaagcttttatttaaaactgatatatttgttgccagttccatatttttaccttccttaagagatgttttactcttcttattttgtataatttttatgctctttgattatctaataaggccagtatttcaaaagctgttctgaatttatccacagtaatatagtctgaacacaaatagtttacttaacttatccttggaaatattcaattttggttattacaaaacagaaaagaacaacagcaacaaaaacattgtgtgaatntatgtttgtatgtgtgtatgtatatcatgaattttttttttaagttctgaaaaagaacttgttctctccttaaagttgtgaagaaattgttaattgccagacaggtaagaaaatgtttataatctatctcattaagaaagatgaagtattagattttacatcataacacaaagtccagcagctacatctgtggaaactgtgcagttgcattttagcctcttcccttccaatttttgtacttttaactacaaaccagtagtatactaatggttatctaatagaaatttaaagtgtcttggtaagtactgagaatttttacttgaattaatcagataagcaacagaaatcaacatatgtagcatggatttgtgctatattggaagtaaaacactataggcagaaagatgtagaaattaagagaattgaaaaagaataatagaattccttggtgtttacagataatttggaaaactttttgatgacagcagaggattttttcccccttattttgtaatgaagatccagcactggttaaaaaataatttgatttgtagttacatttttctatgccagagctcttactgaattgatgatattaggatttctagtattttaaggtaagtatttatagtttaaaatttagtttatatttaaaactttaaaacatctgatctgggatttttttgttaagtaagtatattaacttcaaataccaaattactactaagcagtatattgattataagcatctgttgtctaaagattggtactaggctggacatggtggctcacacctgtaatcacaatactttgggaggctgaggtgggtagataacctgaggtcaggagttcgagaccagcctggccaacgtggtgaaaccctgtttctactaaaaatacaaaaattagctgggtgtggtggtgggcacctgtaatcccagctacttgggaggctaaggcaggagaatcgcttgaacaccggaggcggaggttgcaatgagccgagatcgcgccattgcactccagcctgggtgacaagagaaaaactccatctcaaaaa

SEQ ID NO: 129843 - DNA, 306 bp, Homo sapiens
tattgccagtggtggcaagcattgggtgatcagtccttgggtaatgggggcatgcatggcagtgcccctggtcttaggggaggtttatttcctattctacactacctgtttcttggggtgcagggcactgtgtgggcttaggttcagggtttgcagctgaaccactgaatctagatggagtcttggattcctggctttgtagtcttttgtctggtggaatgatggcagggctccaggtatgtggatatgccaggacactggcttccagaacagaattcactttattggtggctctgctctcagcat

SEQ ID NO: 129844 - DNA, 421 bp, Homo sapiens
ctataaggtaggtactattgttagctccattgtttagatgagtatactgaggtatagagaagttaagtaacttgcctaaggttgcacagctgggatttggacctggttggtctggttctaaagttcacattctttaagcaccacattattcctcctttcaatatattataaccatactggtccctgaaagtaaaatcaaataactgaacccctacaatttgaacaaatacttaataaaatatcttgaaactacttatatttgaaatttttttgctacaaaaggaaacagagttcaacatcctactcaccgccccccccccccccagtttagtggaaattaaaactaatttgggtacctgctgccaaaggctgtgatgaggttggttcagttcaattagacagttactgagaatttcctaga

SEQ ID NO: 129845 - DNA, 1131 bp, Homo sapiens
aggctttatcatatttagaggaaaggggttgttttaggcatacagttatgatactaatacattaggggaaaactggtgacatcaaaatgaattctaatatctagactgatggaaagttttctaaagttttctttggacaagtgttgattttacacatatgttgttattaagataataccctattagaaaactgactttgtgctgctagcaagtgtatctatgtgtctcctaactaatcattgtaaggtatatgttttgatgtgttaaataagttttcaataagtgttaaactgtattttaaatagggcatctataactgtgtcttgtctctttgctttaaagtgtcttttgtttgactataatttagtgttgcaataggattgcaagtaataattttgtggaattgtgaaataactgtgggtacttttaatgtgagagtcttatctatagtatttgtgcttagtattttctagattagcatgaattacacttcctaaggtcactttggaagatgattgatttgatttaattaacatattgatttcactttgactatatttttcttaaagaggaagggaaatattttcaggagatgtttgaccttcttagatgaatggttgagggtagggcccatttgttaggcagcccatttacatcattccaaaaaaggaccagtattcagtgttatgctgcttagctgaggacaccctttttccccagggcctgcccatctacgtttgtattcagtgctctgatttactttattcaccccttatcccatcaatatgttttgtcttctgcttgattcccttgctctcccaggcagcaacctgatcaattcattcacaccatggtgctaatagctaatgttaggttcatattaatttacccaggaatatctgaattccaggctttaggactaggcattaaaccaaagtggtgactttcaatggagggctaatacatactgaagcagacagactggagggaaagaaattttggataaagtgggtcccacagcactgcctttcatattgcatacagtaagcaaacacctactttggttaccataatgggaatgctgacttttaagaaattaagaaatgtatccatgaacatggctatcagttt

SEQ ID NO: 129846 - DNA, 703 bp, Homo sapiens
ggcctatacctaccataatctaaacttaactgctttgtacttttgttttgaaattttcaatgtatttcttgtgatttgaagctttattagtttgtcataaaaccataatttatgaactctcttactataaagcgaggagaaatccagactaataactgctaagatcctttgtaatgctgacttctcatggtaatacctgagtagacctctttatgtgaaagccctgttagggaagctcctggtgaagcaggtgggtttcaagtttgaattgtgtatgcatcctgagatccagaaaggtcaagtggcctgggctgagcgggaagtagttatatcctgggtgttaaatctataaaggcttactttgaagatattgcgagtttggttccagactactttaataaagcaaataatcgcaataaagtgagtcacacaaattttttggtttctcagtgcatataggttatgtttggccgagtgtggtggctcgcagctgtaatcccaacactttgggaggccaaggcaggtggatcacctgaggtcaggagtttgagacaagcctgaccaacatggtgaaacctgtctctactaaaaatacaaaaattaaaaataatagtaaaaataaaaatacaaaaattaaccaggcctggtggtgggcacctgtaatttcagctactctggaggctgaggcatgagaatcacttga

SEQ ID NO: 129847 - DNA, 287 bp, Homo sapiens
gtctttctgtgcatcaagaagtagaatatgggtttggaggacaggtcattctttcctaaattagatgtggtcttcaaaaacacccaaacagcataggggcaagttaagttttccaaagacaaggaaatgtaaagtgttaaatggtccaatgtggaaactagcgtttaataatccaaatctgaacccttcatgactgacaaaaaaaatatgcctcccaaagtgagaaaattgaaaatcaccccaaagggcataatttggttgaatatctatagctgatgatgcctggg

SEQ ID NO: 129848 - DNA, 334 bp, Homo sapiens
ggcatggtccctgactacaaagagcacatattctagctaaaagatacacttttctaaaagtagaactaatgtcatgatataatatgatgctaaactgtgtgactggatctacaaatatagagataaactcacaattttagccaatagctttaactttctatttaattttttaaagtcaaaatcaacactcaggtgtggactcgacttgtcatctagtctagaacattacctaggtatagataacagcaaagcctttactagtcgacatctagaatacatttttaaaactattagtttcggccgggcatggtggctcatgcttgtaatctcagca

SEQ ID NO: 129849 - DNA, 739 bp, Homo sapiens
  misc_feature (671)..(671): n is a, c, g, or t
ggaaccaacctagaatttcctgataggctggatgaaggctgtgaaagaaacagacattggaaatgcttcaaagtttcttaaatgaccagctggaaggctggaattgctgtcaactgagaaaacgaatatagtgggttgtgcatatttgtgtgcggaagagagatgaaatgagatcaagcggagggttaaattagtagtcttgatgtggagagcctgagtaaacagttagatatacaagtccaaaatctggagagttctggtttggagatacagatttgaagttattggcacatacatggcatttaaagaataaggcttgaagatatcactaaaggaaggatcgcagaaaagaagacagagagagaaagaaagaagaaagaacgacacgagaacagaaagaccgaccgaacgaaacgaaagaaacgaaagaaagaaagaaaagaaagaagaaagaacgaaggacagaaacgaaaggaaaggaaacgaacgaacggaacggaaacgacacaacacaacaacaaaccacaacaaaaaaagttgggcgggccgacccccgcacgaagagaagtttgcaacaccgagtggcgggcggccgcggccccggtaggtaagcaagctgggcaagcggcctgcaaaggccatcgtggcacacacgtggcggtgtccccaanaaaaaacgcgcggggacggcgtcgacaccccgaagggcgagcctgcgtcagcggacccacagctacga

SEQ ID NO: 129850 - DNA, 917 bp, Homo sapiens
ggaagaagccttggtgggtttgtgtgggtctttctcttatgccatatccctggtttatatttggatgggaaaatacataaatgtttgatggtgatcatttttatgaaacatgacattgtcaactcctttcttcatatgcattttcgaattcagttcttaaccaaagaagctctttctacaacagggttaaattataaactgaaatagcaaaaaaaaaaaaaaaaaaaaaaaaaaaaactgtggttgggccggcccgcggcccccgggagaaaggttttataaacccattctggtgtgtgggcggcggccggccccagtgggggttgggggcaccgaggggcccacaaggcggtgttccccggaggagaacccgtgggcatatgagaacaaggtggcgtggtggattttactcaaccacaatataaatcagcccgccgggggaaaccagacgaggtgtttcgtgaaacaatccaaaagggaggttcagaaaggcacataggggaatcatacaaaggaggagtcaaaaagaacacgccgaaatcaaaataagcccgcccgggagaagaaagaaacaatcatagaaaacaagagagaacagaacgaacaaacgcacgacgaccagagcacacgagagaacagctgacgacagaacagaggcggcgcagacaggagagaacggacacagatagacgagagggagagagagagaggacagaaaagagagagaaagaaaagagaagaagaaggacagaagacacgccggcgcaacgacgaaggaagaagagaggcaaggaggaggtgagaggggacagcgagaagcagagcagaacgaaagaagaacgagaagaaacagaagagagcggagagagacggaggacagaaggaaaaagaacaagaagaagaggagaaagaaagaa

SEQ ID NO: 129851 - DNA, 1040 bp, Homo sapiens
gtggcttagtttccttaaatatgctcttaagatagttttggattatgcggtattgactgtcttaaatatgaaagataagtcattgcattaagagttcaagctaaatggatacattaagatacagttcctaaacaaattatttatttccaccttttacacaaatcttgggagaattggtgtcaggaaggttcagccttaaagttaagcatgttcaagaaagacacttttcagacagcctgtttatttactgagagctctggcattgggcattttgtctttagtattctcacatagcctacaacctgttcctgttaggaacaagccaagatagctaagaagttacggaagccatgcaatatgtcaattacattgctttttataaatggacaacttatgtgggcatttttgggcagtatatgacttccttgcaggctcttaagttggaagggtttctgtaaaaaggacagttacgggtataatatggctaagagaaataatacagaacctgaaataaaagtaacttcaccagggagttatcctgacttaggtgacatacagtcccagttggcagttactttaaccaggagccctagcataacctcaagactcttagaaactttagaacatggaaattgttaaaagctttgaattgcacatttagattgtggctattaggaatttttaaagttgtaattcctaaaataacaggtcacactaaccggtcttgtccatattcagggttgagtgtaaaaatgaaaggaatcacaaaactgaacttagacctgtggtttaaggatcaaggtgttcactagaagtcactgttactaatacttgatgacaatgtaaagaaacattaaggattatatttgattgttttcaaagacactggctggatgtggtggctcacacttgtaattcctagcactttgggaggctagggcgggtgggaggatctcttgaagccaggagttggagaccagtctgcccaacatggcaagattcacatttctattaaaaggaatatttagtttgaaaaaagg

SEQ ID NO: 129852 - DNA, 669 bp, Homo sapiens
accctctattctctccaaatgttcattgactactaatgctctattctgtttcaccggagaaaaatgaaggaccgaccttctggatctattgcttaagccttcaggtgcctgcatataagatatataaaaggctcagttttattccatttcctggggtgttttgttttgttttaataactgatatccagtcatttcctattttgttcactgaagtgtcatgttttacccatatgcagagttaacaagtttctattatgtatgatctccattttcaaaaatgtctgaggacctgtagagtacactttaaatgcttcaggaagtcagtcataaccttttatatttgcccatagtttgctttcttgcctcatctctgatctccctgagctccatttatactgggccaaaaacttactgctttctcttaagcagaccatctattttatgtgtcagtgcttttgctttcacagatatttaaccaaatgattgtcacagaatatcctaatagtaatatgagatatcagggacccagtacatacctattgaataagtgactacatttggggatttttttttttgagatggagtttcactcttgttgcccaggctggagtgcagtggcacgatctcagctcactgtaacctccgcctcccaggttcgagcaattcccc

SEQ ID NO: 129853 - DNA, 153 bp, Homo sapiens
gcctcctgggttcaagcagttctcgtgatctgccagccttggcctcccaaagtgctgggattacaggtatgagccactgcaccctgctgctagttctttatgtcttgttgacctgacatgtgagctgtcctacctcttttttttttttttttt

SEQ ID NO: 129854 - DNA, 434 bp, Homo sapiens
gagtggtaaggggagaacgggcaggaagggctcatgatgagctctaggccgcagtgaacacaggaaaggcctcattgggaggggcagagagtaggcaggctctatgccctctggcccctttccgtggcagagtcagtcctgaagcatctaccccagtgctaactagaagcgtggggagaggtgatggggaaggcctaggggctgggagcagtgtcaggaagaccttggggttgtggaaggaactggtcctggattcagactcccaacccagactgacgtgacatgccatgagaaggtattattctcccattttatagatgtggaaactgagacccaaagaggtcagtgactggcctggaggtcagtcagatagagagttggtagcagagccctgatgaaagtcaggttggagtgtcctccactggtgaagtgta

SEQ ID NO: 129855 - DNA, 605 bp, Homo sapiens
gagttaaggttttcataatttcttctagcctggaagattctcacagttttctgtcttgtccctctaggccctgcttcctactagctccgacaggtcttcttatttttgatatatatgttatgcgtgtcagatttactaggcacctatgtccttatgatctggtttactcagcctgtccaacttcaggccttgcagttttctagcaggaatcctctacttccaaaattaagatttattgtccttcagtggccactcagatctcttcactaaatacttgagttcttcctgtgtatgttattttatgctaggtgctatgagagattcaaagatataatgatgcttcatagagaggttgccatttgggcactcaggccttttatggaaaagataaataccaagatgaatttgtttgaggcattataagaattgtcataaggtgttacacaagtaagaatgacatttttagtgctggcaacttacttatgatttcctttgacttgtgattttccttttacttatgatttcctttccctgaagttgtttagcatttataacttataatactcagatcatatattattatactacatttacagtatatatca

SEQ ID NO: 129856 - DNA, 456 bp, Homo sapiens
agaaagactgcgggtatagtcacgttaaaggcacctgtgactccagcgatgtcacagttaattatacctgtgattttccgtcccctccctccaggcacctcaccaactttagttaactacacagaagcttaatgaaattctttgcttctgcagttggagttgacaccttgacagatgttcaacagcttgtttccaggtgggacgctgatgtaggctgccccacttcacgcaaaacaattacgtttacgattttcgcccaaaatattgtctcctgtcgttgaaacccatagagaacacttgtaacctatagatttcttggtgttgtggtgaatatgttcagcttgttgtaagaatagttcataattgatgctcttggcatttatcacccagccgtgatgtgctcaacgcgtgatgactaataagttgtatttcgttggatccttttttcttgctttc

SEQ ID NO: 129857 - DNA, 327 bp, Homo sapiens
gtaccctaaaatgttattcatcatgccattcaatattatttctgtcctagtttctgtccaataatcatttctggtgatttcagtatccacagtgatgactgttttaattgttccatttctcatttctttgatttcctcttctttaatgattttgtcctcaaccttatctcaaccactgacttaccatggcatactctagaccagaggatctttaactttactcaggcaatataaacctatggattatcctttcagacataagaaatcctaccctaactaccaccatgaccctaactacagccatgaccctaggatacagtagggaga

SEQ ID NO: 129858 - DNA, 543 bp, Homo sapiens
gaaagatttaatgaacactaacctattcaacaaatttagccggactcatgagataaactgctgctctatgcctcatgctatgatgccgtaggaagtacacaattacttatctcatgttcttgctgaaatgtccagtcaaaatttgatcaggaggaaataatcagacaaatccatccagattgtaggacattcaataagtaactagcttatgtcctgaaagacaaaaacagggggcgttgggggagacatggagctatttgtccaggatagggatgacgagagaaacgacaagcaagtgtgatatgtgatcttgactggatttttgatttaaaatttttaaagaatattttaagacaatgagagaaatttgtggcctatatactagaagacattgtatcaaagttaatcttggaaggtgtgataatgttgtgcttatgagacaaatttccctattgttagatgactcgtgtatttagtagtaattgccattgtacatgacaaatttctttcaaatggctcaccacatagagtaggaaaaacaac

SEQ ID NO: 129859 - DNA, 187 bp, Homo sapiens
agccagagggagaacatgtcaggcagaaagagaagcaaatgcagaggctatgaggcaagaatgtgctttgctgtcaagaacccagacagcaagacgaagatgggtaggagaggagggtagggaggtagagcagtgtgggtaccagagaacggagaaccttgcaggtcattgttaggactgaattatc

SEQ ID NO: 129860 - DNA, 343 bp, Homo sapiens
taaaataaaataaaatagaattaaattctactcaggtaggttcagggcaataaacattctaataacatgtcttttaaacaaattataggatacgatgggcatagactgctcttggtcttcccccagcctcctcatcctccctctttaggggtagccttgaacttgcaatggagaatgagggccaggagggggtggagtcagcacctggctgtctggatagccccaccataccttgttcagtcgcttctcttcatttcaaatgatccctattggacctcacactctttgctagtcttgcccctaaggatgcagacagaaaattcatgatgggcagacagaaaat

SEQ ID NO: 129861 - DNA, 228 bp, Homo sapiens
atagaggatcttagtagtcgctctggacatgggcatgtacagattctcctcttgtggctttcacttaagaaacagaatttgtaaggataagggcgttacaaatcatcaaattgaatccctctttcaagaaaccagtctcatagtcacatgattattgaccagggcaaagaagtccaggcatgtgcttttggaatggcatcctgtgccacatcctccactaaacatgtt

SEQ ID NO: 129862 - DNA, 624 bp, Homo sapiens
ggttttatatgccacaatttagatagtcttaatttaaatttccataaataagtgcaggagaaaacagaggaagtgcttcgaagtcaacaacctggtgacacatattttttagggttttcaggcaaatcttcccatgggattttaattgatatgcaacatagtgtggcctcaggcccccttccaagcacaggactctggtaatttgtacaagctttccttcctcctctatacttgactgaagggaaaaatggaagatggtagacatcctctcaagtggatgtaggaggtaattagaataataaaattgaataattattaagtagtttgctcaaggatattaatcattctgcccattttgaaggagaaaaaatattcctacaaataaatagtagttgtctcttagaagactgagaaatccaggagtttgggggaaatgtgactataattgaaagaaaagagcaaaatggattaatatactagttttccaaagaaatattaaacctgcctaaatttccactataacttctcttgggaaatcaaactggaggaactggacctcttgggaatactatcaccataacataacataatttgaagttgacactagaagttgaagtttatttt

SEQ ID NO: 129863 - DNA, 538 bp, Homo sapiens
attcacaatagcaaagacacagaatcaacctaggtgcccatcagcggcggactggataaagaaaatgtaatatatacactatggaatactacacagccataaaaaatgaaataatgtcctttgcagcaacatggatgcagctggaagccatcatcctaagcgaattaatgcaggaacagaaaaccaaatgctgcatgttcttgagagaactaaacattgagcacacagatataaagatgggaacaatagacactgggggttactggaggggggagagggttaaaaaactacccatttggtactgtgctcattacctgagtgatggaatctgtaccccaaacctcaccatcatgcaacatacttatgtaacaaacttgcacatggtaccccctgtatctaaaataaaagttgatagaaacaaacaaaaaatgaaatgcagatcaggaggagccagaaacctggactaaaaggggagagaggaaaaaagagggaaatggagaggaaagcagggggaaagaggtggggaccagaaggatac

SEQ ID NO: 129864 - DNA, 363 bp, Homo sapiens
tccctcagcccctggaaaccaccaatctactttctgtctctaaggaatggcctattctggacatttcagagagacagaattttgtaatatgcagtctttcatgactgaatcccatgacttagcataatgtttaaaagggttattcatgttgtagcatgtaccagcacttcattctttttttactgcccaggaatattccattgtgtggctgtcacttctgtctacccattcaggtgatggacatttaacttgctccttgttgcttttagcaattgcaaataagaaacagctgaaaaacaatggcattcaaactagactgtggtcattttcaaaagaataaaaatctttagggagaaacaaaat

SEQ ID NO: 129865 - DNA, 437 bp, Homo sapiens
tggcaaggatgggaaggcatgttcagtcctaggagtaggaaggggcagaggtgttgatggcccctacagagcggccaaggacaaggagctgctgttcgaaacagccttcctgctccccaacctgcctcccacccaacaggttttgcatatactctactgggaagagggacacacccgactgcatcactgccctccaagtctctccctgccctgtccagcatccaggagcacccctagttggggaagcttctgtgactccccctacaacagcctaggatggagtggggtttgtgaacaaatgcagaaggcagtcttagggaggtcagctgacatgcccctggcctgtggctgggaagtagcagaggctaaggttcttccccgctctggggttgccaggagtagcactggatcagtcaggtgacagggctctcctctct

SEQ ID NO: 129866 - DNA, 278 bp, Homo sapiens
tggtgcagaaaatacaaaatgttaccactgggcagccttttgtcactcatccttatgaggcattctggaggaatcaaaccagtgtgtgctggcataaaagaatgaagacacagtcattgaacaactgctgtgggcagtgccttgcagagccatgagaaatacaaaaagtagataaaagagtttcagcccttaataaatctgattgtgttatccattttccctttgcccctctagctctactctaccattctctccccaattctgtgcccattatcaat

SEQ ID NO: 129867 - DNA, 249 bp, Homo sapiens
acaaagcttcacggacacagccacgcgcatttcttcgctgtctatcatctgcaagggtcttgagttgccatgcggagtcgagacgtcgagacacaggaggcctggcctgcaaagtcgccaagtcacaaatgtttgctctctggcccttccccggaggagttggctgagcccactctgtgccgtccctcccggctccagctcatgctcaggggctccctgaatgttccttgggcaccaaacaggagtgag

SEQ ID NO: 129868 - DNA, 603 bp, Homo sapiens
aaataaagttgtgatgctccacattaagagaatgaaggacaaatattatatgatcatatgagtatatgcagaaaaaacatttgagaaaattcaactttgctttcatgataaaaactctcaacaaattaggtgtgaaaagaatatgtatcagtgcagtaaaggccatataatacaacccctcagcttacatgtacccaacagtgaaaaactgaaagcttttcctttaacatcaggagcaagacaaggacacccacttgccacttacattcaacatagtactggaagtcgtagccagaacagttaggtacaaaaagaaataagtcatctgaattggaaaggaagaagttaaattgtgactgtttgcagatgacatgattttatgtataaaaaatcctaaagactctaccaacagactattagaactaataaatgaattcagtaaaattgcgagatataaaatcaatatacaaaaattagaagtgtttctactcataaatcacagacaatccaaaaaagaaattataaaaaccaattcattacaatagcatcaaaaaataaaatatttaggagtaaatttgaccaaagaggtaaaagatctctata

SEQ ID NO: 129869 - DNA, 202 bp, Homo sapiens
ccccaccggctcagcaaccctcccagggaggttattactggctccactttgcacatgaggaacttgaggttcagcaatttaaagggacgtgctgaagaccacccacttataagtggccaagttgggatttaaagacaggttgtggcaatggagggagtagaggtgggtgtatgcatgtagagtgggtatttgagcacaggtg

SEQ ID NO: 129870 - DNA, 379 bp, Homo sapiens
gccgagcaaagagctcattgtcagagtttacgcaactgtttgagttgcagagccaatttaaaaataatttctgtccatctggagtggatttaagagatgaaagaaaagtaaatgatataaacctctggaatgttttagaaaaatgcattgagggaagaaaaaaataagggcatagcgttaaaccatccctgcaataaagggctccttggggtgtctgctgcatcagaaggagccctgcaggtttactgaatgaatctctgaatcttggagtgtgaagagaccaaataatagtggggtagtagtagcagtagcagcaagaaaagctgacaccaggcacttactgtgtgtctcacagtaatcctgcaagggtagaggttat

SEQ ID NO: 129871 - DNA, 507 bp, Homo sapiens
gacttcctacacagactcagtactgaggctggcaaagagagactccaacaattctgtactgatgacattctttttgtgcagagaaactctactcccagaggctaacacagagaaaccaggaaaattatttaaatctctaggtagctaacagttaaatggctataaaagtctcccaatgtctgaaattaattcctgtagtaaatatccctaccaaaaaaaagacatacatcatacctgtgagttacagagatttaagttcacgattagttgtgataaatggtgggtctagtggctttttgatgaataactctctgtcttgatcaaattcaaagaccattaacatggattttagtaactgcatttatgactagtattttacagacaaaaatttaaaatcaattaatatatctctaattattatatttcctatcctcccaatgcataaatctattctgttccgtagtgagagatcaaaattaaataccaagatttttttttttttttttt

SEQ ID NO: 129872 - DNA, 408 bp, Homo sapiens
gattgtaaaagacagctaataatagtagatagctcataggcttgaagtgaggaataaataagctgctgtacataaagtgcaaacagaagagctgagacttagcaggcactcgatagctgtgtaccgaatgaatttccagtttcgcaagtcatctatgagtacccccaaaatagatcacttagtttgcttgttttcatgctttataaaaatggtagcttcagagacttgctttgttcactcaacattacactagcaacatttgtattcagatattactgagaatattcattccgtcgatggacatgtgggtcattcctcgtttttgtattttcaacaatgctcctgtgaactcttgtccatggcagagggctcacctctgggattttctctaagacctgggagaggact

SEQ ID NO: 129873 - DNA, 869 bp, Homo sapiens
gatctcacttcacaaaaataagtctgctctccctctgagagtatatttctatgcttcaattaactttgctttaagcttgcattctggagttagtctgcaatttttttgtttactctcacaagaactgagattgctggtccagagctccaactctgttcatctccttggttaaagaatccattccaatgcagaattcccactgacacatcacaggatcaaatgttctggtggccaccctcttgcaaggacttttcttttaactactcctgacatactctattcaccacctcacaactgctaagtattcttccttcttgccttcagcattcttgcctacggaatcatcttcaaattcatggtcagatactttaaatgcttaagaggatattcttgaatatccttatattctattattcagttgatctgactgacacagtttcttaaactcagtttaagatcattatttataaagctacagggaataactagttactgtgacttctccctttattgactctaaataccacattgtgattcattgttgtagctcatgatttttaagcagtaatattctgtgattaaaaaataatttccagccatttatgattcaaaattggttgctcaaggaatgaatttcataaaaaataatgactgtaagtgcctctgtgaattacttttttaaaaaaatattttaatcctatccttattgctgtgaagaagagactacaggaagaagcatgtgcttaatgaccagaaaatgagtcaaaccattgatgtgaaactgagcagcttaattttgttggttaatggtgagtaatgcacaaaacaagccaatgactaaaatatatcttagggagaagaaaaagacc

SEQ ID NO: 129874 - DNA, 345 bp, Homo sapiens
agggtcactaaaattaactgtcagattgtaaagaatcctcgttaaagcaatgatcagaaccagcagtttaaagggcccagttaagggagaagtctgtccttcaacttgttgtgcccctctgtctccccagttcatgagggtttttccagagatgtaccttgagatttgcttgccacattcagctgtggattgagtctagatcattctttaatagtggtaatcattggagtcttttattcggttcttttaaattttttgaggagggtggagaactggcctttacttatattcctttgcttaatgaaaatccatcttgctagtaaggattggaggtgtcagaaaaga

SEQ ID NO: 129875 - DNA, 437 bp, Homo sapiens
gtgtctccgcccaaattcaatgacaaatcaaagacaatggggaaaatgccttgaaggcatctcagagacctttgtggcagcccctcccaccacagactcagaggccaagaggggaagaatggtttcacaggccaggcccagggcctggctgccctggggacactgctccctgcatcccagccactccagctccagccacggctaaaacagtcctagattatgtctcaagctgctgttcaggcaagtagaagccataagccttggcagctttgatgggtgttaggcctgcaggtgtgcagacagcaagaattgttgaggcttgggagtctctgcctagatttcagaggatgtatggacatgcctggatgttcaggcagaaggtacactgcaggggcagagccctcatggagaacctctactaggacagtgcactgggg

SEQ ID NO: 129876 - DNA, 404 bp, Homo sapiens
actctgtagatagggagtttacagccagaccagattctagtaactagaaggagctgattgcacttataaaatagataacatttggaaaggactattttgaatgcttgggataggttatttgctgctttttttcctctctttgggcctctggcgttgtcttctgtggactgggcaggctgtggtggtagggaaggggggagcttagagatgaagagtatgtgggactcctgaagtaacggcaaagggaaatgcattgagatgtcaagatgagggagaaggctttgacatgggtccccagcgggggctgtagaatcaacgaacctctccaaaccggtccccaaacactggcacctggatgagaaaaggagcagagctgagcactttttctctgccctctttctgcc

SEQ ID NO: 129877 - DNA, 712 bp, Homo sapiens
catccttagtggaggaagtgttatttaaaggcattagatacaggtatcaacagtgcttataaaaggtgcttaataacctgggaaaacctttaaaaaatctgttaatttatatactgcataattataattatgcaacagattaaagtttgctttttttaaaagcagtatattagatttcagccaaaagaggcattttgttaagacaccaccatgtctatggtaatctgttttcagtagtaaccatttgaaacaacagggtaaaaattttaagcagtaattactgcatgccagattgtgatgatacctagtagagaaatatgaagaaaattattggagatgttgattcttagacagtttttttggtgatttgaattaaattaatgagaacacaaattttaacatttaacatctttacatgtaagtattgagtaactgattaaagtggatgcacttcactctgcttatatgtagattatttttaataccatgaatatatacatatatataaatgcaaaacgagaatttggaagatcttattccttcactgaaagagaaggtgaaaacttaaaaattctttgctttatatacttatttttaattaaaaaaactggcttgtgatggaacactcaacatttttaacattccttatttaagcaacaattttcaaaatgagttggaagtttattacaggttgggtatctcttacccagaa

SEQ ID NO: 129878 - DNA, 380 bp, Homo sapiens
taaagtgaggggtcgttgttatgtgtgtttgagacaaggtctagttcagtcgcccagctggagtgcagggcacaatcacagcgtattgcagcctccaccttgtaggctcaatccatcctctcacctcagcttccccagtagctgcatctatggtatgcaccacgcctgtctaatttttggatttttggtagagaagagttctcgttatgttgcccaggctggtctcgaacttctagcctcaaaaaggttagtcctactttggccaaagtactgggattacaggcatgagacatcatacctggcctttttttcttttcttttcttttttccccagtgctacctttttacattccatatacttcccctgcatattccacagg

SEQ ID NO: 129879 - DNA, 241 bp, Homo sapiens
ggaggttgcagtgagccgaaattgagccactgcactccagcctgggcgacagagtgacactgtctcaaaaaaaaaaaaagaaaagaaaaacaaaaaacatgaaacatatcatttgcccattttccattgtaataaatgttttagttcaaaaataaaaagagaatcactcgagaagtgcaggcacaaactttggtttggtctctcgtatttgtttggtagttaccttagacaattgatttct

SEQ ID NO: 129880 - DNA, 147 bp, Homo sapiens
gcacatcacattcttcagaagcaagaagccactcatctagttttcagacaatgtgttaaattcaacattcttgggcacagtgactcatgcctatattcccagcactttgggaggccaaggcaggaagaccgcttgaggtcaggaatt

SEQ ID NO: 129881 - DNA, 405 bp, Homo sapiens
tatttgttcaacacagtaatatgtaacgaagaacggaagaacaaatataacatgagagatatagaaaacaaagagcaaaatggcacatgtaattccagctacatcacacactacataaaatgtgaaagagctaagcatacaatcaaaaggctatataaaaagaaagctgcaactataatctatccctaggaattaatactttagattcaaagacacaaacaacttaaaagtaaaaggatgaaaaatgatatacaatacaaacagtaaccaagagagatggagcggcacatgttggcagagacagacagagagagagacccactgcctacaagataaagtctaaatcactttataatctggcctctccttttcagtttagtcttccactcatgaccaatgtgaatt

SEQ ID NO: 129882 - DNA, 430 bp, Homo sapiens
aatcctgcccacctgcctggcgtggctgggagacccgcccgggtgctctctgtctctccctccctctttcactgctccctgaaggcagcgtctaaagaggctgaggctgtcctgtcactgccccgacctctgaggagaagcccgcggctgtcctgtcactgccccgacctctgcggagaagcccgcagttctgatcacggacctcagatggggaagcgcacaggaggcctcgggtggccgggctgtgctgcttctccctagacgggcagagctggcgcataggaggtgcttcacaggtgactaaggaggcaaagacccgaagcctgggggactgcagtgtccggtggatcccagctgcggccatcgggcccatgggtgggagagccaagggaggggctcagctgggcaataggatgggagtgggcggggg

SEQ ID NO: 129883 - DNA, 443 bp, Homo sapiens
accagaaaccatagcagggtttccaaggaaatgagtcctgacagtttcatgattgagccaatgggtgtcaagtaggagcaggcatcttatcttggcagcagcctgtatttcaaagttcctttttttttttttttcctttttcttttttctctctcttttttttgaggaggagcggggccccacccggagcaccaagctgggggccgggggtcccaaaaaagttttgcttacccctaaaccccaggcttaggcgatttacccgtttgagcctcccggttggggggagattttaattttttgggggaaatgcgctttagccaaggtgccttgggggggccaaacctcctgaaaaaggcgacctcccattttggccttccaaagggcctggaggaccgggggaaaccttccaaggcccttaaggttatccctttgaaaccgggggc

SEQ ID NO: 129884 - DNA, 206 bp, Homo sapiens
tcaagcacatctctagcacccagcccacattcagacggtctacaagagcatgtgtgtggaagggcacttaatctactcacttttggccgggcgcagtggctcacgcctgtaatcccagcactttgggaggctgaggtgggtggatcacctgaggtccggagttcaagaccagcctgaccaacatggagaaaccccgtctctactaa

SEQ ID NO: 129885 - DNA, 267 bp, Homo sapiens
tgctgggattacaggcgtgagccactgtgctcggctggtagtactgttaagcgctaagagcacaaacaaaaactatgtctaaaatgtagggcaggtagagcaggtgaggattaaacccagttgaaatcagcggtttcagtagtaagtgggcagatcataattacctgtgttgctcagagacctaagctgagagtgggggtggggaaaggtcacacccattatctttggagaaatgatgagagtaaataacccatagtttccagttta

SEQ ID NO: 129886 - DNA, 224 bp, Homo sapiens
tttctagtaggcaaagctgtcatttaagtgacccactataatttgggatgaaacccgaaggaaattttgccaagtttagaataggagttgcatttctgagtttactcagcatgatgaatccactaaaatgctgactattctttttttggcataaacttacgtcaaggggaaaatgaacattaaaatgaatatagctagagaggcaaaccgtcacaacattcact

SEQ ID NO: 129887 - DNA, 173 bp, Homo sapiens
actccgtggagtgatgtgttgagactatgtaaatgtcttcctcagactttcacccactagttttgacagccattgatgattcttcagctgcatctttcttactacgtttattagttggctttctactgtaaagaagagctttcctcatttatttatttatccattaacatatg

SEQ ID NO: 129888 - DNA, 467 bp, Homo sapiens
actgctgagcagcagcaacccactgggtgaaaacgctggaggctctggatgctgcctggtggcggctgtgagtgatcaggtgccagcgtcagcatcgggtcatccactgtccagaatccagcaccactccctaaattccaacttccccccaacacggggcctgctctgtgggcttcagccggctcggatgttgtctgcagctcccgtcccgtaccctctccactcccacaccctgcctggacatggttacacagtcacacacactccacacagtcacacagtcacacagtcacacgtggccacacagtcacacgcggtcacacagtcacacgcggtcacacagtcacacacagtcacacagtcacacacggtcacacagtcacacgcggtcacacagtcacacgcggccacacagtcacacgcggccacacgtcacacgcggtcacacagtcacacgtggccacaca

SEQ ID NO: 129889 - DNA, 631 bp, Homo sapiens
cagtccctggtgaggatcccaggaggcccagctgctgcaggccttggtcaacacctgagcaaccacaaggagttgaatgccgggcctgagctctgactgtaactgctctacacttggcctgtgccagtggccatgtgcaagtggtcactctcctggttaacagaaaatgccagattgatatctgtgacaaagaaaacagaacgcctttgatacaggctgtccattgccaggaagaggcttgtgccgttattctgctgaaacatggcgccaatccaaaccttaaggatatctacggcaacactgctctccattatgctgtgtatagtgagagcacctcactggcagaaaaactgctttcccatggtgcacacattgaagcactggacaaggacagtaataccccacttttattcgctataatttgcaagaaagagaaaatggtggaatttttattgaaaaagaaagcaagtacacatgccgttgataggctgagacggtcagctctcatgcttgctgtatactatgactcaccaggtattgtcagtatccttcttaagcaaaatattgatgtcttcgctcaagacatgtgtggacgagatgcagaagattacgctatttctcatcatttgac

SEQ ID NO: 129890 - DNA, 235 bp, Homo sapiens
aagcagtgggtaaatagcctcaacaaacataaagatacatgaggacttggtagatgataaagatgacatctcaaattggtgggaaattggtgggaaataggtggtagtgacataactggttagctgtctatggggcaaatctttaatatgtcactctttagaccaaaattaataccaggaggattaaagacttcattgggggcagggcacagtggcttgcgcctataatcccagc

SEQ ID NO: 129891 - DNA, 600 bp, Homo sapiens
ccctagaataaaccaattctgagacgtgttttatacagtctccccaagattctccttgactcaatttcccctcccttactggtacttcctggaattttcttctagataaattttacttaagtccttatctcagctcctgcttcttggggtactcaacctacaataccatgccagttttatttattttttatttttttgagacaaagtcttgctctgtcgcccaggctggagtgcagtggcacaatctcggctcactgcaacttctgcctcctgggttcaagtgattctcctgcctccgcttcctgagtagctggattacaggtacccgtcaccatgcccagctaatttttttattattattttcagtagagacagagtttcaccatgttggccaggctggtctcaaactcctgacctcaggtgatccaccagccttggcctcccaaaatgctgggattacaggtatgagccaatgcacccagccccatcccagttttacatgtgagcctcctccaatgcatgactttatatctgcatactgagacccagggtaagagatacccagccctcaagtcctaccatagtcctgtgagaaatgcc

SEQ ID NO: 129892 - DNA, 470 bp, Homo sapiens
gggccacctgagggaccgagccattagggcttcagaccaaggacagccccagctcctctgagcacctgcatttgcacagcctgccagggaagagtctcttcccaggagcgtgcagaggtgattttgggaaggtctggttgtcagggttgaaggcggcgtgtagaagtggaaacacaggggctgggcaccgtggctcacacctgtaatcccagcactttgggaggccgaggcggatggatcacgaggtcaggagatcgagaccatcctcgctagcacagtgaaaccccgtctctactaaaaatacaaaaaattagccgggcgtggtggcgggtgcctgtagtcccagttagtcaggaggctgaggcaggagaatggtgtgaacccgggaggcggagcttgcagtgagctgagatcgcgccaccgcactccagcctgggtgacagagcgagactccatctcagaaaaaaaaa

SEQ ID NO: 129893 - DNA, 328 bp, Homo sapiens
ggaaaacatctttatgtatggaggcagaattgaaacaaatgatggcaatgtcacagatgaattatgggtttttaacatacatagtcagtcatggagtacaaaaactcctactgttcttggacatggtcagcagtatgctgtggagggacattcagcacatattatggagttggatagtagagatgttgtcatgatcataatatttggatattctgcaatatatggttatacaagcagcatacaggaataccatatctgtgagttacttaaaaattgtaatttctttattgattgggaatgtttttctctttaataaaatcttcatatg

SEQ ID NO: 129894 - DNA, 129 bp, Homo sapiens
gttagaccctagttccagcttaagatttctgagttgagaaacttagactacttgtgagtatgtctcagaagttaagtttggataaaattagatatgtaaaggattatgtcaatttgcaaaagaaaaaaa

SEQ ID NO: 129895 - DNA, 531 bp, Homo sapiens
tctgttaaaatatttgtaaagaagtttagacgttatgacatttcagccctaaatattttggaatacacctccaaaaactgagaacatctcaatgtcattattatacctcacaaaattaacaatgcatttcttaatatcatttgatacatagtccatattcagcacttcttggttctcccccaaatgtctcctcacagctgttttgctcgctggtttaattattaaaacattatgcggctgggcacggtggctcacgcctgtaatcccagcactttgggaggctgaggcaggtggatcacctgaggtcgggagtttgagaccagcctgaccaacatggagaaaccccgtctctagtaaaaatacaaaattagctgggcatggtggcgcatgcctgtaaccccagctacttgggaggctgaggcaggagaatcacttgaacctggaggtagaggttgcagtgatccaagatggtgccattgtactccagcctgggcgacaagagtgaaactccgactaaaaaaaaaaaaaaaa

SEQ ID NO: 129896 - DNA, 334 bp, Homo sapiens
ggttgagcaggtttgctaaatttcctgtcatttttaagattccgtgattctgattcggctcaaccccaagactcatcggttctgtgttttccacttctctctgcaactgacacattccccggagggagaacaactttctggattgtgagatgtgtgttcttagtctcttttaagggagcccctgtgattcttggctgggcacggtggctcacgcctgtaatcccagcactttgggaggccgaggcgggcggatcacgaggtcaggagatcgagaccatcctggccaatatgatgaaaccccatctgtactaaaaatgcaaaaattagccaggct

SEQ ID NO: 129897 - DNA, 358 bp, Homo sapiens
attgatctctgggtttcagtattactcagggccgcccactgagtaatacctagtgcccccaaggggcactgagagaagtaaaaagaagcaggaagaaggaagaggagaaaacaagggaggaagcgggagtggccacgtggcacctgcaatctcatcagagctgcccttggccccacccgtcctgtctaggagaattggcacacactccctggagtctgggcactgaccatcagcaatgatgccagccaccgggcctccacagctagggcgggagcagggccctggtgcccaatgatgcttttagttggcagatggtgggaggttctgagggtccggaagaggggctgagtcatcactc

SEQ ID NO: 129898 - DNA, 483 bp, Homo sapiens
cataagagaccccaagtgagaaccacctggctgagccccactgatctgcagattctaagcaagatatacaatggtcatcgtttgaagcccctgcatatggattgcttgtcacagagctgaagacagccagagcagacttgcatacctgggagtggagtgctaattcacaaagcccaagacttgtgagtgagatggtggctctgcaagcaggtagccttcaaggttggaagaatactggtggtgacagggggataagggctgggaggaaagtgagggaaatgttggaaggtgaaggagacaaaagggcaccctgttagttagtggcagaaactctaccaatatggccccacacagtgacataggaaagagtaaatgtaataaataatctggggaaatctgggagacttgtcaaaagtgacaattggtgtattttggctatgtatgattaaatgaggataaagagaggagttgaaaagaaaaggc

SEQ ID NO: 129899 - DNA, 185 bp, Homo sapiens
tgtagctccctccacactgcaccccacgggcatgtacaattattatgtgtcaattataaacaaaattttcaaaagcaggtaaaccacgccaagggaagagagttaaggtcgcagtgtcatgggtggaggggtgagggtacacaagggccactttacagagagagggtaggggtgacaggaggggg

SEQ ID NO: 129900 - DNA, 130 bp, Homo sapiens
tggtgacaactagttcttggtaatcataataatcagacaaaaacaattttattacttcagactcaaagtttaaaaacattgcttatcaataaatggtcttccctttattaaattcatataactgacaatc

SEQ ID NO: 129901 - DNA, 160 bp, Homo sapiens
tagatgtgtggactggagcaggtgtgggtgtgctctgtgggacgtgctgacttccgccccagctgagaatgcagaagagcagcatgctgcttttcaccatcagttcctctgtccaaactcgaagccacctctggtgaagaggcagtagcatttggcaatg

SEQ ID NO: 129902 - DNA, 383 bp, Homo sapiens
gatccctgattctgtcttgtaatttctttaccccactaacacactcaccactttctaaaaccatacataatttatgtttattattattttaggtcatcatccactagagtgtgaactctgtgaggcaggaccccatgtttagtgacatgtctttgatactaacagccatatctaatacatggaaggactcaactatttgtttgaatgaattcttataataggatacatttagtcttcaactggctggtaggctattaagatataaaacaaactggaaggattttgctgtttaaatcacacctacaatgtctacatttattagaaagggaattttcataaagcaacagtaaaaccaaaggacactgctatttgttgctgataat

SEQ ID NO: 129903 - DNA, 551 bp, Homo sapiens
tgcacagcctctagatcacgtgcaggcacaggtgctgggaactacagaagaggttgaatagaaggcttaacaatgagtttggaagtcaggcacagagggtttgacttccgggggcaccccttgccagctgtatgaccctggcaagtcactcttcctttctgcgccttggtccctgcatctataaattgctgtaaggatgaaattacataattataggtaaagcacctggcacagtgaacagtccacaaatcttagctataataacaatgacgtcagttaagtaactcacttagaaacaacactggccactgaagtggagggccagtgaagtggagtcaagtgctgggaggaagtccaggccagcaggccaactttggtatacaaagatgtgaaaacacgcttggcgtggtggctcacgcctgtaatcccagcacttcggaaggccgaagcaggcagatcacctgaggtcaggagttccagaccagcctggccaagatggcgaaactctgtctctactaaaaatataaaaattagccaggcgtgttggcgtg

SEQ ID NO: 129904 - DNA, 689 bp, Homo sapiens
tgcacagcctctagatcacgtgcaggcacaggtgctgggaactacagaagaggttgaatagaaggcttaacaatgagtttggaagtcaggcacagagggtttgacttccgggggcaccccttgccagctgtatgaccctggcaagtcactcttcctttctgcgccttggtccctgcatctataaattgctgtaaggatgaaattacataattataggtaaagcacctggcacagtgaacagtccacaaatcttagctataataacaagatgacagattttgatcgttttaaagttatgaaggcaaagaaaatgaggaacagaataatcaagaatgaagttaagaagcttcaaaaggcagctctcctgaaagcttctcccaaaaaagcacctggtactaagggtactgctgctgctgctgctgctgctgctgctgctgctgctgctgctgctaaagttccagcaaaaaagatcaccgccgcgagtaaaaaggctccagcccagaaggttcctgcccagaaagccacaggccagaaagcagcgcctgctccaaaagctcagaagggtcaaaaagctccagcccagaaagcacctgctccaaaggcatctggcaagaaagcataagtggccaatcataacacagtaataaaggttcttgatgacctgttaaaacaacaaaacaacaaaaaac

SEQ ID NO: 129905 - DNA, 300 bp, Homo sapiens
tttgaattttagactggaactatcaatagtaattttagaactagtgttgttggcattgggttgtatgatataataacagggatgtgaggactgttctgtgctgactagttcacttaagcggtatctacattacgctaagccattctcctaattcaatgaggaataaatatccaatttgatggggaaactgtcatgataaaacaaccagctgattccattttcatctcttcaagctactgctaaagtagagagtaaagaaagccctgagtccaagtcaaagctaacagagttagtatttca

SEQ ID NO: 129906 - DNA, 574 bp, Homo sapiens
cacctttaggattttctacatataagttcaagttatctgtaaacagaaagaattttactccttccttccaatttgaatgtctttttttcaattcttgcctaatttttctgactagacctttcaatactatgttgaataaaagtgtcaaaagcaggcatccttgtcttgttcctgctcatacagggaaagctttcagtctttctccgttgagtatgatgctagcattgggtttttcacatattgcctttatgttgaggtggtttccttctattcttaggatgttttcattatgaaaaaatattgaatttcatcaaatgcttttattgattcaatcttattactgattatagttctattcatatttttgtgtgtttctaggagtttgtctatttcatctaggttatccaatttatttgcataaaattatttatagtactttcataatcattattttattagaattggtagtaatcgcttcatttttctttctttctttttctttttttttttttttgaagagagggacgggctctcactatgtagaccagtccaggatggaatacagtggtgtgat

SEQ ID NO: 129907 - DNA, 258 bp, Homo sapiens
ctcatttcagtttgataactctgcttatttttctgcttgatttaacaatttctgaaaagcatgtgttaaaatatccaattatgatggtttttgtttgtttgtttagtatttttttggtagagacagcgtttcaccatgttggccaggctggtctcgaacttctgacctcaagtgatctgcccgcctcggcctcccaaagtgctgtgattacaggtgtgagccaccacacccagccactcaaacttaatgtagtaaact

SEQ ID NO: 129908 - DNA, 385 bp, Homo sapiens
ccaccaagtggcaccggactcccagcagtttctactccactaatccatcttgtttctgccattgcatttattgtgtccattcttctttattttgtgtttttttagtttactcctgtttccctctcaccaatacacacacacgcacgcacacacacacacacaccatagccatttgcatcaaagcaagcagttccattttaaggttcaaaatgtcttctttgaatgtatcttttacacttccttttccaaaatcaggatttctacaaatgacacaggtaacttgatgtctactatttactgttccatacacacatatagtgactatatcagccatggcctggcaagtttgataagtgaagccattccattttttagaacaaaaaaa

SEQ ID NO: 129909 - DNA, 437 bp, Homo sapiens
aatacactgtagatgaatgtctgcatcaagctgatgcgtgctgtcaaatccagggagattcaaatcacaaatttaacaaacgtatcttctccttaaaggattatatattactatgattaaaaaaaatagatacactaatgtcatccaaaaagtataggtatgtgtctccaggtaaatgataaatgacagagatgacaaaatagctcaaaacgaagtcagcaagtgaaacacaatttataaggcatgtccatgtaagaattagcacagagaaataactacagagccaagaagtatagactgcaaaagatatcaacgtaccacagaaaacgacagaggccaaatgagaagtatggagaaagaacacctaaggggtctggaactagaattgtcctggcaggcttgagggaacaagaggcatttaaggtgaacttctggat

SEQ ID NO: 129910 - DNA, 428 bp, Homo sapiens
tggggaggcctcaggaaacttacaatcatggcagaaggggaagcaaacacgtacttcttcacatggcagcaggaaagagaagtgcagagcaaaaggtgggaagccccttataaaaccgtcagatcttgtaagaactcactcactattatgagaacagcagcatgagggtaacctctctcatgattcattacctcccaccggctctctcccatgacatatggggattatgggaactacaattcaagataagatttggatgggaatacagccaaaccatatcaaagagtatattatgatccatgctgatatgaaggaaaattattctgccttggtatgagatggattgtgaaagagaaggacaagatttgctgatttattcaaaacatatttactgcatgcttacaatatactggccctcttctaatcaa

SEQ ID NO: 129911 - DNA, 384 bp, Homo sapiens
aacgccaaacagtaaccgccttcaggttcagcttcggcatttctaagcctcagcgtcccaggcacgatgatggggctgtggctcctccctcccattgagaacacttcactgcctcctcgcagtggtgcctactcagggagaacagagacgctcaagctgactgagcttacgtggctgatgagttgcagagagttctccttagcctgtgccccctccctgaggacagggactatgtcctattcctccccgtggcccctgtgtggcctggcatcatgcccagttgttctagaaaccagccaacatggactgaattgattccccaaagctggagggattcatgccattcacctatccatacagtatatattgggcattgggcatttc

SEQ ID NO: 129912 - DNA, 509 bp, Homo sapiens
atgaggagatgccaggatggtgtctttttcccctcactttctgagcagatgttgggatagcattctgaaatcttgaggacacagatatctgaatcttgcatagggagcactgtcatatggaagtcagagggttaaaaacaaaaaaaaaaaaaacaaaacaaagccttccctaggtgcagtggttcacgcctgtaatttcaccactttgggaggccgaggcagttggatcacctgaggtcaggagttcaagaccagcctggccaacagggcgaaaccccatctctactaaaaatacaaaaaattggctgggtgtggtggggtgcgcctgtaatcccagctacttgggaggctgaggtagaattgcttgaaactgggaggcagaggttcagtaaagacttgaagataaattaataatttttcattaaaaatatattaataatgcattcttactgaaaatcataagaattacaatgatttatgggtatacatgttcagtagctttttaatac

SEQ ID NO: 129913 - DNA, 316 bp, Homo sapiens
gagatggcaccaccacactacagcctgggcaacagagtgagactccagctcaaaaaagcaaacaaaaaaccaaaaaccatgcagcatttatgctagacagcaggcagagtggtgcaggagagtgaagcatatcatgtgttctatcattatggagtgagggctctaactcttgtgtccttgagtggctagggaaatctccacagaggagatactgagattaagggagacctagaataggcaagttatgcctacagatgttccagggtaaagcttagaagccaccttcataagaagtagaactgccctggctagaaat

SEQ ID NO: 129914 - DNA, 129 bp, Homo sapiens
tgcggcgtgaaccactacgcctggcctagttttaattttttgagaacctacaagggttccagtttcttcaccttcttgccgtcacttgttattttttttaaatagtcgctgtcctaatgggtgtgaggt

SEQ ID NO: 129915 - DNA, 255 bp, Homo sapiens
gggtggcgtctagaggatccctcataggtcgcaggcgcaggtaagttcatctatctgtatgcctaaatctggatcaatattaaaaacccatgactgctgcataccaaagccacatccttcaacctaatctttactaatattaaaggtaaaatatataaaaagatggaatttttatatccatctgtctttcaattggttccactcttgggccagaaataaaagttacttattgtctcccttcatcctaacacttgc

SEQ ID NO: 129916 - DNA, 203 bp, Homo sapiens
atcaaatgcaccatggtaattcttagcaacataaataggttagtccaatctaacttaatttccattctgtgtttaaaaataatgctagtaacaaatttcagaagtactccttcagaaaagctacaaaaactgcatgcatgttgcaacagataggaagagcttctttcgtattttcaaatatttcacatttcatgttttcaaat

SEQ ID NO: 129917 - DNA, 424 bp, Homo sapiens
caaaatcaagaatttgacattggtactatgcatatatatgtctttgtgtcatttatcatatgcgtacatttgcgcaaaaactaccacaataaagatacagaactgttccaccttaaagatcattcccatacttctcctttttatgcactcataccactcctaatcatctctaacccctgacaaccactaatccgttccatctttgtaattttgtcattttgagaatgttctataaatggaattatatcctttagacctttctgactcagcataatgcccttgcgatccatccaagtatgcatcaatagtttgagtctttttattgctaagtactattccatggtatggatgtatgaaagtttatttagtcattcatcgattgagggttattttagttgtttccagtttttggttttacaaataa

SEQ ID NO: 129918 - DNA, 245 bp, Homo sapiens
cctcagggagcatttacttatggcagaaggttaagtgggagcaggcttgtcacatggtgacagagggagcaaaagagagagttgtgggggtaagtgccacacaattttaaataaccagatctcacgaaaactggctgggcacggtggctcacacctgtaatctcagcactctgggaggccgaggtgggcagatcacttgaggccaggagtttgagaccagcctggccaacatggtgaaacccaat

SEQ ID NO: 129919 - DNA, 638 bp, Homo sapiens
ttttcaggagacatgggtgtggttttctcttttcgcatgttttagacaaaagtggcggactgatgagtttaatacaatggaataccatggcttgtgcatgagggagtaactttttacaggaatgtttattatctttgtcatccgaatccatatgccatgctcagaaaatacaatggatctgtgtcccgagtggaacagaaatagtttttccatgctgaaatgtgttttggtcaccatttgacatttttaagaagcagctctgtgaaatatttttgaaagtggatttatgtattcatattcattcatgtgctgttttttcatctatatattccccatcttattccagaaaggatttaagctggctcatgcatttgttgtatttggaatgtttctttataggtcaaggactagtttcccagtgaattgatttaaagaactgcagtcctctgactcaggcttgaattcacatatgatattggccatttgggatatctctctgttgtatgggcagagtaaacacaagtataaatctgtgacaacattttggatttctcagatcaggtactccatcatctgctttttatcacgtacaaaagaaatacaaggccatttatttccctattaccctgtgaaaagta

SEQ ID NO: 129920 - DNA, 274 bp, Homo sapiens
ctgaggcacccgccaccacgcccagttaatttttgtatttttagtagagacgggttttgccatgttggccaggctagtctcaaactcctgacctcaagtaatccacccacgttagcctcccgaagtgctgagattgtagacatgagccactgcaccaggcccagcttccaactttttactgtaacttttgttttggggtggggtgggggtctcactatgttgcctggagtgcagtggctgtttacaggcactgtcatggtgcatggtagcctcc

SEQ ID NO: 129921 - DNA, 175 bp, Homo sapiens
ccaccagaccccacttccaacaatggaggtctcattaaatacgagatttggaggggacacacattcaagctatatcacccttgttatagtcttttattacaatgtttggtgtgttaggcctcaggaaacaatatccctgaccttctcctgccctcctttcatctgcaccaaggca

SEQ ID NO: 129922 - DNA, 167 bp, Homo sapiens
ttggccaggccagtcttggattcctgacctcgtgatcttcccacctcggcctcccaaagtgctgggattacaggtgtgagccactatgccctgcctgcaaattatttaattagtactttattaatagtgagaaactatttgagacatttcacaaaagatccaagtgg

SEQ ID NO: 129923 - DNA, 601 bp, Homo sapiens
aaggaggaggaggagggagagggaagggagaagtggaggaaagaggagaatagaagagggaagaggggaggggagagaaagaaggaagggaagagaaaagagagaaggagatgagaaagaaggaaaggaggagggaagagaaggatgaagagaggtgggaggaaaggagagaaggaagagaaagaggagaaaggagggaaggagggacagagtcaaacaagatcaacagaacactggctcaggagtcaggtgaccatgattcgagtcccctgtagcctcattgggtgaccctgagaaagtctcttcccttctctgagccttggtccctgccctgttcaaagagcggcttaggctgactgcagtccaagtccctttccagcccttggactctccacccatcagggatgctcttagggccaagtgggcaagtgactccttggctctttcaaccatgcagagagatctctatgggaactggcagagccctggcaagttgaggccatgggaggctgaacttgcttgtccaaggccctctgcacagagaagccacccaggcccagccctgcagctctcccgcttctcctgactccaccactcttca

SEQ ID NO: 129924 - DNA, 196 bp, Homo sapiens
ctgccttgtctcttcttctgtttctgccaagacacaatctttcatttggggcttggccctagcctttccagtccctcctctcccttacatacctcaaggattggggagctcactccctctcaggttgtgtaatgagggtgaaaatggctcctttttgttacggctcctgtgtgctgcgtgcctgctccatgcctgg

SEQ ID NO: 129925 - DNA, 669 bp, Homo sapiens
gtctgcagtggcctgctttttggcatttcttctaagctgaatgcttctctaaaatcttagcttatatctgtagccaaagtacctagccctctgctcacccttctgtggcatccgaggtatctttggtgaacattcaaggacgaattaccaaggtgttctctctcttcgtcaacactcacctcccaagcagcgttctgtggtggggcacattaccaccatgttggggaatcagtgtgtgttcacacgacaagaggcgaaaaagaaaaagacaagaattgccaaaacaagcaaatttttcctattctttcctctgtctgagaaatgttcctcaactttccccaacacccgatgcatgatacctgccaaaaaaagctttctccttgctcttcagacacaggctcattgtgagccattctccccggcatccccgcgagtgcaaatttgtgtatgtggtgttttgttttgtatttattttcccagccctttgaaaacagggccttttcctatttaaaataaatttcagaagtgaaatactttttcccttttgagagcccagcccttcctccatacaaaccttcaggcattttcagaggacaatgaaaacttgctctaaaacaccatccatagacttcccttcagtcagtgtttttctcacacattaacaacaaa

SEQ ID NO: 129926 - DNA, 296 bp, Homo sapiens
ggaccactggttacctatgcatatgaagttttaatggtgtattttaggatatagcatttgactttcctttaatctgaatctgattttatagaattctgtatcacactttcctaaaacactgtaagcatcagagaacaccttagttaaggttcaatgtaaatttcatgttgctaataaggttgttttatttaaagcatttaaaaggccaataggctgggcgtggtggctcacgcctgtaattccagcactttgggaggccgtggcgggcggatcatgaggtcatgaggtcaggagtt

SEQ ID NO: 129927 - DNA, 511 bp, Homo sapiens
cagggtagtcttatttgcgttaatctgtttggtgtctgtgacattcctgagctatttatatctttttcaagttttggatagttttctggtattatttgaaaaagctttctacccctcgttcttgcttaatttcctcttgaacatcaatatttcttagatgtggtcttttgagatagttttctatatcttgtaggcaatctttggggatttcttaaattcttttttcttttctgactgtattttcaaatagcttgtcttcgagctaactgattctctttgaagtattctgctcttgaaagcctcatgaatttttcagttcagcaaatctatcattgtctttttagggtcagtcaccggttccttgctttgtgtgtttggggagatcatggttccatgtttgctattgttttttgtggatgtattaatgcatgtatctttgcattgaattattagtaatttattccagtcttttctgtctgtattgttttatttttattgaatatgtttgctt

SEQ ID NO: 129928 - DNA, 701 bp, Homo sapiens
tgcagtggctcacgcctgtaatcttgacactctgggaggctgaggcgggtggatcacttgaggtcacaggttcaagaccagcatgaccaacatggtgaaaccccatctctactaaaaatacaaaaattagctgggcatgatggcatgcctgtggtcccagttattcagaaggctgaggcagaagaatcacttgaacctaggaggcagaggttgcagcgagccgagatcacgccactgcactccagcctgggcaacagagagaaactctgtctcgaaataaataaataaaaaataaaaaaataaaaatgccacaatgaactttagttatattcttgatgagttctactttggctattataagcatgacaaaaaaaaacttttcaagtatatcaactttttaagctttacaaaaaaactcaaagttcacaggcccaaattaagcagcagctcttatactttccatccaaaacctgagaagactagcatcaccatctctccaatctacaaatacaagaactagggaggatgacaatgaaacatcagggagatgaacaagggcaaaatgaaactaaataggagtgtacagctattaaattccaacctttagctggcaccatattaaaaaggcaccctggcaactataatcctttgcagggaattagggtagaggaacaggacacagcagcatagaaacagagttt

SEQ ID NO: 129929 - DNA, 171 bp, Homo sapiens
aaataaataaataaacaaatatggaaagggggatggctagaatgaactctgcagtgctggatcagaattggaaatatcaatgggagcacatagttttataaatttgtgtgtgtgtgtgtgtgtgtgtgcgcgcgcgcatatgtgtgcatttgtgtattagtgtgatagtct

SEQ ID NO: 129930 - DNA, 269 bp, Homo sapiens
atgtattctgtgtgtagtcttcggaatttctctagatttcttttaggggttgagttatttcttttttttccctccatgctttatattttacttcattgcaatggcacttagaatgattgcttaggggccgggtgcggtggctcatacctgtcatcacagcactttgggaggccgaggtgggcggataactagctcaggagtttgagatcaacctggccaatatggtgaaaccccatctctactaaaaatacaaaaaaaaaaaaaaaaaa

SEQ ID NO: 129931 - DNA, 357 bp, Homo sapiens
tgaaaaactcatactgagtgtggaaatccgggtttgttgagtactcatatgcgtagaaaaatgattaccaaaggccaggcatggtggctcatgcctgtaatcccagcactttgggaggctgagaagggtggatccacgtgaggtcaggagttcgagaccagcctggccaacatggtgaaaccccgtttctactaaaaatacaaaaattagctgggcatgttggcacacacctgtaatcccacctacttgggaggctgaggcaggagaagcatttgaacctgggaggcagaggttgcagtatagccgagatcataccattacactccagcctgggcaacaatagtgaaactctgtctc

SEQ ID NO: 129932 - DNA, 815 bp, Homo sapiens
gatatgattaattacagtatagcattctttatttacattctagtttaccctcagtactgataatatttcttcatcttttggagtaaagtcctttccatagcttcttaaatcacatgtttaaaatgatctcagttatattggtaaggcagaaacttaaaggtcttatttttctttctaatcagtaccaagaccagtgtgcagttcccagtaagtactcaacaaatttttttcaataaatatttttgaattatattccgaatataattatattcagaatataattcagaatattcagaggtagacactagctctatttctaaacactgatattaacatttcactgaatatattattgacatatgctttgaaaggataaaacatatttcaattcatgtttatgagctaattttgcagttctctatcatcagctgactgtgtgatgtattcccctctgattgatattgtattatactgggaagattatttttgaaattctgcaatgtttacatttaaaaatttataaatatttataaatatcaagaagtgaagtatttcagagtcaaagtaatttatgaaatgaaaaaaaatttagaaagtattacaaaaagcccaaattgttcagtgtaatattttttctattccatctgagttagcagtggaatgggaaatataggaagtgacaataagaatttgagtcattttcccaaatgtatattcattttaaatgtagtactctgaagtgtcagctaactttctttgttttttaacatagcatataatttccctaatgttttgcaaaacaaaaacaaaaaaaa

SEQ ID NO: 129933 - DNA, 432 bp, Homo sapiens
ggtggtcttgtgagacaggactggagttcttcaacaacctggagtctcagaattcccctcagaatgccatgaggatacacctgccgagtgattttgcagcagtgttcgggggacctgaatgaggtgtgaagaactggcatgttgcctggcgaggggggtgcccctgatggctcctctgtctgccttctgagtaccatctgtcgccacctctgggtaacgttcattgcatgcttagcacctacaaggtactattctaattcaacaaccctatgagacaggcgctggtgtttccctaaattacagaggaaggaactaaggcagattaagtaacctgccggaggtcatgcagctagtaggtgtacatgttgggattgaaccccggtcatgtggactccagcctgaactcatttccaccacattcagctgagatga

SEQ ID NO: 129934 - DNA, 168 bp, Homo sapiens
cgtcagttgaaagctaaattaaatcaacttttcatgcttttgttagttgacttgaaatctctttaaaatgccttttcactgacagcagtagggaacccaaggcaggcagcatctaaaatggaccctaatacctgactctgggtattcatgctgttggattgaacctcg

SEQ ID NO: 129935 - DNA, 301 bp, Homo sapiens
tctcaccacccaggctctgctttgtttccaaagctcttcccgtagctggtcttctcaggcgtctcagtctagcttctttgaatgccagctgacttcaccccatcgtccctcactgcacatcctctggaggcctcacagtgcttctccctctctgctgtcccctctaccctcacctccagaagaactgacttttttgaaaccacattgtcctttcattgatcacaccactatcactgcctttactgttctgaaataaatttatttacccatccatctatgctgtcaatctgtatggtcctga

SEQ ID NO: 129936 - DNA, 723 bp, Homo sapiens
tgagacttcatatagctatctctgaaattttgggcactaaaagaacttgagaaagttacttcataaatgtgtggaaactggaaattgactctatatctttggtaataaaggggtaatgtcagtattttcaacatcctggtgtccagtctagaaagacctagtaggagaaaaatattaggcttttccaaaggatctgtttctgatttcttaacataaatttggccttgttgagtcctttttaatttgaaccggcaaagtatctccccctgcctcagaaataacttattgattaaaatcgaaaactagggccaggcacagtggctcacgcctgtaatcccagcactttaggaggccaagataggtggatcacttgaggtcgggagttcgagaccagcctggccaagatggcaaaaccccatctctactaaaaatacaaaaattggccgggtgcagtggctcacacctctaatcccagcactttgggaggccgaggcaggcagatcacctgaggtcaggagctggagaccagtctgaccaacaaggagaaaccccgtctctattaaaaatacaaaaactagccaggcatggtggcatgcacccgtaatcccagctactctgaaggctgaggcacaagaatcacttgaacccaggaggaggaggttgcagtgagccaagatcgtgtcactgcactccagcctgggcaaaaaagccagactccgtctc

SEQ ID NO: 129937 - DNA, 372 bp, Homo sapiens
ggggaaatcaagattctttctaatatgagatgtcaagcatgtgctctggagctcaaaggggaggtgtgttctactggtagaattttcataattgtcagtatttggtagacaacatttaaagtttgggaataggtgaaatccaaggagaacataaagatggaaaagttggccaagcgcggtggctcacacttgtcatcccagcactttgagagtctgaggcaggcggatcacaagttcgagaccagcccgaccaacatggtgaaaccctgtctctgctaaaaatacaaaaactagccgggtgtggtggtgcatgcctgtaatcccagctactcagaaggctgaggcaggagaatcgcttgaaaccgggaggcg

SEQ ID NO: 129938 - DNA, 492 bp, Homo sapiens
tgcctcctgagttcaagtgattctcctgcctcagcctcccgagtagctgggactacagatgtgtgccaccaagcccagctaattttgtatttttattacagataaggttttcttcaatgttggtccaggctggttctctgaacgtcccagaccccttcaggtgaaattcacttcgaccccatatgatccgcctgccttggactcccaaagtgctggaattacaggcatgagccatggcacccagcccgtatcagcctttttttaggtaaaatattatttagaattttctagagcagcctctatgagtagatcttttgattgtactctacttgctgtaacagccagaaatgcagaatgatgtttatctagaatctgcaaataaggtctggcctctgcctggaatttataaaacagggtcctactttagattgagaatgtacagaaaaccaataggaggcattttctgcattgtgagatgtcaacatagacatt

SEQ ID NO: 129939 - DNA, 684 bp, Homo sapiens
ggtgctggtatttatagccatgaacttattacttgaaagcatcctagggacccaagtcttaatcaaggggcagttcttccaagtagtggttgaggaagttgggtatgctttccaaaacttctttcctcactaaagattgcagatatactctgtaagtgacttcacagaatatactcaattgtcatattttaatttacatgtttcttctgattataggtcccacgtgattataagttctgagatcaagggtcatctttgtgggggtgtgtgtgtgcacttaaaattttatgtgctggtaatagttatcttgtggatatttaagaaataggaatgtgtgccatattttaaatacaccttatatgcaaaaattttaatgtaatttaagtatatcgcaaaaaataaaaaaaaaaaaaaaaaaaaaatggggggggggcggggccctcggaaaaggctttttcataacacacttgtgcggttggggggcgggggcgggcccccaggtggattaggtagaacactggggggccaaaggcgcggctccccccgaagggagacccgcggcgccagagaaacaagagcggggtgggattccctcacaaattaaaaacaccccggggggaacacgagagcgttgccgcaaacacatccgaaggggggttccgaggggcactcccggacctatac

SEQ ID NO: 129940 - DNA, 314 bp, Homo sapiens
tatcatgtctatggtcacacagccgatacacggtagaggcaggatttgaactcaggcagcttggctatttcagagcctgcactgtaagcgttatgctccattggctctctactcaccaacagcatccacacaaagacacccccttcccctcacaggactcaggagagggacctttggggtctgttttccctcacagctgctccaactggtcaagttagcatgacgtcatccggatgacataaacaaatttgcagtcaggctgaggtgagggggaggacaaccctcagtcaggtttgtcctctacaggctccaca

SEQ ID NO: 129941 - DNA, 363 bp, Homo sapiens
gttattagagtgacacggtattgagagtgcacgacggatttgaaagccactgcttattctaaggactgaccatcttcagctttctactggacacacacacgcctgcccatggcaagaagtcttttatggaaagccaaacgcattctcctggaaaggccacatggagcactccaggctccctctccaggtgtccccccaccccctgtgtctggcggcaaatggctaatgacagatgggcagccggaggaggcctgaggttttcatggaggctcacactcacccccccagcgcatcaccaccgggagaacactgcagccaagcagcctaatggaaacagacagcagcaaccacacagcccttagg

SEQ ID NO: 129942 - DNA, 397 bp, Homo sapiens
gggactggggagcagccacatgccctctgcaggggagtagttgccaggaaggtgcaggcggaggccctgctctccatcacagcggtcctgtttatgagatcgtcactctcaagaggccaaaagttatgaccaaacttcaagagaaactcccagtaaagtagtatttccacagcagacagttgggatgcaggtccacccacagccagctctgagctgacacaggggccctggccagggttccaccctgctctgcctgcctggggccctggctagcctgcagataacatcaagtagtttcgtaatttccacacacagcacttccagagcctcataatcaaccatctataaagtctcaagaagccatgttgcttcctcatggcacctgctttccttcctc

SEQ ID NO: 129943 - DNA, 355 bp, Homo sapiens
acgtagcaataggtcccactatataatagctcttacttgctttagcctctgtgtgtgtctcgagatgtacattttttatactatatattaggtttctcccaagaagcagaatcaatagaggggtggagggtatacgtgtaagaaagagatgtatttttcaactcatgtgattgaagagtgacaagtccaagatcttcagggcagcctggagccccagggaagagttgatgctgtgcttaaatagaaggtcactttttttttttttttgagacggagtctcgctctgtcacacaggctagagtgcagtggtgtgatcttggctcactgcaacctccacctcctgggttcaagtgat

SEQ ID NO: 129944 - DNA, 252 bp, Homo sapiens
caaagcaccccaaaacttagcggcttaccacagccatcttcccatactcctggttctgcaggtctggaagttgcacagagcacaggagggctgacttgcttccatcctgtaaagtctgaggcctccactgcaaagactccacagctgagagggacccaacagctggaaccatctgaagatgtcatctctcatgtttcccccacatgatgctggctgttggtgcgacctcagcccaggctgttggccacaaca

SEQ ID NO: 129945 - DNA, 405 bp, Homo sapiens
tgtccagcatcctgaaaatcattatttcatatattttccatttaaaaaaactgtttcaggtaagaaggtgaatctagtccctgacataccaagttgaccaaaagcagaggtccctccaatgttctttgcatgccactgacttacatgctcaagagaaatctaggagtcatccctgacacccttctcccctttcccacagccagtccatcaagacttattctctgtcccagacaggcgcggtggctcatgcctgtaatcccagcactttgggaggcaaaggcaggatgatcacttgaacccaggaattcgacaccagcctgggcaacatagtgagaccttgtccctacaaaaaattgaaaaaactagtgaggcatggtggcacgtgcctctagacccagctactca

SEQ ID NO: 129946 - DNA, 477 bp, Homo sapiens
cctcagcctcccaagtagctgggactacaggtgtgtgccaccacacccagctaatttttgtatttttagcagagaggcggtttcaccatgttgaccagactgatgtggaactcctgatctcaagtgatccacccgccttggcctcccaacatgctgggattgaaggcgtgagccaccacacccagcctggtcctctgtctttttaaatatgcgtacgccctgccaccctttcctcttctttttctctctctcttaggacatagcagaggggtctaagtcaggggattgttttgagttaggactaacaggatgagaagttagccaggcagacaaattgagctcggacgtgtgttctggctgaaggaacagaaggtcccaaggcccagagccatggatgcaccctataactggggactgacaagtagcttgctgctgctggggtgaaaggcagggtgtggcaaggccagggatgaactt

SEQ ID NO: 129947 - DNA, 241 bp, Homo sapiens
cacccaccagattggcaagcatttaaaaatctgacaatacccgggttagtaaggatgtggagttgcagaccgtgtctgtggtgggggagtaaattggcacatcaaccacttagagcgattcggcaatatctagtccagatgaagattaacatatgctacagctcaactcctcgccatgcagaaatgccaaagaaccttggccacatatacccagggacacatgtatacgaatgttcttagc

SEQ ID NO: 129948 - DNA, 435 bp, Homo sapiens
atttttagtagagacggggtttcaccatgttggctaggctggtcttgaactcctgacttcaggtgatccgcccaccttggcctcccaaagtgctaggattataggcctgagccactgcgcctggcctctttgactaacttctaatgcactttcgaagaagttcctttgccagcttttctagttcctaactttatgcatctcccttttagccttttacttactctatccatggtgttctagagaagttagacagaggaaaccaaggagggtcacgtactctcttgagcgctcttgttctgtggttggatttctgtacagatgtctccatgatatgagcaacagagcagaaatttggagctagattttctactggtcaagcctcaagtgtaatcctatcctatgggatgtaagggcatactgatttttcctgtttct

SEQ ID NO: 129949 - DNA, 645 bp, Homo sapiens
gtattcttttgtgtttgtccccaggccttacaatgacttcccagtgcaagattcagacgcatcattatgtacctatgacactgaccccactgtttattttccaaatattaggtactttggggaagcatgatgagggaagctgtgttgtgactgcccatgagggtggctgatctggctggaggtcaggatggctgtgaggtcaccagatccctaaggggcttgagggaggaagatcagttctccaggaagaatcagatgaactggaagtaaaggcagagaagctaagcgtgtatcttggacagctttcttcttcttctctttttttatttaaaaaaatttttttatcatgactgactgattcagtgaacttgatttttatgagctgctttgcagacatgaagagaaaaaacagcttggcaggagtagggaaaggggggagggatctaaagtaaataccacacttgcctgcagtttagttgttgacaaaaaacagttttccctgagaagcatgtgtaatatgtcaggaagaaaaaagagcaattaacactcttcttacataagatcttattgatagcactgtattaattttaatcatttaggttaaaatgctcttcttttttttaactaccggtcaataaactatat

SEQ ID NO: 129950 - DNA, 357 bp, Homo sapiens
gagcctcaggcctctgggggacaatagcaaaagctctaacatttatgtcactagagtctcagaaggacaggagaaagagtgcggcacagaaaaaaagcatttgaaaacataatagctggaaactgtccaatttagtcaaagacataaacttacagttcaagaacccgccagacaggatgaatctcaagcagaataaaacacaaagacactccatgcccagatacaccataatcaaactactgaaaattaagtcaaagaaaaaatattgtaagcagccagagaaaaatgatattttacttataagggaagaatggttcaaatgactgtggacgtcctttcagaagccatagaggccag

SEQ ID NO: 129951 - DNA, 646 bp, Homo sapiens
gggagaaagccatgtgaagacgaagacagggatctacatgccgaggaatgccaaagattcccagcaagtcatcagaagccaggagaaaagcatggagtcaacttttgtctcatggttttagttctaaagtaaccaaactttggatatcttgatcttggacttctggcctccagaactgtgagacaataaaattctgctgtttaagccagatgaatttctctttaaatttgtaatactctgttatggaaaccttagaaaactgatacacccctttttgcagataataaaactgagtctcaccaccagtgtaaaagtgttcctatttctccacattctctccagcacctgttgtttcctgactttttaatgatcgccattcccaactggtgtgagatggtatctcattgtggttttgatttgcatttctctgatggccagtgatgatgagcattttttcatgtgtcctttggctgcataaatgtcgtcgtttgagaagtgtttgttcatatccttcgcccacttgttgatggggttgtttgtttttttcttgtaaatttgtttgagttatttgtaaattctggatattagccctttgtcagatgagtagattgtaaaaattttctcccattctgtaggatgcctgttc

SEQ ID NO: 129952 - DNA, 236 bp, Homo sapiens
ctagtagccacagtggatctgaaagcagctctggatctgactcagagagtgaaagtagttccagtgacagtgaggcaaatgagccatcccagagtgcatctcccgaggtgagacagaggcggtggggtaccttccacaggccctctcagggtccttggtgatgtccatttaaaacctgatccaaatataaaaggagaaggaaagaaggttccatagtctgacaaaaagaaattgta

SEQ ID NO: 129953 - DNA, 1082 bp, Homo sapiens
accagcatcttctaaaaatgtcagcagcagtgaagtttcagtttgggaaataatgcatttcccctctctggagagtgcacagttatatctccaagaagtactgaaattcagaagtctgcctaatatgtattaaacatttagcttttctcaaactttgaccaccaaatcctttgtctcgctctaactatagttaacacagaatcagtgttcccaggagcacactgtgaaaaatgtagcactctacaaaagtcctaatctccacaggattaagtgaaaccatgattaaccctctgttccttgtccttattagtaccattttctgaagagtaatgtatccccccaaaacttttatactagtttcactaaccagaatccatgtacataaggaaggacagatatttgctccctactaagacatatctattagctacattaaaaaaagtattgcatgccgattttaaagttataattaactggtgatatcacagatattccaagatataattgctggaataaacactgttgttgaagccttctatctatctcagtactagaattaaactcaagtgcagaatggcagacaaagttaactaaaaatcactgtattatttcatttggtcctccaaatagctttgtgagctaaggaggagaaggtgtatcatcaccacttccattttatagatgagaaatcaagtgatttactcaaggttaagtcctccaattctttgttatcctgcattttctcttggctgtagtttaattaataatcctaagaaaatgcttatattttagagtgcagtaagagtacataaacaatgttaaatgcccatcttgcatgtataaaaagttatagcaagaaatctggctgggaatggtggctcacacctgtaatcctggcactttgggaggccgaggcaggaggattgcttgagcccaggagtttaagaccagcctgggcaacatagggagatcctgtctctacaaaaaaatttagccagacacagtggcttgtgtcctagctactcaggaggctgaggtgggaggatcacttgagccaaggaggtcaaggctccagtgagcta

SEQ ID NO: 129954 - DNA, 523 bp, Homo sapiens
tatctgtgaactttgaaagttactgtttctgttaacttatcagttaatggatatttatctgatttaagcttctttagaattggagatactaaagttggacttaagccattatcacagttagaaatatatattaacctataaacgttcataatagtttgctgcctgagatggggtagttattaaatatcttcagtgttaaagaaaataatcaggccaggtgcagtggctcatgcctgtaatcccagcactttgggaggccggggcgagtggatcacctgaggtcaggagtttgagaccagcctaaccaacatggtgaaaccccatctctactaaaaatgcaaaaattagctgggtgtggtggcgcatgcctgtaatcctagctactcaggaggctgaggcaggagaatcgcctgaacccaggaggtggaggttgcagtgagctgagatcgcaccattgtactccagcctgggtaagaagagcgaaactccatctcaaaaaaaaaaaaaaaaaaaaaaaaaaaaa

SEQ ID NO: 129955 - DNA, 275 bp, Homo sapiens
gtggggttgttgagatgacgtgaccttgagtcttgcgcagcctgtgtctgccatgtcagccttggtggcccccagcatgagtgtggcactccggtgtgcctgtgtcccagtgtggctgtgtgtctcaggcaagtgaactgatgtctgtgtgacatgtcttccgtgggcatgtgtgtgtccacgcacacacacacatcgttctggactgctcttggacggacatgggcatggatatggggtggaggggacacagggacgggaaaggtacaaataca

SEQ ID NO: 129956 - DNA, 310 bp, Homo sapiens
acctggcagccactcccagagctcctggaactctggcccaaggctctctgactgactccttctcggcttaccggctgaagactgatgctgccccatcgcctcagaagccccgtagaccatcacagacgccgagctttaggtaactcacagtggagggtaagcccgtccccttcttaatcaatatggaggctacccactccacattaccttcttttcaagggtctgtttcccttgcctccataactgttgtgggtattgacagccaggcttctaaacctcttaaaactccccccactctggtgccaactta

SEQ ID NO: 129957 - DNA, 674 bp, Homo sapiens
gacaagggtggaaaaaagactagatttaagcagtaaaagatcattaagcgaggcttcatcacttcttcagtaggacagttattattgggattcaaagaggggcttatcaatgaatactatgttgtccttccccttctaaatttgaaatcaactgagaagtagataagaagattgaaacattttttttttaatagccttattggtaaggctcaatggagaatatgccatagatctgttcccaagtgagcttgctaaaatcctccctcccaattaaacttaacaggatgatggacatctggaacttccaccccacccctgactccacccgccccactgcgggttgcttagtacaggacctgtagacaaaggctggcatcccacacgctatgcttaatcctgctggtgcttcagctctcttggagagcttgggaggggctgggccacgggtgactagtttcttctagttgtcagagggttgaggaatgaggtctagaacattatggctgcagactttactttcttaggaagatttgaggctgccaaatagtggccttccactaccagtatgcttgtatggtgctttttcctaccctttctagaagattgaaccatgagcttaaattacatattttagaccaaagagaattacagatttctgtccttaaaaactcata

SEQ ID NO: 129958 - DNA, 146 bp, Homo sapiens
atgtttttcctctgttaggagcttattggtatgcctctactgtacttacacaatcaatgggaaaacaatctacttgaaaagcttacaagccacatctttaaaccaataaggagctctcacctctctgatttacatcctgctgaaag

SEQ ID NO: 129959 - DNA, 520 bp, Homo sapiens
ggcagctgagcggatgtggggggtggccggcggcgctcaggaatgcggccctccccctctcccagccgacagcctctttggctcagaaacacagcgccccaccctggctggccgccctcagcccaggcctgatggatcggactccaaccagggctttcgctgggccctgctgccctggacctgccctgctctgtaaccgtgaggagtgaggacacagaggaggggtactgagtctgggcctaggcccctgccctgaggtggaagtggagaggtagagcgggagcaggagtgggtcaggctgggggaagcaggccacagcccgcagcctgagagcctaccctggactcagagctgggcagacacgccccaagagtcccatctctggaaagccccgtgggtctctctgttaattaaatacatttgtttggtaaaagcaactaaaaatacttgcagcatcgtgagctgcggagaagagctggctaattaacgcctggtttgtttgggatctggaatacatttc

SEQ ID NO: 129960 - DNA, 678 bp, Homo sapiens
aaagaaaaagaaaagcatcactgtgctgtcaaaacttaatttttaagtattacttatggttctgtatttatcctgcaatatttttagctcttagaaaaaaagtggtagctgggacatttgttgcacttgggaggctgaggcaggaggatcacttgaggccagggtttgaaatcatcatagggggaccccatctccttaaaaaaatttttttaagtagatggatgtggtggtacatgcctgtgtcaggattgtctaagtcttagctacttgggaggatgaggtaggaggatcacttgagcccagaagtttgagactacagtgagctatgatccagcctgggtgacaaagtgagactctgtctcttaagaaaaaaaaaaaaaaaaaaagtgaatgctgcctgaaggttgaaaacacctactgtcgagaaaacactcacacctgagcagtccatttcttccacgggaagtccagttctgaacaacgtgcctgttgttcaactatctgcccgagagtaactgcacatatttgaccgtagaagcaagcacctttcccaaagcgtcttcgcgcacaaccgctaggaaccttttcacaagacttgatccatcacccttggactcatatggctggacccgcgaagggctcattaccctgcaaacccgcggcactctttggccaacg

SEQ ID NO: 129961 - DNA, 207 bp, Homo sapiens
aaagactgtagcacaggagtttttaatctttcagactcttccataatgagcctccagcaatttgtcaagaacccttaagtttttcctattttgacactggttcctatggagattgctgctcttataagttgtgagaaatttaattgttttttacttttgatataaatacctctacatgagtaatacatctgtatatttgctgtattt

SEQ ID NO: 129962 - DNA, 321 bp, Homo sapiens
gaggctgaagcaggagaatcgcttgaacctcggaggcggaggttgcaatgagccgagatcgtgccactgcactgcagcctgggcaacgcagcaagactctgtctcaaaaaaaaaaaaaaaaatcgtaaagatggccttccagctttattttgctaagagtagtctttacgtggtccgtgtggttttgttaacacggcagtttcgatttactagactaaaactagcatataaagaagctaagaaggctggccaacgatcccacaaccagcataaggttctcagtgtggcagtctctgttgttcagagtccatgttttaattt

SEQ ID NO: 129963 - DNA, 356 bp, Homo sapiens
ttgccatggatgggagccgtgtaaccagggaatgccccagctagtggtcacactccaccagcaaactctgcccctggtgggaaggaacagacagcagcactcttcaaaatgactgcgtgggaactgggggtcatattcaagaagcccctttcagtgccagcctactccattcctcagaaagcaagctggtattgcaagagttaaatgtgatgcagtcccagttcctgaagcctacagttagaccagccccgcttcactagcgtgtcaggtggccttgttcctaacaggaatcgcaggcctttccctttgtgaccagaattctgtggcttacttctttgcctcaaagctgcactgag

SEQ ID NO: 129964 - DNA, 770 bp, Homo sapiens
ggagttggagatcagcctgactaacatggtgaaaccccatctctactaaaaatataaaaattagccaggcatggtggtgtcacctgtaatcccagctactcaggaggctgaggcaggagaatagcctgaacccaggaggcagagcttgcagtgagctgagattgccccactgcactccagcctgggctaaagagtgagactccatctcaaaaaaaaaagtgttctattaaaggtaatgagtagagcctattaatgattggaggcacatgataaaaaaggctaaactgctttgaagggaatacttggacacacagacattactgttgattctggtgaggactccgaaagtaatgaggagagctagagagaaagcttctactatcttagagaatacatatattatgaatagaatgttgctagattatgagctttgacagtttttctggtgatattttacctggtaatgaggaacacactatttgaaactggagggaaggctattcttgtcataaagtgtaagaaaactgagctgaattttttgcagccactgagtgaaagatgtaatttctaactgattaagttggatagttagctgaggagatttctaagtcaaatgtggaaggaacaacctagtttctcattgttactttattataattgtgacaggaaagagataaattaggatataaactattaagtaaaaatgaatgagcactgattattttgaaagttctcagtccatccaaataaaatgctctggaaattgggtc

SEQ ID NO: 129965 - DNA, 321 bp, Homo sapiens
aaaggcttcagccaatactggagggatgggacagggcaggataagagtctgcaaacatttggaaggctcaaataccctggagggatggaattaccttgcctagtagccaagtgttttaaggcatcaggcaaggccttgcccataattcactttctatctgtacatgaaagtcccaccaaggatgaaggatatggctgaacactggacctggtctggagtggagtggactctgagaatgtctgtctgctgacactacccttgttgcacttcctggggtagggacaataaaggagacccatgtgaccagagtctccacatcat

SEQ ID NO: 129966 - DNA, 318 bp, Homo sapiens
tgctgggattacaggcatgagcaaccgcgcctggccaggagtccttttcaatagctactaactatgggctaggctaagtgtccttcacctaagccccacctatataggctaggagatagcattcctgtaacagaaaaagaactggacttgaactctgaggacttaagctcaggatctgactggcacttactgaccttgaccaatcacaagctctctgagcctcagtctcttcatcaatacattgaagataatctcaaccttgattcccctcttttcaggattgttttgaataccaagtgagacaatggccaatgcatt

SEQ ID NO: 129967 - DNA, 740 bp, Homo sapiens
ggaaacccctgataaacctgtcagatcttgtgagacttactatcgcaacaatagcacaggaaagactggccccgtgattcagttacctcccgctgggtcccttccgtaacacatgggaattgaattctgggagatacaagtcaagttgagatttctgtggggacgcagccaaaccatatcacctggtttctctgtgttgcccaggctagtcttgaactcctgggctcaagcgatctgcatgcctcggtccatcaaaatattggaattacaggcttgagccactgtgcccggcctctgctgaccttttaaataaagctttggcaagtgacagtttgaggttaggaaccattgataattgatgaattaccggataagtctttatttcttccttctacatctgataataaatccgatgatttccattttcatgtcattgcgcctctactgttaacatataattatttatactttctatttttttttttttaactcttccactttctctttttgtggtggggtacttaccctagcaataaacacattgttgtcttagatgctgcattggatagcagatacgtggatatagtattagactagagaatgcttaagaattctgcattccaaaagcatactaaagcctctgtttctagtgcttaagcaacagtgtccttgatatcagtctaagaaagtctggatattgacatgcaaatgaaaaaatcagactctttgaattttgtttg

SEQ ID NO: 129968 - DNA, 434 bp, Homo sapiens
atttttttttctttgaggcaggatcttatttgtaagccaggctggaatgcagtcttatgatcactgctcactgcagccttgacctcctgggcttaagcaatcatcccacctcagcctcccgagtagctgggactacaggtgcataccaccacgtccagctaatttattatttgttgtagagatagggtctcactatgtttcccaggctggtcttgaactcctggactcaagtgatcctcctgccttggcctcccagagtgctggggttacaggtgtgagccactgtgcctggcccatggctcagatttaaaagatgtaaaaggtgtatagtgaaaagccacccacttcctgtactagctaccatattctctctttacaggcaactggtattcctccttccagagataactctgttaatatatatatatatacac

SEQ ID NO: 129969 - DNA, 570 bp, Homo sapiens
agaaagttaaataaactgataacgatagaaaaaaggcttatatcagaaatataaagaaatttccatttttttaatactatacaatcataaaaaaagaatgaaatcatgtcttgtgcagcaacgtggatgcagctggaggtcatcatcctaagcaaactaatgcagaaacagaaaactaaatactgcattttctcgcttataagtgagagctaaatattgggtatacctggacataaagataggaacaaaagacgctggggactactagagggggaagacagggaggaaagcaacggctgataaaccacccattgggttctatgctcactatctgggtgatgggttcaatcacaccctaaacctcagcatcatgcaatatatacctttgtaacaaacctgcaaatgtactccgattttaaaataaaaagtgaaaaaagaaaaaggaaatacaaaaaaattcaaattaaaaaaaaggattaatttattatatataccccacatatgtgaacacaaaagggtctggaaggacacaagtcaaattgctcattgttagccctgacaaaacatgga

SEQ ID NO: 129970 - DNA, 242 bp, Homo sapiens
ctaggacacctaatcagtaaaggcaaacggaaaatagtacctgaacgaattgaaggtgtcacatctctacctttgcctgaaacaaagcaggaacttagaaaattcttgggattagttggatactgtcgtctatggattgactcttatgcctgaaaaacaaaatctctacataaaaaactcacccaagaaggaccagacccccttctttggaccctatcagaagtccaacaagtagaagagtt

SEQ ID NO: 129971 - DNA, 180 bp, Homo sapiens
agctttatagaaaagtttgctgacctctgttctgtatcaaattttaggcagtttaaaaggaaatctattggaatttcatataatatatagattaatttgaggagaaataattattcaatattgagtaatcatcaaagaacaaacgcagtgtctttcttcaattttttttttttttttttt

SEQ ID NO: 129972 - DNA, 594 bp, Homo sapiens
tggccactagaatgtgaatccagggtaggttccgcagtagggagcccaggtcgttctatgtctgttctggacatcagtggggtgtctggcagtttagtgtgggctcactgagaagctttgcaaggaccacatggcagcaagatgcgctcgagagacagagaggcaaggagggagggaaacagacacagacagagtgcgcctgtgagacagagagaggtggagaccgtgaggccgtgagagccagccccaagagtactcgctcccctgtgccttccagctcgccctggcacacccctctcatctcccagccaagccaggtgctaccctgttctcctccgtgtgctcttgcctggaactctcgctctgcctccctgcctcacctgtaacctccacaagcacctcctgaatccctcagagctgtctctgcagccacatgttcacccatgtcatggacccaccgagcactttgagttacttatgaccttggttacttctccctggccttgactatagttgatgcaggtgccttgtcgtgtgtgtgtgtgtgtgtgtgcgtatgtgcgtggtaaaacacataatatcaaacttaaccat

SEQ ID NO: 129973 - DNA, 177 bp, Homo sapiens
tgctgggattacaggcatgagccaccccacctggccctgataattatttgtgattcctttctttcgttgcaccttttgcatacattcaatcaggtatcaggttctggcaagtctacctcttccagttcctcaaatcagcccttcctctcattctctcactttggggaaagcctggat

SEQ ID NO: 129974 - DNA, 700 bp, Homo sapiens
tctgctgttgttaggtggagtattctgtagagtttatagtgttcaagtcttctatttccttgatcttctatctatactatccattactgaatgtgaagtattaaggtttctaactattatttttgaattatattctgcctttcaattctgtcagtttctacttcatatattttggggttctcttattaggtgtacacatgtttataagtggcatgtaattttgatggattgacctttttattgttacaaaacattctctgtagtagcaattttttgtcttaatgtctgttgtttctgctgtgagaatagctgcatcaactctcttttggttactttctgcatggtataactttttttatcttttactttcagtttatttgtatctatttaatctcaagtgtgtctcttgtagccagttatagttggattatgttttttaccccttctgcctatgtgctttttgtttggagtgcctgattaatttccatttaatataattaccaataaagtggaatttacatctgctattttgctctttgttttctatgtgtctcattgttttttggggtggttattcctctagtcctgtagtgctgccttttgtgttaaatagatattttcaagtgtatcacttaaatcacttgttttgtactgtatacttttagttcatttttgtagtggttgccctgggaattataat

SEQ ID NO: 129975 - DNA, 814 bp, Homo sapiens
caagcaacagttttgactcttagcttcttgaacacttattgtctttaaagaaaagtaataccagcttggcattaggtttgaaagagttttcacatagggagtggtgagggatagagtaggtcccagcagcgtccctttaacactcactcacataccatgtttctgaaagttatatattttggcatttcttgttagaacttgcagacatgctgggcgcagtggctcatgcctgtaatccccagcactttgggaggctgaggtgggtggatcacctgtgggtcaggagttctaaaccagcctcaccaacatggcgaaaacccatctctactaaaaatataaaaaatagccaggcgtggtggtgcatgcctgtaatctcagctacttgggaagctgaggcaggagaatcgcttgaacccaggaggcagaggttgcagggagccaagatagcaccatggcactccagcctgggagacagagcgagactccgtctcaaaaaaaaaaaaaaaaaaaaaaaaaaaaattgggggggggccggggcccggaaaagttttaaaccctccggtgtggggcgcgcggggggccccagagaagggtggtatcttggacacgttgggcccaaaaggggggtccccataagagagaaacccggggaggaagagcaaagtgcgcgtggggtttcccacccgaatataaaaaaaaccccggggggggaccacccgagggggtcctgagaaacaatccccagatgggggtcagaggggaaaaacggggcttacccacagggggctcaacgggaggccgaatttaaattacg

SEQ ID NO: 129976 - DNA, 520 bp, Homo sapiens
attctaatataaaaagaaagtataaaatagtttaaaccaaaacaaaaagaaaactttccaaatcttcaaatagatgtaaatatacaggtataagaacatcagagaacaccaaatagtttcaacccaagtaagattatccccagggcatataatagttaaactctcaatgttcaaaggcaaagagaggatagtaaaagcagcaaaagaaaataagtaatttggtcaggtttggtggctcatgcctgtaatcctggcactttgggaggccaagaagggtggatcacttgaagtcaggaatttgagaccagcctggccaacatggtgaaaccctgattctgctaaaaatacaaaaagtagctaggagtggtggtccccagttacttgggaggctgaggcatgaaaatcacctgaactcaggaggcagaggttgcagtgagctgagattgcactgctgcactccagcctgggcaacagagtaagactttgtctcaaaaaaaaaaaaaaaaaaaaaaaaaaaaaa

SEQ ID NO: 129977 - DNA, 689 bp, Homo sapiens
gaatccccttctttttcagatgaagaaattgaggcccagggacattaaatgacttacccgaagtcaggcagcagctcagtgctagcagagctaagactggaagctattctagaactgtgttttatttattcattcagtttctccaatttaaagcctggctaaggagataggactaatacacccagaaataattaacaggaggaggcatgtaattagaagcttaaatttcaagagtggaaatgggccttagaggctatctattatgacttcctacacaaacaaacatctctccatacccctgaccattgagtgcttagcatttgacttgaaacccacctctagtcctaattttgttccttggagctatacaggatatatctacatcttctgctgtgcacagtcctccaagaatttcaaaatagctcttttgaacctatagaacatcatatccaagctaaaaactccaaacttctttaagtctttcacattatacatgattttgagcaatagtcattataaacctggttgtctcccttcgatggattacagaaacggcttccaatgaatgatacctcccggtattcctgtccttgtgtagtcccctcccatcctgaaggtaggttctttgacctacatagaatgtgacagaggtgactctttgctagttctgatcttcagcctcaagaagg

SEQ ID NO: 129978 - DNA, 332 bp, Homo sapiens
ttcttcaacaaagattctgaggagaaaagcagcaatttgagtctcattcctccttgccactctgaaggatgtggcaacatgcagtgaaatcctcaaagacggacattaaagactggggggagaaagagaagctcaaagcttatatgatcagctatgaaaacttgaaaggatgcttgtgtgagaacaagcacttcaaaataattctgtcaactacagaaaagtaccttttcacccaaaatattttaaactttgtacatttttttaataaaaattaacaaaacatagcacaataggatgcccagattagttcaacctttgctgaagcatcatct

SEQ ID NO: 129979 - DNA, 801 bp, Homo sapiens
gtttttggtctcgtgtatgtagattcacttaatctgcattgtaaggaaactagccttttgtcatatgtcttgaaaactttttattgatttgttatttgtattttgaccatatggtatgtttttctgtttagaaatttttatgtagtcagatttatcattttcttttatgactttgagtcataaaagtgaaaaaagtcattgagttttatgtaatccttagaaaatccttcttgaggatcataaaaattttcccccatgtttactcctagtaagtacttttatactttttatgatttcattttaacatttaattatttgatttatttgcagtttgttttgttctagagagtgaagtagtgaaataattttatatttcaagattatttcccatttgttccaataccttttattttgaattatccttcttaaccactttgaagtaccatttttgtcatattcttgtagtatgggtgaaatatttcctctgcttttccatttatctgtcagttcacacagaagtatcagactgttgtgctataatttttaaatactagctaaacggcttttccataaatatttttcttggctatcttatgtgtgtataattttctacttcatcttaaaattttttttatcttgtcccctctccctctgttggagttttagtaggttgcattacatttatggattaattttggggagaattgaaatacattcggtgttgatattgtgtatttttccataaacacgtggtttttattaacatgtatttaaaaaaaatttagcatataattaggtgaa

SEQ ID NO: 129980 - DNA, 750 bp, Homo sapiens
cgtggtggtacgtgcctgtggtcccagctagttgggaggctgaggtggcaggatcacttgagcccagaagatgaggctgcagtgagccaagactgcaccactatactttagcctgggtgaaagagcaagaccctgtctccaaaatataaatacataaatataaaagttttttaaaaaaattttaaaaatagccagcatggtggtgtgcacctgtagtctcagctacctggggggctgaagtgggaggactgcttaagcccaggaggtcaagggtatagtgagccataatcatgccactgcactccagcctgagcgacagagtaagactctgtctcaaaagaaacaaacaaacaaacaaacaaacaaaaaaacttgccaggcatggtggctcatgcctgtaatcccagcacttgtgggaggtccaggcaggaggatgtgcttcaggccccaagtttgagaccagcctggacaaaagtgagaccatggtttttggttctcagatttttacaaaagaaaataactacacataaaacaaagccaattaatggacaataggtaacatgctccttttcagaaatgtttttataacatggcaaatcctttaagtttacaataatatagcactaaaatagcatgttttctaaacactattccatgcagttatttatcagtggtccacatatacccatcacttcatttaaaaggatttgagagagtttgcaaatcactaaaaaaaaaaaaaaaaaaaaa

SEQ ID NO: 129981 - DNA, 249 bp, Homo sapiens
agggaaggggagtggggatcaatgctgtcttgcagcctgtttctggctacttttcatcaacatctcgctgagccctagagtaacccacaaggcaggttgtagcagcctcgtctttttttttgttgttgagatggagtctcgctctgtcaccaggctggagtgcagtggcgcgatcttggcccactgcaacctccatctcctgggtttaagcgattctcctgcctcagcctcctgagtagctgggattac

SEQ ID NO: 129982 - DNA, 701 bp, Homo sapiens
caatatagtgaagagagtaaattcttttttttaggtctccattactaacaacatatacatgtatgtttttaatgtacttaagggtatttcaaattcattttactgtttaaataatacctgtttgtcaatgctctcatttttagaaaacttggtaatgtcaaaaatgtacagaaaaattgatgcaaaagacttcaggatgcattgaactattgataccaccaatgcagcaaaaggacactgaagtggtggccaagagccctgggtttccatcctggctggcccagaggctaggccagtgatttggacaaactcctttactctcttagcttgagtttcctcttctgaataatgaaactgggaaagtttgaactagctgatctttaagggtcttttctgctctgatgtaaaatagaattctatttttgacatttcatcagcacttgtgtttgcactctttgtttccttggcaaatacctatcttggatgtagaaagtttcttccagtcctcagcagagtcatcattattctaaatgaactcagcctaaattcatggtaatcatgatatatgtatgaattcactcattcattcattcattcaataattgagttgcctaccctttatcaggcattatactaattattagaatacaggatgattaagaaaatgtttttgcaatcaagaaattcccagcttagtgggg

SEQ ID NO: 129983 - DNA, 339 bp, Homo sapiens
gtagctgggattataggcgcccaccaccacaccccgctaattttttgtatttttagtagagacagggtttcaccatgttggccaggctggtctcgaactcctgacctcaagtgatccacctgcctcggcctcccaaagtgctgggattacaggtgtgagccactgcggtcagactacattacattctaatatagttatagtcacaggtaccaaggatcttcaacatgtctttggggggaaaaccattcaacccacaacaaaagctaaagaagaaaaatcacatgattgtatcaatcaatatagaaaatttgacaaaattaaacaccttttcatgataaa

SEQ ID NO: 129984 - DNA, 441 bp, Homo sapiens
atcaaggggtagttttgacttacatgtctcattatttaagaaataaggttatagctacccaaatagtgattaactctgatagatctgggcaaaataaattgaaaaccttccagagaaaggattcaccattctagatgccatagaacattcgtgattcacaggaagaggtcaaaatatcaacatgaacaagagcttggaagaagttgattttaaccctcatggatgactttgagaggttcaagacttcaatggagaaagtaactacagatgtggtggaaatcacaagagacctagatttagaagtggagcctgaagatgtgaccgaattgctgccatctcagataaaacttgaatggataaggagttgcttcttatggataagcaaagaaagtggttttatggaatggaatccactcctggtgaagatgctgtgaacattgt

SEQ ID NO: 129985 - DNA, 324 bp, Homo sapiens
aggtgattcaggcttgagcaggtgtgcagaatccaccctgaatctcaaagggcagtaagtgtgatgttaatcacctgtggattccttcttactgtggctcttgttgagacttcagaaaaccatactggataggcccctaacacatgtcacatgtcatggcagtacactgagctgtgacgatgagcctgcatagacacagccattaccttcatgaggtttatagtcaaacaggagagatgacactaatcatcacacaaagaaaatgtaaaattgcaactgcagtcagtgctgtaaaggagtggttcttagttctatgagaacaca

SEQ ID NO: 129986 - DNA, 583 bp, Homo sapiens
acgatttatgaatcagacatgaggtttggcacacagataaatgtgatttcagacagcatccttctcactaacttgctgccttcttggaataagaatttccaagatgtctcaggaggtaccaagggagcagcaacaaggcctaatgatcacttcttcaagaatttatcccaagaaatgcattgtatcttaagttggggaacacttttacctactcaaaaatcttttgaggtattcagataaatccatgatctgagttttatgttaatagttttacagtgtcatagtgtggtaattaagtgtagaattttaacctctgaggctgggcgcagtggctcacgcctgtaatcttagcattttggaaggctgaggcagaagaattgcttgagaccagcccaggcaacatggcgaaaccttgtctctacagaaaaatacaaaaattagctgagtgtggtggatcatgcctatagtcacagctactggggatgctgaggtgggagggtagtttaagcaagggagtttgaggtggcagtgagcctagttggcactattgtactccagcctgggtgacagaagaccctatctc

SEQ ID NO: 129987 - DNA, 334 bp, Homo sapiens
cactaaaaatacaaaaattacccgggcgtggtggaaggtgcctgtaatcccagctacttgggaggctgaggcaggagaatttcttgaaccctggaggcggaggttgtagtgagccaagattacaccaatgcactccaggctgcgtgacagagcaagactccatctcaaagaacaaaaaaagaaacattaagagaataaaaaagccacactacagactgggagaaaatatctgcaacacaaagaacttttatctagaatatataaagaacttctataactcaatttaaaaaaataatccagggactttttccatcataagtccattgggagcctg

SEQ ID NO: 129988 - DNA, 359 bp, Homo sapiens
tgcttacagtcaatcaaccagagaggaataaaggaggaattttctaagggtactggggagtttcccgtgacctcaggcgtgaaaaagacatttaccgaagatggaaaataggatgctactctcttccagttactatccgatttggcatcctatgttccactcttcaggtaaatgtctttttcactgccgcggatactatactacatcagataccattactctcatgactattcattggaacagagaacaggaagctcacgaaccgcagataacaaagggaactgaggacaggcacgcgtgacttatgtctgcaaatcccagtgcattggagacggcaaggccgggtcggactcccctgg

SEQ ID NO: 129989 - DNA, 376 bp, Homo sapiens
tcagcctcccgagtagctgggactacaggcgcccaccaccacgcctggctaattttgttttttgtatttttagtagagacggggtttcaccgtgttagccaggatggtctcgatctcctgaccctgtgatccgcccgccttggcttcccaaagtgctgggattataggcgtgagccaccgtgccccacctgggtttttatttttaatagagtagctccttaatttgaaacctgcttcccctctaatccccaacccagaaagaagaagggttgtgtatggtccataaacaaacttctcaactattaagtcaggtgtttgctttgtactctttggtatttttgtaggtctttatgttttctgtcagatcctctcacta

SEQ ID NO: 129990 - DNA, 398 bp, Homo sapiens
tcgagccttaccgaaagtgtgtagtcacgttactgaaatcacaagttgcaagagacaaggagcaggtaggggaacagcgagtgatgccttcttctggcgctcagtaaactggcatttgacataagatgaacatagagcagctacctgtggggatatgtcacttttcgtctgtagctctccgcttagggacaaaaggaaaggcggcttcttgcatgactcagctctcagcttaatttttttcttttggcacagtgaatcggggtcctgagtatttctctttccctttcagcccgcttttccctttaaatgttgaagccctcaaaatcacatttggatgatttggagaaaggcacagacctgtttctgaggcattgtccttaactgtggcactttttttt

SEQ ID NO: 129991 - DNA, 191 bp, Homo sapiens
attcagccctgactgccacttgtccctctgacctagccataaaatactaatatttgcagctccctcttatatggtgaggaataataaaacattatagcactttgggctttgtttcatttcttcccattgatagcttttttcctgccactgtcagcatagctatttcccagcatgtttttccctccagttct

SEQ ID NO: 129992 - DNA, 219 bp, Homo sapiens
tgtttagcactgaggcattgcaaccactgttgctcagcatggtcctccaggactccaaacatcatgatcctcaagaatctaattttaattctcaatgtttcctgtaagtcacagcccttttgctcaggcagaatagattttctactgacatcaaatggtctgacctataatacaatatcaagataccttggctattgtgggtggacaatttcttctata

SEQ ID NO: 129993 - DNA, 272 bp, Homo sapiens
aagcaactagagctaagatttgaatggaggcagtctggctcctgagttcaggcttctgacactgcctgtgtaatcatgagactacatctgaccatgctcatgacaccaaatccatagtcttccaaacgggggatcagagccaaccacagcacctccttctctctcactggtccacccagttgacaaatactgttaatgctctctgatctctctctctgtctctctggcctggctccctctcttcaggtttggctccttcctcatcttcttct

SEQ ID NO: 129994 - DNA, 845 bp, Homo sapiens
agtaaaaaaacaagggtttttataatagacaaatatggttttgaacttggttttgccacttattagatgtgaacctttgggcatgttaatgttgtttacgttcttagatcttcagtttccttctctataaactgggagagatgtctatttaatccatagggttggaatgaagatgaagggaaaatgcctgtgtagcctcacgcccatagtacggaaatcaactgctatttctctttcagtaagagaaactgggtttggaatttatagtcattgttgactttaaatcacacattttgtgtaatatattacttaggaaagaccagaagtatgtacaccatttttttttttttaaatctcttggtgatgtaattacagatgattattttctttgtacttttgggtacattccattctttttttcacaaagaacatgcattatttttgtaatctaagagttatgaaataaatgtaaaattgagtgtcagtttatgtgcacctattcattggaatttaagactctccattctcagattctgactctaaatttacaaggcacatactaaaaccataagcaatttcaatccagttattctatcatgaatttatagttttatgtctttgtctcatactgattataaatggcccacttaatcttatgaatgtttaaaacaggtaatagattcacatgattccaaaacgtttttcaaaaacatattgagaagaagtattgtcccatctgttcttcagtatggccagtttccactgacctctctttctctattactgctccccaccagattggggtaacctctttatgcaaaaataaacaaatatgaatatatact

SEQ ID NO: 129995 - DNA, 930 bp, Homo sapiens
tccccacgagtcgtccccctttaggaagtttttgggggtcagatctcacccccccttgcccacacaggttgggaagaagactttgggccgacgcccctcacttctcccccagacccaattgcagggactttagtcctctggagtgctgcgtgtgagttaccttgtgtgtctgtgtgcgtgcctagaggtcaagtgtaactggtgttcgtgagcacctcgtggttgcgggtctctaactctcgtgggtctctaagcgcacccgcggggctggagcggaggttcgtgtctctgggagggtcagtggtgtgactgaagctgggagttagctcgtgtctgtgggtgcctcggtgtgtgtctctggggctctgagtccctgtgcgtgcgtgtgtgtctgtgaacccgacaggaagctccccgagggcaggaatatgttttgctctctactcgatcccagcgactggcaacgagcgtttaataaatatctgttgaatgaataaatgtctgcgtgtgagagcgtctaccctccagagtggcctcggaggaaagggcccgagggcggccatccaaaaagacccccagacacggggtggggcgggggcgaacggcccgcgtcgctcccattcctcctagcgccccttcccccggtctccactccaaagtttccctggggctgaagaatccacccagagacgaagacttggcggagggggctggagactcggggacccggggcccgagacgggagtgcgggcagagggagggctcgggagcgacgacccagagccgtgaaacgaaaaagaaagcaggcaaagcagcacggagcgaaagagcgaaaagctccctaccaagccaggctttgttccctgaacctaagactttacccggcggctggcggcgggcgggccgggagcgagcgagcggaggcgcgcg

SEQ ID NO: 129996 - DNA, 247 bp, Homo sapiens
ccagcatggcaccgtaatatgtactaacctgcacattgtgcagaagtaccctaaaacttaaagtataaaaaaattatggaaattattttccaaaatgaaatttattggtataattgctcaaattttcatctgtttaatatacagtgaagtcatcattttcttttctcatctattttcttggtttactttccagttctaataattatagcttgccttctgttacatcattttaaaaatatttaataac

SEQ ID NO: 129997 - DNA, 315 bp, Homo sapiens
tccctccggggctcgctccccacgtgcactgcccaagtcccatgctccacctgccaagtcctctctcgagtccttctggtgcccccagccttgccacctgcagctggctgacctcacaggccttcagggtctccctgaccctcctcctcctagccacccctgcagggccaccagaaggcaccacctatagcaagcatcagccacacctcacccctgcagagagataaaacagcagtaacaggaacctgcctgtggcggcccactgcccagaacccccacacccagggggtgccttgcccggcccctggccgtctc

SEQ ID NO: 129998 - DNA, 463 bp, Homo sapiens
gggtgagagtggcctccagggcttctgccacagattccagagcctggattcaggattcagaacccacccagtcacccccggtctgtgccctggtgggctcccatgcactcagtcctcagtttccccatccggcagcaggtgggtctgtggcgacttgcaagtgagcccagtgtgagccgcatccccacacactgcccggcccccacccctcgggctccatggcagctctttccaggcgcctgctcttccagtctccagagaagaaaggcctggggagcgggcggagagtgtctatgctaggatcagggtcagagagggaggagctggccgtcaggtgggccaggaagcctcagtcccatgccccggccctccagcccgatgcccacccagtcctgccctccagcccgatgcccacccagtcctgccctccagccccatgtccacccagtcctgccctccagcc

SEQ ID NO: 129999 - DNA, 527 bp, Homo sapiens
tttttgtggagtcttttatgatagtttttatcaagcgtgcaagcatgagaaccctctcttcacagcctcctccagctctatttgtcagggttttttgtttgtttgtttaacattagtgattccattttgactttgacaacttttacactatatagctgttctaaaatttcattttgcaaaatgaatactgatatggtttggctgtgtgccaatcacatctcaaattgcagctcccataattcccatgtgtcatgggagggaaccagtgggaggtaactgaatcatgggggcaggtctttcccatgctgttcttgtactattaaataagtcccacaagatctaatggttttataaaggggagttcccctgcactagctgtcttgtttgccgccaagtaatacatgtcttgcttcaccttcaccttccaccatgattgtgaggcctccccagccatgtggaactgtgggtccattaaacctctttcctttataaatgaccagtctcgggtatgtctttattagcagcat

SEQ ID NO: 130000 - DNA, 394 bp, Homo sapiens
ggcactgtagaaatgcttgaaagaatttgaatcctctgctctgaatgtttaggtcaagagtccaaatcaattcaatcagaaggtagtgtatcctctgtggccatgttcaactgttacgcaagtaccacagatgacacagaacatttctgatagtcacagtccactaaattgataaatgggatctaattaaactaaagaacttaggcacagcaaaaagaaactatcatcagagcaaacagcaacctaaagaatgggaaaaatggggtcgggcatggtggctcaagcctgtaatcccagcactttgggaggccaaggcgtgtggatcacgaagtcaggagatcgagaccagcctggctaacacagtgaaaccccgtctctactaaaaatacaaaaa

SEQ ID NO: 130001 - DNA, 131 bp, Homo sapiens
atttagcaggctgctcctcctcaccttgtcccccgtctttcatgaagccagggcgttctagaaacgtagaggaaaaactggaatgacgttctatgatgaggtcaaacccatctgcccaatttcacacacag

SEQ ID NO: 130002 - DNA, 412 bp, Homo sapiens
gtaaaaccccatctctactaaaaatacaaaaattagctgagcgtggtggtgggcacctgtaatcccagctacttgggaggctaaggcaggagaattgcttgaatccaggaggtggaggctgcagtgagccaagatcacgccactgcactccagcttgggtggcagagtgagactttcccccccccaaaaaaaagattacagttagatgagaagcgtaactggttttctgttgtacagtagggtgactatgactaataataatgtatatttcaaggtagctagaagattttgaatgttatcaccacaaagaaatgatagatgtgactggtgtggtggcttatgcctgtaatcttaacactttgggaggccgaggcaggaagatcacttgggcctagaagtttgagaccaacct

SEQ ID NO: 130003 - DNA, 565 bp, Homo sapiens
aaaaaatcacagggcggtatgggaggctgaagcaagagaatcgcttgggcccgggaggcggaggttgcagtcagctgaggtcatgccactgcactccagcctgggcgacagagcgagactctgtcttgaaaaaataatagtaatttaaaggtttatatggacattattgtgtgaagattagtttttacttctctgagttaaattcccaggaatgcaatactgggtcatattgcattagtgtgctgaattttataagaaaatgtcaaattgtttcctagagtggttttaccattttacattaccactaacaatgtgtatcagttatccagttctctgtatccttgttggcatttagtgttctcactgcttttttattttagctattgtaatagacatatagtgtatcctattgtcacttaaaaacacttttatttcttctagactttaggttgtttataacaattttcattttaatttgcattttcctatgatattgaacatctttttatgtgtttatttgccatttgtatatattattctgtgaaatatttcttctctgttcttc

SEQ ID NO: 130004 - DNA, 202 bp, Homo sapiens
tggctggtacccttatgttctgaccaccagaatgttggctctgccgtgctccgaccaaaggaagcaagcagccctcttcagggcacagtgccaggcagcaccccctccctgccctggccctaacccacagcttgagggggatcctaaaagcaacagctctgaaagacacttggggccactgcaactccgcaccaagcagagt

SEQ ID NO: 130005 - DNA, 557 bp, Homo sapiens
tagatatgtctgccccattttcctctcatattttttgtctctggccctaaatctctttctggtcttgatcatcgcaaacttcattctcccattaatgaaacttgagctatgagagagagattatggataaaaagaagcaaagacagcattagtgtattagaagagctggtggcaaaaggaaaagtgcaggtgagggggaaagcaaaaggtagggaaatttaaggattagagagaaggatatctcgaccttgaagagtcagggtaggggaaagaaagtaatctggataaggaaagaaataaagccagttttaatgtatcccaaaagtctcaagacagattaagacttattaaaataaaccacaatagcagcttttattctcttccacccactttaacctcaaaaacaagttccttggagatttcggttattggattagtcattatcctagacactactcgtattataattcttgacaatttcaataactatgtagacaatccttccaagttcttcacccccatgccttgaccctttttcaatcttaagccccttcctc

SEQ ID NO: 130006 - DNA, 328 bp, Homo sapiens
ccttgctgtcaggaaacattaagtttcctaagtgacatcctttttctgcatgtttacttatggttatgtaaatcaagcgggcctccccattggaaatgatggcagtggttacaagggacttcacctggtcttttgtagttgtggcaaatagataagatacaaatgtgacctgcaattcagttcagcattatgaagctgtatctgctccctgggtggtggtcacagccctgctttgtggccctaacccttgccttcctgctggcgggccttgcacaggtgcagagagggggttagtattggcaagctaattggataaatggtgaagttt

SEQ ID NO: 130007 - DNA, 379 bp, Homo sapiens
attctgaaatccacacactctttctcttccgattgaggcaagaccctgaatggcagaaggctctaaaggcagcccttggtgaagctaatgagctgtgggagggcaggtgatgggggctgtgatgggaggtgtgctttcaggatgcacagacgttacttcaataaataatgagctcaatatccgtgggcgagttggtatttaggctcctttccgtgtgtttttggatggatgattaatgcagctgtaaaagagaagccgtgagctgtgtgtgggcagatgcagactgaaatgaaggccccgagcaaagttccatcgtgggacatgggggtccaatgtgtaaccccctccccggaaggacacagcacctactctgtgcggg

SEQ ID NO: 130008 - DNA, 694 bp, Homo sapiens
tacaaacatacagttagatagaaggaataagtttcagtgtttgcagagtaaggggactgtagttaacaacaatatactgtatatttcaggatagcaaaagagaggacttgaaatgttcgcagcacatagaaatgataagtaatcgaggcgataggtaccctaaataccctgacttgatcgttacacgttctctgtatgtaacaaaatatcatgtactgcctaaatatatataaataatatgtattggtagaaaaactgcttttcttaatgtgactttttaaaaagcaccgtatttagaaggtaaattccctataattagtgacaaattatatgtggtatcatgatttgagtggtaaaagttttgaagtttttgtgtttttgtttttgtttccgagacaagatcttgctctgttaccaggctggagctggagtgcagtggcgcaatcactgtagcctcaaacccctgggctcaagctatagttttgaagtttttgtcttcttttttgagcataaattcaaagaaatagttgtgagctgtttgcacccactatggtgttttaagaacagaacatcatcattccctcagagttaaccactttcccgagttttgctttttcttttgccattacttttatttttagagctccatgtattttgtattcctgaaaacaaaaacagcttttgtactttatat

SEQ ID NO: 130009 - DNA, 728 bp, Homo sapiens
tatctcagagagtttcacttaatctaagtgtcattattcaatatcaaagcaggaaaatgtcatctgatatcctcccacttatgaaagttttaatcatccctcatcagaactaaacttctttctcattctggttatgctattaaactttcttcagatattgatgtaaaattctaaccatgcccaactttttttttattatactaattatactgtctttagatgcctacagccatttaactgccatggacttagaaaagccaaactcctgggttatatctgtgaaattacagagtcctatagataaacccaactgtttttggaaaaatatcaattgttttcttcctcatagacaataatctcgtaaaagatttctaatcatgggacagttaatcacggggacagtttctggttgtttcctcagagttatgttggctcattacagaacagacactccttacctgcagaatttgtacattgtggggagtaatttatcccaaaccagttcagacactaggactaaaatgttaatagtaccatttggagaatgctcagtacttgctaaacactttatattaatatttcctttaacctcatcatagcatccctattaggtagattattattcagattttacacacagtgcatttgtacatagagcttgcccaacaccacacaggtagtagtctgatctcaaattaagccctagaagccacagtgggagagtacca

SEQ ID NO: 130010 - DNA, 1016 bp, Homo sapiens
aaaacaatagtcagcctgactgtacaatcccttcattggcagtggatagctctggtgttttatttatgttgatcacactgtcaatgctatatggaataaccatttagttgcctctctattagtccataacatttttattactgtaattaaatgtcattatccatattgaactctgtattagaaaaatcaaattaggtaaactgaaatatccagaaagaactacagaactgttgggattcacccccagcaccctgacgtcatcttcagactttgatgagaaggaaaaaaaaaaaaaaccatgagtattcacttctcacagatagaggtcactaatggactgaatttgaatcactgtagcagaaatcacaaagttattaaagtaatctagtgaaaaaggaactcgaattgaaattaaagatatcaaaagatgattatccagaaaagtctgacctgaatacaaatattacatcaccttgaccttttttgaatcttctaaacagagagcaaaaccaaaagccgctcggcacccttgctgttttttaacttcagacgcttcagatcccagaagcaggaattcttccttgtaaagtacaaagctcaagagtcaaactagatcagatgttcacactgggtctctacagaataaagcttctggacttgtacatacttgagcctttcttaaaaccacagcttcaaactgggaaaatataaagttgtctaaatcctaaatcaaactctccagcaggccagaatataaatgtaacgggcatcagagaaggttcaaattagatccagccggtcaaagtcaaactcgtatatgatcacatcatctgaaacctaacatacaggaaaagccaggactgctttggggactccagggtagcccagcatggtgtcatttgggaatctactttcttctgctaaaagcatcccctggaatttctaaaactgcaatgaaactactgaagtgttaagacatgggctttaaaacaacaacaacaacaacaaaaaaaaaa

SEQ ID NO: 130011 - DNA, 371 bp, Homo sapiens
tgggtctccagaggggatttatgtttccttctgttggatgtctttgggtgctaccaacctgggaatactgtatgttactatcctggcttggagcttcctagaccatgctggtggtataaattcaaaccccagatggtcataaagcttgattgctatgaactgaatgttcatcccctcccacacctccttcatatgttgaagtcctaatccccagtgtgatgattattggaggtggggcctttgggatgtaattaggtcttgagggtggaatcctcatgagtaggattagtgccctgacaagaagagacacagaaaggtctttttctccaccatatgagaatatagcaagaaggtaaccctctgcaaaccag

SEQ ID NO: 130012 - DNA, 233 bp, Homo sapiens
ttggcctccatagccagccctactgggtttacagaaaagggacaggcaggggtgaagccaggtcatggctgagtccatctcaacagatccagcttcacctgcaagtgaccacgcaggtgacttcctcatggtgacaaaaggagtcatggcagggtagagatatcataccatggcaggggaaagatatcatagaattttccatgagcacatttatgagacatcaagttacaact

SEQ ID NO: 130013 - DNA, 746 bp, Homo sapiens
agtctttagggtggggagacagtgagtttaggtatgtggtctgcctatggcagtgggttcctaagccacagatccttttaggcagtaccacttcagtggctccacctgtcactggatctgcttaatactgtttccttcttccccttctagcctaaaagagttaatggtttcctgctactgtcagcccctgggtgccttttcatcccttgaggttaccattgacactactcaaacaaaataatggtatgtttgtgtttttgttataaacaattttaaaaaatttaacagaaacctgcatttataaggaacactaaaaaggtccattttaaaataattgtttattaaactgtaacaaggtttctagcaattttagattgaatgtgatgctcctaaactgctttaatacatgccataattacaaattaaatttttgggtcagacttcattataactgtggtaatttaaaaaaatccacacttgaaatgagacaagtgtctgttgactaaagagaaaaaaaagacaaaaaaaaaaacttttgcggcggctggagcctaaaaaaatttctaagcacttctgtgggcgcgggcgccgtatggttatgtggaccttggccaacgtgtccaagagagaccggggcctcgccaggggtgggtttctccccaataaaaacgcgggggaacccggcttctgacatccagaggggtcgggccttgcggcctcaacggtccagcaccgttagcccggag

SEQ ID NO: 130014 - DNA, 268 bp, Homo sapiens
atataaaactcaacttcagtgtcgtaaacacaattctaaacccgagagaaaataatctggaacctaattccttctaaatttggcataagaaatttataacatttttcaaaagggcacaaccagaggtgcttttctaggtgagaatgcttgagctcatgttcacattggtctaacagcaccttctttgcagtgagatgctgttttcatacaactggaatcagccttcaaatccttcagtgaagaggctgggacggcaatctgccccttc

SEQ ID NO: 130015 - DNA, 717 bp, Homo sapiens
gtaaggcttaaactaagattacagcttttatattgtctgcctttagaagtcatatttggaatttattcagtttattctcctgccctttcccttttgttctgattctgtcacttacgttttcatttaaacatagtctttttatgaattaaaataagtatcagcagatggtatgcagtatagatgcttataaaataggaaaatgattgcagagacatttaaaatgactattgataaataatttatattgatattatttgttactcactttttaatttctggaattcaaatatttttaaatctcaaatagtttcacaacctggcatttatgaaagtgttgccccaatttattcatacttaccagggtggtaaaaatcattcaagaaatgttgagttacatataatctggaagcttctaagttttaagggcaacactcattgcacacttaatttcttctttcaacattgacctgtcacaattgttgttgtttcattaagtttataaaacatattaaaatacgtggagtaaaaattgttatgtctctaataataagtatttttgatttgcagatagagctttaggaaacagcactgcatgcattattcacatctgctgtgagtatacttgacacagctgcagtggagagatgcttgaaaaacatactgtaaaatacactcggtttcctcttattgacatatttagcagaacaaggctaattg

SEQ ID NO: 130016 - DNA, 450 bp, Homo sapiens
tcccagctatttaagaggatgaggtgggaagactgagttgagcccaggagctcgaggctgcagtgagccaagatcatgccactgcactccagggcaagcccttgtcttcaaaaaacaaaaaaattcaaaaaagtaatgcgttgaacaaacaccaagtacaaagtatactaatacagtggataaatgctactccaactctgatccactgactgccaggatcagcatgacactacagatggaactcaagaatctgtcataacaggctatccggctgattgttctgaatgtgaaagttttagaaacactgttccaagggtaaaaatgaggggacctaatttcttctctcttaggaatcttaccccccaaaaggtattgcaagcatctgttgtggggctggaattcctaaaacctctcaaagcatgctgtgtgaataaaaggacagtgttcaga

SEQ ID NO: 130017 - DNA, 645 bp, Homo sapiens
tggttctagaagtgcagctttccccaggaaggaggctggcaggatacattccatcagctagcagtggccctctctgcaaagggtgtaggcttgaagtgacacctctgttttgctgtttacttatttaattcttatatccagtgaaatttatttattatgtagttcaaaaataataaagtgaaaaaaatgctgcttctcagtgtgctttattaaaatattctgtgaaggtgaacatgtctcagtagtactgaggtgaaatagggcagcagggagacttgccagctccattttataaggaaatgttccaaagtcgttatttaaatgactgatatgtttagttatcaaaataaaattcccatcatgcacagtggctcacgcctgtaatcccagcaatttgggaggacaaggcaggtggaccacttgaggtcaggagttcgagaccagcccagccatcatggcaaaaccctgtctctactaaaaatacaaaaattagccaggtgtggtggcgcacacctatagtcccagctactcaagaggctgaggcaggagaaccgcttgaacctaggaggcagaggttgcagtgagctgagatcgtgccactgcactccagccagggtgacagagtgagactctgtctcaaaaaaa

SEQ ID NO: 130018 - DNA, 416 bp, Homo sapiens
ggcaccctggcgaaaccccttctctactaaaaatacaaaaattagccgagtgtggtggcccgcgcctgtggtcccagctagtcgggaggctgaggcaccagcatcgcccagcccggaaggttgaggctgtagtgagccgggaccgcgccactgcactccagcctgggcgagaggagaccctgtctcaaagacaaaaaaacaactggtaggaaaacgcaccctcaaaacacatgatgagatggtcgagaccagaccctaggagggtggggactggctgggtgggtatccagagaccatgggcgtttcataatgcattgtttcccatctcctccactcagcgactcttcttcccctgaagtcttgcattaagtaagtgaatgaatcaatcatcaagttaatgaagctctgactttgta

SEQ ID NO: 130019 - DNA, 444 bp, Homo sapiens
tgggatggatagatgcattttatttctctggaaatactccctgcctggcaagctcagagggctcacccctggagatgcaaattctgcctaacccctcccacagtcttttgagcagagatcctctcctctgtcccttagcagtgcagggcccaatctcacccagttctcccttcactgcaagcattgcttccccctcagtaaactacccaaacctcatttgttagcttgtttatgaagtaaatatcagggacatgaaataaaacgtctggcagcaacttccctaggacatcagtgactgtcctcaaactactctcaaaaggagctgtacatttccctaaagaaccattccaatgtaagatggcaaagtatccttggcagaaaattaaacctaaccacaagtgcctaggccctaggctatttagacatgaatcaaaaacagcagta

SEQ ID NO: 130020 - DNA, 700 bp, Homo sapiens
gagcatctactatgccaagccctgtgctgggctcaggaggacccagggtgggagcagaatcccatggaaccgcctaggaggttcaggaaagactcctttagagaggagaaccttgagctgagaccaggagggttggagaacttggccaactgaaggagagaggccagcctgagccagggccaggaggcagggactatgagtagtttattgtggctgaagcagggagttgacaggaaaatgttccttttcctgcactcacacaatcgtaatgatctgtgtcgctatttgtttagtgtctgtatcccctgttagaccacaagctccacgaggggtacagtgtgtatgtatactgctgcatcctggtacccagaacgatgcctagcacaggggttcccaacccccaggccaaggatcagtaccagtcatggcctgttaggaaccaggagcacagcaggaggtgagccgcgggcaagctggcattactgcctcagctctgcctcctgtcagatcagcagtgtggcattagattcccctaggagcttgaaccctactgtgaactgtgcatgggagggatctaggttgcacactccttatgacaatctaatgcctgatgatctgaggtggaacagtttcatgctgaaaccatcctgccccatcagtggaaaaattgtcttccatgaaactggtccctggtgccaaa

SEQ ID NO: 130021 - DNA, 425 bp, Homo sapiens
ccattaataacattctgtgagcacacatctagcttaagtgtttcccttgacccaaaatccaattaaaatcactattagattaagataatggttacatatcagaaatagctgagcaaaagattgagaagagaccatagggcacagaaaaatcctttagtgtttttgtttgtttttgttttttgagacggagtctcgctctgtcgcccaggctggagtgcagtggtgcgatattggctcactgcaacctccgcttcccaggttcaagtgattctcccgcctcagccccccaagtagctaccacgctccgctaattttttgtatttttagtagagacggggtttcaccgtgttggccaggatgttctcaaactcttgacttcatgatccgcccgcctcggcctcccaaagtgctgggattacaggtgt

SEQ ID NO: 130022 - DNA, 624 bp, Homo sapiens
gattatcttaagtagacatggactgtttggtcacttactctcaatatagactgtctccctaaaaatgttttaaataagaacaactttaaaagacacaaatctattttaaaatattggatatccaatgagtttatatttaaaggaggcttggatataaatagcattccaaatctgagaaaatatcttacttgcctttaataactgaatgaaaaatatatgagtagcaatacatattttttagttttgtttccacatcagtgcactgttctggaacagtatttgcctcatcgttattggagatactgaggctgcaaaagttgaatattctcagaaaggtctattgaaacatcaagtgcttggtccatggtaactggttgatagttatgtgagctttttctgtagcacatcaaaataaaaatagatacattaactttatacacatttatattacctgttacataatatttcttggactcatttcatagatttagtttttgaatctgtggtaaaatcttgaggtgacaacaattaataaatctttcaattttttttaacaatgccttactaggaacacaaataatctatgatgatagttgttcatcaagcagatattttatatttctc

SEQ ID NO: 130023 - DNA, 501 bp, Homo sapiens
tgagaggctgaggcaggagaatcgcttgaacccgggaggcagaggttgcagtgaactgagaaatcctgccaccacacttcagtctgggcgacagagcaagactccatctcaaaaaaaaatcagacaaaaaaaggcaactttatgatttcacttacgtgaaattctagataggtgaaactatagtgacagaaagcagatcagctgttgcctggggcaacacttagtgaaaaatcactaaggggcataaggagatgcttgtggtgatgacgttccttatcttgattgtgctaatgcttatatgggcacatacagccttcagagctcatgaaattatatactttagatatgcacagtttctcatatctcagttttacctccctaaaactattaagaaatttgtgcttaatactttggtgagcattttatgccctttgccccatgtagttggttctcactggtaggtaggcaggcaggtagaattagcagctttaggtgagacag

SEQ ID NO: 130024 - DNA, 616 bp, Homo sapiens
cacagtttggcttgcaggcagtttgagctaattggacctcatgaaaggcaaaaactctgcaaagtggtggagtcgccaaacctggactgttttattggttgaatggctagcttctttctttaggcaaagcataggatagtattcaagagtacatttttaataataaactggagataattaagtactggcatcaggcatatttcctcagatatcactgggtttgtagccatttcatccagagcatctctggatgacatctctggttggatccctggttgacatcatttttatccagagcagtctgtttcacattctgctgccaaactctgacaattgtttgaagactaggattaggagaagagagagagacataaacactcagttgtcctgccttgactttgacagatactaagatctaacatagtctaccaaatgaagagtgacagttaaagacagcttctgttattacctgaagtatcaaatatttagtgataccttttttgttgtttgttcctattttgtggcaggaattactgctatctaggaagcagtcatagagtcctctttatttgttaaagaacacaagactgaaacaacaaaatctaaaccaaaagta

SEQ ID NO: 130025 - DNA, 357 bp, Homo sapiens
cacaaatagccagtgtcgtggtgcacacctgtaatcccagctactcgggaggctgaggcaggagaatcgcttgaacccaggaggcggaggttgcagtgagccgagatcacgccactgcactccagcctgagcaacagagtgacactctgtctcaaaataaaataaaataaaataaaaattttaaaaagtgtgattcccagcatgaactgggaaaacatgttgggctcatggctctgctgcccgccaggccctccaccagctgtgggagaagccgcatcctcagctgccgcaaaccttcatgcaggaaaaggccagcctggcaaaccacaggcacgcgggtggcacccggccacacgg

SEQ ID NO: 130026 - DNA, 271 bp, Homo sapiens
agcagacatctgcagaagtttcagaactcagtggagcttggcttaagctctcatgagttgcatgtaaaggaatatgtatgtataagaggcggatttgaagtggcagagggtccacaaaaggcacaagtactaaccactgaatgggaggagatagaaaaatgtgtaagtcacaattaagtcacagaatcaccaagtctttaccaagtgcattgtcagcactttgcaaaacgctgtgtacttgtctttcaggaagcatacaatatgcacccaa

SEQ ID NO: 130027 - DNA, 427 bp, Homo sapiens
tcatgtctccatgcagctggccttcccttcttttttctcaatagggctttcttcaccttttcatctagaaatcttttttgcatcttttaaatttcaattgtgtgtcaactacttggtgaagtctcctttaatatcctccccatcctcaccagcacacacacactatgtggaattaattattcccttccatatattacttatatgtcttgttaatgcatctattcttatatgtatcacaccgaatcataattactataagcttcttgagggccaagactgtgccttattcatcttcacatttccactatctggcccatcataggttttccataaatttgttgagtctatagaccagtgtttgtatataactctatcaagcccctcttttctcctaggctccagatgtgttttttcacttgcttactgg

SEQ ID NO: 130028 - DNA, 494 bp, Homo sapiens
taatgataacagccctaaccatatattcccactttggagaataaaacagctcagggagttactgcctagggtgaaactgtaatggttcaaagtgccaacactccaccacccctcttccacactctcttcccctcacaacaggagaaagaatgtgagaatacaaatcagcagcatctgatggcctcactacactcccacccgcccatctgcttaacagactttatggcaagtgctttccttggaagtggctgaaagggagcaacaccttgcagtgggaagtaaacttaaatgttaaaacttgaccttccggccgggcacagtggttcacacctgtaatcccagcactctgggaggctgaggcaggtggatcacgaggtcaggagttcaagaccagcctggccaagatgctgaaaccccatctctactaaaaatacaaaaatcagccgggcatggtggcacacacctgtaatcccagctactcaggaggctgaggc

SEQ ID NO: 130029 - DNA, 481 bp, Homo sapiens
taattaaggtaatcccaccttcttcagctaggctttgtgaccacccaatattgaaacgatttcctctgcctctgaattcctacagcaacatttagttaagcattcatttggcaatttaatcaagtggtgacttatgatagctttttaagtgagcccagataataactatttatccctcatattgagtactgtccagtgctgcacaaagaagtcactcataaatatttttggatggctgatttactgattgaaattatatccttccatggagatttgctttgcaagggaaacatgaaaagagggcatctgggtgatactaggctgtcatcaacctatcatcaatgcttcctttacatgaccaaaatcaggccaagacaaagaagtcagtctcatctccatcatttgaatcgaaagaaaataatcccggtaatcacaaattccatttcactttagaataaccattcctaaaagtttgcaaaat

SEQ ID NO: 130030 - DNA, 487 bp, Homo sapiens
ttccggatttcccagggagggggcctctagacatctgccacagggtcagtcctcagaagccagtgttgagacgggggtgctgccacccacgaggactctcccttcccgctgtgcctgggagggagttgggggagcgtggaaatacagaacctgctgagtgcccagggccgctgctgcccagccactgcctgcagctgctgttccttcaggagccaaagtgagccctggggcaggggccgccagagagagccctccacagccgacttgctgtctgcccttggcagggcgctttccttttctgagcctgggtttgctccggggaaaagacattcttagaggtgcccaaaataagaggctcattgggacttggtggggtttggtacagatgaggccttggctgttgtcaaggattgccgcctgaaacccagcaccaggcttggggggcctgaagtcttggggaaccgcaggacagttctgagactgaagt

SEQ ID NO: 130031 - DNA, 555 bp, Homo sapiens
tgaggtttagttgagaatgtaattattaggaaaatggtgaaaagcaaattcaaacaaattctaagtttagcttgaaaaatggaaaaggttcttaagttctgtctgatgcataaaggggtagaagcaaaggaattatgctccaaagccaagaaagagggtgtacaaaagcagctgatccacttgacatagttcatagccttttgcaaaggaataaaagcctgttgagcagggaaccaaaagatctcattataggatgaagccaagccatattaaagcttgtgcactagtaactatgtctaaaaacagcctgctgttttatattgaaccaatacatttcttaacttggtaggttgcagtgtaaagatgtacagagcctgtctgctggatgctatgccaattacagatgtggcagagtggtgtcaaacacctacaaacagttagatcgcaagcaatcttagagtgaaacaaaagaagttttaaaatgtcacctcaaaacctagttaatcgtgtgtgtttgacttttagagtcttgaaatcacctttattatataattt

SEQ ID NO: 130032 - DNA, 826 bp, Homo sapiens
gatgtatggcttgcaaatattttatctcaatctgtaggttgtctcttcgctttgttagttgttttctttgataggcagaaggttttaaatatgatttcatttgttacctttccttttgttgccttgtacttttggggtcaaattttaaaaattattgcccagaccagtgtcatgtagtttttccaatgtcattttgtattttcctctagtagttttatagtttcagattgtttaattttttcatctattttgagtagacttttgtatatggtgtaagatgaaggtccaattttattcttttacatatggatatccagttttcctagcaccatttattgaggagattatacattttccattgtatattattggtaattttgttgaaaatcaattgactgcagaggtatggattcttttctgggcttgctattctgttccattggttgatgtgtctatttttatgttagtgccatgctattttaaatattattgctttaaagtatagcttgaaatcatggagtgagatacatctagctttgttctcttttcttatattgccttggcaatttgctttttgttatggttcacatacgttttaggatagttattttctgtatatcgaaaaatgacattggaatcttgatagagatctcaataaatgtgtagatagctttgtgtaacatggacatttttacaatattaattcttccaatacataaataaaaaatatttttccatttatttgtttcttcctcaatttttttttttgctaatattttatagttttcagcatacgggtctttcacattcttggttaaatttatta

SEQ ID NO: 130033 - DNA, 346 bp, Homo sapiens
cagttcctcctcctggggacgcgacaccctgagtcctgggcctttctgtagtccaagtgcccaatgctaaggtccacttagtccccaactcctaaatccccgtttctcctcctgatcaaggctcctttctgccttgccatgaaatggtggagtctctctacccctgggtctcttccttggtcctctgatctggtcattctcctcccccggcacatcccctcttcccctgacggagtcttactctgtcacccaggctggagtgcgtgcagtggcgcgatctcggctcactgcacactccgcctcccgggttcaagcaattctcctgtctcaacctgcagagtagctg

SEQ ID NO: 130034 - DNA, 285 bp, Homo sapiens
atttatgaatatttccaacacaaaatatctttcctttctgtactttgacttagataattctctgcttataatactagctggttttggtttctctgtggtgatctatggtgtgactctcatctcctctggagagagctccttatataagctctgtcacctgagggccactgctggcattccagtgagtgagctaagctctagaagccagacaagtagaattatttttcccaccgtagaagatacagtacaagttcatgtatagaagaagtttattattttctcaag

SEQ ID NO: 130035 - DNA, 517 bp, Homo sapiens
ttggatgatcaaatagaagatccctagcaagtaattttataaagacaaaaatttcgtgtcaactctgtaataaaacaatatatccttagaatcagttatcacttaaaatccttattttatagaaatttttgtgtttcaaaagtatagctagggcaagtcccccttcagggtggatacttaaaggagatgaaatcacttcataaaggtgtctgcactcccatgttcattgcagtgttatttacaaggtagccaagatatggaaacaacctaaatgtctgttgatggcaaattgataaagaaaatgtgtgtgtatgtgtgtgtttatacaatggaacgttattcagcctttaaaaagaaggatattctgtcatttgccacaacttggttggaccttatgctaagtgaaatagaccacgcacaaaaagaaaaatactatataatctcacttatatgtggaatgtttttaaaaagtcaagtatacggagacagagaataaaacagtggttaccttgggcag

SEQ ID NO: 130036 - DNA, 518 bp, Homo sapiens
  misc_feature (329)..(329): n is a, c, g, or t
caggcatgctccaccatgcctggttaattgtgtatttttagtagagatgggacttcctccatgttggtcaggctggtctcgaactcctgacctcatcatctgcctgcctcgacctcccaaagtgctgggattacaggtgtgagccactgcgcccagcctagtgtattcttttaatagagttttagaattttctggatactagtcttgctcattttttgttagatttatccccagctgtcttacattttttgatgcttttgtaaatagtattttctttctttttttgggggggggcgggggacagagtctcgctctgtcacccaggctgnaatgcaggggtgtgatctcagctcactgcaacctccgcctcccaggttcaaggaattctccggcctcagcctcctgagtagctgggactacaggcgtgcaagaccataccgggctaatttttttggtatttttggtagagatggggttttgccattgttggccaggctggtcttgaactctggacctca

SEQ ID NO: 130037 - DNA, 534 bp, Homo sapiens
caaaacatgtttggggcgccctatgtgctgaatctagcctgcagacaagttcaaatatgcagcatgtagcttgagatggatgagtttcaaaatgcaaatcctatctgcactggcaattggattattttgtgtcaaggaaaatgacttttctgtcttaaggtatttttgcttttgattgcttcttttattgcttgggattttcttctccctggtataacagcctagtggatactttatcatctaaagctacatataagcctatactatgatccagcaatagcccccctaagtgtatacccaaggaaaactagtgcatgatggatctattcaaagtaacacaaaactggaaacaagccagaagttcaacaacagaagaatgagaaatcttggtttattcattcagtggaatgctgtgcaataataagaacacacttttgttttgagatagagtctcactctgtcacccaggctggagtgcagtggcacagtcacagctcactgcagcctcaaccttccaggctcaagcaatcccct

SEQ ID NO: 130038 - DNA, 415 bp, Homo sapiens
tcccagattcaagcaattcttctgcctcagcctcctgagtagctgggattacaggtgcacaccaccacgcccagctaatttttgtattttttagtagagatggggtttcaccatgttggtcaggatcatctcgatctcttgacctcatgatctgcctgcctcggcctcccaaagtgctgggattacaggtgtgagccaccgtgaccggctctagtttcttaaagtagaaatttaaataattattttgggacctttctgcttttctaatataagtagttccttttcctctaatcagttgttttgttgaattcccaaattttcatattttatttgcatttctattcagtgaaagatatgttctaccaataattttacttgtggtttcttctttggttcttgggttatttggaagtag

SEQ ID NO: 130039 - DNA, 474 bp, Homo sapiens
cccagcgactctcaaatgagtgactcttctggagtttcccccatgactaactcatcagaactaaagccagaaagtagagatgatcctttctgtattggaaatcttaagtctgagcttctccttaatatattgaagcaagatcaacatagccaaaaaattacaggagtatttgaattgatgagagaattaactcatatggagtatgacctagagaaaagaggcattacgtctaaagtacttccactgcagcttgaaaatattttctacaaactgcttgctgatggatattcagagaaaatagaacatgttggagactttaatcaaaaagcatgttctacatctgagatgatggaagaaaagccacatattcttggtgatattaaaagcaaagaaggaaactactattctcctaatttagaaactgtaaaagaaattggactagaaagctctactgtgtgggcatcaacattgcca

SEQ ID NO: 130040 - DNA, 452 bp, Homo sapiens
ataacaaaaagacatttggggagcaagttaaggaagcttaaatataaactggataattgatgacatgaggaaattttcttagttgtgataactgaatagtggtagtacaggagaatgatgattttaagaggtgaatgctgaagcacttaggggtgaaatgtaattgggtctgtaatttacttccaaatgactaagtaatgcacatatatgcttgcaaattttcataataaaacttgggagaagagaaggcataggaaacaaatatatgaaaacgtaaacagtgcagcagtgattgcctctgaaaaggaaactaagcagctagggtcaagggagtcttctttttactactgtatatccttaaggatttttaaaattgtataccatgtacatgtaccagctattcaaataaataaggttttcaacattaacagtggctatcttttcagtagtgg

SEQ ID NO: 130041 - DNA, 462 bp, Homo sapiens
tcctttccccagggacattgctcaatgggcagcaagatgtaaactctggagtctacaggtgaaaccatgtctttctgagaagtaatggggtagtgccgtcctttacatattgcttcacgcaaagtattatgagacagtggcatctagcacttgtcttagggtttaataacatgaaagtccttgccctcagaaaaaaatccttaccatgtaccttgttttttcctgtaaacatgcacactgctggctggagtgtgacccccccacagcaaggtttcccaagggttctgaacttagagagttggcatctgcagcactgattatgatctttcctatatgagttaatctaagtggagggatacaaagccatgcttgagctgagtaggcccaagatgcagaagcagtggctgcttctctctctgttcccttcctcacaacagcaactgaaggggcatgtatgtggca

SEQ ID NO: 130042 - DNA, 224 bp, Homo sapiens
tctcagcctaatcatcacttccaagagtggcttccccttggagaagactttcctggtgggaggacttccctcacaaaacccaccacctcccacctccagcccagttactctgcctcccagcatccttctctttctttcagagcaccaatcacggtctatcactatttctatttactttatgctgacccatttatatctacctgtttatatctgtccccactagg

SEQ ID NO: 130043 - DNA, 283 bp, Homo sapiens
cacagcagctggacagcgacagtctgtacctctcttgttccagcacgaaacagaaaagaacaaattggagaagaagggctttctgcaaagcctcctcttcaatccccaggtcagagagctgtgcttagtttttaacacaatgcacagtcgggcctgaaagcaggctgctagggtgggagattgctgctcctgagccaaatgatggacaatttcttgtcagactggagagcaaacacaaacctcttcatgtcaaatgatggatacgagtgatggtgaggctctt

SEQ ID NO: 130044 - DNA, 433 bp, Homo sapiens
tgcatcttccaacaacagcttactggaatccctttaggcaaacttccaccgtccaaatgttcctttattctttatctccagaacccagtcacgcacattaacaaacagatgggagcattccaacttcgcattactgataagccctctatcattattgacaaactaaaaaacattagcagtcactattgtttaagaagacacctactctgcatctcactcaatccttggctttgctccccctgctcatctgactctctgcccagcacctcctcttgcttgcttatatccagccccattgtgtccgaaattggtgggttcttggtctcactaacttcaagaatgaagccgcggaccctcgtagtgagtgttacagttcttaaaggtggtgtgtccagagtttgttccttctgatgttcggacgtgtttggagttt

SEQ ID NO: 130045 - DNA, 448 bp, Homo sapiens
tatctatagaacttggcttttcttgttttctgtgtcttgtgtctgaatataataatgatgtttaacattctgtgtgtgacctctgactgattttggaaatgggaaaaggatccatggcattggtaggaaaaggttgccaagtctgccttaagaatttttaggaatggcagggcatggtggctcatgcctgtaatcccaacactttgggaggctgaggcaggcagatcacctgagattaggagttcaagaccagcttggccaacatggtgaaaccccatctctactaaaaatacaaaaactagctgggcgtggtggcaggtgcctgtagtcccagctactcaggaggctgaggcaggagaattgcttgaacctgggaggcagaagttgcaataagctaaaatcgcaccactgcactccagtctgggcgaaagagtgagactctgtctca

SEQ ID NO: 130046 - DNA, 253 bp, Homo sapiens
tccgccggctttggcctcccaaagtgctgggattacaggcatgagccaccgcgccctgccatatttaaagtttttaaaccagccaccagcagaggcctttaaaagcagacgatgagcctgggcaacaaagcaagaccctgtctctacaaacaattttttgttttttaagtagccctgtgtagtgacacaggcctgtagtcttagctactcaggaggcttatgtggcgggatcagtttagcccaggagttcgag

SEQ ID NO: 130047 - DNA, 121 bp, Homo sapiens
ggtccgatctgctttatattactttactttcctcctctctattcataaattaatgtgaaagagaaaatgcaaacattttcctagacaaagtgaaacatgtcctcatatcttactttaaaaa

SEQ ID NO: 130048 - DNA, 333 bp, Homo sapiens
taaagccactgtctgaatctcagcatagggcagaagaagctggatgtagaaagtgctttccatgattttctcaagcatgctctgaatgcaggggcggacggtgagggaggcccagagacccagggcctgtcactaaccagaaaaccacagcattgagaagcatcctccgcacgcttccaagagaacgttcttatcaccgttcatggggtgcagctatttactctgggctacttgcttaggagcagaggctggactttcaaggtgaatatggcccatcaatccggcagcaaacatactttttaaagctaagaatcttctttcgagttggagcag

SEQ ID NO: 130049 - DNA, 333 bp, Homo sapiens
agcctttgaacaggcctgtgtctaataaataccattttaggcatccatggtacaatgttaatgctcttctcactttacttggggtaaattttccttctaagttctgcagaaactgaagaatcaataacacaggaagcccaaaggcctgttttttaataaaataaacctaaaatggttactgggccctggaggatttctaggtgcacaagaaaaggggccaacacattcctttaactctgtttcacccatcctggccaactcagtattagctaagaattttcaaaactgtttcctttttgcccttagaaatatcttactcactaccttccaaac

SEQ ID NO: 130050 - DNA, 258 bp, Homo sapiens
acctatgtaacaagccttcacatgtaccctcaaacttaaataaaataaaatagacctatatttaaaaatatttttattgtctaatttaaaatgtactttaaggctgttatttttttctatcatccatatgtatcagttactacaataaagtaattgagatttagaaaaaaagaatgcatgtacatgagatagaataaggatgcataccctatgatgaatacaaaagagggaaaaacctgtaaaaattgaatcaggaag

SEQ ID NO: 130051 - DNA, 348 bp, Homo sapiens
gatgcgtggtcctgggatgtcattaaactgcttatggcttctgtctctccatctgtaaaatggggaaataataacatctacattccaggactgctgccaaaattcaatgaagctatgcctaacacagcctggcacccagtgggcacccacaaacagtggccactgtctaactaggggagcctcaaatgccagcaggcctgtctagaaagagggtgaaagggaggtagataaagtttcatgagaagacgggggcaggaagaagtctgttcaccagaagcctctgcactgacttgtcagagggggcccacctgaggctgggctccaaaggaaaagggcctcctcagccca

SEQ ID NO: 130052 - DNA, 568 bp, Homo sapiens
tgccagtaggtacatgtgaaggaaaacaaaacaaaacaaaacaaaacaaaacaaaacaaaactgctctccctagccaaaataccgggaaaaggacaacctagcaagacagaaaaatgctagacaataagtgctctactccagccaaacaccacagaaaatgaaaaaaattaaaatgaacacacccctccccatgggagcaacggttgaatggcgtggggagccaggactttaatctcaatgatagatagtgagcacccccatcccctggcctattcagcatcagtgaagagcatggccttccacccctaatccatgacattgaagcaccttcccccttcctgctgggttgttgtcagggaagaactagtagaaagccaggacattcaccacggaccagcattcatggggccaccttccactcagtgtggtgttagtggagattaaggggggaacagtgactagacatacctaccactcccatccaggaagagatccgtgaagtcctagtggggaggtgaattcctacctcatccagctgaaaagaggggcctttggggtatcagagaa

SEQ ID NO: 130053 - DNA, 966 bp, Homo sapiens
agtggaagactaataagaaaatgctagtgagctccaatatttacaaaatcaaactatacatgtagttttatgatattaaaactatgcaacttggtaaattatactatgatattaaaatatgcaacttagtaaatcactgactacatattttcttaaagataatggctttttcaaaacaaatatccaaaacataaatttcactggccattgtctgaaatccctggctataaagctgacatttattttaatgatgcagtctctgctcaaaatatttcagaatgtctttttatgagtcttacaaggaaatcagttttcatgtggttttaacccgttttccactaatcagcttttgcaaagcttgctgacctattttatttaccagattttgttccaattaactttttccaaaaatcaaattcatgctcataggacaaaatgttattgatcattcaagatactcaaataagagcaagttatctgagaacctcacagacctgaaggaggacaggagaggtctgggcaggcaggagccaccgtgagcacctctgtgcccgggtgggactcatttatagggcatcagacctgacccacagccccagatctggcactcagaccacgtcaccttcagacacttcctctgcttccgtcgttagctttcctcttctcatctgtcagttgggagggggcccaattatatgatgaggaggtctgtgtctgattaaaaggactacttaaaaatagtgagaaatgaccatttgttgggaaaagtccttattaccctctccaaagtgagctcactgagtgtctgttgaatgaatttggccatggcattctggtatgcttggcatatggctgacttcttgcagtcataactcaaccccaattcccccaggaaacactcggcgggtccttcttccatgcgtgaggctcgtggcgggtccttctgtgagtgaggcccgtggcgag

SEQ ID NO: 130054 - DNA, 396 bp, Homo sapiens
gtgtctggcagttttctaagaattatcctgtgcgaattagaataattctacaaccttatgagggagttgctatacctcttccagagtttcagaaagcctccaagttccatatatgccatctcgaccctccataagatggaccaaaagacagggtgattggatcagacatgtgaggactcctaaatccaaaggagcaggcataaggcagcagctgcctcagtacaaaaaagcagagcttacaagtttttgctggaagtattgatgccgaagtattctctcgttgccatgacaggtttcagaagaactgctttcttaatccttctgactgcttcgaagttttcttttttctttttcttttttttttttttttttgagttgcagtcttgctctgttgcc

SEQ ID NO: 130055 - DNA, 494 bp, Homo sapiens
gggctttggcggatcccgcggtctctgctgaaccaggagcaggataaacctctccagtcggtggcatggggttagaacagcagatgccaaggtaaacatgcagccagtgggaaagcagatgctgccagctctcagcatccggcagagagggagtgaggcatgggaagtatgcctcgtccagaaggatggagtgggggatgcccatgatcagatatccccatcctctacagaagagaggccaacatgccatcctcaccaggtctgttcagggagtctagcttctgagttagacactgacagtggtgccaggatgcaagggcagtcagccattaagagctgggccctctgcagttcaaatataagccagaacctttaggagggccgaaatatgggagctcaaatgtctctcaaagccatcgggcccttgaaaacaactgttagagttaaaaaggataatataaattaatatgcctaggaagaacaaatatcaattt

SEQ ID NO: 130056 - DNA, 2029 bp, Homo sapiens
acagggtcgctgagaccagtgcacgagcctcttcggaagatgcatcctggactcttggccgcagaagagaaagcggttggggtctcccagggactctttctaaagggtcagtccaccatggtaggggttaacgtgggtccacccgtatagggaaaggaaagaaattgtatttgacacttcaggggggcgggtggcggacgggtctcgctgcctgattggttttgcatttcatcccaatttttttttctccactctctctccctcttttcagtttctctctctgatcccaggggaggggaaacgggaatagtgagagatcaaaaataaacctcttatgtcaagccgggaaggaagtataaataagaagggctcggcagcccactcggtgcttcccggggtggggaggaggcaggaggcggctgcgcggggctggcgcgggcaggggcggaggacgggcgcacgcgggccggggccagctgctcgcgctcggctcgggggcggcggcgcgggaggagcgggctgcgccagccagaggggccgccgggggagcgctcccgccgccgggccccgcgggcggagtcggccttgcacccgattgattccgttttcctggagagagcggccgggccgcgctcgggccgccagcacctgcccgcgcctggcgggtttttccttttcctgcgcgcagccaccgccgcagcccccatgttccccgcccccgccgccccccggtggcttccgttcctgctgctgctgctgctgctgctgctgccgctggcccgcggcgccccggcccggcccgcagccggggggcaggcctcggagctggtggtgcccacgcggttgcccggcagcgcgggcgagctcgcgctccacctgtccgccttcggcaagggcttcgtgttgcgcctggcgcccgacgacagcttcctggcgcccgagttcaagatcgagcgcctcgggggctccggccgggcgaccgggggcgagcgggggctgcgcggctgttttttttccggcaccgtgaatggggagcccgagtcgctggcggcggtcagcctgtgccgcgggctgagcggctccttcctgctggacggcgaggagttcaccatccagccgcagggcgcggggggctccctggctcagccgcaccgcctgcagcgctggggtcccgccggagcccgccccctcccgcgaggacccgagtgggaggtggagacgggagagggtcagaggcaggagagaggagaccaccaggaggacagcgaggaggagagccaagaagaggaggcagaaggcgctagcgagccgccaccgcccctgggggccacgagtaggaccaagcggtttgtgtctgaggcgcgcttcgtggagacgctgctggtggccgatgcgtccatggctgccttctacggggccgacctgcagaaccacatcctgacgttaatgtctgtggcagcccgaatctacaagcaccccagcatcaagaattccatcaacctgatggtggtaaaagtgctgatcgtagaagatgaaaaatggggcccagaggtgtccgacaatggggggcttacactgcgtaacttctgcaactggcagcggcgtttcaaccagcccagcgaccgccacccagagcactacgacacggccatcctgctcaccagacagaacttctgtgggcaggaggggctgtgtgacaccctgggtgtggcagacatcgggaccatttgtgaccccaacaaaagctgctccgtgatcgaggatgaggggctccaggcggcccacaccctggcccatgaactagggcacgtcctcagcatgccccacgacgactccaagccctgcacacggctcttcgggcccatgggcaagcaccacgtgatggcaccgctgttcgtccacctgaaccagacgctgccctggtccccctgcagcgccatgttctcaggctgccacctgcaggggtggatccatttcaagtatttatgcaaatgtgtctctgaactaaagtgtgatcttatgccaatgc

SEQ ID NO: 130057 - DNA, 380 bp, Homo sapiens
ttgtgcccagaagacactggccctgggcgcctgggttgagttcaaaaccaaaagaaagaagaaaagtgctgtaaattcgggatttctccaccggatgctcctgcttccgcatgggtgtcacctccatgccgtttcttcctctttctagggaaaagcttcagggagcagcagtgtgagaagtataatgcctacaattacactgacatggacgggaatctcctgcagtgggtccccaagtatgctggggtgtccccccgggaccgctgcaagttgttctgccgagcccgggggaggagcgagttcaaagtgttcgaggccaaggtgagaatcaccctgggactcagatccagagatggggaggaaggtcgcctgtccccaca

SEQ ID NO: 130058 - DNA, 4016 bp, Homo sapiens
acagggtcgctgagaccagtgcacgagcctcttcggaagatgcatcctggactcttggccgcagaagagaaagcggttggggtctcccagggactctttctaaagggtcagtccaccatggtaggggttaacgtgggtccacccgtatagggaaaggaaagaaattgtatttgacacttcaggggggcgggtggcggacgggtctcgctgcctgattggttttgcatttcatcccaatttttttttctccactctctctccctcttttcagtttctctctctgatcccaggggaggggaaacgggaatagtgagagatcaaaaataaacctcttatgtcaagccgggaaggaagtataaataagaagggctcggcagcccactcggtgcttcccggggtggggaggaggcaggaggcggctgcgcggggctggcgcgggcaggggcggaggacgggcgcacgcgggccggggccagctgctcgcgctcggctcgggggcggcggcgcgggaggagcgggctgcgccagccagaggggccgccgggggagcgctcccgccgccgggccccgcgggcggagtcggccttgcacccgattgattccgttttcctggagagagcggccgggccgcgctcgggccgccagcacctgcccgcgcctggcgggtttttccttttcctgcgcgcagccaccgccgcagcccccatgttccccgcccccgccgccccccggtggcttccgttcctgctgctgctgctgctgctgctgctgccgctggcccgcggcgccccggcccggcccgcagccggggggcaggcctcggagctggtggtgcccacgcggttgcccggcagcgcgggcgagctcgcgctccacctgtccgccttcggcaagggcttcgtgttgcgcctggcgcccgacgacagcttcctggcgcccgagttcaagatcgagcgcctcgggggctccggccgggcgaccgggggcgagcgggggctgcgcggctgttttttttccggcaccgtgaatggggagcccgagtcgctggcggcggtcagcctgtgccgcgggctgagcggctccttcctgctggacggcgaggagttcaccatccagccgcagggcgcggggggctccctggctcagccgcaccgcctgcagcgctggggtcccgccggagcccgccccctcccgcgaggacccgagtgggaggtggagacgggagagggtcagaggcaggagagaggagaccaccaggaggacagcgaggaggagagccaagaagaggaggcagaaggcgctagcgagccgccaccgcccctgggggccacgagtaggaccaagcggtttgtgtctgaggcgcgcttcgtggagacgctgctggtggccgatgcgtccatggctgccttctacggggccgacctgcagaaccacatcctgacgttaatgtctgtggcagcccgaatctacaagcaccccagcatcaagaattccatcaacctgatggtggtaaaagtgctgatcgtagaagatgaaaaatggggcccagaggtgtccgacaatggggggcttacactgcgtaacttctgcaactggcagcggcgtttcaaccagcccagcgaccgccacccagagcactacgacacggccatcctgctcaccagacagaacttctgtgggcaggaggggctgtgtgacaccctgggtgtggcagacatcgggaccatttgtgaccccaacaaaagctgctccgtgatcgaggatgaggggctccaggcggcccacaccctggcccatgaactagggcacgtcctcagcatgccccacgacgactccaagccctgcacacggctcttcgggcccatgggcaagcaccacgtgatggcaccgctgttcgtccacctgaaccagacgctgccctggtccccctgcagcgccatgtatctcacagagcttctggacggcgggcacggagactgtctcctggatgcccctggtgcggccctgcccctccccacaggcctcccgggccgcatggccctgtaccagctggaccagcagtgcaggcagatctttgggccggatttccgccactgccccaacacctctgctcaggacgtctgcgcccagctttggtgccacactgatggggctgagcccctgtgccacacgaagaatggcagcctgccctgggctgacggcacgccgtgcgggcctgggcacctctgctcagaaggcagctgtctacctgaggaggaagtggagaggcccaagcccgtggtagatggaggctgggcaccgtggggaccctggggagaatgttctcggacctgtggaggaggagtacagttttcacaccgtgagtgcaaggaccccgagcctcagaatggaggaagatactgcctgggtcggagagccaagtaccagtcatgccacacggaggaatgcccccctgacgggaaaagcttcagggagcagcagtgtgagaagtataatgcctacaattacactgacatggacgggaatctcctgcagtgggtccccaagtatgctggggtgtccccccgggaccgctgcaagttgttctgccgagcccgggggaggagcgagttcaaagtgttcgaggccaaggtgattgatggcaccctgtgtgggccagaaacactggccatctgtgtccgtggccagtgtgtcaaggccggctgtgaccatgtggtggactcgcctcggaagctggacaaatgcggggtgtgtgggggcaaaggcaactcctgcaggaaggtctccgggtccctcacccccaccaattatggctacaatgacattgtcaccatcccagctggtgccactaatattgacgtgaagcagcggagccacccgggtgtgcagaacgatgggaactacctggcgctgaagacggctgatgggcagtacctgctcaacggcaacctggccatctctgccatagagcaggacatcttggtgaaggggaccatcctgaagtacagcggctccatcgccaccctggagcgcctgcagagcttccggcccttgccagagcctctgacagtgcagctcctgacagtccctggcgaggtcttccccccaaaagtcaaatacaccttctttgttcctaatgacgtggactttagcatgcagagcagcaaagagagagcaaccaccaacatcatccagccgctgctccacgcacagtgggtgctgggggactggtctgagtgctctagcacctgcggggccggctggcagaggcgaactgtagagtgcagggacccctccggccaggcctctgccacctgcaacaaggctctgaaacccgaggatgccaagccctgcgaaagccagctgtgccccctgtgattcaggggggcaggggccagtcttgtgctcctggacatgcggtactgaggtgcagacaagggtctccactgtggtgactgggtcccttggccatatcaaggcagcacggcccacccaggcctcccattgccgcaacccctccagtactgcacaaattcctaagggggaagaggagagggtatggggcggcagaccctatcatcaactgtccagtggactggaccttgctcgggttcaagtagagggcataggttaaaaggtaaaagtgcacttattgactcagacaggacactcagcgtcagtctgtttgcaaaggactagcaaacttaaatgaaaaaaaaaattctatctggtttccccgataaataatctacctcacaggggaaaaaattagtacaagagaggcgtggggcagggagtcaatggtgaatgtcaaagcaggctccaaagctggaccccaagctgtcttcaagaatgaccacgactgtcttcagtgttaaaatccatcacctaaagggccgcagcgtcgcagggtttggagagccacatgttctcaggctgccacctgcaggggtggatccatttcaagtatttatgcaaatgtgtctctgaactaaagtgtgatcttatgccaatgc

SEQ ID NO: 130059 - DNA, 3273 bp, Homo sapiens
acagggtcgctgagaccagtgcacgagcctcttcggaagatgcatcctggactcttggccgcagaagagaaagcggttggggtctcccagggactctttctaaagggtcagtccaccatggtaggggttaacgtgggtccacccgtatagggaaaggaaagaaattgtatttgacacttcaggggggcgggtggcggacgggtctcgctgcctgattggttttgcatttcatcccaatttttttttctccactctctctccctcttttcagtttctctctctgatcccaggggaggggaaacgggaatagtgagagatcaaaaataaacctcttatgtcaagccgggaaggaagtataaataagaagggctcggcagcccactcggtgcttcccggggtggggaggaggcaggaggcggctgcgcggggctggcgcgggcaggggcggaggacgggcgcacgcgggccggggccagctgctcgcgctcggctcgggggcggcggcgcgggaggagcgggctgcgccagccagaggggccgccgggggagcgctcccgccgccgggccccgcgggcggagtcggccttgcacccgattgattccgttttcctggagagagcggccgggccgcgctcgggccgccagcacctgcccgcgcctggcgggtttttccttttcctgcgcgcagccaccgccgcagcccccatgttccccgcccccgccgccccccggtggcttccgttcctgctgctgctgctgctgctgctgctgccgctggcccgcggcgccccggcccggcccgcagccggggggcaggcctcggagctggtggtgcccacgcggttgcccggcagcgcgggcgagctcgcgctccacctgtccgccttcggcaagggcttcgtgttgcgcctggcgcccgacgacagcttcctggcgcccgagttcaagatcgagcgcctcgggggctccggccgggcgaccgggggcgagcgggggctgcgcggctgttttttttccggcaccgtgaatggggagcccgagtcgctggcggcggtcagcctgtgccgcgggctgagcggctccttcctgctggacggcgaggagttcaccatccagccgcagggcgcggggggctccctggctcagccgcaccgcctgcagcgctggggtcccgccggagcccgccccctcccgcgaggacccgagtgggaggtggagacgggagagggtcagaggcaggagagaggagaccaccaggaggacagcgaggaggagagccaagaagaggaggcagaaggcgctagcgagccgccaccgcccctgggggccacgagtaggaccaagcggtttgtgtctgaggcgcgcttcgtggagacgctgctggtggccgatgcgtccatggctgccttctacggggccgacctgcagaaccacatcctgacgttaatgtctgtggcagcccgaatctacaagcaccccagcatcaagaattccatcaacctgatggtggtaaaagtgctgatcgtagaagatgaaaaatggggcccagaggtgtccgacaatggggggcttacactgcgtaacttctgcaactggcagcggcgtttcaaccagcccagcgaccgccacccagagcactacgacacggccatcctgctcaccagacagaacttctgtgggcaggaggggctgtgtgacaccctgggtgtggcagacatcgggaccatttgtgaccccaacaaaagctgctccgtgatcgaggatgaggggctccaggcggcccacaccctggcccatgaactagggcacgtcctcagcatgccccacgacgactccaagccctgcacacggctcttcgggcccatgggcaagcaccacgtgatggcacgtgattgatggcaccctgtgtgggccagaaacactggccatctgtgtccgtggccagtgtgtcaaggccggctgtgaccatgtggtggactcgcctcggaagctggacaaatgcggggtgtgtgggggcaaaggcaactcctgcaggaaggtctccgggtccctcacccccaccaattatggctacaatgacattgtcaccatcccagctggtgccactaatattgacgtgaagcagcggagccacccgggtgtgcagaacgatgggaactacctggcgctgaagacggctgatgggcagtacctgctcaacggcaacctggccatctctgccatagagcaggacatcttggtgaaggggaccatcctgaagtacagcggctccatcgccaccctggagcgcctgcagagcttccggcccttgccagagcctctgacagtgcagctcctgacagtccctggcgaggtcttccccccaaaagtcaaatacaccttctttgttcctaatgacgtggactttagcatgcagagcagcaaagagagagcaaccaccaacatcatccagccgctgctccacgcacagtgggtgctgggggactggtctgagtgctctagcacctgcggggccggctggcagaggcgaactgtagagtgcagggacccctccggccaggcctctgccacctgcaacaaggctctgaaacccgaggatgccaagccctgcgaaagccagctgtgccccctgtgattcaggggggcaggggccagtcttgtgctcctggacatgcggtactgaggtgcagacaagggtctccactgtggtgactgggtcccttggccatatcaaggcagcacggcccacccaggcctcccattgccgcaacccctccagtactgcacaaattcctaagggggaagaggagagggtatggggcggcagaccctatcatcaactgtccagtggactggaccttgctcgggttcaagtagagggcataggttaaaaggtaaaagtgcacttattgactcagacaggacactcagcgtcagtctgtttgcaaaggactagcaaacttaaatgaaaaaaaaaattctatctggtttccccgataaataatctacctcacaggggaaaaaattagtacaagagaggcgtggggcagggagtcaatggtgaatgtcaaagcaggctccaaagctggaccccaagctgtcttcaagaatgaccacgactgtcttcagtgttaaaatccatcacctaaagggccgcagcgtcgcagggtttggagagccacatgttctcaggctgccacctgcaggggtggatccatttcaagtatttatgcaaatgtgtctctgaactaaagtgtgatcttatgccaatgc

SEQ ID NO: 130060 - DNA, 1479 bp, Homo sapiens
agcggagttcgctgcgtgtcgaggcgagcacgcgctccgccctggaggctgcggcgacgggtcctcctccgccgtccggtcgcgccctcgcggaagctcggcagtgcgcgtgcgcccgcacccgcactccaaattagaaaggggacgtctagtgggttgcccgggaggggtggcgggagcggtcctggaaataatctgtcctctgtcgccgggaactggcgaggtagttccttcgcggtggagagacctggaatggccaaatatcaaggtgaagttcaaagtttgaaactggatgatgattcagttatagaaggagtaagcgaccaagtacttgtggcagttgtggtcagtttcgctttgattgctaccctggtatatgcacttttcagaaatgtacatcaaaacattcacccagaaaaccaggagctagtaagggtacttcgagaacagcttcaaacagaacaggatgcacctgctgccactcgacagcagttctacactgacatgtactgtcccatctgcctgcaccaagcctccttcccggtggagaccaactgtggacatcttttttgtggtgcctgcattattgcttactggcgatatggttcatggcttggggcaatcagttgtccaatctgtagacaaacggtaaccttactcctaacagtatttggtgaagatgatcagtctcaggatgttctgagattgcatcaggatattaatgattataaccggagattctcagggcaacccagatctattatggagagaattatggatctacccactttactgaggcatgcattcagggaaatgttttcagtcgggggccttttctggatgtttcgcatcaggataatactttgtttaatgggagcttttttctatcttatatcacctctagattttgtacctgaagccttgtttggaattctaggctttctagatgatttctttgtcatctttttattgcttatctacatctctattatgtatcgagaagtgataacccaaaggctaactagatgaaaaagaaaacaaaactgagtttactaggatatctgagctaatgtagaacatcaaacagaaggacccatggcagtataaagcaatgaagcaatggagtattatctcacaaatataaaaccactataagacaaacatttgattatcatttgacaaatacctaggtataactggaattttcatgtttgaagttctaatattaagtttagaattataatgatctacagttgtatcttgattctatgttgtctggaaaaaatatggaattatataaaaagggatgcttttatatatttttcttttccccagaattacttagattaattagatgtatagtaaaatattgttaaatgtcagtttatccatcttatccttctcagcaggtacctatatgataatatatagctgtgaaactcatctaaatatttttgttccaataaaatattatatact

SEQ ID NO: 130061 - DNA, 1959 bp, Homo sapiens
agcggagttcgctgcgtgtcgaggcgagcacgcgctccgccctggaggctgcggcgacgggtcctcctccgccgtccggtcgcgccctcgcggaagctcggcagtgcgcgtgcgcccgcacccgcactccaaattagaaaggggacgtctagtgggttgcccgggaggggtggcgggagcggtcctggaaataatctgtcctctgtcgccgggaactggcgaggtagttccttcgcggtggagagacctggaatggccaaatatcaaggtgaagttcaaagtttgaaactggatgatgattcagttatagaaggagtaagcgaccaagtacttgtggcagttgtggtcagtttcgctttgattgctaccctggtatatgcacttttcagaaatgtacatcaaaacattcacccagaaaaccaggagctagtaagggtacttcgagaacagcttcaaacagaacaggatgcacctgctgccactcgacagcagttctacactgacatgtactgtcccatctgcctgcaccaagcctccttcccggtggagaccaactgtggacatcttttttgtggtgcctgcattattgcttactggcgatatggttcatggcttggggcaatcagttgtccaatctgtagacaaacggtaaccttactcctaacagtatttggtgaagatgatcagtctcaggatgttctgagattgcatcaggatattaatgattataaccggagattctcagggcaacccagatctattatggagagaattatggatctacccactttactgaggcatgcattcagggaaatgttttcagtcgggggccttttctggatgtttcgcatcaggataatactttgtttaatgggagcttttttctatcttatatcacctctagattttgtacctgaagccttgtttggaattctaggctttctagatgatttctttgtcatctttttattgcttatctacatctctattatgtatcgagaagtgataacccaaaggctaactagatgaaaaagaaaacaaaactgagtttactaggatatctgagctaatgtagaacatcaaacagaaggacccatggcagtataaagcaatgaagcaatggagtattatctcacaaatataaaaccactataagacaaacatttgattatcatttgacaaatacctaggtataactggaattttcatgtttgaagttctaatattaagtttagaattataatgatctacagttgtatcttgattctatgttgtctggaaaaaatatggaattatataaaaagggatgcttttatatatttttcttttccccagaattacttagattaattagatgtatagtaaaatattgttaaatgtcagtttatccatcttatccttctcagcaggtacctatatgataatatatagctgtgaaactcatctaaatatttttgttccaataaaatattatatactattggggaaaattcagtatttcttttagtgctagctaagttttgtgcatttggagcagttctgccttttcattctggtataattaattatttgctatcagctgaaactgaaagaagaaacttgaacttcatacttcgatatcatattctagtttacagaacacattttaatcaatagaagaattaagatgaaaaacatggccgggcggggtggctcacgcctgtaatcctagcactttgggaggctgaggcgggtagatcacaaggtcaggagatcaggaccatcctggctaacatggtgaaaccccgtctctactaaaaatacaaaaaattagccaggcgtggtggcaggcgcctgtagtcccagctactcgggaggctgaggcagaagaatggcgtaaacccaggaggtggattgcgccactgcactccagcctgggcaacagagtgagactccctctcaaaaaaaaaaaaaaaaaag

SEQ ID NO: 130062 - DNA, 831 bp, Homo sapiens
agcggagttcgctgcgtgtcgaggcgagcacgcgctccgccctggaggctgcggcgacgggtcctcctccgccgtccggtcgcgccctcgcggaagctcggcagtgcgcgtgcgcccgcacccgcactccaaattagaaaggggacgtctagtgggttgcccgggaggggtggcgggagcggtcctggaaataatctgtcctctgtcgccgggaactggcgaggtagttccttcgcggtggagagacctggaatggccaaatatcaaggtgaagttcaaagtttgaaactggatgatgattcagttatagaaggagtaagcgaccaagtacttgtggcagttgtggtcagtttcgctttgattgctaccctggtatatgcacttttcagaaatgtacatcaaaacattcacccagaaaaccaggagctagtaagggtacttcgagaacagcttcaaacagaacaggatgcacctgctgccactcgacagcagttctacactgacatgtactgtcccatctgcctgcaccaagcctccttcccggtggagaccaactgtggacatcttttttgtggtgcctgcattattgcttactggcgatatggttcatggcttggggcaatcagttgtccaatctgtagacaaacggtaaccttactcctaacagtatttggtgaagatgatcagtctcaggatgttctgagattgcatcaggatattaatgattataaccggagattctcagggcaacccagatctgtaagtaatgctaaagcatgttcaaagttagaggaagacacatttcttctcttttgtaaagtgaggtttacc

SEQ ID NO: 130063 - DNA, 834 bp, Homo sapiens
agcggagttcgctgcgtgtcgaggcgagcacgcgctccgccctggaggctgcggcgacgggtcctcctccgccgtccggtcgcgccctcgcggaagctcggcagtgcgcgtgcgcccgcacccgcactccaaattagaaaggggacgtctagtgggttgcccgggaggggtggcgggagcggtcctggaaataatctgtcctctgtcgccgggaactggcgaggtagttccttcgcggtggagagacctggaatggccaaatatcaaggtgaagttcaaagtttgaaactatatgataatatatagctgtgaaactcatctaaatatttttgttccaataaaatattatatactattggggaaaattcagtatttcttttagtgctagctaagttttgtgcatttggagcagttctgccttttcattctggtataattaattatttgctatcagctgaaactgaaagaagaaacttgaacttcatacttcgatatcatattctagtttacagaacacattttaatcaatagaagaattaagatgaaaaacatggccgggcggggtggctcacgcctgtaatcctagcactttgggaggctgaggcgggtagatcacaaggtcaggagatcaggaccatcctggctaacatggtgaaaccccgtctctactaaaaatacaaaaaattagccaggcgtggtggcaggcgcctgtagtcccagctactcgggaggctgaggcagaagaatggcgtaaacccaggaggtggattgcgccactgcactccagcctgggcaacagagtgagactccctctcaaaaaaaaaaaaaaaaaag

SEQ ID NO: 130064 - DNA, 2134 bp, Homo sapiens
agcggagttcgctgcgtgtcgaggcgagcacgcgctccgccctggaggctgcggcgacgggtcctcctccgccgtccggtcgcgccctcgcggaagctcggcagtgcgcgtgcgcccgcacccgcactccaaattagaaaggggacgtctagtgggttgcccgggaggggtggcgggagcggtcctggaaataatctgtcctctgtcgccgggaactggcgaggtagttccttcgcggtggagaggtacgtccggcgcgcggcggcacgcccaccctatcggggcccgcggagccgcggacggcggggtctggccttcttggggtagctctggccgccgaggctctgcggggcggcgggagtcgccgcctccttccccccgggcccctccctcgtctggaagccccagaatcgccccgcggctgtccggagtcgccggcgacggtggaggggccgacgcggagagcggctctagacctggaatggccaaatatcaaggtgaagttcaaagtttgaaactggatgatgattcagttatagaaggagtaagcgaccaagtacttgtggcagttgtggtcagtttcgctttgattgctaccctggtatatgcacttttcagaaatgtacatcaaaacattcacccagaaaaccaggagctagtaagggtacttcgagaacagcttcaaacagaacaggatgcacctgctgccactcgacagcagttctacactgacatgtactgtcccatctgcctgcaccaagcctccttcccggtggagaccaactgtggacatcttttttgtggtgcctgcattattgcttactggcgatatggttcatggcttggggcaatcagttgtccaatctgtagacaaacggtaaccttactcctaacagtatttggtgaagatgatcagtctcaggatgttctgagattgcatcaggatattaatgattataaccggagattctcagggcaacccagatctattatggagagaattatggatctacccactttactgaggcatgcattcagggaaatgttttcagtcgggggccttttctggatgtttcgcatcaggataatactttgtttaatgggagcttttttctatcttatatcacctctagattttgtacctgaagccttgtttggaattctaggctttctagatgatttctttgtcatctttttattgcttatctacatctctattatgtatcgagaagtgataacccaaaggctaactagatgaaaaagaaaacaaaactgagtttactaggatatctgagctaatgtagaacatcaaacagaaggacccatggcagtataaagcaatgaagcaatggagtattatctcacaaatatatggaattttcatgtttgaagttctaatattaagtttagaattataatgatctacagttgtatcttgattctatgttgtctggaaaaaatatggaattatataaaaagggatgcttttatatatttttcttttccccagaattacttagattaattagatgtatagtaaaatattgttaaatgtcagtttatccatcttatccttctcagcaggtacctatatgataatatatagctgtgaaactcatctaaatatttttgttccaataaaatattatatactattggggaaaattcagtatttcttttagtgctagctaagttttgtgcatttggagcagttctgccttttcattctggtataattaattatttgctatcagctgaaactgaaagaagaaacttgaacttcatacttcgatatcatattctagtttacagaacacattttaatcaatagaagaattaagatgaaaaacatggccgggcggggtggctcacgcctgtaatcctagcactttgggaggctgaggcgggtagatcacaaggtcaggagatcaggaccatcctggctaacatggtgaaaccccgtctctactaaaaatacaaaaaattagccaggcgtggtggcaggcgcctgtagtcccagctactcgggaggctgaggcagaagaatggcgtaaacccaggaggtggattgcgccactgcactccagcctgggcaacagagtgagactccctctcaaaaaaaaaaaaaaaaaag

SEQ ID NO: 130065 - DNA, 1242 bp, Homo sapiens
  misc_feature (32)..(33): n is a, c, g, or t
ttaacatattcttcttgtatataaaaaaatanngcctcagtgattatggagagaattatggatctacccactttactgaggcatgcattcagggaaatgttttcagtcgggggccttttctggatgtttcgcatcaggataatactttgtttaatgggagcttttttctatcttatatcacctctagattttgtacctgaagccttgtttggaattctaggctttctagatgatttctttgtcatctttttattgcttatctacatctctattatgtatcgagaagtgataacccaaaggctaactagatgaaaaagaaaacaaaactgagtttactaggatatctgagctaatgtagaacatcaaacagaaggacccatggcagtataaagcaatgaagcaatggagtattatctcacaaatataaaaccactataagacaaacatttgattatcatttgacaaatacctaggtataactggaattttcatgtttgaagttctaatattaagtttagaattataatgatctacagttgtatcttgattctatgttgtctggaaaaaatatggaattatataaaaagggatgcttttatatatttttcttttccccagaattacttagattaattagatgtatagtaaaatattgttaaatgtcagtttatccatcttatccttctcagcaggtacctatatgataatatatagctgtgaaactcatctaaatatttttgttccaataaaatattatatactattggggaaaattcagtatttcttttagtgctagctaagttttgtgcatttggagcagttctgccttttcattctggtataattaattatttgctatcagctgaaactgaaagaagaaacttgaacttcatacttcgatatcatattctagtttacagaacacattttaatcaatagaagaattaagatgaaaaacatggccgggcggggtggctcacgcctgtaatcctagcactttgggaggctgaggcgggtagatcacaaggtcaggagatcaggaccatcctggctaacatggtgaaaccccgtctctactaaaaatacaaaaaattagccaggcgtggtggcaggcgcctgtagtcccagctactcgggaggctgaggcagaagaatggcgtaaacccaggaggtggattgcgccactgcactccagcctgggcaacagagtgagactccctctcaaaaaaaaaaaaaaaaaag

SEQ ID NO: 130066 - DNA, 1220 bp, Homo sapiens
cttgtttttccctctaccagattatggagagaattatggatctacccactttactgaggcatgcattcagggaaatgttttcagtcgggggccttttctggatgtttcgcatcaggataatactttgtttaatgggagcttttttctatcttatatcacctctagattttgtacctgaagccttgtttggaattctaggctttctagatgatttctttgtcatctttttattgcttatctacatctctattatgtatcgagaagtgataacccaaaggctaactagatgaaaaagaaaacaaaactgagtttactaggatatctgagctaatgtagaacatcaaacagaaggacccatggcagtataaagcaatgaagcaatggagtattatctcacaaatataaaaccactataagacaaacatttgattatcatttgacaaatacctaggtataactggaattttcatgtttgaagttctaatattaagtttagaattataatgatctacagttgtatcttgattctatgttgtctggaaaaaatatggaattatataaaaagggatgcttttatatatttttcttttccccagaattacttagattaattagatgtatagtaaaatattgttaaatgtcagtttatccatcttatccttctcagcaggtacctatatgataatatatagctgtgaaactcatctaaatatttttgttccaataaaatattatatactattggggaaaattcagtatttcttttagtgctagctaagttttgtgcatttggagcagttctgccttttcattctggtataattaattatttgctatcagctgaaactgaaagaagaaacttgaacttcatacttcgatatcatattctagtttacagaacacattttaatcaatagaagaattaagatgaaaaacatggccgggcggggtggctcacgcctgtaatcctagcactttgggaggctgaggcgggtagatcacaaggtcaggagatcaggaccatcctggctaacatggtgaaaccccgtctctactaaaaatacaaaaaattagccaggcgtggtggcaggcgcctgtagtcccagctactcgggaggctgaggcagaagaatggcgtaaacccaggaggtggattgcgccactgcactccagcctgggcaacagagtgagactccctctcaaaaaaaaaaaaaaaaaag

SEQ ID NO: 130067 - DNA, 660 bp, Homo sapiens
ggaactggcgaggtagttccttcgcggtggagaggtacgtccggcgcgcggcggcacgcccaccctatcggggcccgcggagccgcggacggcggggtctggccttcttggggtagctctggccgccgaggctctgcggggcggcgggagtcgccgcctccttccccccgggcccctccctcgtctggaagccccagaatcgccccgcggctgtccggagtcgccggcgacggtggaggggccgacgcggagagcggctctaggtgggtttggcggcggcgaggacaccgccgctccctctagggtcgctcggagcgtgaccctgagaactctccttaatgcaggaggggtgtgcgcccgctcgccaatccgtaaggacaccggccgaccccgggcctgcgtttctcagcgttcggagttgccttcgcttaatggcgaggcggatcgttctggagcttccacctctttagaggcacgaatctgtctgctgggctgccgataaatttttaacagatatagcatacgcagaaaagtgcatacgacatacacgtttaaagaagaattaataaaacacccagataaaaacgaaaagggcattaccggcaccccaggagtttctcacccatgccctgtgctcctttcggagcctgattgtctcct

SEQ ID NO: 130068 - DNA, 1405 bp, Homo sapiens
agcggagttcgctgcgtgtcgaggcgagcacgcgctccgccctggaggctgcggcgacgggtcctcctccgccgtccggtcgcgccctcgcggaagctcggcagtgcgcgtgcgcccgcacccgcactccaaattagaaaggggacgtctagtgggttgcccgggaggggtggcgggagcggtcctggaaataatctgtcctctgtcgccgggaactggcgaggtagttccttcgcggtggagagacctggaatggccaaatatcaaggtgaagttcaaagtttgaaactggatgatgattcagttatagaaggagtaagcgaccaagtacttgtggcagttgtggtcagtttcgctttgattgctaccctggtatatgcacttttcagaaatgtacatcaaaacattcacccagaaaaccaggagctagtaagggtacttcgagaacagcttcaaacagaacaggatgcacctgctgccactcgacagcagttctacactgacatgtactgtcccatctgcctgcaccaagcctccttcccggtggagaccaactgtggacatcttttttgtggtaaccttactcctaacagtatttggtgaagatgatcagtctcaggatgttctgagattgcatcaggatattaatgattataaccggagattctcagggcaacccagatctattatggagagaattatggatctacccactttactgaggcatgcattcagggaaatgttttcagtcgggggccttttctggatgtttcgcatcaggataatactttgtttaatgggagcttttttctatcttatatcacctctagattttgtacctgaagccttgtttggaattctaggctttctagatgatttctttgtcatctttttattgcttatctacatctctattatgtatcgagaagtgataacccaaaggctaactagatgaaaaagaaaacaaaactgagtttactaggatatctgagctaatgtagaacatcaaacagaaggacccatggcagtataaagcaatgaagcaatggagtattatctcacaaatataaaaccactataagacaaacatttgattatcatttgacaaatacctaggtataactggaattttcatgtttgaagttctaatattaagtttagaattataatgatctacagttgtatcttgattctatgttgtctggaaaaaatatggaattatataaaaagggatgcttttatatatttttcttttccccagaattacttagattaattagatgtatagtaaaatattgttaaatgtcagtttatccatcttatccttctcagcaggtacctatatgataatatatagctgtgaaactcatctaaatatttttgttccaataaaatattatatact

SEQ ID NO: 130069 - DNA, 967 bp, Homo sapiens
agcggagttcgctgcgtgtcgaggcgagcacgcgctccgccctggaggctgcggcgacgggtcctcctccgccgtccggtcgcgccctcgcggaagctcggcagtgcgcgtgcgcccgcacccgcactccaaattagaaaggggacgtctagtgggttgcccgggaggggtggcgggagcggtcctggaaataatctgtcctctgtcgccgggaactggcgaggtagttccttcgcggtggagagacctggaatggccaaatatcaaggtgaagttcaaagtttgaaactggatgatgattcagttatagaaggagtaagcgaccaagtacttgtggcagttgtggtcagtttcgctttgattgctaccctggtatatgcacttttcagaaatgtacatcaaaacattcacccagaaaaccaggagctagtaagggtacttcgagaacagcttcaaacagaacaggatgcacctgctgccactcgacagcagttctacactgacatgtactgtcccatctgcctgcaccaagcctccttcccggtggagaccaactgtggacatcttttttgtggtgcctgcattattgcttactggcgatatggttcatggcttggggcaatcagttgtccaatctgtagacaaacgggttcatcagagaagagcagccgtgcaagtgagcagacccatcaagaggctgttgcatgcctggacacacagaactctcctgcctgtacagtcggatgcaggtcagggcctcagcatataccccatgaccgaatgctcccttcagcctcaccacgtttatgcttcacgttactagactgtgtttccatcctttggttctcaggttaaatgttccctcctcactcagactacccaaaagtaggcagtgcaaaagtagtgcaaaagtaggcagtgaccctcccctccccttaccccagggcactctgaggcattcagacat

SEQ ID NO: 130070 - DNA, 2188 bp, Homo sapiens
agcggagttcgctgcgtgtcgaggcgagcacgcgctccgccctggaggctgcggcgacgggtcctcctccgccgtccggtcgcgccctcgcggaagctcggcagtgcgcgtgcgcccgcacccgcactccaaattagaaaggggacgtctagtgggttgcccgggaggggtggcgggagcggtcctggaaataatctgtcctctgtcgccgggaactggcgaggtagttccttcgcggtggagaggtacgtccggcgcgcggcggcacgcccaccctatcggggcccgcggagccgcggacggcggggtctggccttcttggggtagctctggccgccgaggctctgcggggcggcgggagtcgccgcctccttccccccgggcccctccctcgtctggaagccccagaatcgccccgcggctgtccggagtcgccggcgacggtggaggggccgacgcggagagcggctctagacctggaatggccaaatatcaaggtgaagttcaaagtttgaaactggatgatgattcagttatagaaggagtaagcgaccaagtacttgtggcagttgtggtcagtttcgctttgattgctaccctggtatatgcacttttcagaaatgtacatcaaaacattcacccagaaaaccaggagctagtaagggtacttcgagaacagcttcaaacagaacaggatgcacctgctgccactcgacagcagttctacactgacatgtactgtcccatctgcctgcaccaagcctccttcccggtggagaccaactgtggacatcttttttgtggtgcctgcattattgcttactggcgatatggttcatggcttggggcaatcagttgtccaatctgtagacaaacggtaaccttactcctaacagtatttggtgaagatgatcagtctcaggatgttctgagattgcatcaggatattaatgattataaccggagattctcagggcaacccagatctattatggagagaattatggatctacccactttactgaggcatgcattcagggaaatgttttcagtcgggggccttttctggatgtttcgcatcaggataatactttgtttaatgggagcttttttctatcttatatcacctctagattttgtacctgaagccttgtttggaattctaggctttctagatgatttctttgtcatctttttattgcttatctacatctctattatgtatcgagaagtgataacccaaaggctaactagatgaaaaagaaaacaaaactgagtttactaggatatctgagctaatgtagaacatcaaacagaaggacccatggcagtataaagcaatgaagcaatggagtattatctcacaaatataaaaccactataagacaaacatttgattatcatttgacaaatacctaggtataactggaattttcatgtttgaagttctaatattaagtttagaattataatgatctacagttgtatcttgattctatgttgtctggaaaaaatatggaattatataaaaagggatgcttttatatatttttcttttccccagaattacttagattaattagatgtatagtaaaatattgttaaatgtcagtttatccatcttatccttctcagcaggtacctatatgataatatatagctgtgaaactcatctaaatatttttgttccaataaaatattatatactattggggaaaattcagtatttcttttagtgctagctaagttttgtgcatttggagcagttctgccttttcattctggtataattaattatttgctatcagctgaaactgaaagaagaaacttgaacttcatacttcgatatcatattctagtttacagaacacattttaatcaatagaagaattaagatgaaaaacatggccgggcggggtggctcacgcctgtaatcctagcactttgggaggctgaggcgggtagatcacaaggtcaggagatcaggaccatcctggctaacatggtgaaaccccgtctctactaaaaatacaaaaaattagccaggcgtggtggcaggcgcctgtagtcccagctactcgggaggctgaggcagaagaatggcgtaaacccaggaggtggattgcgccactgcactccagcctgggcaacagagtgagactccctctcaaaaaaaaaaaaaaaaaag

SEQ ID NO: 130071 - DNA, 223 bp, Homo sapiens
attgctcctgttattgatttctagtttcaggccattgtggacagaaaataatacttgatagaatttcaatcttcttaaatgcattaagacttgctttgtggcctaacgtgatctatccgagaaaatgttccacgtatacttgagaagaatgtgtattctgctctgactggatggaatgttctgtatttctattagatctattctatttggtctaaagtttagt

SEQ ID NO: 130072 - DNA, 125 bp, Homo sapiens
ggtccccttatgttctgaccattttagtgagaacccaggctgcccctcgaagggcacagagaaacagggagcgtcacagtcagctcgttctctctgtggatttttgagtctccatcctgaagcct

SEQ ID NO: 130073 - DNA, 198 bp, Homo sapiens
tcaaggccactgcaatgggtgacagagtgggactctgccaatttaagggaaaaaaaagcactgcttattcccaacctgaggaaattggtagtttctgtaatggtagtcaggaagcgcacttctttcttatatgttaacagatgacattagtaaaaccttaacctaattgttaacagaatttgctgtagacacatggtt

SEQ ID NO: 130074 - DNA, 186 bp, Homo sapiens
gggacctgcctggcaggagagtttttaaacagtaacatacaggccaggcgtggtggctcacggcaaacctctttttttaataaattacccagtcgcagatatttctttatagcaatgagagaacagaataatacagaaaattggtaccaggaatagggcattactataaagatacctaaaaatatg

SEQ ID NO: 130075 - DNA, 351 bp, Homo sapiens
gtagagaggaggtttcaccacgttggccacgatggtctcaatctcctaacctcgtgacccacctgcctcggcctcccaaagtgctgggattacaggtgtgagccaccgcctggcccttgttagtgttttttaagggttcccctcctcccccttttaaagttgttctaaccatttagaggatgctgtagctaccaggccacttggaacgtacacctgtctgagttgagaccgaagttttaaattcagtcagttcttcatttgtttgtgactttgcggattatgtggggatattttaaaatccaagtttgaggatgttcagcactcactcagtggacctttatgttctcctaa

SEQ ID NO: 130076 - DNA, 163 bp, Homo sapiens
cttggtgataatgatgatgacgcttattaatattagagcactagtacaatgcctgatccatgtggacactcgataggttctagtctgttcctctgttcctcccttttcccctttcccttgtggactttcccacaactcacctctcacccctcactattgagag

SEQ ID NO: 130077 - DNA, 487 bp, Homo sapiens
taactttccacaggtagaaagaatattctcaaatttaaatgaaaaaatcaaaaagtcagagaaaataaacgaaaaccatttcattctcttataaagcctaatatattttctgcttaaaactctgtaattagattaaatacacaaatggttaagaaaaaatttacaaaattaaacaaaaaggaagggctaggttatttttctttattactgcgacaatatgacttcatatttttcataattgtagaaaacaacttgcttttcaccactttaaaagaatattgaaatgtaagataatttaaaatgttgcatataaatgtataccctttacttcctatatccacaaatggacattcccaatgctttccagaatttaaagtgttaagaagtttggcatttagaatgtcagcagatatgcctttgatatgatattacattaagcaaataaactcaatgtaataattttcttagttatatttattatgctcaa

SEQ ID NO: 130078 - DNA, 448 bp, Homo sapiens
aagattatttatttacttcaagagttaagagtggcagtttggggatagcaccaggagatatcagctgtgatggcttggaaaaacagtgtaaactggcagtgtaaacaagagcagggcatgtatgggtagttgagaaaggtgaataggagtatgactagacagaagatagtagggatgacaagtttttttggggggcacagtccaagttggtctggtgtctggaatgagactggggcctaataaaaaggcgtctatacaggagcttaaatgggctgtaccctgaggacaggcctgaattctgagaagggaaagtggtaaaagtattgtccagtccttttgaagttggtggctgagcttggtgaggtgtgtttttaaaagacctttagtccattctacttttcttgaagatggaggaccgtaagggatataaaggtttcactgaaaacta

SEQ ID NO: 130079 - DNA, 256 bp, Homo sapiens
ctcccgagtagctgggactacaggcgtgtgccaccacacccagttaaattttgtacttttagtagagacgaagttttgccatgttggctgtactggtctcgaactcctgacctcaggtgatgttcccaccttggccttccaaagtgctaggattacaggcgtgagccactgcgcttggccccaggccatcatttaatgttaaatgtttttaaagcttttaatgtcaaaggcttttaacttcaaatggacccaaaat

SEQ ID NO: 130080 - DNA, 116 bp, Homo sapiens
aaaggatgagagtaacattttcataggaataaccttgaaacagatcttctataatatgccaaccaagtaaatgtttgcaaacacaggaaattttatgattagtgactattggttgt

SEQ ID NO: 130081 - DNA, 441 bp, Homo sapiens
tcagtgaagggtggtatagatttagcttattttaaaggtttaatatcttagccactggtttggggcttcatttcagtactcgtagcaaggacctcatgctttcgttattaattaatgtttatccttttgttattaattactgtcatgacacctttgctacatgttaggcacctggatagagaagagtttccaggttctgtattactgcctcttcaacacttgtcgggatgccgaagctagctacttttaaattttttgtataaactaggactgactcaaaaaatagaggctttcatgtagacctagaggggcatgaaagaatgaagagctgtttggttgaaagatatgaaatatttacatcccagagataacctgctgtaattcatcccattttctgttgtttcttaatgttaatattttatgcagtcattcacaagtgtt

SEQ ID NO: 130082 - DNA, 479 bp, Homo sapiens
tatgggtaaacctgactggccaaaaaacatgaaaataggcacaacttcaatagcaatcagaaaggtacaaagtaaaacaacagaggtatttttttgcccatcagattggcaaaactaattaggcaaccctaatgctcaggcttagcaagggtggggaaatgaacactctcacagcaattcctggaggtatcaatcagcaaagccattctgcagggcaacttggcagcttccgtttgtacttaatataggtgtgcccctgccgacctagcagtttcacttcttgatagctacaccagcgaaacccttccacacatgcttcagcaagcatatagagcaggggtatccaatcttttggcttccctgggccacatggaagaattgtcttgggccacagataaaatacactaacactggctgggagcagtggctcacgcctgtaatcccagcactttgggagtccgaggcgggcggatcacgag

SEQ ID NO: 130083 - DNA, 820 bp, Homo sapiens
tgctggattatatggtaagagtatgtttagtttttttaagggaaactgccaaactgtcttccaaaatggctgtaccagttttcattcccaccagtgatgaatgagagttctactgctctacatggccaccagcatctgatgtggtcagtgtttgggattttggccattctaataggtgtgtagtagtacttcattgtggtttttatttgcatttccctaatgacttatgatacagaacatctttttatatttatttgccttctatgtatctactttagtgaagtgaacagatgtacaagtctttggcacattagaaaattttggagcatttttaattgagttgttcattttttaattgttacattttaaaagttctttgtatgttttgaataataatctggctataatcacttaatatttccaggagattttttttttaagcttttcttttattattatactttaagttttagggtacatgtgcacattgtgcaggttagttacatatgtatacatgtgccaggagattttaagttagtttttttcagatgagaacagagacagttttcttccttctcaatctgtgtaccttttatttccttttcttattttattacatttgctaggacttccagttcagtgctgaaaaggagtgttgagaggagacatcctcaccttgttcctgatcttagagagaaagcttctagtttctcaccattaaatatgatattagctgtagattttttaatagatgttctttatgaagttgaggaagttctcttctattcctaatttcatgcaagtttttatcatgaatggg

SEQ ID NO: 130084 - DNA, 329 bp, Homo sapiens
ggaagactaaggcaggagaattgcttgaacccaggaggcggaggttgcagcaccactgcactccagcctgggcgacagagccagactgtgtcaaaaaaaaccaaaaaaacaaaatcagaatgctgccagaggagagaaagaaccagctgttcccagcagccttctactagtcagtcccaactaccctctactgcttcagttgccaactgatgttagttttctcacccagtaacttcgttggcttgtgtttttttagccatctgtacacacttgagcttgcaatcctggcatacagtgataaacaaaatagacatggtccccgccctcac

SEQ ID NO: 130085 - DNA, 782 bp, Homo sapiens
ggaactgcaaatgatacagccaccctggaaaacagtttgacaatttcttaacaaagctatgtttattgtatttttattcataatcaccaaaaactgtaagcaaccagagtgtccttcaataagtaaatagataagcataatacaaaaaatccattcaatgaaatactattaaataataaaaaaggatgaagtgtcaagccatgcaaagatatgggtgaatcttaaatgcatattgctaaggaaaactatccagctggaaaatgctacttaccatatgattatattcatatgctattttttaaaaaggctaaactatagatatgcttaacataccagtggttgccaggcattcagtgggggtttgtgggatgggtgacagtagtgaagagatggaacacagaggttttttagggagctgagattattctgtgtgatgctgaaatattgagtacatacactatcagtctgttgcaatccacagaactttacaaaacaaaaagtaaacctaaccttacacagattttttaaaaagtcatttagaggtcaggagactccaagatggaattcaggctgagacaaaaaatatctaactgtattacaaatgtatgaaatatcttatctgaagggagtggaggataacagtggtgacataagtaactttgaaaataaatggagatgagtctgtaatagtaaaggcaaaagaaactacataagcaccatattctagttgaaaagggtgtttacacaggggtacagattaacaatcctcataccactataca

SEQ ID NO: 130086 - DNA, 307 bp, Homo sapiens
gacctcaggtgatccacccgcctcagcctcccaaagtgctgggattacaggcatgagccactgtgcctggcccaggagacttaatatttaaaggctgtcaattatccccaagttaatctagaaattaaatgaaattcagatgaacatcctaagaagttttgaattactcaaagtcttagcaggaaaccaatggcacacacagaagtgttcaccgaggggagtcaatgaaggacctgtttacaaaggtgtggacaaagcttaaggaaaccaagaaaccaacaggggaaggtgaggcaccctaagctag

SEQ ID NO: 130087 - DNA, 338 bp, Homo sapiens
gcccgcctcggcctcctaaagtgctgggactacaggcatgagcaccatgtccagctgagactgcatttctaaaggctccaggtgaggttgctgctgtgatgctgagggtcccaggactgcatatctgctgcagggccttgccctttccaactcctgctgccttcttgacattccctcccctttcactgagcttgtgcacagactgtcttctcccctctgggctacgcacccagtttttcctgtctggaatgagctgctattcccccttaccctacacaccccatctcctctttccccaacagcaccctgtgctgaagccttcgcaggatttaccaggc

SEQ ID NO: 130088 - DNA, 447 bp, Homo sapiens
ggtctcgatctcctgaccttgtgatcggcccggctcggcctcccaaagtgctgggattacaggcgtgagccagctcacccggccacttggtggcttgtttctttcagaacgagaattccacaaaacccaggaaatcgtcttgtgacctagctccaggtctcaaagttatgtctgctgcattcttttggtcaagcaagtcactaaggccagcccaggtttaagggaggggagttagactcttacctttcactgtgaggagtagcagagaatttgcagcctgtcttaaatgttttgtcacatactgtatgtgtttcatcaagtctaacatgttgtgggagccaaggcccttggccccctaaaggtttgctgaaaaatcactggcatgaggcagattggctaatcggagaaaaggcacacacatgtatttaccatgtatacacaggagcc

SEQ ID NO: 130089 - DNA, 857 bp, Homo sapiens
gagggaggataggcagtgaggcagctggttacattcttgtgaggctctgattagcctcagcaaatctacattttacatgtgaaaacctacatttttacatggggaaaaagtaaattatgcattgttgcacacctagtaaatctatattttacataagataaagtaaacatgtgaaaatagggagtagaggctatgacataaagctgtaaaattacagttatctgtttggaaacaaaagcaaagcagtttttctgtgtgtgatccagttcccaagcttaactttcccttggtcatagtgagtttggggtcccgagattctggttttttttttttttttcttcacattattcaaggcaccatacaaaggctcaaaaaataagttgttgtattaaaaatcatacaaatttgtgcatgtggatactgtggtatatgcacaaataaacaaactggttatattggaataatttttactacgtcctacaaatatttacaatatcctaaacatacaacaaaattatttcaaaacagtcatcttctaaaccatggatctttttgaataccttagcagttagtgtggttcatttgaaatacacagaattggaaattacaggcctctgggttcagtctcgaatctgccttgtgtgatgtgtcttcatatgttacccctcagagcttcttctgaggccttattttgtctggttatactagatgacctctaatattccctctagtacactggattccatctcaaaggtcattgcttcttgaagctgtcatcagtaatagaaaagccctattttattttcccagtttatttaaccccaatcctagtaatccccatgcaaatgtagatcaca

SEQ ID NO: 130090 - DNA, 687 bp, Homo sapiens
aaagtgctgagattacaggcgtgagccatcacgcccggccaagaatacttttaagtaggattgcattatgtactaatttttttaactagccagtcactcaaaaatatactgtaaacttattgataccagttttttactattataaaaatagcaagtattgtctaagaattcataaccacccggaatgccaggtttgaatttagaattctaggattcttggaatcactcattcctatccggccacctatattgtcctatactgacaggaaatttgcacgtatatacctggacataacagcctgcacgtccaggctccaccctccagctactacaagttgttaacctcggctattcaacaagctttgaggtacacacagtaattgcataatttggctgttttggcagggcattccagggttcctgagatctaagtgtgggttggaatgaagtgcagtggaacacatcctcttggccggctcatttcctgctcatatgcactaggagaaattcatagaaatgttcataccagcatttgtaagcagaagacaggctgagtgcctttgctcatgtctgtaatcccagcacttcgggaggccgaggtgggtggatcacctgaggtcaggagttcgagaccagcctggccaacgtggtgaaaccccgtctctactaaaaatacaaaaattagcc

SEQ ID NO: 130091 - DNA, 496 bp, Homo sapiens
ggtcatagctgactctagaggataaaaggacgagcagcgaagacacagtcatgagactagttgtgtcatgatacctctcacatcagatgattgagcaagaaaggaaagatctgatgtcagcgtgtaaaggctggatatgggcaccaaggattggggagctcagttcgggagatgtgttttggtctttattaccggcagcccaggggcaggaatactgactgcagctttgggtagtttgaggacacatctgaaagaggtgagctgaagcctttcagttttcagctgtacttgcattaaagcaaggcttgtccctgctggggtacccttcattcctcgacctcactgactggtgagtttcttccatttcatgagtaatgaccatctgtgggcacagagcttcgtcatcttactgaatccccgccctttgcaggggtgaccttactgtcacttacagatgaagcagctgggactttgggaggttcagcagcttgcccta

SEQ ID NO: 130092 - DNA, 745 bp, Homo sapiens
gtggggagtgacatgatgaaggaactgtttaggaaaatcactccaacaatgatattggaggtttggtaggaaacagtctggaagcatgcagctgtatcaagcagctgttggagtgatccacagtgatcagacttgggctgaggttatggcagaattaatgaaaataacccaatcttgaggatactttgaagaaataaacaatggtgtatggcagactataggagaagggcactggtaaattgtccaaggtgacatcttgatctcaagcttggaaagctggaagaacgctggtatcaccgagaaatgagaaagttggtaacttggataggaaatgcattttcgaaaaattgtaaaatgtatttgagattatggtagcttcaattaacatttttatatatatttttaaaacattctaggccaggcgtggtggctcacgcctataatcccaggccaaggtgggcagattacttaaagtcaggagttcgagaccagtggggccaacatagtgaaaccctgtctctactaaaaatacaaaaattagccgggtatgtggctataacccaactacttgggaggctaaggcacgacaatcacttgaacccaggaggcagaggttgcagtgagccgagattgcgttactgcactccacactccagcctgggtggcagagtgagactccatctcaaaacaaacaaaacattctaatcttctagcattcctacttttgaatatacaccagaaataa

SEQ ID NO: 130093 - DNA, 150 bp, Homo sapiens
tttcacctcagcctcccaaagcactgggattacaagcatgagccactgcacccagcccaccgtatttcatttccaaaataactgagaagtcatggtcatcacgctcttttttttgagatggagtctcactatgtgacccaggctggagtg

SEQ ID NO: 130094 - DNA, 493 bp, Homo sapiens
gaggaaaaaggcaaattaagttgtgatgaggggagaaaagtcagcaaaaacctaaatacatatgtagtttcattatattttatagaatcttagccaattgctgatagaaagatttacatagcaatcccacactcagtaaacatgtaatgagtaaaaaataaatgtcttctgttgctttcttaagctaagaaaaaagttgggttgcttatttatttagctgatattggtttaaaaataatgttcaactcctactagttgtaaacagtgtactggaccgtaaagatgcaaaagtaggcaagaaaagggacaatcacagcatgatattaatgtaacaagcctcacttaggggagcacagacgaagagtgcaacccagtaatccaggcaggagacatcaaggaactctttccagcagtgtagggtttcgaatggcatctgaatggctgaacaccaacagttcacctggtgaggcaaggaagggggcattggctgggt

SEQ ID NO: 130095 - DNA, 572 bp, Homo sapiens
tgcagtttttctacttctcaatagatgtcatggctataatatggtaaagttgactctgaagactacattgaaaatgacatcatcacttcagatgcaaattcaagcatgccatcaggatgggtgtttcttggaatttcccagtttcactcagatactaccttcactgttatttgccatagtttttatctacctattttatttccttaatttaaaaaaatcagtttatgtttattaaatatgactatttaaaaagacaagtatataccactgtcataagtcaatagccagttatcatttcctctatatataatctgtagaaacaaatattaaatggtataattaaatttgagctttgataccattgtctgataaaatccctgggcctgaaagctgttctatctttgttataaagatattctgcttcatgaaattagaaggataaaaaaaggattaaagagagaatactttctcactgtgtgaaaaaatgctgcgtctgggaaccgcaaaaaaaaattcttctttctcatacttaacaaaaatatcaactgaaaccaagtcttagcgacctggat

SEQ ID NO: 130096 - DNA, 398 bp, Homo sapiens
tgggcatggcccagcagggtcaggtgtcacctctgttctcccagtggggagttgatttcttctctccacagatcatgtctttaccctaccagggtccagtccaggctgaactagaaccatcacatcacctctgaactgaacagttgaggggttggggcagataccccagtgggacttcatgtcatttttctaaaccaataggactgggcagtcctcgctgggattgccctggacaatacaaattgggatttgtattgtcacttgaggaaagtcattggtgctttgagtgaggagtggaggggaagatggggtcagaggcctactgatagagcaatgaaccctgctgtggaaggatgcaactttgatcccaggcttcactttgggatcgtgagagggct

SEQ ID NO: 130097 - DNA, 1085 bp, Homo sapiens
ataaagacttaaatatgtactaaagaggtgaagctgttaaatggttaggagaatatcgttataacctcaggataggaagattttgttgtataagacacagcaagtacaaactacaaaagaaaagattgattacttaaactccactcaagaacttctgttcatcaaaatacgtcataaggagtctgaaaagcctgtaatcctagcactttcggaggccaaggccggcagattgcttgagcccaggagttcgagaccagcctgggcaacatagcaagaccccgtctctaaaaaaatacaaacattagccaggtgtagtgttatgtgcctgtagtcctagcttcttgggaggctcaggttggaggattgcctgagcctggggaggtcgaggctgtagtgagctgtgattgcatcactgcactccagccccgttgacagagcaggacacagtctccaaaaaaagagactgaaaatataagctacaaagtgtgagaagatatttacaaaatatatacctaaaaaataattagaagtatctagagaattggtatgaatcatcaagttaaagacatcctaatagagaaatgggcaaaagatatagaaagatattttacagaagaagaagtacaaataatttataaacttacacaaagatgctcaatcccatttgtaattagaggcatataaaccaaaaccacaatgagagtggcaaaaatttaaaagtcacatcatcatcttcattgcttctgtacatggaagtacaaattggtatataccactttggtaacagttggtcagtacctaataaagttgaacttatttgtattctttaacctagtaattttactcctagaaaatatactttagagaaactattacacatgtttactaggatacatatacaggagtatttgtgacagcactgttcataatcttaaaaaagacaagaaacaatctaaatatacataggtagagtggatcattgaagtctggtatattcctaccatggattactatgcagcagtgaaaatggatgcaccaaggcatacactgaacaaaaggatgaatctcaaaaatacaatgttaag

SEQ ID NO: 130098 - DNA, 316 bp, Homo sapiens
ggcatgtgccaccacatccagctaacttttgcatttttaatagagacggagtttcatcatgttggccaggctggtcttcaactcctggcgtcaagtgatctacccgcctcggcctcccaaagtgctgggatcacaggcatgagccactgtgcccagttgattcagactcttaaaagagcctgactcctagaatgttagacctatcacctagtctgatttttccatcacatagataaacaactgaagcccagagaaggaaagggactcacccaactaggtggtggtcggcaaaagagcccaggccccaaagttataa

SEQ ID NO: 130099 - DNA, 480 bp, Homo sapiens
tcacagacacctataaatgacatttaaccaggtatctgggcatcctgtggcccagtcaagttgacacataaaaataaccatcattaccaggtttcttaagagaagcctagaaatctatatttttatatgaatttttccaattttcaatggcttagcaactaatttagttttattttgaagcatcgtgagtgacagaccacatctgcaggctaggtctggttcttgggtcactaatttgtaacctctagtctaaaatatactacccaccagccttattgcacacagagggctaccggacacagagtatatatgaactaaaaatctccagcagtgatgtttgcattctgtcattccacccttctttttttgcactactcttttggaacatgttcagtgtatctgagttgggttatagttaggtgatatggattagaagtggcttgtcactgcttactatttatgtattgtaagatgctcgtg

SEQ ID NO: 130100 - DNA, 183 bp, Homo sapiens
gggtcttggatctggctttagaatgactcaggttgaacacataaagccgtaaggtaaagaggacatcatccatagcaggaactggcaatttacagggctgggagacttaaccgtcccagacgggtgagctcctgatactcaagttagcgctgactcagcgagggccttgaggcttgactcaca

SEQ ID NO: 130101 - DNA, 381 bp, Homo sapiens
ataatcttctactgtatcctaggaaagaacttaacaggatacctgcaggaatacatggtagacaagtgttaaggacaccatcctcacttacatggaaatataaagatctaatggtctgattgtgggaaacacactttctcaattagcaggttacagcacggttccattaatgactattgttaagcttgattgtgagctcattacagaaacctaaaaaacacattgctcaagtgtgtttaaggaaacaatttgttttacataaaaaaagacaagacacaaataattctgggcacttccatcagcagggaaccttcaacactacttggatttgccatgacttcaatgtcaacaatgtagtggcaccatcatctcttgatgatg

SEQ ID NO: 130102 - DNA, 757 bp, Homo sapiens
aggaaaaatcagaaggtagtctttataggaagctattccagcagtcttaaggtaatgaagtccagaccaaggtgctaaataaatggaaagaaataggtaaacatgagcaatggcttgggagataaaattgctcaaagttggtaatttgagttgggactcagtagaaaatagattcagctgacgtttatgagcattgtattagtaaggccttgttgaacacttttacatacaactttcaagactaggaaactgggaaaataagagtgtctttaacaaagttttaagagttatttttagtttggccttagatgtacatacatcttttaaaaatctaacatagtatgcacatattagactcttcgttgatggttatttcaaagtagtaacatcatgatacggaggacaaggataatatcttctttaggacttgttaaaatgaaaaggatactgtatgtgggcaagggataaaaatccattttatttttatggtctcatattgattgcatttgtaaaatttgactccttatatattcaaatgcctcacatgttcttaatagaatgtcttttaaacaacagcgtagtatagcaaaaagaggattggactgaaagttgggaaacctgggtgaccttccggctgacatagtgggtggccttgggcaagtcacttatctctctgttcttcatttcttccatccaaccaaacaaaaggaggagctaaagttttacatctccaacatgacaaggtcattgatgataa

SEQ ID NO: 130103 - DNA, 327 bp, Homo sapiens
gtcatattatttctgtatctggaaagcaagcttccagcagtccagtgtgctgttggagcaggacaagaatccacatcgggaagccaccacttcctgagtcatattatttctgtatctggaaagcaagcttccagcagtccagtgtgctgttggagcaggacaagaatccacatcgggaagccaccacttcctgagtcatattatttctgtatctggaaagcaagcttccagcagtccagtgtgctgttggaaggcagcacctttattaaaagaaaagaggtgttagggcatgagactcacctgccatgcctgctgtgtgagggacgc

SEQ ID NO: 130104 - DNA, 330 bp, Homo sapiens
tcaaattaactgacagacaagtggaatccttatgtatgttaaataggaaggaagtcagcctaagatgaaaagacaccacccaccaatgataattcatttaagtagacagttataggaaagcaataaccatgatgtcatgtggctatatgggctctgaagtaagactacatgagctcaaatcctaggtctaccagttattagttgaatgagctttgttaagttatttaacttttctgtgctcagtatcctcatgtgtaaaatggtaacaaaacctacttcaagttgtttcgaggattcaattaagttaaaccatgtatgtgtttagaagag

SEQ ID NO: 130105 - DNA, 340 bp, Homo sapiens
gatcctatcctacattcaaattagaccactttatctgtttctcatagctgttatttggacttcgtttttctctctgccacctggcctgacctctatgacattttaagtctgtttaccacctcttagctgcctaccatggaaagcaaaagactccaacacatccaagttccagagccctttagatgcccagtttcctacaggaggcatgtctccattcttcctactttctgagattctctctagtaaactcagtcatgtccatttcttttcccactcttcctactttccagagaaatgttttttccttggcttagaatagaaaaatacttcaccacatata

SEQ ID NO: 130106 - DNA, 266 bp, Homo sapiens
attgccaagcagagaaaatggcatgattagaaatataattttaaataccggttttcagagattttgtacctgtcaaggctatgagagaatttctgaattagcataccagttcctccccgattttccaagggcctgaagaaaccagctcccttcccactcagcctgtggctgtggccatgactgccctcctctacccgcacctggcctggggagtaactcagccgcagggcctcaatggcagcgtgcagagggttggaccgcagtgc

SEQ ID NO: 130107 - DNA, 424 bp, Homo sapiens
ttcacaacaaagctgtgagaggtattatgcccattttacagatgaggaagctacactgagagttgtgacaggtgtccaaattcatgtaagtaataaacgctgaaactgagctttaaaccaaatccttataaaacttccatatatgtgtttccataactagaagaagcattgtatgtttttaactaatttagcagtcttgtaggaatgcattcattaaatcagtgcactttatcagaagatttattttttagccaggctggctacaattatggatcatgccagatgctcaatggagggaggaagtgagatgaagtaggctaaagagaaataatcttggtcagattgaagaaggataagcactcttaattgtcaatatcaaatgaaaggagaaatatgaccttgatgtgaaggcttaaggcagggt

SEQ ID NO: 130108 - DNA, 221 bp, Homo sapiens
tatggtcctccagaaagacacacctggactaatttgaccctagaaactgcacggttctgagacatgctctggaccagcctgagctagagcagatgtggtgagggcggcgccaggggcataaagtgcagcctgggaaaggcagtaggtggagccgccagccgcctgtgtgggcagccaggatgcctagcacttgcacatttgttccatctgtgctgggggag

SEQ ID NO: 130109 - DNA, 353 bp, Homo sapiens
tcccaggttcaagcaattcttctgcttcagcctcctgagtagctgggattacaggtgcctaccaccatgcctggctaatttttgtctttttttcagtagagacgaggtttcaccatattggcagattggtctcaaactcctgacctcaagtgatccgcccacctcagcctcccaaagtgctgggattataggcgtgagccaccgcccctggcccatttactgtttaacatctgggatcacaggtgtgagccaccatgcctggtcaaccccgtcttaaaaaaaaatcaaaacaaaacagtaaattgcaatccaggtcttctcattccaaaccattagccgatgtgtagtattgc

SEQ ID NO: 130110 - DNA, 404 bp, Homo sapiens
aatagagaaaagagatcagaaagcagtatcaacccagccctgctgagtttttccaaaggagatctcccaggttcttggtaaagacattcctgctttgtacacctggcaagaagctttttaaaaaaattacatcttaaagggacaaagaaaggatttacacgttttgttgttgttgttgttgagacagtctcattctgtcacccaggctagggtgcagtggtgccatctcagctcactgcaaccttcatcatgtgggttcaagcgattctcctgactcagccgcctgagtagctgggattacaggcgcatgccaccataccctgataactgttttgtattatagtaaagatggggttttgccatgttgcccaggctggtcttgaactcctgatctcaagtgatct

SEQ ID NO: 130111 - DNA, 220 bp, Homo sapiens
gatggatttccacatgaggaagtgtcacgaacaagcgttttgcatctctgtcagctggattcccccatgtgtacgtatgtgagaacatgccgtgtttcctgtctgtaatggtagaggcagccctgatactggattttcacctgaggatggatagatcttcagggttcaagtgggtttgcatctggactttagggtggccctgtaggccctgtgtgagaag

SEQ ID NO: 130112 - DNA, 339 bp, Homo sapiens
ttttaaatttattgtagagaaggggtcttgctatgttgcccaggttggtcttgaacccctgacctccagggatctctcctgccttggcctcctcaggagctggaactacagatatatgctaatgtcttcaatttatggaaatgcagaaatgccttttttttttttttttttttttttgagatggactcatgttctgctgcccaggctggagtgctgtggtgtgatcttagctcactgtatcctccacctccggggttcaagcaattttcgtgcctcagcctcctgggtggctgagactacagatgcccaccaccactcctggctaacttttttgtattt

SEQ ID NO: 130113 - DNA, 236 bp, Homo sapiens
cctcctctcagtccgcctctctgagcacttcctacactgcatcataagtgtacgtggaaagatttcttatccttgtatccatacaataccctagtgggtatctagtcccttgctgtggagacaaggatgaagaagacacagatgaatggcttctcccctcctgcctcagacttggcagccatcagaaaatatgcacatctggctgggcgcagtgggtcacacctgtaatcccagca

SEQ ID NO: 130114 - DNA, 435 bp, Homo sapiens
gatctcaaaaatgcctatgctaaaacagagtactaaacagtgaaaaatcacgtttggcaatggaatgttttccacaatgtattgaaaagaaacctgattttatttttctccaacacaatatatatatagattcagttatcgatatttattaagcaccttgggttaaaccctgtgtattaatttattctcacgctgctatgaagaaatacttgagactaggtaatttataaagaggtttaattgacacacagttctacatggctggggaggcctcaggaaacttacaatcatggtggaagaggaagccaacgtgtccttcttcacaaggtgacagaagatatttttatatcttcactttatccacaaaacaatacataaattaacaataaattggttgtttcattgatcattgcttgctttggcaaatatttctcc

SEQ ID NO: 130115 - DNA, 480 bp, Homo sapiens
gttagtgggtgcagtgcaccagcatggcagatatatacatatgtaactaacctgcacaatgtgcacatgtaccctaaaacttaaagtataataaaaaaaaaattactgactgtggtaaaaggttgggaaagatgtctttcaagatgtttcctaaaacaaaattctgtaataattaaagtgacacttaccatgttctagacacttctaagtgctttacatgtgaacctcagttgaagctcactatcagtcctaagtggtaattatgattgctattgtacccattttacaaatgaggaaactgaagcatagagggattagttaagttgttcaaggtcaggtagctaataagtggcagattccggatgagaactcatcaggctggcttcagggactgtacttcttaaccagtaagaatgttggtttcttaggttgtatatgtaatgtggcttgccctaatattcaaatatttgtattctaatt

SEQ ID NO: 130116 - DNA, 517 bp, Homo sapiens
ctgactcgctgcctctccaccctggagacagggagagggaagaatttcggagaccagggtgggtgggtgtggcccttcacactggtattaaggcctccctcctctcctgtgacatgtaacccccagggcctgcaggtgcccagacagcctgagctcatggcgccctacggggaaggctttgcttagatgtggaaatcaggtagaggacactgggattccctcagtcaatgtccgaaatcaacctttaacctccagaagtgctttaaggcccgcttgaaaagggaaggaaaaggtaaacgttcatggtggccaaagtaataacccccacccccaccaattgctcatgtcctatgttacacagcacaattacataggaagggggaattaagagtgcagataaaattaatgttgctcatcagctgaccttaaaacaagattatcctggagtatctaggagagcccatgtaattacaagcattctttaaaactggaagagggaagtagaaggttaagaacc

SEQ ID NO: 130117 - DNA, 218 bp, Homo sapiens
ataagccacccaagtctatggtattctgttacagcagcccagatggactaagacacttactgaccagacccaagggtcgtgtagggtggtgatgtgctcactaaatactgtgccagtgccattgtagctaggggcagctgtgtgacctgcttctggctcatgcatgcaagagttctgtgtggagtttctgagaaaacctttaaaaggaggtctggctc

SEQ ID NO: 130118 - DNA, 349 bp, Homo sapiens
ctgaccacaccagtgcactccagcctggttgacagagcaagaccactgtctcctgaaggggtaaattcagacaccagttgattatctaggatttacttatagaatatcgatcctggaagggtagggatgctgtttgtagaatgaattattgcctgtatcagtctcctctaccgtgatttgctgaggagagcagcagggttttattagagaagggaagctgaagcaactgaaaccatctcacgtggctcacagccacactagcaggattggttcagcagatgtccttggggggcagggatgggaagcaggtctcagatcactcccaaagtttttacatctgggggttcca

SEQ ID NO: 130119 - DNA, 414 bp, Homo sapiens
cctcccaggttcaagcgattctcctacctcagcctcctgagtagctgagattataggcacgtgccaccacacccagctaatttttgtatttttagtagagacagggtttcaccatgttggccaggctggtcttgaactcctgacctcaggtgatctgcccgcctcggactcccaaagtgctgggattacaggcgtgagccactttgcctggcctggaggacatttttaattgccacaacttgtgggagggatgctactggcagctcgtgagtggagcctagggatgccgctcaatatcctccaatgcataggacgccacccccactaccacagtggagaattacttggccccaaatgtgaacaatgctgaggtcagaagaccttgccgtagcatgatggacttatgccatcact

SEQ ID NO: 130120 - DNA, 509 bp, Homo sapiens
taaggcaacggctgttcaagaggtgggatggagggtatgggttgcacatgcagaatccccctgggcttcgtgaagaacccagggcaccctgggctcagcaggaaggaacacactcaacagcccagggtctgtatatgaggggcaaagagctgactgccaaatcccagccaggatgtgactgtgccctgcccagttccctcaactccacctaccccatctccctcaactccacctaccccatctccctcatgctgccacccccgactgtcactgcaccgaccggccctcgaggacctgctcttaggttcagaagcgaacctcacgtgcacactgaccggcctgagagatgcctcaggtgtcaccttcacctggacgccctcaagtgggaagagcgctgttcaaggaccacctgaccgtgacctctgtggctgctacagcgtgtccagtgtcctgccgggctgtgccgagccatggaaccatgggaagaccttcacttgcactgctgccta

SEQ ID NO: 130121 - DNA, 325 bp, Homo sapiens
taaggcaacggctgttcaagaggtgggatggagggtatgggttgcacatgcagaatccccctgggcttcgtgaagaacccagggcaccctgggctcagcaggaaggaacacactcaacagcccagggtctgtatatgaggggcaaagagctgactgccaaatcccaggatgcccagggaacctcacccaatctgccgaaagaatgtgagaatggccattcccttctgtgaaattccaggggtcggtggggccaaacctatcatggcgggtcctgtgactcttcagcacagggcactgcaaatgatttcccctgtggaaagccagg

SEQ ID NO: 130122 - DNA, 139 bp, Homo sapiens
ttaatgatcttcttagcaatccgatgtctgctgcacagggtcgctctttgatctctaaacattaagtcagtactgaggctttcagtcctattaccttatccaataatttctaaaaaacgggatctgatggcaaataagt

SEQ ID NO: 130123 - DNA, 404 bp, Homo sapiens
gctgggactataggcgtcggtcaccatccctgtctaattttggtatttttggtaaagacagggtttcaccatgttggccaggctggtcttgaactcctggcctcaagtgatccgcacatcatggccccccaacgtgctgggattacaggcgtgagccactgcgcctggcctgcagttccctcctgactagggctttctgtgccctgatgtcctcgcttcccatccctgtcatgctctcctccctctcatgaccttcaatcatttctcttatccactgcctcaccatcatggtctgctgaagctgcatgtctgccttcatctacttgagagtcctgcagtgtgtttaatgtggggcagacccaacatgctgtgcataatttgcagataggttagagcaaagataa

SEQ ID NO: 130124 - DNA, 325 bp, Homo sapiens
agaaggtggcccatgggtggagagccacggctgtgctcaccactgatcactgcaactcagtcctctatgagcccccttcccttctctgggcacgtggaatcccagagcaccgcatctgaaacagtggccagaggagataaggggagaggccatgagggtgcctgaatcctcccacagccgggcaagagaagagggttccaatggcttgagagttggatgatgggactcagccaggactctggctggctggggctgctggtcttgtgtctttctcctctcccgtcttattactcctatcaatatgatgctgtgagaagtggtctgg

SEQ ID NO: 130125 - DNA, 228 bp, Homo sapiens
ggttaagtagtaactgtccccaaatcacacagtgttaaagcaggattcaaaagcaagtggctcaacttgatttcaaactctttccatatcatgcttttttcctggagaaatagtgtaagaaaagaaatacaaaggcattgggttatttcagaattaaatgtaatttttgtcaagcacagaaactgtgaagtattcatatgcctgtggtttaatgaaactggaatctgg

SEQ ID NO: 130126 - DNA, 395 bp, Homo sapiens
ttacacagtttagtcagttcgcctcacgtttttcacatttttgtgttttttaaaagtgatttcatagtttaaaaccctgtggatgctgctgaagtgctgtctggtgttcctaaacataggaaggctgggatgtgccttatggagaaaataggtgtattcaaaatgctttattcaggtctgagtagtttgtgttgttggctatgagttcaatgttagtcaatcaacaacatataagttgtctttaaaaagaaagacacacaaaaaggttatacactgatcagttgacaaaaatgtagtgagagacttgtggaaaccctgtatttccccaaggagcaattcggtattcagtattagctaattcagtgttcatggcaactttatagaacattgccagt

SEQ ID NO: 130127 - DNA, 556 bp, Homo sapiens
ggccaaatagcatcttagctctagatagaacagcagcagtcaaaaccatataggaacagtttatgtcatgaaaatcctccaaagtgttagctgagaaaaggactagaagaggaatctctggctgaggagaggatctgtctaggatccagatccccctctgagatactccacttggattttctctgcttttcccttaaaactacatcttgaatgtggttagaaattgtttttctttgatcatcttagagctaaaattggcctgtatctgcaaaataactcctgtagaataaactataacctaatggaatcaattgacaaaatattagtgttcagctaataaacagatggtgggatacaaaatcaagaaaaatgagtaggtttccggattttcctgcactaccaagaaccagtaagaaaatgtaactgggaataagattccatttataaaagaaacaaaacataaataacccaggaatatgccctaggaagaaatgtggaaattctttattatgaaaactcctaaagctttaagtacttaaaagaaatctgtacaaaa

SEQ ID NO: 130128 - DNA, 816 bp, Homo sapiens
ggcatctgaatgttgtcttaaaaaatgattaagttttagagagttggaacctggagggtagcattctaagcagaggaccagaaagcacaaagctttggctgctggaaaatgcagggcatttagttgtctgtggccagtgaggggagaagaaggagctgaggaagttggggcaagatggtaggagcccaaaggtcaggctggctttactgactccacttaaccggtgaagaaactgaggccaagaaggggcaatctggagccccattatgactttggtgagccccaggcactcttgacttcatgcattccttcctccattagaaaaaaggtaattgaatgttatgactgccttggttaattacagctatctcaatattacatattaaaacctattgttcaacttaaatgttcatttttttctcctgattttaaattacattaaaacatgttcacgggcccctaagagtttctcaggccccaggcacagtgcctgccgggtctaatggagaagctggcctgggaaggaagcagctgccggcccctcagacccctgggctttgtcatgcccgtctgcagcaaccagcagccctgactttcatcgtagtgaggaaaaatgggaaagaggccaagtctcttgtgtattctgatctttggctctggaaacttctataaaaattaaccttgaagtcaatgaactataatggctctgcagcagccggggggtgtgggataagaatgaaagagaaagaagaacccacagtgtttcaacattagaatgagtgtcagcacttgttgaattgtccccaccccagctca

SEQ ID NO: 130129 - DNA, 493 bp, Homo sapiens
ttatatcctcattttcctatctttttaaattttcttcaagtatgtattacttttttaaaaattgggtactatttctttttttaagaaaaaaagtgtttttctgtttaaagagaaaccactagtgcagataaacagctatgaaaaataattctaaaggtactcacaaaataggattttcttcaaagaaacaaaatcctaaatcagataataaatgctgaaaatagaggatctaggaaacagcctagcccctctatcccaattccttccccaagggacatctttctagtcagggtcaaaatactgagaagttatttcccagtggctagagcagatatcctaggagaagaatcaaaaaagaaagaaagaaaagaaaaagaagactacctactgctaatccatttttttttaaataaaggcagtgcaaagacagaaagggttgaaaatgacagctgtggcctttagaagcactggctttcagctatgttttgttttc

SEQ ID NO: 130130 - DNA, 229 bp, Homo sapiens
  misc_feature (13)..(13): n is a, c, g, or t
  misc_feature (31)..(31): n is a, c, g, or t
tggcggagtgcantggctcatgcttgaatancaacacttggccgggtacagtggctcacgcctgtaatcccagcactttgggagaccaaggtgggaggaccacttgaagccaggagttcgagaccaccctgggcaacaagcgacactctgtctctacaaaaaacttaagaattagctgggtgcttggcatgtgcctttagtcccagctattcaggagtttaaggtgggg

SEQ ID NO: 130131 - DNA, 306 bp, Homo sapiens
ctctctgcctctccattttccctctatacttaaacaaatacggagaagagagcaatgtcatcatatgaattagtagagaactcagtcttttctacagatgaaaccatttattacatttattctctaacaaatagatatatcaaactggaaaatcaatgtgaaataaaaatgtaaaagaaatggtcttttccaagtcattaacacaaaatatattttccaaatatagcagctgcagcaaggacagctctctacccaataccagctctcatgagcccagatattgatctctaatcctctcctcccctg

SEQ ID NO: 130132 - DNA, 765 bp, Homo sapiens
gggcgtgcttcctgtgtgcttagtgtggacgggaacgtgaatgtgagtggagcctggggagtgggccagggccaggacttggggagccagagtgtgagctggagcggaacctgcggggcagagtgcggcgtgcgcagcgtgcgcagctgatagcatgtgaacatggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactgggggagatcgtcaccaccatccctaccattgggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccaccccgtcggtggagcgggatcctctagatgacctcgcat

SEQ ID NO: 130133 - DNA, 731 bp, Homo sapiens
tttacatttcctttgtctaggatcaagtcttccataccagggaccaggccaaaaccagactgccactgcccctacttgggccccactgtccccagaaagcagctgctgtgatcatgggcaatatctttggaaaccttctcaagagcctgattgggaagaaggagatgcgcatcctgatggtgggcctggatgccgcaggaaagaccaccatcctatacaagctgaaactgggggagatcgtcaccaccatccctaccattgggttcaatgtggagacagtggagtataagaacatcagctttacagtgtgggatgtgggtggccaggacaagattcgacccctctggagacactacttccagaacacccaagggttgatatttgtggtcgacagcaatgatcgggagcgagtaaatgaggcccgggaagagctgatgagaatgctggcggaggacgagctccgggatgctgtactccttgtctttgcaaacaaacaggatctgcctaatgctatgaacgctgctgagatcacagacaagctgggcctgcattcccttcgtcaccgtaactggtacattcaggccacctgtgccaccagcggggacgggctgtacgaaggcctggactggctggccaatcagctcaaaaacaagaagtgaaagccagacagccctaacaaagcaccccacccaccccgtcggtggagcgggatcctctagatgacctcgcat

SEQ ID NO: 130134 - DNA, 177 bp, Homo sapiens
attttttgaggtaaatttgaaaagacataaaatagactaccctgacaaaaatcttcacagattaaaaatactaatatttgcattgtcatgtatattacaaacagtattccttgtcttttgcttttttgttttgtgtttagtgtttcttgctatatgaaatataacttctttatgcag

SEQ ID NO: 130135 - DNA, 251 bp, Homo sapiens
aagacatcagcttctcattcccagggatgtccctgccttgatattaggcaggacccagatgaaggtatgcagaaaatataggcaatggaggacaaagacacctctttaaatcttctttcttgtggaagccagggaacagagactattaaatggaataggtggaacctctaagattttacttctaatgagataaactttcacttattctcaattcaaatgactcattcagatctgatgtttgaacttggaat

SEQ ID NO: 130136 - DNA, 280 bp, Homo sapiens
ttatatgcaaaaggaaaaacctatttacattaacccaatggcaaggcattttatagactgaaggatcctcctataacattaattcttagtttatgtagcttatactactgggattagcatgtattaggcttcttcaaaactgagatacacctaggcacaccttaaggcatcagagattctggtatgttgtgtctttgttctcattggcctcaaagaacatcttaatttctgccttcattttgttatgtaccctatattcattcagaggcaggacaagcag

SEQ ID NO: 130137 - DNA, 882 bp, Homo sapiens
gctaacagatgtgaatgccttttggaaagtcaaaattggtgttcagatgggagacattatttttccacaccagtcagagtgaacttgtgcatggctgtgtgcgggccaactggcagtggacaatggagtcacctctatttcttgcaaggacagtggtgctgagtgtctattataagggtccgttttccctgggatctggtgggaggcattctttcaggacctgttcagctaaacaatgcctcattgtggacatgaaggactctggaccctgtggttcagggtgaccttttgaacatgcttagcagccattattataataaatatacaaaatgaaaacttgtgataaaatactgtgtgtattccctgcttaccaagcgccagccactgtaccaagtgttgtatattaacgagctaattcagtcctcacagtgacgccatccaggctctctttctccatattagagctgaagaaaaaggagtagagaggttgcgacttgcccaaagtcacatacctagaaagtggtggggtgggttagaactcaggtctatttgattcccgaggcttcctgcccaagcactgtctgtctcaaccctacctggtcaagccaagcagtgaggctccagggaacttgaggtgccttaggtcaggtaggagccccaggtatgcctgggatccagaccatagtgtactggctgccagcgcaggccatctccccttgataggtgggtgggcaggctgccctgagtcagcaacctcttgagcccaggagctcagcatggaactcagctgtgctggtggtggcccagctgccagggtgtttcaaaatagaagctacccctggaaagctctactgcccactgcgagactgttgtggaagaatg

SEQ ID NO: 130138 - DNA, 735 bp, Homo sapiens
gttaaaacagctagagattatttgaaaacaaaactccatctatctaggaaaatgactgtcaacttctttattttttaataacaaaaaggttaacatatgtccaaatgacatgaaatgagcatgatataaacatctagatcagaacctgctgtatggtgtccactaagtatacgttcttatttccttccactctcctccttttccattagtgacacacaatacttgtagagtaccttaaaccttgatacagatatttctcttgtccaaagttcatttggcaccattgatatttaaaagagaccaagtaaacatttatcttccaaatttgctaagatttgtctccgttttggtacaaggctgaaatttggactatcgctttttgtcatttttcttattgtagtggaaggaagaaaactgggccttacttggtttctgagtgccattttataattgttatatttctattctttagttcattatttgagttactctattagtagtctttcctttctctggatagtgagctactttttttatttaaagcttgattttaatgccacttcctctatctgttcctaattaattgcactcctttttggttatgtttcactttgaaagagctttttatgatcatttatgagtctctaagtctgtatttcctgctagattggagccccatgaggttaggttagagatttaaaaaaaaattaaatctagagtaggtgctcaataaat

SEQ ID NO: 130139 - DNA, 170 bp, Homo sapiens
gagcttagtgaactgggcctcacttcgtagtgagggcaaactcacatcctttcactgggtctcaatcctgggccactcgagatgtcaggcagttggcccggagctcggcaggtgggtctggctgcgatgctcacttcccagtgctgctgacctgggtcgaccaccgtgtg

SEQ ID NO: 130140 - DNA, 381 bp, Homo sapiens
tacagcgagacccatggggctcaggccttatgtctctctgttccaaagatgccatgagatgaggcctccatgtcccagcctcaccaccccaaggcctcgtctggcacgtttcctggcactctcccctcgtgccaccttggcctcccgctaaagcagaggaaccccagctccccagctctcccctccctgcaatccctgaaaccaaacagacccatgctctcttctctggttaagggccatgggaacccaggtggcaggtaacagggtgatagccagagagcacagatcaaaggtctggaatctccccaggtccacagagcaagctttcctgccttcggcacatggctttgtgtatcaattgtgtgccaggctcaggctagt

SEQ ID NO: 130141 - DNA, 652 bp, Homo sapiens
gcaatgagccgagatcatgccactgcaccccaccctggacgtcacagtgagactgtcccccctcaaaaaaaaaaagataaaaagatattagattttttatatttactattttaaacattgttttaatgagcatccttgataaatatcttttacatattaaaagtatgaaatttatggggaagagttgtagattgtaggtgatttgtttagttctaaagtatattgttaatcaataattgttaaaactgggtgctactggtttaggaatagtctaaagacaaatcagtagaacaaaacaaatagcagagaaatagccttatataaatagtaatttagtaaataataaattaccttttggaaatgttgctaggatatttgtgcaattcattgggaatacgtctaaatgtcagattaaatgtaagaaataaggtatatgtaatcattaaatttattttcataaaataagcatccttagatctagataatggactgatgatcttcttagaaatcttgtttctcatattttgtgattcactagatagtttctgttaacacttcagggccagaagaaacacacagaagcacacatatatatatgtgtacaaacatgcacacacacttagatgtgtatgtatgttatatatttacatat

SEQ ID NO: 130142 - DNA, 318 bp, Homo sapiens
aaaaagggtcctctaagctgaggaagtgaagattctgggatcctaccctctctaacaccaaggaggagaaatcaggaggttagggccctcccagcctcacttctcctggaccagacccctatttcatcttgattcctatccatctttttatttatttatttattgacagggtcttgctctgttgcccaggctggagtgcaatggcgcgatctcggctcactgcagccttgacctcccaggctcaagtgatcctcctatgtagctgggaccacaggcatgtgccaccatgcccaactaaatttttgattttttttttgt

SEQ ID NO: 130143 - DNA, 592 bp, Homo sapiens
cgtggggtttccatgataaccactctgcaacagactcccagagtcatctcagccagtctcatctatgtccagtcctcaatgcccacatttcaacatgttcaaggctgtcatcttccctctctacgttggtcttgctgcggcttctttagagaaattatcaagactttggagtcatacacctaggttggaatcctagttgtacacttttctgtgtggcctttgaaatgaagtccttttttctcatgttctgtgaatgctaccaatgctcattatacaataagcacttgtcaaatgctggtctccttccccattttttattagcatgaacatttcccctctctagtgggcttggaatcatctagtttttcattgtaataatgtacgttctcctcctctacacctccgcaagcccatttctctggaaacacctctcacgttggtcctgtcctttcaatattaagggatgtcatctgggcccatgcaaccagtgtctctgcctacccgatcctctctgcccgccactactgcctgaagcatgtttcagatcatattcccacccaaaaactgccagtgcccccactctcagttccat

SEQ ID NO: 130144 - DNA, 360 bp, Homo sapiens
agctctctctgtgggggacgtcctgacgctctctctgtgggggacgctctctgacgctctctctgtggggggggctctctgacgctctctctgtgggggacgctctctctgtgggcttggaatcatctagtttttcattgtaataatgtacgttctcctcctctacacctccgcaagcccatttctctggaaacacctctcacgttggtcctgtcctttcaatattaagggatgtcatctgggcccatgcaaccagtgtctctgcctacccgatcctctctgcccgccactactgcctgaagcatgtttcagatcatattcccacccaaaaactgccagtgcccccactctcagttccat

SEQ ID NO: 130145 - DNA, 562 bp, Homo sapiens
acccagagaaatgcttaaatccaccagtataaatgcttaaaaattttctttgttaaaccagaagggcatccttgacacaccccttttttcctacatgcacgaggtgaagaaaaacgcaggagcctgctagattttaagaatcaacatacagagtttgagactttatgcctcatttaaagtaacaaggccgggcacggtggctcacgcctataatcccagcactttgggaggccaaggcgggcggatcacttgaggtcaggagttcgagaccagcctggccaacataggcaaaccccatctctactaaaaatacaaaaattagctgagcgtggtggcgggcacctgtaatcccagctactcaggaggctgagccaggagaatcgcttgaacctgggagatggaggttgtagtgagctgagactacaccattgcactccagcctgggcgacaagagcgaagctccatctcaaaaaatacaaaaataatgcacatttagaaaattattcaatgtacaaataaatatgaataaaataaacatacagccaccatgtggtatcaggtg

SEQ ID NO: 130146 - DNA, 481 bp, Homo sapiens
caatcatgaatccagggcactaatctgcctccagtttatttttagcagaaatattattgaagtcttttcagtacataattaattttcaaggattgccattaacctcatagtatgagatgggacaagaaaatttttgcatgtaaggtttgagtggaaaataatgatttttaagtagtttgctatgtgtttggtgaggtagggtgttctatggtttttagttttctcagtttgacctaggagtaatgactctcccagccaaacataatccatctttagataatagtggctgtttatatatttaggatgtgtcaacctcctcaaggctgggaagtatcaaggcctaatataatatttggctttcatgttctgggtgtgcaacaagaggaccaacagtcttgttagctaaaatcaacccaaagtattagagtttggacatgaacttggcctgcccatgccagagggaatacccctgtgaaaagta

SEQ ID NO: 130147 - DNA, 365 bp, Homo sapiens
ggctgtgtatccttgaaaatgcctgttctcaaagtgtaatctttgatgatattgtcagaggaagcatgtaggtagcaaagagcaggagggggagcccctgggaaatcccacacccccagggaccacccaaatcaggcatgctagatataagcagagaggaggggaatcacctaggtagaaagaaacttccattatgatgcccaggaatcattcactttgcagttatcctgtcagaatgtagctagatagatgctgatagggcaaaggggacattcctaagcaaaacctggcaccgtatgtacacaagagggcaaacaagaaactcctaagagatacccaggtatcataagcacagatttaaccac

SEQ ID NO: 130148 - DNA, 569 bp, Homo sapiens
gagtgtttttatatggtagccagtctgaatccatttgtgatgatgatgaaaaacacaacagatagctggatagttaatgtaggaaactttgctttatgaaataaaattttgagaaagctaaatatattttcctaacattgaatcgcttacgtgtgttttatgtaacaacttattaatctctaatttttaataagtacagctattatttataaaatattttagcttataaataattttaacacactatatcatttgatctcaaacatgtaaaaatacttattacacaaaggaggaacatagagttaccacttgatttcagttgtgtttgctgactgacgtagggtcaaagaatacattagtagcactactgaaacataactctatggtatatgattctaaaacctgtgtttttcccactatgctatatgtacattcttatttcatgaatttagactacatttaataactgacacacgtactatttgttcaacaacagttaagttcttaagaagtaatgatggtgcaaaaagaaaattttaatcttgcctaattcttaatgtaatcagtaa

SEQ ID NO: 130149 - DNA, 528 bp, Homo sapiens
ttttttgggccagtagcaattttattaatgataataaaataactcaaagatattatcaaatctaatcttgttcaccttcataagtgctcaaagcaagacaaaaactcatcaaaagaagaaaaattagaacaattaatatttttaattgaaggatggctgagacactacgtaatgatgttggcacatcatatagtaaaaagttaatcaaaacatattaaaaataatgagaggagtgcacgtccttgttggccatatttctctcttcagatttttatgaaacatttatgacgtaaaaatctttttctcatgccaaaaatgattaaaacttgttttttaaaaagaatgcttagatatcatgtctttcatggccatctctaagtcctctctgaatttctaaaatttcgaatgccaatacatgaagaaaataattgtgtgttactttatagaatgtaacaaagtttgccagagcatagaaaccacatataaaggatggtttccactacaaaaagagttcaatgtcgggacagg

SEQ ID NO: 130150 - DNA, 643 bp, Homo sapiens
aaataaaggtgaactaaatacattgccagataaataaaagctgaaggaatttgttgccagcagacctgccttacaagaaatactagagagatttttttaggatgaaagcaagcaatatcagacagtaatctgaattcacatgaaaaagcaaagagtgcttataaaagtaactgtgtagttaattaaagagcacaaaacaatagaatatttcttcctctttctattcttaaccaatttaaataacataaagcaatatgtatttgtatataattgcatatatatatattgatttatcgttgtgcttataacatatacaaatgtaaaatatttgacaaaaaatagcacaaaggaggtggatgggaataaagttacattggagtaaggaaatgacgccagatagtaactcagatctacagtctgaaatgacaattaaaaaatggaaaataaaaaggttaatgaaacaaactctgtaaatatgtgcttgctctgctttcttctcttggcttccttggaagatgtaacattgcataaagtaataattataacaatgtattattagattcgtgaatgttatactagaaaatacatgatataaaaagaggaaaaataaagatgggtcaaaggaacaaagaaggcgtgacac

SEQ ID NO: 130151 - DNA, 116 bp, Homo sapiens
ctttgggaaatgctgatgaatgaaacgttgctggagaatggtagttagagttcacttaccatccattccgcgtcaggcatttaccaaacaggctaccacatgctcctcacagaggg

SEQ ID NO: 130152 - DNA, 281 bp, Homo sapiens
acaactcaggggcgagctgctgctaactcaggggcgtgctgctgctgactcaggggccagctgctggggattcaaaaatgaccaagacagggtccccaacctgctctgggggtgttcatcagctccagggagatgaaatttctcttgatggctcctctctgtgcccatcctgctctagaagcctcttcattcactgattggtatttggaccaaccaaatggtttttcctagccccctcctgggctctaaaggcagcaccagaaatttcaagcaagaagctg

SEQ ID NO: 130153 - DNA, 667 bp, Homo sapiens
gattcttgtacctcagcctcctaagtagctgggactacaggcatgtgctaccaggcccagctaatttttgtgtgtgtatgtgtgtgtgtttttagtagagatggggtttcactatgttggccaggctggtcttgaactcctgacctcaagtgatctgcccccctcagcctcccaaagttgtgagattaaaggcgtgagccaccatgcctggccaagcacagattttttttaaatggatctctttaacagttcatacatcaaagcaataaacacacaaacatccagaggaaaaaacatgaggttataaagtagcctagctcagcaccctggtgagtttgttgcaagtctaccaacatgggcctcatctagaaggaatgcccagagtctgggcttggtgctgattagccacactctcatatactttaaatcatctctagactacgtataatacctaatacaatgtaaatgctatgtaagtagtagttgtactgtattatttagggaataatcacaagggaaaaaagtgtgtatatgttcagtacagttgcagccatccattttttttcccagatacttttgatctgcagttaatttaatccacagatgtggaacccacacatgtgaagggccaactgtatatcaaaagccaaaaaatgttcatcaccac

SEQ ID NO: 130154 - DNA, 342 bp, Homo sapiens
tttgtgcagggaaacttccccttataaaaccataagatctcgtgagacttattcactatcatgagaacagcataggaaagacccaccctcatgatgcaattacctctcaccaggtccctcccatgacaggtgggaattctggaagctacaattcaagatgagatttgggtggggacacagccaaaccatatcggtcaggtatcttagacttgttcaaaaccaaaccttaagtttctacccttacctctgaaaatgacatcactattcttccatttgctcaggtccaagtctttgaggtcattcttggctccactcttagtatcacacctcaccagacagcaa

SEQ ID NO: 130155 - DNA, 438 bp, Homo sapiens
agcagatcaaacctctggacagctcactggaggtaacattacctgcaaagtaaggtgtatggggaagcaagtagatagtagaggaatgaaaagtgtgtgagaataatgctttcaaaacagtaggatagtatctgaaaagtatccttggtttttggattttcaaaacaatgagaaaacacagttgcagtggatgaatgtcggaaccttatgaaatgtgactcatctgacctttcagagattggaactgccccacagtgctgttctgctaactcttcttctctgccctctaaagtccctgcttccctttctttcctttttagtaccggggtgtacataatcgatccatcataatcatcagttcatgacatgttctcatcattgatccatagcacggccttgtttttgtatttggtcatttaaaataaatgtctgttttat

SEQ ID NO: 130156 - DNA, 384 bp, Homo sapiens
agcagatcaaacctctggacagctcactggaggtaacattacctgcaaagtaaggtgtatggggaagcaagtagatagtagaggaatgaaaagtgttttggattttcaaaacaatgagaaaacacagttgcagtggatgaatgtcggaaccttatgaaatgtgactcatctgacctttcagagattggaactgccccacagtgctgttctgctaactcttcttctctgccctctaaagtccctgcttccctttctttcctttttagtaccggggtgtacataatcgatccatcataatcatcagttcatgacatgttctcatcattgatccatagcacggccttgtttttgtatttggtcatttaaaataaatgtctgttttat

SEQ ID NO: 130157 - DNA, 306 bp, Homo sapiens
catgcccagcctaatttttgtatttttagtagagatggagtttcaccatgttgcccaggctggtctcaaactcctgccctcaggtgatccacccacctcagcctctcaaagtgctgggattacaggtgtgagccactgtggccgacctactatttttattatttttgagctaggttctcagtctgttggcagactggagtgcaatcatggctcactgcagccttgaactcccagactcaagtgatccttccacctcagcctctggagtagctgggactacagacatgcaccaccacacctggttaa

SEQ ID NO: 130158 - DNA, 399 bp, Homo sapiens
ggatgagttctggatgagggggcaaggaaaatgcttccagccctgtccccatcacttactagttgtgaggccattgacgagtcaatgtctctgcttctattttgctcatctgtaaactgggttgaagtctatttacccaattagcctgcctcacagaggtactataaaaggttagtgaagcaacagagatgataaaagcccacagaaaactgggtatttgcaagtggtgagcatcagattccccgagtttccagggcctctgtgctttgcagaaggaagtgtaggggggcttggttatctttatcttttctgcaggttcttgaactttctgaacctcatgaggggagagctgagtggatgccacaggcacagagaactaccacctctgccctgccccat

SEQ ID NO: 130159 - DNA, 248 bp, Homo sapiens
gtttggggcctaggaagattaatttggctagggccagaggaaggcggtaaaggttgtttgtagagctgagagaacaaacagtattttagaaagatcagttcagcatttctgtatagcttatttaatcctgttttgaaattttgtaacgtctgaattctaaactgacaacaactttaaaatcatcttttattggagtgctacaatcttttcaagtaaatagaatgctctcaatattcctctcccacgtt

SEQ ID NO: 130160 - DNA, 433 bp, Homo sapiens
attaagagacaaggctccagcatcagactctacaagtttagattctgatgctgtttattcccagatgtatctcagtttcctcatctgtaaatttgggataataaatattgctacctcaggtctgtgaaaattaaatatcaagcacagcacctgatctatagacagaaaagttggttgcttcacaaaatgacccgtcccttcctattcaatctcatccctgctacccctaggaactgtttatatgccaagcataattacttacatgcaaagtcctctgcacatgccaagcaatggtccttgtctttgaacatgcttttccctctacctgaaatcccattggcacttcctctgggttgaggttaccttttaccttttgaatccaactctgtgtctcctcttccttccctagttgtcctctccctattagacaaag

SEQ ID NO: 130161 - DNA, 172 bp, Homo sapiens
aagacttttcaagatctctaatatgctgtctcaaaatatacattaaaaatgtgaagggccatagttttcttttacttgtctatttactgaataaggctgaatttcagaaaatgtgaagattgaacaagtttcaggctataacgaaaatttaggggcttttgtgatctggtcc

SEQ ID NO: 130162 - DNA, 468 bp, Homo sapiens
tgtctcaaacaacaacaacaaagttctataagagcacataaatccagtaacgaatatcaaagatgacttttaagttacaatgaagctacgatttggcagatatgagtaggacgtttttaacagtgtttcagagaatggcacttgctaagacccagagaagcacagaagaaagtgtggtgcttcagtcattcataatggctggagcatagctaggttgggaatggtaaatgatgagactagagagataatcagggactggttagtgatgagtcagataaagacagtgagagccactgaaggaagaatgaagtgataaagtttgcattttggaaagatctttcaggctgcaatgtggtgagtagattggaggaaggcaaacctatagcagaaaagcttctaagctattttggatattcaagtgagatggtggcagcctgaagtaagctgacgtaagggattgtttgaacc

SEQ ID NO: 130163 - DNA, 327 bp, Homo sapiens
gtgactggcatgctgatcgtatgactacgtaggacagtctcaggcactcggtcttggctgagtcaacactctgagcagagtgagagccactgaaggaagaatgaagtgataaagtttgcattttggaaagatctttcaggctgcaatgtggtgagtagattggaggaaggcaaaccatgtcttctcagcagttagtgcatttagacatctcccattaagcacagggctcccccctcacttcaccctaccctagataacacacacaggaacataagcccctaaccaaacagaaaggaaatctcagacgtacagggctatcccaagaca

SEQ ID NO: 130164 - DNA, 590 bp, Homo sapiens
tatgttgatttatcaggaaagttaaatgaagaaatcttcaagaggccatttataattctgtttttaaaagtcaaaattgaaaagagttgggccaggtgcagtggctcacgcctgtaatcccagcattttcggaggccgggtgggtagatcacctgaggtgaggcgttggagaccagcctggccaacgtggtgaaaccctgtctttactaaagatacaaaaattagctgggcgtggtggcgtgtgcctgtaatcctagctactcaggaggctgaggtaggagaatcgcttgaacctgggtggcagaggttgcagtgagccaagatggtgccatgcactccagcctgagcaacagagtgagactccatctcaaaaaaaaaaaaaaaaaaaattgatagagtttatactatttaatgtttaaatgttttctgtaaattaaacatcaatagacttgataatcatatttcaggaacatttttttccattgaattatttacatatactgttgtactgtaaggctttaaattaattttaatattttattattttaattagcatttgaaatgtatagtgttcaataaatggattgcta

SEQ ID NO: 130165 - DNA, 526 bp, Homo sapiens
tatgttgatttatcaggaaagttaaatgaagaaatcttcaagaggccatttataattctgtttttaaaagtcaaaattgaaaagagttgggccaggtgcagtggctcacgcctgtaatcccagcattttcggaggccgggtgggtagatcacctgaggtgaggcgttggagaccagcctggccaacgtggtgaaaccctgtctttactaaagatacaaaaattagctgggcgtggtggcgtgtgcctgtaatcctagctactcaggaggctgaggtaggagaatcgcttgaacctgggtggcagaggttgcagtgagccaagatggtgccatgcactccagcctgagcaacagagtgagactccatctcaaaaaaatcaatagacttgataatcatatttcaggaacatttttttccattgaattatttacatatactgttgtactgtaaggctttaaattaattttaatattttattattttaattagcatttgaaatgtatagtgttcaataaatggattgcta

SEQ ID NO: 130166 - DNA, 622 bp, Homo sapiens
tgtttagtccttggtggctttggactacaagcctcgtcctgtgggctgagctccccctcagaactgtaccaaggcccatacctcccttctactccagtgtgacctaaggactcagctgggctttctggctgttttttgatatagcccttttttggtgcccattgttttcagaattatatcagtaagcatcagtaatcatcctttgattctatcggagtattctggtttctttttgatctgctttcccagaggagtctgaagatgagctcttatcattggtatttggatgcaggttgccatgtaccaaacaagaatatttcagaattgacctggagtagggctctggatagcaaacctcagctaagccaacaaggctgccatggtgcttaacacccagcctgggtcaactctaggtcctgagggactctggaaggctaagaaaggttatggaataccctaggggttcagtgtcctgttgtgggttttagggatttccatagtttaagggccttggtgattttcttggaggaattcataacattttaggacggtgacaaaacccagctccatcctggctttccctaccaccccaagataaagggagtcaccacagcccggttct

SEQ ID NO: 130167 - DNA, 302 bp, Homo sapiens
tcaaagcaggggtataattttcaatgtagaccctcttgtatctatttttgaattacattagtctatttccttttcaaaatttagctaaaaatttttctaaaaccaggaaatgactaacagttgtagctcattaatgggatgttgcgatttatgagtcaaacgactcttcaaatcaccaattagtggcagacactcctaaggcaacgtagaatattaaacacatatttaaaattcaactgttccttttctgccaggatagaaaccagtagtttttgtgtctcttggtgggggagtagagcctg

SEQ ID NO: 130168 - DNA, 294 bp, Homo sapiens
tttcaaccatgggctctgcaggggagaggcatctcctatttactttatgggagttggaagttaattcaaaccataggccccatgggggaagggatgccatccctactgatgtgggggtatgagtggaagacagggttttgcccatggaatctgagtggggatgaagggtgtttctcactgattccctactgtaccattcttctagtgggggaggagcatgacatttttgtggtattcacccccagaacaggttggtatggctgggccaccctgttccaggttctttggctttcc

SEQ ID NO: 130169 - DNA, 323 bp, Homo sapiens
aactcccgagtagctgggactacaggagactacaggcgcatgccacacatgcccagctatttctcttggtatttttagtggagacgaggttacaccgtgttagcccatgttatctgctcaaccaccccatgaagctgcaccagacagcccactttttggatgaggagacaggggttaagtaacttgctcagagccaggcagctggtatgtgtgtgaaggagtggacttccaggctccccttcaccatcttctgagagaaccccaagacacagtgggcatcaggaagggtaggtttctcatcacctctctccccaggctgtgcc

SEQ ID NO: 130170 - DNA, 700 bp, Homo sapiens
gaagatcggtagagaatttcatcaaaggtgccatgagaaataaaatcttaggaagaggatgctcaatagtgatggatgcttgaggagagacagaggattttgcaaactgattaaaggtgatagaaataatagtttctaattaaaactgcttctaattaaaactccttttaatggaaggataatacttagtgaatttgagttctcaaagtactgacttacagtttaaatatgaaagtctcatttttcttctaatagggttagtagagtataattaggcaaacttaacaagtgttgtgcagcacagagattattttaaaagttaagtatttgagaatccactttaatcaaaaccttttagtatgtgagaatataattacattttacaaatatatttgaaattctctttactatatgatggaaaggtatcaaattcatccaacattcagaggtttagtaccctaatgacgttcttatttaacaattaattttaataccaaaatgcaataaaacacatttagctatcttcttgcttgtcctggatattaataaaaatctgaggcttatgctgaggcaggaaaacattcgttaattttatgtcattaaaaaaagaaaactgtactcacttttgttctaatcttaaattttgtctttctttctgtacagtttctacctatttttactgtatctttccagttagttt

SEQ ID NO: 130171 - DNA, 582 bp, Homo sapiens
taggtcaacaaataatatatcaggctaaataaaaccaagttcctgccattagagaggtcacactatggaggcagagagagatgtagaaacataaagaagcatgatcaattccgagatgtgctatgggaacacaaagaatggggcagagaatagctgaaccctgttttatagcaggctggtaagacatgggatgttctaatccctttgaacctcctcctcccagattcatttgaagtggcttttaacccacagagctcttttcactttttttatcttagagggagggatagagggaagagtttgtacagctctgtaagtctagagaataagagccctaagaaattatttctgtacagatacagattggctttgatttaatttaaataaactggctctcaaaaattctaagaatactaactactcacacagttttgctttcatttacacacagatgagaaagcatctgtagctctgcattttatttgctataagcaaaaagtggttcgagatatttaagtatctgaagcttggttgtattgagtcctcacatgtcccagttcagcccactgcagtttttttttt

SEQ ID NO: 130172 - DNA, 233 bp, Homo sapiens
tcataggcagagctcagagaagctgctggggccaaggattaaaagtgaacaaatcctgccaaagagaagggctagttaaaaaaaaattaaaattaaaaagacagaaacaaataaaaggaaacgaagcccagaaggaggaggcccccagggagtatgggaagatggtaaaagtgagaatgagctggtgaatcccagggaagaggatgcctgagtgcttttactgtccttgcaac

SEQ ID NO: 130173 - DNA, 348 bp, Homo sapiens
ctcaaccgcctgatccagaggatccgctcagagatagggaatgtgaagaagcagtgtgccgatctggagacggccatcgccgacgctgaacagcggggggactgcgccctgaaagatgcccgggccaagctggatgagctggagggcgccctgcaccaggccaaggaggagctggcacggatgctgcgtgagtaccaggagctcgtgagcctgaagctggccctggatatggagatcgccacctaccgcaagctgctggagagcgaggagtgcaggatgtctggcgaatatccaaattttgtgagcatctccgtcatcagcagcaccaatgctggggcaggaggggct

SEQ ID NO: 130174 - DNA, 310 bp, Homo sapiens
aacacgtaatttgggagtcccagaagatgaggaaaggggaagaacaaacatttgaagaaataatggcccaacatttaccaaatataacaaacattagagaggttcaaaaaacttcaagtaggataaagtcaaagagatctgcatgtagacacaccatattcaaaccattgaaagtcaaagagaatcttaaaagcaaaacataagaaaatatactcttctgaaggttgtctacaaatctatctgaggcacagtgtggcttcaagattagactttggagtcggttttgtcatgtatgtctttggaggtaatg

SEQ ID NO: 130175 - DNA, 404 bp, Homo sapiens
gggagaagccttcttttaataaaatgtgagaaagcctgtgtgaagcagatgttctggcttgcagaacctcgtggagtctttattagtcacatgtgcattttggagcttccatttgggaaattctgaactgtagtgccacatctttgggaatgcaggaatcttagaataaatgtaggaacatgttctgttctgtactcttcttggtggagaatctagcgtggtatcaggcctgccaaacagcagccggaaggaggctcctcagggaagtgtcttaaacacctcgagatggcgcagctggctaggctcggtgtggtttgtaaaagatagcaatgaatttccatgccaggagcgcctgctctgtgttcacaaagcagtgtgtgtctgctttaatatctcattttggc

SEQ ID NO: 130176 - DNA, 379 bp, Homo sapiens
gatgggtagattggggatgaaagctaatagttacagggtttcttttgggggtgatgaaaatgttttgaaattgaagtgatggttgcacaactctgtgaatacataaaaaccattgaattatatactttaaatgagtaattgtgtgatatgtgagttatacttcgaagctgattacaaaaaagttgtaggaggaggaagggaggaggctaaaagaaaatacagtcaccaatcaaactgtatttatatctgtgaggggaaacatattaattgttctccataggcccttctggctcgcccttcatgacggagcctcaaagcatgcctgcattcctcagtgcctagtccactgcatgcaaataaaatcggatgcccagagcag

SEQ ID NO: 130177 - DNA, 641 bp, Homo sapiens
agaaggaggaaggacagcacagcctacagccgtgctcaggaagtttctggaacctaggctcatctccacagaggagaacacacaagcagcagagaccatggggcccctctcagcccctccctgcacacagcacatcaaatggaagggggtcctgctcacagcatcacttttaaacttctggaacccacctaccattgcccaagtcacgactgaagcccagccacccaaagtttccgaggggaaggatgttcttctacttgtccacaatttgccccagaatcttactggttacatgtggtagaaagggcaaataagggacctctaccattacattacatcatatgtagtagacggtcaaagaattacatatgggcctgcatacagtggacgagaaacagtatattccaatgcatccctgctgatccagaatgtcacccgggaggacggagtatcctacaccttacacatcatacagcgaggtgatgggactagaggagtaactggaaatttcaccttcaccttatacccgaagctgcccaagccctacatcaccatcaacaactcaaaacccagggagaataaggatgtcttacccttcacctgtgaccctaaaagtgagaactacacctacacgtggtggc

SEQ ID NO: 130178 - DNA, 352 bp, Homo sapiens
ctctgtgagtggtttgctgcctcctatccgtcaatatccaatgccctgggacagcgggggaagtgggattccagcctttcatttattctttcacctatttgtcctctttactctgtgtacaaaaaagagaggattatactatcatagactgttgtttctaaacagaaactcaggctgggcacagtggaatacgcctgtaatcccagcactttgggaggccgaggcaggcggatcacctgaggtcagcagttcgagaccagcctggccaacatggccaaatcccgtctctactaaaaatagaaaaattagctgggcgtggtggtgtgcatctgtaatcccagctactcgggag

SEQ ID NO: 130179 - DNA, 527 bp, Homo sapiens
agtgggaacactacactttctcatcaatttttctgtaactctgaaatagctctacaaaaataaagtctactagaaaaagaaaaacgatgaggacaggctaatgacaattcacaccatgactggttgatgaatgaaacatacaacctttcactcaattcatgaattttattttagtaagcctttatggtgcttcgtgagccagagactggtaaaggcaatgaaagttccacaggatgccttgttcaaaagcccatcactctctattttgagaagtgaaataagagctttgattagtatcagtagtgtccggaactcttgcacgaatatgagtgtccaggcggagccttggattgtgggattaccctctgtagaggtgtgtattatcttgacttatatggctagccgtgaggtaaaaaaagattcccagagttttgtgggtttttttttttttccctttgagatgaagtctcgctctgttgcccaggctgaaatgcagaggcgcaatctcggctcactgcaacctccgc

SEQ ID NO: 130180 - DNA, 1043 bp, Homo sapiens
gtatctggggcccttgagctgctgctcagcctgctcccacactgtgaagtgtactttcactttcaataaatctctgctttcctgcttcattctttcctagctttactgtgcgtttgtccaattatttgttcaaaacgccaagaacctggacaacttgctgtccgcaaccaatcagactgattgtgggctgaatcttcatttgcatggaagtgcaactttgtaacttcactttagcctctgattgcgggccaccacttcatttacatgaggcaaacaccaatgcgtttgttcaattctttgttcaaaaccccaagaatctggacaacttgcactcaagaccctctacgggtttggcgagccagtctttcagtggctgttttctagtagctccttggcaattgaggggaactggctgggaccactctccagtgctgtctgaaggccaaggagtgaacagggatggctgccctgccttgaagagggaaggactcttttctatcctttccagctatagtccctgatccctacatgtgatgcggttggcagcggaagctcatcctgggcgaactcacacacttttcaggagacttaaaccttttcttatgctaagttcttcccttcccctactcatctggctaaaggacagactatgcaaaaaaggttatacaagtcagagggtctgagcatgtcggaggtggtctgtgtggggcatggggtggggggaaaattcatgaaaggcaatttattgcctaaatttaaagggttaaagggttgctttaagtgggatagaaaaaccttaaggaaagttcatagtaggtcctcagtggtggagtgttgtgggaagtcagggaccctgaatgaagggactggctgaagccatggcagaagaacataaactgtgaagatttcatggacatttattagttccccaaattaatacttttataatttcttacgcctgtctttactgcaatctctgaacataaattgtgaagattttatggacatttatcacttccccaatcaatactcttgtgatttcc

SEQ ID NO: 130181 - DNA, 1216 bp, Homo sapiens
caaggcttcgtttgaatagaagtgcaactttgtaacttcactttagcctctgattgcaggccaccacttcatttacatgggtgcgtttgttcaattctttgttcaaaaccccaagaatctggacaacttgcactcaagaccctctacgggtttggcgagccagagaccatcaagcttcagatgatcatgtgacagggtttccagccagttccaggtgaagacaccacccctggccatcaagaagtcacccggtctccactagacagagtagggtgagagttccgtgatctccaaccggtagtgattatgccccaagtcagcataaagaagttacggaagaaaaaccatcagtccctctgtctcacataaagacttatggggatcacgtttctcagaggggagatgaggcaggagaatagggtctggaggcagggaacctaaggccgtttcacactgacttcttagaactaaattgaaaggaaaaccctaattttccatgcctaagtaacaaaaggaccagaggctactccctttgcaaacccccaccttttctgtgtggcatatgggaaattgaaagtacctctgattgattgttttctgcaaccaatcagatgtttgcattggagtgtaactttgtaatttcacttcagtctctgattggttgctgcagtctggaaattctgcaggccaagtcttcgtttgcatagaagtgcaactttgtaacttcatcttagcctctgattggttgctttctgcaaccaatcagatgtttgcataggcgtgtgacctttgtaacttcacttcagcttctgattggttgctttccacaaccaatcagactgattgtgggccaccacttcctttacgtgaggtgaacaccaagtggccaatggaaaacctcaagagggtatttggacctgagaagattctgtatctggggcccttgagctgctgctctgcccactctcacatggtggagtgtaatttcactttgaataaatctctgcttttgttgcttcattctttccttgctttgctgtgtattttgtccaattctttgttcaaaacgccaagaacctggacaacttgcagtcaagaccctctaccagtaacactagttgtatccctgtaaatgaatgggctttgaagattttctagaagaaaaagatcacctcattgtccttcattttttgacataaaactgtgatagcccaat

SEQ ID NO: 130182 - DNA, 868 bp, Homo sapiens
gtatctggggcccttgagctgctgctcagcctgctcccacactgtgaagtgtactttcactttcaataaatctctgctttcctgcttcattctttcctagctttactgtgcgtttgtccaattatttgttcaaaacgccaagaacctggacaacttgctgtccgcaaccaatcagactgattgtgggctgaatcttcatttgcatggaagtgcaactttgtaacttcactttagcctctgattgcgggccaccacttcatttacatgaggcaaacaccaagtaggtggccaatgggaaacctctagagggtatttggacctgagaagattctgtatccggggttcttgagctactgcttgggctcactcccacactgtgaagtgtactttcactttcaataaatctctgctttccttgctttgcagtgcgtttgttcaattctttgttcaaaaccccaagaatctggacaacttgcactcaagaccctctacgggtttggcgagccagccagcgagaccacgaacccactgggaggaacgaacaactccagacgcgccgccttaagagctgtaacactcaccgcgaaggtctgcagcttcactcctgaagccagcgagaccacgaacccaccagaaggaagaaactccgaacacatctgaacatcagaaggaacaaactctggacacgctgcctttaagaactgtaacactcaccacgagggtccgtggcttcgttcttgaagtcagtgagaccaagaacccatcaattctggacacggcatgatctcagctcactgcaacctctgcttcctgggctcaagcaattcccctgccccagcctcctgagtagctaggattacaggtgtgt

SEQ ID NO: 130183 - DNA, 503 bp, Homo sapiens
agggtccactcaagacagtagaaaccacagtaggtgctgatgaggacactgaatacagcaggttggctcaggaactgctggaggactgtaaaatacagagaaaatggtgagacagagctggccatggggagctggcattgcccgattccaaacgctcgaagggggccctgcccagctgctgctgcctcctccagaaggttgaggaggggccctgctgggacggggcctgccaacaggggacactcccagctgcgtgattccccaggcagcacggtgaggcaggatttgggaacactgccgaagctggagatgggaatcctggctatggctgtctggacagccctgggtgggcactgccgatggcacagtgcatggttgggagggagctgctgctgcttctcctcctgttggagcctgacagggggcagctaataggagccgtggcatctccactgtccagcccttctttgtggctaagcagcatgtggtcttgtccataggtt

SEQ ID NO: 130184 - DNA, 620 bp, Homo sapiens
cctggctacagtgctatctataacgccatgtctgtagtatcgtatcctgatcgagctgtacactagaatctaaatatttacatatacccaaaattaacttatgctcatatattaggatgtgagaatatcatctgtttatggacacatgaaacctcctaatgacctggaattgttagaatatttgactttttatatgcaaagtttttcaaccaagtggtttgtctaatatttaaacatgtactggcacaatttgtgatgaaaatattagcacatttgcaataatgtttctccataacagagaatgttaatggataccagaattttatttttgtatttatgttcatagtacttttcctcttgtctactccagacagttattccataaagcatttgtataattaaaaggaaaacagaaaaaggaaaagtaggcaaatgtgaaaatagtttcaatatatcttatgatttcttaatgtaaaatgttttgttgaagtatatggctatcatgactaagtgctagaatttatagttacaggcggtgtccttttaaatgtggaaaggcttttaaaatattttaaaactggacctgtattatcctgaatacactattttgaaaattttta

SEQ ID NO: 130185 - DNA, 4270 bp, Homo sapiens
aggagtagggagaagggatgaggtgactttttgggcggggtggggggaacgtctgggcagccagggacctgcccattcactcccctttcccagccccgggagggcgcagcgcccgggtggggagcccgagccagcccaggccggctctggcctcctgacccagacagcgcagggcgcgagggatcgcgcggccgagcccgggtcgcgccgctcccagcatcggggccgctagccaagagttcgaggccttcccgatccggatgtgatgaaaaagagcaacagagggagaagtgtttcaggattgtaggagtggaagaggggaaagagaggcagagagggggaaggccccctcgcaggggagccggctggagtgagctggctggaaagagggggcggagtgcgcggagtcagagccgccaccgctgccgcagttgccgccactgcggcgtctgggctgagccggagggaggcgggaggacgcgcaggggcggccgccgccgtcgtcaggccaccggggcgaaaatgcggccgctgccggaggctcgctaactttccggggcggaagaggaggaggaggaggaggaaggggcttggagcgactacggggggatgcggagaagcagtcagttccctgcacccagcacctcacagcccttcctccgtgcgccctgccgggcggcgagctaggcggcagcggcgcggcgcgggctcggcggagcggcccatgtccggcgcgggcgaagccctcgctcccgggcccgtggggccgcagcgcgtggccgaggcgggcggcggccagctgggctccacagcccagggaaaatgtgataaagacaatactgagaaagatataactcaagctaccaatagccacttcacacatggagagatgcaagaccagtccatttggggaaatccttcggatggtgaactcattagaacccaacctcagcgcttgcctcagcttcagacttcagcacaggtgccaagtggtgaggaaataggcaagataaagaacggccacacaggtctgagcaatggaaatggaattcaccacggggccaaacacggatccgcagataatcgcaaactttcagcacctgtttctcaaaaaatgcatagaaaaattcagtccagcttgtctgtaaacagcgatatcagtaagaagagcaaagtaaatgctgtcttttcccaaaagacaggctcttcacctgaagattgttgtgtccactgtatcctggcttgcttgttctgcgaattcctgaccctttgcaacattgtcctgggacaagcgtcatgtggcatctgcacctcagaagcctgctgctgttgctgtggtgacgagatgggggatgattgtaactgcccttgtgatatggactgtggcatcatggatgcctgttgtgaatcatcagactgcttggaaatctgtatggaatgctgtggaatttgttttccttcataaatatttatcttttgtttgtgttaaaactggagagtgtttaaaaatttccttttggggggaagaaaagcacattgtaagattctcatgaaacaacatggaatttgcactgttaactcattattgtaagtaatctctgaaagcctttttactttaaccaaatctacatggtttaatatgtgaaattttaactactttaactagttttataaatttcttaatatgttacaataacttagggacattttgacaccccccttcccaaatgttaaatgccttctcctttttaccgatatttctgtttcttttaaccgttctcaggagcactttgctccaaatatattatttttcagtgtgtatttaaacgaggcagtttattttgatatgtatctattcatgattgaaaggaagcagtcttggccaggcacggtggcttacacctgtaaccctggcattttgggaggccaaggtgggcagattgcctgagctcaggagttcgagaccagccagggcaacatggtgaaaccccatctctactaaaatacaaaaagttagctgggcttggcggtgtgcgcctgtagtcccagctactcaggaggctgaggcaggagaattgcttgaacccgagaggcggaagttgcagtgagccgagattgtgccactgaactccaacctgcactccagcctgggcaacagagcgagactccatctctaaataaataaataaataaataaataaataaataaataaataaacaaaccagtctttattttaaaagaaactttaggaaacaaacccacataatagttgggaaccagtgttgatctctctcccttaccttctccacttgttcaacagactctgaatgccgactgtgtggactctcttcctcagactgtggggacagatacaattccactcctgtccacaggaacatgagatttagcagactaaggagatctgtaaagaatgaaccataccacaaggcatactgaagtgaggattataagagaaataaactcaaaatgctgttggaatatgcagagaattgctaccagaatattcagtaaggtttcagggagaatgtggcatttgaggactctcttagaatgagtgattcacctgctatttaaatgaattatttagatttttgacaaagatttaggtggacaccctaaactgtgtgtgcctttaaccagttaaaagaacagtgccttcagcatacttttttattagttgtaggaatacagctttttgaaaaagctataaagtttaaattaactaaaaatatgcattttcttacacataatttaaatgttatcatacttttttgatgaaaacataatgccttagtaaaatagctctatttaataaagaagattgagtactctgacacatttcatttaaattaggaaatttttaatattaaaatcccagtgttctgagttattgaaaggctttcttttattttgagagctttaggtctttttgggatgagaacattttagttgtttagtttgtttcttaagcagtgctattttttgtaaacacagataaatggaaaccattcttttcaatgcagaagaaatctagatatcccctactgtgaccaaatttctgtattacgattttatgttaaattaaactaatatggcaggttataatgatccttaagtgtaaagaaatcagtcaattacaagagtaattgtatagttattgagacctatagtgtgtggcttagatgaaagggagagtaaattttcataccatgctctctcctactcagtttgatctctctaaaattgtagtttggtttgatttaatataattcttagtagaaattttgaaagtatgctttgggattaataattatttttaatttttctggctgaatatcaaattgatagtaacaacagaagcataattttaggaaggctttcgcaaacctagccttttaagagaggtttttaacctgaagcatgagaatatatcacctgtggtttttcctttgagatgaaacgtagtttctagttatatcattacttaaagggcttaaaaagaaaaaacttagcaaacttttgaatctttcttttattgctatttacacatacatacacacatacaaaacctttaaattttgggatctgaatataattctggtaaacagctgtcttcatttttctcctctaaagaacttaattcatttgttacataaaatataaggaaatctttatactattttacagtaaccacaatctaaatatttacatatacccaaaattaacttatgctcatatattaggatgtgagaatatcatctgtttatggacacatgaaacctcctaatgacctggaattgttagaatatttgactttttatatgcaaagtttttcaaccaagtggtttgtctaatatttaaacatgtactggcacaatttgtgatgaaaatattagcacatttgcaataatgtttctccataacagagaatgttaatggataccagaattttatttttgtatttatgttcatagtacttttcctcttgtctactccagacagttattccataaagcatttgtataattaaaaggaaaacagaaaaaggaaaagtaggcaaatgtgaaaatagtttcaatatatcttatgatttcttaatgtaaaatgttttgttgaagtatatggctatcatgactaagtgctagaatttatagttacaggcggtgtccttttaaatgtggaaaggcttttaaaatattttaaaactggacctgtattatcctgaatacactattttgaaaattttta

SEQ ID NO: 130186 - DNA, 4768 bp, Homo sapiens
aggagtagggagaagggatgaggtgactttttgggcggggtggggggaacgtctgggcagccagggacctgcccattcactcccctttcccagccccgggagggcgcagcgcccgggtggggagcccgagccagcccaggccggctctggcctcctgacccagacagcgcagggcgcgagggatcgcgcggccgagcccgggtcgcgccgctcccagcatcggggccgctagccaagagttcgaggccttcccgatccggatgtgatgaaaaagagcaacagagggagaagtgtttcaggattgtaggagtggaagaggggaaagagaggcagagagggggaaggccccctcgcaggggagccggctggagtgagctggctggaaagagggggcggagtgcgcggagtcagagccgccaccgctgccgcagttgccgccactgcggcgtctgggctgagccggagggaggcgggaggacgcgcaggggcggccgccgccgtcgtcaggccaccggggcgaaaatgcggccgctgccggaggctcgctaactttccggggcggaagaggaggaggaggaggaggaaggggcttggagcgactacggggggatgcggagaagcagtcagttccctgcacccagcacctcacagcccttcctccgtgcgccctgccgggcggcgagctaggcggcagcggcgcggcgcgggctcggcggagcggcccatgtccggcgcgggcgaagccctcgctcccgggcccgtggggccgcagcgcgtggccgaggcgggcggcggccagctgggctccacagcccagggaaaatgtgataaagacaatactgagaaagatataactcaagctaccaatagccacttcacacatggagagatgcaagaccagtccatttggggaaatccttcggatggtgaactcattagaacccaacctcagcgcttgcctcagcttcagacttcagcacaggtgccaagtggtgaggaaataggcaagataaagaacggccacacaggtctgagcaatggaaatggaattcaccacggggccaaacacggatccgcagataatcgcaaactttcagcacctgtttctcaaaaaatgcatagaaaaattcagtccagcttgtctgtaaacagcgatatcagtaagaagagcaaagtaaatgctgtcttttcccaaaagacaggctcttcacctgaagattgttgtgtccactgtatcctggcttgcttgttctgcgaattcctgaccctttgcaacattgtcctgggacaagcgtcatgtggcatctgcacctcagaagcctgctgctgttgctgtggtgacgagatgggggatgattgtaactgcccttgtgatatggactgtggcatcatggatgcctgttgtgaatcatcagactgcttggaaatctgtatggaatgctgtggaatttgttttccttcataaatatttatcttttgtttgtgttaaaactggagagtgtttaaaaatttccttttggggggaagaaaagcacattgtaagattctcatgaaacaacatggaatttgcactgttaactcattattgtaagtaatctctgaaagcctttttactttaaccaaatctacatggtttaatatgtgaaattttaactactttaactagttttataaatttcttaatatgttacaataacttagggacattttgacaccccccttcccaaatgttaaatgccttctcctttttaccgatatttctgtttcttttaaccgttctcaggagcactttgctccaaatatattatttttcagtgtgtatttaaacgaggcagtttattttgatatgtatctattcatgattgaaaggaagcagtcttggccaggcacggtggcttacacctgtaaccctggcattttgggaggccaaggtgggcagattgcctgagctcaggagttcgagaccagccagggcaacatggtgaaaccccatctctactaaaatacaaaaagttagctgggcttggcggtgtgcgcctgtagtcccagctactcaggaggctgaggcaggagaattgcttgaacccgagaggcggaagttgcagtgagccgagattgtgccactgaactccaacctgcactccagcctgggcaacagagcgagactccatctctaaataaataaataaataaataaataaataaataaataaataaacaaaccagtctttattttaaaagaaactttaggaaacaaacccacataatagttgggaaccagtgttgatctctctcccttaccttctccacttgttcaacagactctgaatgccgactgtgtggactctcttcctcagactgtggggacagatacaattccactcctgtccacaggaacatgagatttagcagactaaggagatctgtaaagaatgaaccataccacaaggcatactgaagtgaggattataagagaaataaactcaaaatgctgttggaatatgcagagaattgctaccagaatattcagtaaggtttcagggagaatgtggcatttgaggactctcttagaatgagtgattcacctgctatttaaatgaattatttagatttttgacaaagatttaggtggacaccctaaactgtgtgtgcctttaaccagttaaaagaacagtgccttcagcatacttttttattagttgtaggaatacagctttttgaaaaagctataaagtttaaattaactaaaaatatgcattttcttacacataatttaaatgttatcatacttttttgatgaaaacataatgccttagtaaaatagctctatttaataaagaagattgagtactctgacacatttcatttaaattaggaaatttttaatattaaaatcccagtgttctgagttattgaaaggctttcttttattttgagagctttaggtctttttgggatgagaacattttagttgtttagtttgtttcttaagcagtgctattttttgtaaacacagataaatggaaaccattcttttcaatgcagaagaaatctagatatcccctactgtgaccaaatttctgtattacgattttatgttaaattaaactaatatggcaggttataatgatccttaagtgtaaagaaatcagtcaattacaagagtaattgtatagttattgagacctatagtgtgtggcttagatgaaagggagagtaaattttcataccatgctctctcctactcagtttgatctctctaaaattgtagtttggtttgatttaatataattcttagtagaaattttgaaagtatgctttgggattaataattatttttaatttttctggctgaatatcaaattgatagtaacaacagaagcataattttaggaaggctttcgcaaacctagccttttaagagaggtttttaacctgaagcatgagaatatatcacctgtggtttttcctttgagatgaaacgtagtttctagttatatcattacttaaagggcttaaaaagaaaaaacttagcaaacttttgaatctttcttttattgctatttacacatacatacacacatacaaaacctttaaattttgggatctgaatataattctggtaaacagctgtcttcatttttctcctctaaagaacttaattcatttgttacataaaatataaggaaatctttatactattttacagtaaccacaatctaaatatttacatatacccaaaattaacttatgctcatatattaggatgtgagaatatcatctgtttatggacacatgaaacctcctaatgacctggaattgttagaatatttgactttttatatgcaaagtttttcaaccaagtggtttgtctaatatttaaacatgtactggcacaatttgtgatgaaaatattagcacatttgcaataatgtttctccataacagagaatgttaatggataccagaattttatttttgtatttatgttcatagtacttttcctcttgtctactccagacagttattccataaagcatttgtataattaaaaggaaaacagaaaaaggaaaagtaggcaaatgtgaaaatagtttcaatatatcttatgatttcttaatgtaaaatgttttgttgaagtatatggctatcatgactaagtgctagaatttatagttacaggcggtgtccttttaaatgtggaaaggcttttaaaatattttaaaactggacctgtattatcctgaatacactattttgaaaatttttaaaaatgacttctttattttgctttaccgtatgtttatatctaattgacatattgactaatgtttgaaagaattcaaccataagttaaaatctgaaggttatctttatcatgtttcatccctgtctgaagatttcctagtcttcttatgtaaatcacatgactcatgtccgtaaatgaactatgaaagatatcgatcagtttatgatcattgacatgtgatttcaaaacacagtgttcttttaaaaatctataatatgtcaaaatacaagttttttttttttacatcgttttagtaagttaatttcatttatttactttggagctatatttccacttagaaaaactaaggtaattttacaatatatgctgagattaaaaaccaaggtaaaaatgatcaaacatatatgaaattgagtcttagatttaatgaatttcactcgaaaataaatgatcagaagaattttcatctaaggcatagagtggcgaaatttttgtaaa

SEQ ID NO: 130187 - DNA, 434 bp, Homo sapiens
cttcacactgggtccaggtctccctcgggctgcgcccatgccactgtgaaagaatcccaacacctgcttttacgtcgtcccctttccaccaggacctgggattatcccttctaaacagctcttaaccccatctctgccagatttgcagactcaagatggggttgcaggggtggctgctgttcctggacctatatgctggtaggagactggtgctggcaggagcttcatggatttgccaaactatcacatggattgatcatggatgcccggcggagcctcacactctcttgccctgtggcctccacaccctgagtacttcaggcatgggacatgacacctgcactccacaccctgttccctctgcccccaccttgctggagctgcctcagttatcgtgcagcagggccaggcctgcgcctggttccctttctggc

SEQ ID NO: 130188 - DNA, 377 bp, Homo sapiens
agtaaagttcatgatttctcctagacatgttctctctctttatgacctagatcaagagtgatctctttaagtcttttcttcataatcccacagcactttgtacttagatgtacttagaaagaaccatatacacggtacgtcatgattgatatgcaagccttcaccactctacctgtcctaaaagtcagggacacaccttcttcatttcatcagtccctacttctatccagcattggcatccagtaagtattagtggaatggacagacaacccgaatttgtgctgatggcagtttaccctgttttaactgtcatccttctgctactagacatggatgagacctgagacgatgggactgctcagaggtccctggctctt

SEQ ID NO: 130189 - DNA, 358 bp, Homo sapiens
ttctcttactctcctttatactgatcactataaaggctatcaggtttacctctttgctgctcttaaacatgacttctccatgccccagctttattttaggcccttagaatttcccaccaaaattactgcagaaatctcctaaatgatcttactgcctccagtcttgcatttcttcagcagatcctccactgctgccagagtttttctaagacgcgaatatggtcacatcaatctcctactcaaaaatccaaattcctgctgggcgcggtgactcacacctgtaatcccagcactttgggaggccaaggcgggtggatcacgaggtcaggagctcgagaccatcctggctaacatggtg

SEQ ID NO: 130190 - DNA, 187 bp, Homo sapiens
gctgggattacaggtgcgagccactgcgtccagccccagttgtttgcatttttattacagtctatgatcaggtcatgagtcattggagagcagggattgggttttttccatgtgtcttttccttttggtgctctatacagtgtctgacacatatactggtgcaataagttactagggtctgaatctg

SEQ ID NO: 130191 - DNA, 205 bp, Homo sapiens
agcttggtgtgaaacatcaagattcattcaatacttattctacattaagcactgatgagatgtattgctgaacactgtgtgatgagtcaagaataaaaatgttacagaccttggattttatagcacagtgaaggggttggccaactacagccagcgagccaaactggcccaccttctgttttcgtaaataaaattttattggatg

SEQ ID NO: 130192 - DNA, 483 bp, Homo sapiens
aatttatccattaccactatattttctagtttttgtgtgtagaggtttttatagttgtcttgaatgatcttttgtatttctgtggtgtcagttgtaatgtgtccattttcatttctaactgagcttatttgaatcttctctcctcttgcttaatctgtttagtggtctatcaattttgcttttcttttcaaagaaacagctttttgtttcattgttatttttgtttcagcttcatttagttctgctctgatctttgttatatatatttctttctactagctttgggtttagtttgttcttatttctctagctccttgaggtgtgatgttaggttgtaaatttgtgatctttcagacttcttgatgtaggcatttagcattataaactttcctcttagcactgcttttgctgtattccagaggttttgataacttatatcactgttatcattcattttgaaaaattttcagattgctatctttg

SEQ ID NO: 130193 - DNA, 311 bp, Homo sapiens
ttaggtgactgagatatcatgctaccctgtggccagccatgtgggcacatcaccacgtcttagtcttcaggacactgaggcagaaagcaccgtcccattcacaccttggtaactgaactctaacatctcagcctgagaatcctggattttttgcttatttgtttttaaactaacttttcttttcctttcctttcctttccttttcctttcctttcctttccttttcctttccttttccttttccttttccttttccttttccctttcccttttcctttccctttccttttccttttccttttcctttcctt

SEQ ID NO: 130194 - DNA, 458 bp, Homo sapiens
gccgaggcagacggatcacatgaagtcaggagttcgagaccagcatggccaacatggtgaaaccccatctctactaaaaatacaaaaaattagctgggtgtggtggcagatgcctgtaatcacagctactcgggaggctgaggcaggagaatcactagaacacaggaggtggaggttgcagtgagctgagatcgcaccactgcactccagcctgggcaacaaggcgaaactccatctcaaaaaaaaagcaaaaatcagctgggcgtcatggcgcacacctgtagtcccagctactcggaggctgaggcaggagaactgcttgaaccaagcatggtgccactgagctcctgactgggtgacacatttctcctcctttaccacccccgacccccagagtttctgcggctgacagtgtatgcttccggagctgcttctgttacaaatatatcgctggccta

SEQ ID NO: 130195 - DNA, 252 bp, Homo sapiens
ggctagcaggaaagagaaatctgtaccagatactgagggaaggattaaggttgttccctcagtcagggctactaaggaagtaatataaataacagtgggctaggaaggatgcaaaaagaataaggaaagaaacatgcatacagcgggcttgtaacgtactcagtgatatttacttgtaagaaagagggaggggccaggcacaatggctcacacctgtaatcccagcgctttgggaggccaaagcaggaggat

SEQ ID NO: 130196 - DNA, 683 bp, Homo sapiens
gcacactccaatgttggtgaggacggtccatccattctgcatatgtctgcgtctttgggacttagagtctggcaagtagaagagggatttcatcttgttggaaaatataagttggaaaatcaacccacatgaaattgcagaagccaaggggtgagtgttctagaaagtgtctaattctttctttgcttttagctaggctgcattacatgattctatgtgttcattatttttggacactttctaaagagtagctagaattgtaaagacactactaaggtgataatttaaaaactatgctgtcattcatatcaattaaaaataaactcaggtataagacttggcccaactttctattttcttgctgaaattgattgtttaatttcatttttgttagttgaatatgtttgggtttctctatggtgcatctaataagattttgtgtccacattgtgaggctttatggcctttctcctttcagtatttcagtgtgtttatggttgctgctcatgtttaacctgctactcttaacttttagcagtgggaattaagagttcaggcatctgaatctatttaaatatcaaaactctgggaagcttctctgataaccaaatcacatttatccatgcacttgttctgagcagcagttgaagttaggtgatattttacttagtgatccttatata

SEQ ID NO: 130197 - DNA, 766 bp, Homo sapiens
ggaggaaacagataatgaatgctaggaaacagctgcttctaacgtggcaggcagaaatgcatcctcatggagcaaatcggtcatcacaggaatattagtggaaaatcatctctgattaaacattcaagagctatggaatgtgatttactttcatatattcacccttccccccattatctttccgttgcctgtagatttcatttttatttgtcaaataatacagaaatactttcttgtaaaagaatatttaaacaacagaactctagataggttggaaaagatagtcccctttatgctatacccttctcctttcccagagttgggggtcagcaccttctggaacccttcctagacatttgcatacatgtttattcttatttgcacataatcattgtctttttgtaaatggatttctgcacagtttgaatctgttcctttttacattgaatactgtcttaacgatttctctgcatcactatatttagataaacctcaaatttttagaagtagggcttatgcaatcaaacttaattaactttattaatctaaaaaataatctaaaaatctaagtgcctcttaggaacagaaaggtgtcatggcccacccactttgggactggatggtggatttaggatgttttgtggcaggctggcttgcacctggcaaaatatcttgggtcagtctaacaagggagaactgatctcctgccctgaaagtttattactgtggcaccagttctgcttaaaacaaacatttagtcttcttt

SEQ ID NO: 130198 - DNA, 329 bp, Homo sapiens
cctcctgcctctcccaacaactccacgcccctccctgctgtgccatcagcacaggcagcccctggggagtactaggggacaagagggaagggactgattttgaagatcagcatctgcattcctaccctggttccaccactcaccagtgtcacagcctcgggacattaacacagccctactttagaaaggagagaatggagccacatggaaattaataatagcacccacccgtgcgattgctgtgatgaccaaatgaggaccaaccaagcagagtgcttcacacagtgcttggcgcatggttctcattgaactacaaatttctcatctgg

SEQ ID NO: 130199 - DNA, 224 bp, Homo sapiens
tctggttacagtgggaatgataagaagtaaaagtgaaatatcatgaatgttttcttatatctacctaaatgtatcataacagcaacgacaaagataagcactgtaatcccagctactctggaggctgaggcaggagaatcacttgaacccacgaggtggaggttgcagtgagctgagatgacaccactgcactccagcctgggtgacagagcaagactctacct

SEQ ID NO: 130200 - DNA, 249 bp, Homo sapiens
gtaggtgattctagaggatcccgatagcgtctcaataaagattagttgacttttgttttctttctcaaacccatttttgatttttagcctgggtctatttgtcacatgtaacctcttttacattgacctccagtaagatcaagatccttcttggggcccagtgggaaaccagttctgtgccactaacatcaagacagtaggtggcatatattattttgcctctagatactcctgtagacatataaaggc

SEQ ID NO: 130201 - DNA, 294 bp, Homo sapiens
gtaggtgggatcccacgtccggctaatttttgtatttttagtagagatggagtttcgccctgttgggcaggctggtctcaaactcccgaactcaggtgatctgcctgcctcagcctctgaaagtggtgggattacaggtgtgaaccaccatgcccggccagggaaaaacatctttttgtaggtgttgacactgcagcttctaagttagttgagaggttggaacccccgcctccttcctgtggttggaaggaatagggaactagactctaacatttttttagctgggagccagat

SEQ ID NO: 130202 - DNA, 483 bp, Homo sapiens
ggcggtatctgattccggacatggtttgccttcttgcaggattgactggacatggtttgaattggtgacaacaccctgaaggagtggatgtgggtgagaaagagcaatagaagactctgcaattcctggcctgagcagttgtaggagaaggtgaggggcgggtggagtgagcttcatgggagaccgggtgtcctgtgttggaagtgctcattttgagatgtgtcctgggtgtcccagttgagatcatgagtaggatgataataagagtgtgtgcatctggagttcaggctgcaggtcaaggctggagataccaaggggggactgggaggaagacagaagcttatattgacagccatgaagtggaggggattccccacaggagcaagcgtaagcagagagaggactaagagcccagcccaggctctgcgaggagccagcagaggaggctcggaggagcagccatcgaggcgggaggaggatcag

SEQ ID NO: 130203 - DNA, 324 bp, Homo sapiens
taattttttgtaataaaggtgggttgtgagatgactgacatatgtatccctacattaaataccatcagaggctgtagtgggtatgctttgtgttatttttgagatggggtctcactctgtcacctacgctggagtgcagtgacatgatcatagctcactgcagccttgaactcctgagctcacgggatcctcctgcctcaacctctcaagtaaccgggattacaggtgaatgctaccatcactggctaattaaaaaaaatttttttagaagtggggtcttgctgtgttgcccaggctggtcttgaactcctgggctcaagagat

SEQ ID NO: 130204 - DNA, 750 bp, Homo sapiens
acagcagacagcagtctgatcagggttaaggaaaacttaacaaggaaaggttgagtgcctcatacctatcagcagttggggaagactttatcatttctaaaccccaaggaagcagagggagggagtgggtacaggaactagaaaagagtagctgctgttgttgaagagtactatggtagtgagagaaaactgtaactgtaaccatcctcctagggaggcatttggaaataaacaccccaaggatgctttacttccatctcctggttttctgctcatgctccctatgaactgaactcaccagaatctagagggcaaggggagtcttggtggaggctgtaaaggtcagcctatttaagcatagagccaggtagagaaggatggaaatggaattgacatggcaaaacgaaaatattttgcacacatctgcaaggtgaaagaagaaatgtttgaggaaagatgggctgaacccaatggctcctgcctgtagtcccagtactttgggaggctgaggcgggaggttggcttgaagttaggagtttgagaccagcctgggcaacgtggggagaccctgtttctacaaaaaataataaaatttggccgtgcatggtggtgcatttctgtagtcccagctacttggaagacaggcgggaggatcgcttgagctcaggagttcaaggctgcagtgagctatgatcgcaccactgtactccagcctgggcaacatagcaagacctgtctcaaaaacaaaaa

SEQ ID NO: 130205 - DNA, 189 bp, Homo sapiens
catatatatggaagtacagtagtgtaaatctaacattaatttctggtttctgcccccgagaaattgcagaatgtagcttagtcagtcatgtctgttctgttttcttctcatgcagttcctaactcttgtcttctttcgtaatctaaaaaaacctgctgcccagctcccatgtcctctgcttctcttgtc

SEQ ID NO: 130206 - DNA, 450 bp, Homo sapiens
ggagaatatagttattctcaatatgagaagtctcctggatcaaaagtaaaatcccttgaaaataagacttcctctctgtacacgtcatctcatatctcaagcggctactgaatacaggtaatgctgtactcctgatggaggcaatgtgcttttcaatttttcaaattcaccatgccaaaaatgtgaacatttgaaaatactgcaataattgactacattcgccaggattcatctgaatgtttgacattttgtacactcagcatattgtattttaacacctgctgcgtggctttctatgtcaaagtaaatatggacccagtaagcatattaataaaggcaggagaaaagttgtactgtttagaagagaatgaatataccaaaatcaagaggctccactttttccccacttctgctacatatctgctatgacctcacacaaaataacttcat

SEQ ID NO: 130207 - DNA, 352 bp, Homo sapiens
  misc_feature (5)..(5): n is a, c, g, or t
agtantttacctaaaatgtgctagtagctatagacatttatatgtgaagcagctcttttttttttttcctggaaaccgagtctcactctgtcgcccagggtggagtgcagtggcccttatataagctcactgaaacctccgcctcctgggtacaggcaattctcatgcctcagcctccagagtatctgggattacaggtacctgccaccatgcccggctaatttttgtatttttagtagagacggggttacgccatgttggccaggctggtctcgaactcctgacctcaagtgattcacccgccttggcctcccaaagtgctgggattacaggcatgagccatcacacccag

SEQ ID NO: 130208 - DNA, 366 bp, Homo sapiens
ggtgatggttcaacaatatgaatgtgcttaacaccactgaaccatgcagttaaaaatggctaagatggtaaattttatgctatgcatattttaccacaatggagaaaaagggggataaaaaagcaggtagagggctgttttgactttcaggacatagtttgctgacccataagttaggctgttgcattttaaattctaagcatagacataatgttttaagccagtaacaaagtaccatttatacactaacatcatgttcattttattcctacagatacatataatttctgtagtgaagttcttaagattagaagcctatttcccagtacctagaaaaatatgttttatataaagtaagagttcagg

SEQ ID NO: 130209 - DNA, 724 bp, Homo sapiens
tctggaactcctgacctcaggtgatctgcctgtctcggcctcctaaagtgccgagattagaggtttgagccaccatacccggccttagagagtagattttaagtattctcaccaaaataaataaataataaataagtaaataaatatgaggtaatacatgtgttaattagctagatataaccattttaaaatgtattttattttatttatttttatttatttatttttgagacagagtctcactgtgttgcccaggctagagtgcagtggcgcaatttgggttcactgcaacctccgcctcttgggttccgcaattctcctgcctcagctgcccaagttgctgggatacaggtgcctgtcaccatgcctagctaatttttgtagtttttgtagagatggggtttcaccatgatgggcaggctggtcttgagctcctgacctcaagtaatctgcccatcttggcctcccaaagtgctgggattacaggtgtaagccaccgtgcccggccttagagagtagattttaagtattctcaccaaaaaagagataactttgtgaggtaacacgtgttaattagctagctttagccatttcacaaggcatatatattttaaaacatcatattttacatgagaagcatgtaaatttcttttgttttgttttgttttgtttcattttgttttgttttgttgagatggagtcttgctctgtcactcagccttga

SEQ ID NO: 130210 - DNA, 353 bp, Homo sapiens
actaccttgttttcaccttgtcttttcacaatgcagtcatcattcaatttttgcttgtcaaaacactatgttgagttacagggaaaagtatacttgcataaagccatttttaatcccctttaactgaatacattacctccctctgatatggttgctctgtatccctacccaaatctcatgttgaactgttactcccagtgttgggggagggacctggtggtaggtgattgaatcatgaaggcaaatttccccttgctgttctcgtgatagtaaattcccgcaagatctgatggtttaaaagtgtgtggcgcttccccactttactctctctgtctcctgtcaccatgtgaaga

SEQ ID NO: 130211 - DNA, 205 bp, Homo sapiens
acatctaaagtgcacagagcacatggcagcgaattcctctaatgggcaggcaatcctggccactttgctggccctcccagtccgtcttggcactggatgtgggctctgggctttgtgtgatgccgtcaggcagagatgagcaggggacatgtgcacgcccacggctgtgctccggccctactgcctggcccgcctgccgcactag

SEQ ID NO: 130212 - DNA, 279 bp, Homo sapiens
gtagcctctacctcctgggctcaagagatccttctgcctcagcctcctgagtagctggtactgcagacatgttaccaccatggctggctagttttttttgaattttattttttgtggatatttggacccctttagatataaataaagagcttttataaaatatctatgagaatactatgcagccataaaaaatgatgagttcatgtcctttgtagggacatggatgaaattggaaatcatcattctcagtaaactatcgcaagaacaaaaaaccaaaca

SEQ ID NO: 130213 - DNA, 287 bp, Homo sapiens
atcatgatttgacagagccaatgctcaagtttactggatgggtcttttatattccactggtcatagaattaaaatgagactgagaaaccaggtgagctggatgcaaaccattaatctatacatttttaataaacagagtagacaaactggtacaagatacttccaggcaagtgtagaactttaaacaacatattataaatcactagctaatatatttattttatatcttgatttaaggtcagaatcagagtatccctggagacaaaaatagaactatcacagagcag

SEQ ID NO: 130214 - DNA, 845 bp, Homo sapiens
cccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgcaccttttctattgtattaaatatttcagtttctccattgtatggaggcttccagcaattagtttacaagccaacttatttactattcagtaactttttttgatattgagattgttcctaattttgatcattttaaacaaaggtgtgaaaacaggccaaatcttttcattcactcatgactatttcacaaagatagattcgtagaataagtattttcaaattccctttcagaaaagtagtacaatttaacactcacaagcagtgaatgtgaagccaattctccatacctttgccagcaagggtggccccaagaaccacacacagtaccccagctaagggcaaaggtagcttttatcctggccatagcacactgctgatggtcaacaagacaccaagtcctgctcacagatgctaaacagagcagatcctctcaaaaaaaaacaaggaaaaaaactttggggcgcccggccgaaaggttctaacactcgttggcgcgggccgagtaggaaaatgtcctaggtccaggaacggcggacaggggggtccccaaaagccggggccggggtgcacaccagggctggctctggctcacggccatccccccccccgcggcggaggaggaaaaacaaagaaag

SEQ ID NO: 130215 - DNA, 291 bp, Homo sapiens
tgtccttcaatatcaatctttctttggagaagcattttccaagtatattccatgaatagtgtttttgttttgttttgttttgctttttgtttgtttttttaatggaaaaatcttgggatctgttgacctgaaattttggggagtgctagctaacatatttaaccctgaggatcaacagtgcacagctgcacattacaagttctaagaagtttgggtttgttaacccactgtttcctaaatcgttgtgctcagaaaaactccctttttaaaatattagtattctgtgaagtc

SEQ ID NO: 130216 - DNA, 252 bp, Homo sapiens
gaagagggcctgggatctctagaatggaagggcacctagaaattacaggagtggggatgaaagttgttgtctttctttttgttttctacagcgagactccgaactttaagtatgcccagctgaatgtgtcttattctgggctggtaaatgacaactggaagctagggatgaataagaggagcctgcgttacatcaagcgctgcctaggagccctgccagcagcctgtatgctgggcccagagggggtcccgg

SEQ ID NO: 130217 - DNA, 303 bp, Homo sapiens
ctcttgaggataggggaatgttcatatgaaaaaaaaaaaccactcagtttgtaattttacatcacccttctctacataaaaaaattcacagacaaagatagtatttgacctctaataccaatatccatgtattcattaataatattggattattaatcaccctttgatgttactggtaccaccagatgcacaacccttgaaatggcgcgcagagttagtgtcacctgtataaagcacagaaactaagttcttaaagtgcccaactaaatcaattcttctttaacagaaatgacttcctttttt

SEQ ID NO: 130218 - DNA, 513 bp, Homo sapiens
tctgtatattatgactgtcacagttctgcatgaaatcatacataagtgctgcctatgcatgtgtattatacatagcattatgtgtgtgctaagagtatagagggcacatattcttaggttctcctgatgctgtgtcacagatcattggtcattaaaaaaagaaaagaacaaaaaagagcgtagaaggcagactagaaggaggtagtgccaaacttaaaacagcaatcgcctttggccacgggtggttcaacagaatttggggttaatctgtaatattatatttctttaaaaaaaagatctccatgtaatcacagggataaggaaaaaaaaagttttaagcaaatgcaccagtgttaagtgttaattgtgggtggtggaaaattattacatgagaaaagaatgttacagatctatataaactaataaaagattttttttttttttttgagatggagtctcactctgtcacccatgctagagtgcagtggcgtgatctcagctcactgccagctc

SEQ ID NO: 130219 - DNA, 382 bp, Homo sapiens
ccacacaggcatccggccagcagtcagcatctcccggagatctgctgggactaggcctgcaggcagcctgaccgcagggagggaggcaaccttcgtgggagatcttcagaaatattgttcattcggtttctcaagagtctccaactacagtgcagtttagctttcacagcttacatcccaggtgtcaaagagacacaacttggggcagggatggggacagaggtcagagaaggaaaggtggcctaagggcattgaggggtgctccccagagtttgcagactggctctgcagacttgcaggtcatttcctgtaccctgtcctgaaaccctcccacggcccgtttgagcctatcagtcatttacactgtagcgagaagttacct

SEQ ID NO: 130220 - DNA, 256 bp, Homo sapiens
ctcttttgatgttagatggccagctgaaggaaatgtagataaggaaacaattggctatgtatttaaggtggtaactggggtcagaggacagtcagggcacctagaccagttcccttgtattgactcatggttaaatatagtacagactccacctgcatggttgcagacttgcctggcagctttttgctcaagctgagcctaagccaccaaaaaaaaatcagctttgctggaagctacagagacaaagggaaagcca

SEQ ID NO: 130221 - DNA, 369 bp, Homo sapiens
actctctgtctctctgtactatctttgcaactgttctgtaaatctgaaactattctaaaatgtaacatttataaaaaataatggcttatcacagtttcctctgtaagaaacaatgggaaaagggtgatctttgggtatgaaactctgcctctaccagctatgaagctttggatgtgttgcctaccctctgtaagcttcagttttctcatctgtaaaatggagagaacagttccaaccacgaagtgctgttgtacagattgagtaagatagtgcatgcaaaggacttaccactgctaaaagtgctttctttctgggcagcagcagtttctctgctcagtcagccttcacgttgggttcttgacaactgca

SEQ ID NO: 130222 - DNA, 403 bp, Homo sapiens
gcggacagttgtttttggctggctgacccggcatcacccatgccactccccgccccaccctcgctccccacaggtccatattttgcataggatcctgcctgacagtgggacagaagagcccactgtgaactgcaggaagtgacacctgggcatggccagctgcagactgggcagggtgtgtgggcaagacccagagaccggccactggggaactggtcacgggccagacctggagtggactccagccatctggttccttcttgccactgcgctcctccctgcaccctccagaaagtttgcagcacaaggtaatttttccaaatgtagttcaccctgtctctcgaggatgccaaggctcctgcagggtgcagtgggggacaggaacactgggttaagagactct

SEQ ID NO: 130223 - DNA, 238 bp, Homo sapiens
ccaagtgaaagttttgagagccatcacatggttttaccaactcagttgttgtaagccactgagttttgttttgttgtcttcttttaaattgtgtgttattgcagtatcatttagccttcagctattgatacaaacaagtatcctgtctttgttaaatacaggttgagcatccctaatccaaaaatctaaaatcttttttttttgagactgagtctcactctgtcgcccaggctagaat

SEQ ID NO: 130224 - DNA, 273 bp, Homo sapiens
cttctttatcctttctcataatagtgggcttattaaatcatagtctatttttttctaagataaaaatagcaacccctgttctttttgttttctgtttgtttcatacatttttctccatctccttactttatgggtgtcattgcatgtgagatggatctcttgaagacagcacacagttgggtcttgcttatctatccaatttgccactctgtcttttagatgagatgtttaatccatttacatttaaggtcaatattgatatgtggtttgttc

SEQ ID NO: 130225 - DNA, 294 bp, Homo sapiens
gtgggtgagtccctctctgaccctgggtgggtgagtccctctctgagcctctttcccagctgtaaggcgggaaagccgctcctcaaagatctgtttccagacatcccaagcccaacgcacgtggcaggccctgcagacagcggacaatgagaactgacaacaacccgctctcagggccagcagacgcgcctgcgcctcccgtggagtcctcgccaccccccacccagaccctgcctggagcccagtgtcccctcggagaggccgcatcccagggaggggccatacccaggaggc

SEQ ID NO: 130226 - DNA, 636 bp, Homo sapiens
tacttaggcacaaatatatttaatcacatgcacacaatatctcattggcttccattccatatagcatcctaaggctaattgtacagtcttgttcctaaattacctttccatcttccttaactctatctccataaaagtaccctttactcctactgaaatgattgccttttattcttatatcaagtttttgttctcgctattctgtcaacatcagtgtttctcagactttcatgtacacgtgaatcacctagagatcttgttaaaatggagattctgattcagaggccctggtgaaaccttagattctgcatttctaaataacttgtctggtgaagcagatgctactggttggaagatcacactttgagtggcatagatatatgtagaatgccttctccctttcctctctggtgacttcctacctcttatttaaggtcagacatacaaatcacacctcctttgcgataccttccttctgcagctccagtcagagctgtttccttctctgtattgtttagtgctttcacttggctacagttgggaaattgtctgctgaactttgtcagcggatgttagtgctgaggggtgcagctgtctgcaggaatctttctgtctttagcacaattccaacaacat

SEQ ID NO: 130227 - DNA, 608 bp, Homo sapiens
cacggtagctcacacctgtaatcccagaactttgggaggccgaggtgggtggatcacttgaggttaggacttcgagaccagcctgaccaacatgtcgaaaccccatctctactaaaatatgaaattagccaagtgtggtggcaggcacctgtaatcccatctactcgggaggctgaggcaggagaatcgcttgaacccaggaggcggaagttgcagtgggcagagttcgtgccactgcaatccagcctgggcaacagaatgagactccatctcaaaaaaaataaacaaaacaaaaacaaaatcacttaagaggaaattgcctctgggcctgttacgtttttcataaaatgaggaggttaaatcaaaaggccactaaatttaatacactgcaatactttatgacagtaagatgtctattaaatttatatttaaattatagggttttacaatttggcagttcctcaaaaactaaatgtaaaattaccacatgatcccgtaatcccaattctagttactttacccaaaaatactgaaagcagaaactcagattataccccagtgttcacagcagcattacttacagtagccaaaaggtggaaacaactgaa

SEQ ID NO: 130228 - DNA, 357 bp, Homo sapiens
gaaaggactgcaggggaattggcctagcagtggctgcccacgcagggcaggtgtctggacaagatactctgttgtgctgggaatgcacagtgtgtggggtggcagtatgtctggagagggctccccacggcttctgacaggccactggcccactcaggtgtggccaggatcctctcgagtggaggctgtggccactactgattactctgacactttgagccttggaccagaagagtccccagcatcgctcacctctggtcgggtaaagtgaggggagaggtgggagagtgcagcggttactgagaaccagtgaagttaatccattgtgccatgcttcccattccccccgaccctagc

SEQ ID NO: 130229 - DNA, 389 bp, Homo sapiens
tttctgcctgtgaggtccacccagagatactggcttttccagcaaccagaattaggaagaacttcagtttcatggcatgggagcccatagcaccccagaatcctgagccaagcattctaactgctaacaagccaatcccctgcctcctggcagaatcacccctaagagggcttgtaatgggcagtactggccccaaggcaaatttttttttttgagtttcttttatcctaacacaacttctacttcaactagcatcactgagctggctttggggtgagggtctcaggcacctaattgattttatacagaaaggcatttctcctgatattaatctttagggaaatgaaagtccacttttcttctgtccagtgttttgtggcccaaagggg

SEQ ID NO: 130230 - DNA, 476 bp, Homo sapiens
cacaggaaactttttaagtaggttttattatccttcaaaaaggataggaaaactgaggctgggaagggttaagtaactggcctatactcattgcagcataagtatcacagcttaaatgtgttccattctttgcctgaccccaaacctgtgctctaaagcattgtggaacatcaaaagcctctctgccttccctacagtccaaaaattctcaattttctactatgggagctattaaaattacactagataaacctgtattttaaaagtattcaaaacaaaacacaacacacttacttagagcaataataataaatattacagaataatataatccttcccgttctaaaatatttttaaagaatatgataactttatattgggtcctagataccatactgtatttagggaatttaccaagatagagctggctttattgtaagtcaagcaaaatgaactggcgttcttgtaagctgggt

SEQ ID NO: 130231 - DNA, 431 bp, Homo sapiens
ggcccggatcggggctatgcgcagtcagcagcataagtattctcgtatgaatgtgtcctattccatcgtccgactatcaacatgatgtcaactaaggggttgcgttacattctccagcccttctgactaccctagagtacatcagattcacacttgtctacattggcattgatcataatatgattaaacttccacagtatcagaggcggatgctcctctagagatcagaactagcttgcatgcaggcttgagtactggccagttcagcagaataatcagtacgtcgcattgcgttctacctgtgatgtttaaagaatatgataactttatattgggtcctagataccatactgtatttagggaatttaccaagatagagctggctttattgtaagtcaagcaaaatgaactggcgttcttgtaagctgggt

SEQ ID NO: 130232 - DNA, 117 bp, Homo sapiens
aaaaaaaaaacccacccatgctagcccctgctcagcaccctctcctggtgctattttgaggtgatatccatcttggcctacgggtctctactaaatctggctgtccactacctctga

SEQ ID NO: 130233 - DNA, 739 bp, Homo sapiens
caccatttacataagtgaaactataaattatataatttttatgttcattcactaaacatgcttgtgacatcattttgctcctattgattattcattaattttattttgtaatacttaattttatgactataccacaggtttgaggcctttgcttgttttgtttataatccactccactattgatagacacaaaagcagtttctgatttgaggctatcatgaataaaccttctacgaacaaatcagatatacacatttttctgtaataatattttcacttttcttgagtttaagtacataagagtggattttctgggttataaaataagtatatatttggcattgtatgaaatagggagacattttcctaagtggttgtgccatcttaaactaaaatgaaaatgtatgagaatcagttccactttctaaccaatacttgatgctttcagttgttttagtgttatccattcttatgggatataactgctgagtagctgtctgccttcccaataacacagaaaattgagggcccagaggacagttttattttcatatttgacatcttctattattttttatagaagggtgatttgggtagtaaaattgtctttcaactttctaggttgtctctgaatcttactggggttccttgtcttaaaccacattcagaaattttcacgaccaacttctttttatctttgtcatacgaggccaatgagggactgcattcctgagacttt

SEQ ID NO: 130234 - DNA, 718 bp, Homo sapiens
ttatatagaactctttgcattgaaaatttagcctgtgaagaacttcgtccatatgcccttagttttgttaatgtgattcacccacagagaaagccagggtaactaaatatgatactataatcagagatagaggatcttaacattgctcactctgtacatattttcatatggatgcaaatgtatttctgccagtttagaatatgtgccatggctttgctacttggcacttataattaacattagtagttatacccctcagtacttttggcttcaggtttttcttcattatcttgtctttggcccaagtataagaatctacagattctttctcataaaacagtgtctacagggaaaaacaaaacaacgctttttctttattacaaaagagaattggagggaggctgaggcatcggagggagactgaggcaggaaacttcctcgaacccaggaggcagaggttgcagtgagctgagattacgccactgcactccagcctaggcaacagagtgaggctccggctcaaaaaaaaagaaggaagaattctgtcttcttaagtgctttcttacatctttttttgttttaatatataattagtaagcttttgtatgttgtccttgttttcatttttagttctctctcatattctcttgatatcattttaaatgaaattaatttaccatttagaaaattccttggtccaaagtaaaatatgaatgaa

SEQ ID NO: 130235 - DNA, 694 bp, Homo sapiens
ggccacttggaaacttgagttgcagactcatttttatttttgtgaagaaattctgctgtgatgagatttcattttaattttttaaaaagttcccttaccattgctttactatgaattgggaatgctgtggtgagtgctccatctggtaacatcagtatatgttgtggttttttttttagcacagctacataatgactacaatgccttagcacccaattaaataacataatccacactttattgtgtcttaaaaacacaacattcaaagttcactttttttgctttgacatgatgagtatgcactggtagtaaaagtaaataaaatgttgcagtacagcaataatcgtgacacccatgacgctgccaggttgtaactgcatctgtataatttgtgatgcaccgaaaagcagtgtgaagtgatgagagtaccatatgtagtccatcacaactgctcagctctgccattgtagcatgaatgtgtccagtgataaataagtggctatgcttcattaaactttatggccaccaaaatttgagtttcatataattttatatgtcacagaggattctatagttggctttatggcaatcatttaacaaactgtccaaaattattcttaggcccctagcccatgcaaaccacgtggcatggggctagattggaccccttgggccttagtttggctgaatactg

SEQ ID NO: 130236 - DNA, 243 bp, Homo sapiens
gtttaatttgaaaagattggatatcagcattctgagattacagaaaattcaacgcgtgactcctcaggttcagtgcgtgctcttagacataggtgaagggaagcaaaagttcctattggaatactaccactcacctccttcccaactcccattgccccctccaccagtaacatacctgtgtaccttaccctcacctgtgaaaggacccatatgtacataaacccagaagataccacagcagga

SEQ ID NO: 130237 - DNA, 696 bp, Homo sapiens
gagaactgctctttctttatttctttatgtgtttgaaaatgaaattttacagtttcttcatctgaccctaaaatcctggttttctcagatcttttcttttcctgtttggtaaagtttactggtacctgtgttttaaaatagaatgtcctccctttgtatttaaatagaaagtacagacaactgcaattagattaagtcattcttaataaaaaattgggacttgacaactcccatcattgttcccaattcctttttctgtttttttttgttttgttttgtttgagtttctgagaagaactaaaagtcttggaacaactctttctttaacaagtactactattcccttttaagaagtgtatgtgcttcccagcaatttattgactatttctggcttcatcagtggaagagaattagatacatgtagaaattgaaattttctaatcaagagattttcctgaaggttcagatgtggagataagacaaagcagcgagtaagagaataattcgactttgttcatagtactctgacaccagtagctctgattattttaatataaagtattttggtttcaatcgtgctttaatgtcaacatttcgaaattgagtaaaaacttcttagggttagaataaaatttatagtggtagttaatgagttctgagggattaagttttgctcatttcctaaccatgcaccct

SEQ ID NO: 130238 - DNA, 165 bp, Homo sapiens
tggccatcagtgctgagctttgccctggtggcccctcctgagagccgtgctgttgccaagcctggtgcctgcctgctgctgggccacccaggtatgagctgcttattagcaagtgccagatggagtgggagaaacccttggccctggtgggacaggcaggcctct

SEQ ID NO: 130239 - DNA, 695 bp, Homo sapiens
attacaggcctgagccactgcgcctggccagggcctcattttccaaagtcttatctttcctatgatgctctattcatttacaagcatatatatatttaaaaggaaaacatggacatcctgcacccatcattctacagcttgtttttcatttccaatgcactgaagattgcttcatggttttgtatacggaaatgcgtagttcttttcctttttcttgactgcatactattccgttacataaatgtactgtgtaatatttaacccattccttgtagatgggtgccctgctagtctcagacatttgtccttatagacaatgtcacagccaaaggtatgtatctctgtatttttgcagacatcgtcatgaatatttttttttttttttgagatggagtttcactcttgtggctttcctctttttttccctggttggacagttttgagagtgttcttggaaaccacacgacacgagaacttgttgcctaaagagtgacagacaggacacagagattttgaaattgggcccggaagacgcttatcaacagctcggacacctcatcgtgaggcttcaatttcttcgaaaagaatttcgacaatgttcacttaccttgaaaaagaattccattctccatgatgtaattttcatacctagttttcgatagtcacacagggttgcctaccgccaaataattatg

SEQ ID NO: 130240 - DNA, 789 bp, Homo sapiens
gagttctttctttgaaatagtatgtagaagctcagtatataaaatacatataagcaggactgctgtgtttgaaaaggaaatgagggtttatggttctactttctcagttctcctcttaccctttccctaccatgagaactccctggaaagcataatttgtaaaccactgatttagaaattatcgaacataacttatccctccagtagatgttagacattgagtgaagttcatggcattatgggaagaacgtttgatttattcctttagagattaattttattgcttctaaatgctcgaatggagcaaggcaaagagaaagattcattctaaagatcttttagttgaaatagaattggactcaacttccttgcaggctaactttataattacaaaaataactatcaaatgctattttttatttgagaggaaagtctgtagatttacctgaatattaaacgatattcaactgtacattcacattttgataatggaagatgttagaaattcccaaatttactttcagaaagctaaaattctctattatgccggattgctattacagccaatgtttattctaaattacttacttaaatataagagtcagaggaagtcttcagggtgagaaaaaatatttagggcttatcttgcagggaaatcattattaaatttgtgcatagtttagcttaacatttatgtgcagtctagccattaaaaacattgttatttcctttttcctccacctttccctggagtgggccatcagttacccgataaagccatggaaatac

SEQ ID NO: 130241 - DNA, 356 bp, Homo sapiens
agtatttggaatcccaaaagtagaaatgcctttcccttgagattgttgtttctcaacctttaaaaatccatatttcctttctgataaacattaaaatctcacaaatcctagaggattgtaatacatgttccttcccatacagtcctactcctcctctacacctcaccatactgactacagactttctcttctagttccctcatctgtgaatattatgcaaagtccttctttatatgatttatgtaatagatttttaatattaactatttcaaaattgtatatccttcctcccccatcttcagattctaacattgcccctagtcagaggagaggataccccttaaagattactcagt

SEQ ID NO: 130242 - DNA, 293 bp, Homo sapiens
actgctggaatgtgcccagtaaagacgtgggggtgtctgggcagctgaaagcctccacacgggaattcagtaaggacaactgctgaaccctgggttatggatttaaaaataaacctcagtgacccgcatgccttaagaatcatttgggaaagaacgttgctgaatccagcaactatgtgccccactggggtgaactacagagagggaaaaagagaaaaatgcttttactacccctttcaaggagtatgataggacaaaaagacaaaggaaatccaaaattggcttccccaaga

SEQ ID NO: 130243 - DNA, 280 bp, Homo sapiens
gatgcgcgataatccaatgcacctatggagcacaggacatttaatccctatggaatatgtaaaccagagtgtagttggacttcctggtgaaacctctggaattttactacagggagttgggttaagcagtgaaacaaccattgttgctatgccacccttcctccatccaatggacggcaaagatgagggcttgagagctgccttcttcaaagctgacttgtggatctttacgtcatagaatcccaggaaaactctgaacatttactgaagcgacctctcc

SEQ ID NO: 130244 - DNA, 251 bp, Homo sapiens
cttctagccagggaaatcagaaaagaaagaaagaaagagagagagaaagggaaataaaagttattgaaatggaaaaataaaaatatctctatttgcagatttaatgatcttgtatataaaaatctctaaggaatccactaaaaaactattagaacaacaatgagttctgtaaggtttcaggatacaagattgacatatgaaaatcaatcatatttcttaagcttgcaatgaataatccaaaaatgaaagta

SEQ ID NO: 130245 - DNA, 496 bp, Homo sapiens
cgaactcctgacctcaggtgatctgcccgccttagcctcccaaagcgctggggttacaggtgtgagccaccatgcccggccagcaagccacttacatatttttacattttctgacagccccgttcaaaaaaagtcaaagagagttggtgaaagtgacttgaaacattttacctaacccagtagatgcatttccatgtgtagtcaatgtgcacgatcctcattgagccattttacatcaccttttgcatatcaagtcttcaaaagctggggtaccttttgcacttccagcgcacatcagttcagagtggccacattccaagggttcaggagccacctaggccacaggcaccccactgatatggtgaccggctttgtaggctagaggctccaggctaagctgggtccacgctgcccccatggggcgagacaggcagggaggggccctcaagtcacacccaacccctgccttctcggggctcacaatccaatcagggag

SEQ ID NO: 130246 - DNA, 558 bp, Homo sapiens
gtagtctcctttttaagcctgtaaggaatttaacactttgtttaatagacttctttaaaaatatgctcatgttttgttggactttgagtgatctgttaattcccaggtaagcatttctgtgtgcacatgaagatgcataactcatacctatttttgtggactcttgggcatttcatacagttctctgcagatagtaaggcactcaatacgtctttgcctaactagcttagcagtgtagtgatgggtttatattaattaataacaggtcgggcatggtggctcgtgcctctattcccagcactttgggagactgaggcaggcagatcgtttgaggtcaggagttcgagaccagcctgaccaacatggtgaaaccacgtctttagtaaaaatacaaaaaaattagccagtcatggtggtgcccacctgcaatctcagttactttgggaggctgaggcaggagaatagcttggatccgggagaaggaggttgcagtgagccgacattgcaccactgcactccagcctaggcaacagagtgagactcttatctcaaaaaaaa

SEQ ID NO: 130247 - DNA, 883 bp, Homo sapiens
aggagagcctggcagacagagctctgggtagagtctgggtagagggacctgtggtgggagaaagagagaagatcagagtggaggggagaagcagggttggggccttgaaggtactgctgagcatgtgggtccttatccttaccctgcattgcccgcaggcctgacctttgcttcattcttcatggctgccaagtgagagtgtggcccctgcagatggttggatcatccatccagttctttgcttcctctagctgatatccttctttgctgtactatatgggaaaagcaagaaatatttgacaccaaaattgcttcctttgtgtggccccgtattgccctgtatagaagcatttcgtcttcacaacaactctatgagcagtgtgaagatggactaatacaaagaggaactaggggagcttggaggaaccagagactcaatcagggattcaagtgaagtctctgttgcaaacccttgagcaggtgagaacccctggactcttgcaggggatgtgggaggagctgtacatacagacagtgctgtccagccaatgtgggttcaaaccctgcatctgtcactggctatgtgaccttgatcaagttccttaaggtctccaggtttgttttcttatctgtaagatgagaatcctcttctgcaaaccatgtctgtttaaaatatgtgcttattttgaaagtgatgtagcaacattttctctagttaatgttctttctccctcataattttaaaacatttattcatgactataatgttaagtctgtgactttatttttgctaaatgtccatctcagagaagaatatgactttatatagcgaagtattttttaaaaaatagccttagtaatgcatatttgcaataaaaatatt

SEQ ID NO: 130248 - DNA, 139 bp, Homo sapiens
actttctgatgcttttaaggatgttttataacaaattgtgtagctttttccaatggaatgtttattctgaattatctaattcatattgtaagtatagagggagtttaatataaaattattaaactaatatttgtgaaag

SEQ ID NO: 130249 - DNA, 277 bp, Homo sapiens
gcacttctgtttcctctgggaggaaatttgagggctggcaacttgactttgctgaggcagacacagctgatctgagatagcaccaggaccctggaggaggtcctggaggcttgtccactgctccccacactttcccacgggattcctgtccctccttcctgcagagggcagctgcaatgggatatttttggcagtctccctttgaaagcatcccctaaacgcgaatgtcaacagcagtgcttgcagggagcagctgtagctgtggggagccgtgtgg

SEQ ID NO: 130250 - DNA, 458 bp, Homo sapiens
tgtgcactttcctgacactccatgcactgcatcttgtctgcagaagaaggaatgttgtagttatcacaatagaagttacatgaaaaagcccctaagcatgggtatcctcagtcagagaagtggcctgataatcagaggcatcatttactgagaacctgctatgcgccagcatcaaactaggtatttacgtgctttctctccagccctcacaactctgaaaggaagtactgttgtctttgttcccattttatagttgaggagactgaagcacagtctctgtgactcacccacagacctgagctcgcaagcaaagaggctaggattggaacctgcgtctgttcggaacccaacctcatgctttttccattgtgcctgtggcttctctgtggtgaggactcagggggaggccttggtgttccttaggctctcattgttcaccacagtctaaacctttttga

SEQ ID NO: 130251 - DNA, 366 bp, Homo sapiens
aggatggaaagaaagatagatggtaggctttaaggcattcctaggtaaagtgacctagggatataaagatttgtttcttttggagtggtatagaatttaattgttcatggctgggcgcggtgggtcacgcttgtaatcccagccctgtgggaggctgaggtgggcggatcacgaggtcaggagtttgagaccagtctgggcaacatagtgaaaccccgtctctactaaaaatacaaaaaattagccaggtgtggtggtgtgtgcctgtaataccagctactcgggaggctgaggcaggagaattgcgtgaacctgggaggcagaggttgcaggtgagccgagatcacgccattgcactccagccag

SEQ ID NO: 130252 - DNA, 189 bp, Homo sapiens
ccactttccaggcagtgcgcatttacataattatgtaacaatttcttttcttttctttttttttgagacggagtctcactcggtcatccaggatgtcgtgcagtggcgccatcttggctcaccgcaacttctgcctcctgggttccagcaattctcctgcctcagcctcccaagtagctgggactacag

SEQ ID NO: 130253 - DNA, 182 bp, Homo sapiens
tgctgggattacaggcatgagccactgtgcctggccttaagttttttatagatgggaaaaccgaggtccaaacgtgagcaagggctctgcatgctacctctctattttctcagccccttctgcaggctccatgccataagaacatggctcctaaggttcaggcctatggccccagtttaggt

SEQ ID NO: 130254 - DNA, 439 bp, Homo sapiens
ctgttctcagagctgtatattttttaattcttttgttcccatttccctcctttgaaactgagataatggacctaataaattcagagtttgtccagatacctgtattgataaacactaacttgactggacagagcatgaaatatgttttgaagacttatttttggccgggtatggtggctcacacctgtaatcctaggactttaggaggccaagatgggtggatggcctgagcgaagtgtttaagactagcctggacaacgtggcaaaactccgtctctataaaaattagctgggcgtggtagtgtacacctgtagtcctggctactcaggaggctgtgtaggaggatggcttgaccccaggaggttgagactgcagtgagctgtgtttgtgtctctgtactcgagcctgggcgacagagcaagaccctgtcaaaaaaaa

SEQ ID NO: 130255 - DNA, 723 bp, Homo sapiens
tgatttttgtcagctgtaaagtaggggccaatttcattcctttgcgtgtggatgtcctgtttcccagcaccatcggtggaagcggctgtcttttcccattgaggagtcctgccatcctggcacctgtgccaaagcccattcgaccttgagtttgagggtttatttctgggtcctcgcctctgttcccttggtccatacaccacctttatatcaggacggtgatgctttcattcctgtggcttggcagtaaaattttgaatcaggaaatgtgagtctccagcttcgttctttttaggattgttttgggtaatcaggaacccttgagattccatgtgaatttagggtgggtttttctgtttctctgagaaatatccttgagattctcccaggaagatatattgttttgagggctttaaaactccctataaatattgctgtactttgggggcccttttcttcccacactgtgtttttgagatttacccatgctgttgtgagtacctcgctgaatgcagcacatactgcatcatacaagtgcatcctgatccatttcccctgacggacgtgttcattttttgttatggcaatgctgcaatacacgtttttagctgtgcctctttgtgcttgaatgtgaggggttttctaaggtgtgaacctcagaacagagtcgccaggccatagggtgtgcacagcctccgtctgtcctgggcggccccacgcggg

SEQ ID NO: 130256 - DNA, 856 bp, Homo sapiens
ggacgttagcatgcatatcgagtttgcccttatgtggtgggagttcaaacacacaaagacccactgtatgcacacaactgttcttgctggtttgggataggctgccatgcttttttaatgttagtacagcctgtatattcattacggaattcagataaaatttccttatgttctgctgttatgtttgatcgaatcctaatcacagtgagctcttcattagctcaatatgtggtttgccctctggaaacagcctttccccctttttctgtgtattggggatgggagtaataacattttggggaggtttttaaatctcccagaagaggaaagtggcctgctttggcaggtgtgtgcaggatagaatatgtttcatttgttctggtgccaagaatgagcgctgtactacggtagttcccttaggatttgtatgtgctctgggctcatgaagatactgcctcatgagctgtggcagttgtactcttttttgatgacctgaaaagggattatttctgaggaatgaaaggctcccatcatgactgtggatgtggaaaaccttttctagctgagagcatttatatctacaatacattttaaagtcagagttcatgttccctgttttaatcacatgactacatgtcccagtacacaaaagggcactggttggcgttctccttaatgtatttagtaaagatcagaagaaatcctttaagagtttaaatgcccctggaacaggcatatacaggctctagtcaagaatgaattcgagtgaaggaaagctgtgtgacacctggcattcctctgtgttcatggagcttatttgaggctagaagatggattttaccatctagacctctct

SEQ ID NO: 130257 - DNA, 797 bp, Homo sapiens
ggagcattttagattttgaatctttcagatttgggatgctaaaccagtaagtatatgacaaatatttcagaatcaaaaaatgtcagaaatccaaaacactttttgtcctaagtcttatgcataagaaatactcaatctgtgtgaactataggcatcaagctctacagcagttctctagaacctccccaccttgcataactgaaactgcacacccatgaacaacttctgattctacccactcccagctcctgacaaccagcagtctcttctcatattcactctggaatccacttacatgaggtccctagagtagttgaacccatggaatcagagagtagaatgtccaatgaaataaaatatttgcaaaacctctctccaaatttgtctcatatccatcaaacacacatggttcatgaggaccagatttccagcagttcattcccaccctttctaccagtcagttctgaatttgcaaatgtccacatgtatttctggaaagatccacatggtcctcacctgccctctgcagaaggagaggaaacttaaagaacccaagacagggaacatgcttctgctccaaagccaccagctcttgcctgtccccttcactctttctagatcattccttgcactctgctctatctttagaggtcactggttcaagtaagtcatcatgaaacacctgcaaaaaactgccccaccttgagcctccactgcctgatgactgaactgacctccagccttgattctggtctcccctgtgttatttctgctgaaacatccagtcccaggccagg

SEQ ID NO: 130258 - DNA, 750 bp, Homo sapiens
gttctactatgagtaaaatgctatcaaatagcatcacatgctatagagaaatctttgttaaaggaaaagtcaattgatgtgacaaatttcattgttgtcttactttaaaaagttgccacagccaccttaacctttagcaaccacaagttttatcagtcatcagccatcaacatcgaggcaagatattccccccagcaacttactgaaggctcagatgatcattaacagtttttagcaataacatttttaaaattaagatatatattagacataatgctattgcaaacttagtagactacagtgtagtgtgaacataacttttatatacactaggaaaagaaaatgtgtgtgactcactttattgagatatttgatttattgcagtggtctggaactgaacctacaatacctccaagatatgtctgtataaggagaaaggggcaaaggatttgagagtttaatgagcatgatctcaataatgggctgtggaatataagctttcctccttcctcctgcaaatgtttaatgatagcctgtgaaacatcatgagaattttggggctagagaaatgaacagacatggttcttgctctgagaaaagaaattatattatagtccattatttcccaaactgtagtcattcaaatgtcccatcatatttttgttatatctttgtgctccctgtattatcatatagtgttttttaaaattatgtacacttttaagtcttaataaacttatttgaaaagac

SEQ ID NO: 130259 - DNA, 271 bp, Homo sapiens
gccccaggcttactgtctcaatctgtgctcaatacagcagctactagccacatgtcgttagtaagcacctgaaatgttgcttgtctgaattaagatgtgctgtaagagtaaaatatacactaagttttaaagacttactatgaaaaggaatataagatattgcaatagttttatattgaatatatggtgaaatacagctgacccttgaacaacacaggtttgcactgcaaagatctacttatgtatcaattttcttcccatctgccacccc

SEQ ID NO: 130260 - DNA, 526 bp, Homo sapiens
aggactgagcacatcgtgggaacaggcactaaatttcaggtttcctcccagctcatccctcccctttcctttcctatgtatgtgcatttgtgtgacattcaacctaactgagaagggaccagtttgccagagcagtgggtttccactctgacttgggcctggtgttgttagggaaagcagccactttctgcatggctaccagaagcggtgacaaacttgggttccctattgtcctcctccaccgagtctgggtaacgtgtggacttgctctatggagaagcacactgccatacggtttctcccctcgccagccaggcagagcctgacctgggtctccccaagtgtaagcacttcagaaaaccaaactctaggttcggcagctcagtggctcacacctgtaatcccagcgccctgggaggccaaggcgggaggattgcttgagcccaggagttggagaccagcctaggtaacattgagagaccccacctttaaaaaaaaaaaaaaattagctgggtatggaggcatg

SEQ ID NO: 130261 - DNA, 555 bp, Homo sapiens
ttccatagaaaaatctgttacaattttattgagattttttgagaaatcaacatcttaacaatattgaaacctccaatccattaacattgtatatcctgtcttcttcaatctgtgagaagcttattctttgccctttgaatgttggtcatatagtggtcattggccaggacataaagaagcgggctgatgcctatccttgtttttctatagcctcatctctatagacaacattctgtccacaagtgaagaacaaagccagaagcaaacaggtggaatcctcaggagagtctttttgtaataaggagaaagatctcatatttgatttttacttctgacaggctctctggtcccatcccacctattcccctaccctaccagctgtgagaccaacaagagagctgggctacacccaacttctgtcccctcatacttgtgagaattccaaaccccgcagaccctggtctacttgggggaacccgatcacagtcccacctcctaacagcatgaagtttcaagctatgcatactacctgactctttccctttaatccctgta

SEQ ID NO: 130262 - DNA, 475 bp, Homo sapiens
atgacgggctaaaagggcccaccaaactgtaaagttgcaaaattctgtatttctaaaatatttccagagaatatcaattaggagacgatatggaaagcggggaagggtcaagagacaggttgctgaaaatagaagtgtgccccggatgctataggagcacagaaagagggcaactgatgaacactggggtgagagtggaagaggagaccctggaagactccggaaggaagttgtcttactctggtcaagcaggaggccctgtagagggagtggtgcagacccaccagcatatgcagcttcacaggggcaaaacacctgtaggtccatcacgtgttggggactagcaagtattcagcttggctggagcagaggcaggagtgggaaactggggacaggtgagactagaggttggcagaaaccagccatagtagtttttggctcatttggacaacaaggagccccacagagagagcgt

SEQ ID NO: 130263 - DNA, 400 bp, Homo sapiens
ttatggcattatgtgtctgtctttttgaccctgaagatttgtgagcccaagggcagtctgatgtcctggtgtatttgggaacttttctgttaatatgccagaacagctgcagcctctttctctatgtctcttcgtttttttttttttttctgtgtcctcattctttgtgctcactcttctcttacctccacccccttaaattggctgaatgaagattgtttgggtttttttttggctcatgttcatggaattcactgatcttaccatgttccccatcatcctgaagcagctggattgatagaatggtggaatggctttttgaagtcaccattacaatgccaactaggtgacaatactttgcagagtgggggcaaagttatccagaaggccatgtatgctc

SEQ ID NO: 130264 - DNA, 374 bp, Homo sapiens
cctcggccagcaaagggactgcatgaagggtaagccacaagagccaagctcccaggcaggcaggcagactccaccatcttgagcacaaaggccaggcgagagtacagcaggggtcaggctggccctcctcaccccattcttcatacagtagcttcccagaaggaagccccttcagaggtgaaccactgtgagaaaggcatcagcatgggcctggatagaaatagcagggaaacagagcaaggaagacagcagcctaggatgaccagcatgggacatgctggagaaagaagcctgttgtaatgctggatgtacctcatcatgatcattacagaaaagaagacagcctgtctgaaacaaggacacagaggagatag

SEQ ID NO: 130265 - DNA, 366 bp, Homo sapiens
cttcctggaagaggtggcacagtgggccacagaggctgaggggctacaacaaatactgaaaatgcagtggtcagtgaggtaacaacgggaacagaaaaagcagcagcaggcatagttggggggaatgtgacccctgggggcaaatacagtctggaaacactgggaagtccttacataaagattcctatagccagtgggaaccacgggaagctaacagagctttgggaaaaacagtaaaagcagcaggatgccgagcacccacgccctgctgggcccgaagccaagaccatgaggagattcaggagagtggtcccaggggtcagaagaggtgtgtagatctccaaaatgacctctcaccaatcaccc

SEQ ID NO: 130266 - DNA, 227 bp, Homo sapiens
taataatctaggtaaaagttaactggcttggacagggtagtagaagtagaaaatagggaaaatagattccagatgttatctgaatgtagcatctgctagatttatgaccagctggatacagggtgttaagagaaagtaaagaatcaaggatgacgcgggatttctggcttaaacaattagaaggctggaaataatcattactgagacagttacaactccagggaaag

SEQ ID NO: 130267 - DNA, 347 bp, Homo sapiens
aagtaaggcagaaaacagtaaagggaggagaaacttccataaaaagaagggaacatatttagcccttctttttacataaattagcaatatttctatatggaggtgtaatcaccagagggtacatgcagtcagagaagttactgagtaaagattgcaatttccctctcctgagtcctctccctatgtgttttagaggcccatttgctgacacaccagcaagcatttttttcctgttagcactatggaacctagatgctaggaaatacataacaagacactattgggcctcctgcaccaccaactgaattgtcagcaaagttcccacagcaaccctaaaggaccaggcc

SEQ ID NO: 130268 - DNA, 197 bp, Homo sapiens
tggttaccatgggctgacaagcagtgtgggggtgtgagggagggaaaatggggttataggatacacagcagacatgtaggatgcaaatctagagctgcaattgttatgtcatgaggattacagttaataaaatggtatcatattatggatttttgttaagtagattttagctgctcttgtcacaaaatagtaactgt

SEQ ID NO: 130269 - DNA, 648 bp, Homo sapiens
ggatcaggaataataaccaatgagtactacgcttaatacctgggtgatgaaataatctgtacaacaaacccccatgacacaagtttacctatgtaacaaacctggacatgtacccctgaacttaaacaaaaaacaaaaaacaaaaaaagatttcctcctctttaagagtatttccttaggataggttcctagaaataaaattactgaatcaaagttttaaaaaaatttaaggctgttgatacacagtcccttaatagctttcttaattgttggttacatttctgcaataatttatgtgtgcacagtttggtaaatcattgtcatctcttgattttatgtttttaaatctttgctaatgtgacagctaaacatggatttcttttacctttgttgtaatttgcttctttgtatttgaacttcctcttgtgtgaattattcatgcctttttgcctgtttttctcttaaagttctagtcttgcttttgtatctttgtataagtcctttaaccaagatactaatctttattatatttgctggtaatgtttttttttttttagcgatttgtctttttttggactattcctttttacctatgaaggatgtttttgtttatgttttttaaacacaattttacttcttttgtgattg

SEQ ID NO: 130270 - DNA, 419 bp, Homo sapiens
ccccagagcctgtggagcctgactcataccaaattaaaagtggctgtgacttttctccctctggagagttttgagctttcattttagagctgttcttcctaaagggtagaggaatgaaccaggtacctcccttgagaattaatgttctggaatgcataaagtgtgagaaagaaaaattgtcaccttagcagaacatggtcggatatgatgccagctggtccttctggaaaaatattagtgtttcttataaaacacctgatagatttgaataagcagatcaaggaagagtctggttactttttgccaagagaaaattttttgtttacttaaaagctcctaccttttaggcaagttttaaatacaactttgaaacatgcaattaatgtgtctgggaagtgtatttttgtctaaaatgaaca

SEQ ID NO: 130271 - DNA, 430 bp, Homo sapiens
cctttctattaattccaagcttttagataataacttaactctcaaccaactgccaatcagaaaatctttgaatctacctatgataagtcactgcttcgagttgtcctgtctttccaaaccaaaccaatgtattaataaactaggaatagagtaaaactacctcaacaggccatagccgcaaccgagcctgctgccaatgcctctaagccgaaggtggctgtgccacccacgaatgccaatcttggcaaatctgccagggatgtcttcaccaagggttatggatttggcttgatttgaaaacaaaatctgagaatgaattggaatttacaagctcaggctcagccaacattgagaccaccaaagtcatgggcagtctgtaaaccaagtacagatggactgagtacggcctgacgtttacagagaaatggaa

SEQ ID NO: 130272 - DNA, 355 bp, Homo sapiens
cgtgtggatgagaggcaggaccctggcacagaatgggtactctctgtcttcttgttcaaggggtagaggagccccggcataggggatggatacagcagtcaggagcagggctcagagggattcccaggttcctgggctgggtgttggtctcaggattccttcctgctttggtggcttctttctatgaagcaccatcaggcagtttgtgggtccaggccattctgagggtgtggacgctgtggctaggaacaagctcagggatggcatttggagggggcgtgtggcccatggtcaggcagtggaggagggctcaggggggccctgcagagagcccgggaaagcttcactctttctt

SEQ ID NO: 130273 - DNA, 296 bp, Homo sapiens
tgctgggattataggtgtgagccactgtgcccatccaagagctgtttcgtaaggaactgtgggcctgtattgttttattcattgtttagatgtacacactttaagtatctgcccaccattctttcatctcagatctgtcccttgggatcattttccagaaggaattcagggtttaatcttttgttggttactgttggtagtaaaacttttgtctgcacatatctttatttcatccatttttttttaaacttagttttgcttggtataggagtttaaattggtggttttacttacat

SEQ ID NO: 130274 - DNA, 446 bp, Homo sapiens
atctagaggatccctggggtctcttcctgacctcaagtgatccacctgcctcagcctcccaaagtgctgggattacaggcgtgagccatcacacctggccagcttctttataatcttatggtgccacagtgatgataaaggcagtccgtcgttggccaaggggttgttaggcagtgtatgactgtacttctgagatagaagattatccctgaggcatggtggccaaggactcctgtgagatgaaatacatgagcaattggcagttctttgtcatgagaatgattcaaaaacttctaaaagcttatacttgacagctctcactaagtagaacaggggtgcaccgactgccttagaactcatagtatggggggtccaagtgaaactgtggacttggctatgtagctgcttgggtattgcgacccagatgccttcctgagtgcttagca

SEQ ID NO: 130275 - DNA, 313 bp, Homo sapiens
agtgtcactgctccttcctctctagagggtggtttagcctagagaggcatttgaaatttgtctgacgataaatagaacttaaaggaattgtcctgagtttgaagcttctgagccttaggaaagacgggtctgagctgttttcaggctgcagtgtactttcagggcctggctgcttgtacaggttccagttcttcttccctagagagtgacctaatgttttatgtccggtatttgggggtagcttattttcctaggtgggagtctgaagatgcaggttttgctcagggactttggaatctaaatgacccagatt

SEQ ID NO: 130276 - DNA, 597 bp, Homo sapiens
gaaaactattaatctctttcacagggcattatcaaattattaggacagtgacaattccagtgcaacgataatagcagtgctccattaactccatctcacagtcctaggtaggtttcacgttctcatgaggaaaccaaacatttttcctgggggaaaaaatctcacgttgaactgtaatccccagtgttggaggaggggcctgctgggaggtgattggaggggtggacttcccccttgccgttcttgtgatagtgagtgagtcctcacgagatctggttgtttaaagtgtgtagcacctcacccttggctctcttcctctttcttcggccagtaagatatgcctgcttccccagtcgcctccaccatgattgcaagtttcctgaggcctccccagccatgcttcctgtacagcctgcggaactgttgagtcaattaaacctctttttttttacaaattaatcagcctcaggcagctctttgtagcaatgtaagaagggacgaataaagataattaatgcaaatttcattgggagagcacttgaaccatgatatataacatatctgtatagagtcttcccccctgtgaaaactaaaaac

SEQ ID NO: 130277 - DNA, 160 bp, Homo sapiens
tggtgagattataggcattagccactgcactgggccatgtgtacgttaaatttaaaatgttctctaaaaggcattttatacttctagcaacaatgtatgagaatgttttttctttccaaatcctcactgcctctgaatttgagtcttatgtatattttat

SEQ ID NO: 130278 - DNA, 103 bp, Homo sapiens
aagagaaggtttttcaactttaaaacctttacaggttattttttgacatatttcctctgttccatcccagattgttttaaagtatacgtcatttctttcagat

SEQ ID NO: 130279 - DNA, 232 bp, Homo sapiens
ccagtcttacccatcttaggaaatggtaccaactgctcaagccagaaccctggggtcactctgaagtctacccccaacctcacccccaaatccaacctaattgagcccttttaactgtatttccaaatggaacagagaatctatccaactcctctgctagcaccctggtccagccacatagcagtctcctggctgggctcttcttcagtggcctaaataatgtttctgattc

SEQ ID NO: 130280 - DNA, 193 bp, Homo sapiens
gggacttcatcctgagggcagagacttctagatttcttacgaaaacggtttcataaaagaaagaatattttaataccaaaagaacaggaaagaaggataggcgtggtggctcaagccggtaatgccagcactttgggaaaccaaggcaggtggatcacctgaggtcaggagttcgagaccagcctggccaaca

SEQ ID NO: 130281 - DNA, 666 bp, Homo sapiens
gatgttcaagttgatacttgtaaatgcaaagaaatgccgtgtgtgcgtgtgtgtaaattctcatagcttttggagtacaagaggtttttggttacatggatgaattgtatagtggtgaagtccaagattttagtacactcgtcacctgagtactgtacattttacccaatatatagttttttatcccttaccccctttcttccttctcccttctgagtctccacctccattatactactctgtctgcctttgtgtacccatagcttagctcccacttataagtgagaacatacggtatttggttttccattcctgagttacttcacttagaataatggcctccagctccatccaagttgttgcaaaagacattattttgttctttttatggctgagtagtattccatggtatgtgtgtatatatataccatatattctttatccctacattggttgatgggcacttaggttggttccatatctttacaattgtgaattgtgttgcaataaacatatgtgtgcaggtgtgtttttgatgtaatgacttattttcctttgagtagatacccagcagtgggattgctggatcaaatggtagatatacttttagttctttaaaaaatctccatacagttttccatagaggttgtactaacttacgttccc

SEQ ID NO: 130282 - DNA, 346 bp, Homo sapiens
attgacagtaaaggaaagtgaggtaatgttgtgaatttaaaagtaacataaagcttttcaatcacttgttaaaaatagcattgcagagaaacattgaaccctccttaaatgtaaatagcatgattcatcgaacatctagtcaagatgactaatctttttttctagtaacgctcaacagtctagaaggtacagaaggcggtgggtatcaaggtttataaaaggtcaggaattggaactctggggacctggttgttctcatgagggcacataccaagatcagggtgagctaggaagtttaagtgataggaagataatagatttatttagagaggggaaattgagacag

SEQ ID NO: 130283 - DNA, 519 bp, Homo sapiens
caggtccaggcgggcagcgctgtccggcgcctacctttctgcggtgccggaatctgctcgtctgcaaccgtccactttggtagctgccagccacatggggctgttgctaatgtggcaggtgtagctgaagagctgaacgctttgatttattttaattaattaagtggttatgtgttgccagtagctcccatctgggctgtgaccccatggtctgcggacctcactctggcaccagactccgagtggagctgcatgcggccaccggacagtgtggagtgcctcttcgggttgtgtagaagtaggaagtatgtcaccaacataggagctgttgctgctgcgttctctagcacacctgccttgtttgtactgctgggcgtggaatgcctctcgggctctgacagtgtcattgacactgttgctgatctccttggatttacctggtccatttggatcaagttctttcacctattcacatgagcagatatcaccttaaaaccttaaaggttggcttaacacttc

SEQ ID NO: 130284 - DNA, 447 bp, Homo sapiens
tgagagactgggataattcagaaaatgactgtgttctgtggctgcagagagtcatttccatgtagagtaaaaagccacacctcccatgggaaagcccccaaggaggaagtgaggcctgcttagtgacaggccctgcactggaaccactgataatcagagcacccatcggagggcagctagtctacacaatgagcactgtggacctttagtcagttttcctgtttagtttaaacaccagatgcccgatgcagtctccagctctgcaagggaaagaaggaaaagaaatctgggccctctaagcagtgggtgcttgagagagcactgggtatgttttcaatatactcctggagcaaactcggtgaggacctgagggtcagaggagaggcagctccgagagcctcacgtaccaagaagccagagagcacctgcttcccaggaaccctcccc

SEQ ID NO: 130285 - DNA, 418 bp, Homo sapiens
agcgtgtgccaccacgtccagctaattaaaaaacattttttttgtagagacaaggtcttgctatgttgcccaggctagcctctagttcctggcctcaagtgttcctcctgccttggcctcccaaagtgctgggattacaggtgagagccactggcacccagcccattgttaaattaagaaatttttgaagtttatatgacttccacaatttatacatataatacagaccaaagtgtggtctaacttgtatagatagttggaaatcttgtaaaatttataagctggcatcatatattttatatgctgttttggaatatatgctttttatatacatgtgaattttatgattgatatggggatataatgattatatcctacacttctgcattactccacaggtattactgttctaaagatt

SEQ ID NO: 130286 - DNA, 337 bp, Homo sapiens
gaaatctgatgaacatttctgtaacttggctatggagattaaaaaacaagtactatataactgaatttcccaatagctcatgactccttagcttttgggatctatgattcagaacattctccttttgcatttcaccagaggcattagtgaggtatgtgaaaacatgaacaagataggaaatatatttgcatagtttctgtatgatttgcatactcctccacaaactgtaatctattgaaaacacacacacacacacacacacacacacacacacacacactctcgtgtatctcccccacagggcgctttagaagcccaaatgacatgatcactactc

SEQ ID NO: 130287 - DNA, 200 bp, Homo sapiens
ggtgtgaacatcctggaagctgatctttgaggggctactcatctcaccctgactcccccctacccgcgtctaacctgtgtaagcccgagttggtcttaacacctatgcccaggacatctgttctctaactctgccctttcctactcctcatgcagcggggactgaagcctaagaaggtggtgtgtttactatttgtgcct

SEQ ID NO: 130288 - DNA, 378 bp, Homo sapiens
ttcccacttcggcctcccaaagtgttgagattacaggtgtgagccaccacgtccagccttacatggatttcatatatgtacacagatatctctaggcaagaaactagtcacggagttgcctttgggagaggttactgagattctaggggttagaaatgtgagggagacttaattgatacttacatcctctatggacattggagtttttcattatgtgcatgtattacgtttttagtgtaatgtttgatacctgcaaagcagtacatccaacatggtaaagagattaagtacatggaccatggagccagactgcctctctcagatcccagctgagtctgtgggcaagttccttaatctctctgggtctcagagcctttg

SEQ ID NO: 130289 - DNA, 635 bp, Homo sapiens
gatggggtctcactgtgttgcccaggctggtctcgaactcctagcctcaagagatcctcctgccttggcctcccaaagtgctggcgttatctcttggagttacttacattatgaaaaatctacaactacctctaaattttatttttatctaaatgatactgagaagatagcactgccagatgccatttttattatttggaatattaacttaagaaaaaatcatgttcatgctgtggcagaggcagatgtcaaaattgcatatatactttagcaaaaaatcaacagtccaggagatgttcactacaactgaatgcgctgccttttcaggcaatcctgtggctcaaataaagccatatttgcagtgcttacactttaagatcaatgtaatgtcatgtaagaaaccctccagtgttcctcacatgactgaaagttttgcactgtctacaacaaaaacactgaacactgtcagcatttggatgacatagctgcataatttggtctttctaccatattcatgtgagtgactcttgaaaaccatagatgctagctatttttaaaaaaactataatgtttgaaaaagttaagagataggatatttattcaagacagcttattctagattccatttgatatca

SEQ ID NO: 130290 - DNA, 161 bp, Homo sapiens
aatggcttataccaccagttcactgactttaactctttaaaacttaccaataagcaccagttctgaaatagctctcctttatctctgaaatgtattataagttttcaattaaaaacaaaagatctggccgagtgggatggctcatgcctgtaatcccagca

SEQ ID NO: 130291 - DNA, 822 bp, Homo sapiens
gtatagactgtttatttctgagtattttgagacaagaattagttgctgaagattttaggtgcattattactaataaatacaagtcagcttgctttttaaataaggggaggagtcatgtaagaaagaaaagccatgaatagcttttagttaacatatgaacttgtttaaagacacttggttggagtcttgattgttttgtaagaagagctaaatggtactactgtcccctctccagctgcaagaaagagaaatatgttctttgataatggcttttgtccctccaaggattgtcttattcattggattcagtgaaatagcagttggtcaaaagtctcttaagctgaaagaattgcgaggaaattagcagatagaacaccaagactcctaggagcggttctctagtagcagcacttgaattgctgaatgaatatctcccacgtggattctctatggttctatcactttataccatttactgtcataagcctcttatcaaaaactttgaaggtgtgtattattttatatatgtaccttagtgtctacacccattcacctagatctttctttgaattagattttcattgcaccttacctcaattctgttgcacatttatttaaagatctgataaactgagaaaagtatacattttgaggatacatttcaaccatttttttctgagttcatatatatcaggcattaggcagctcagaaatcacaagttggaaacatagtcttaacaaatttgttattaaaggaaagagaaatagcataaaattaagatcaaatttatcaccacagtatgtctactttcactggtatca

SEQ ID NO: 130292 - DNA, 732 bp, Homo sapiens
tgttttggtgtgtgcctgtaatcccagctactctctaggctgagatgggaggatggcttgaacccaggaggtggaggttgcagtgagccaatatcatgcccctgcactccagcctaggcaacagaatgagaccctgtcttaaatcacaaaaaacatctcggagtgatttaaagtctgcacactcttttgaacaaggatgcaaaatattgccaaagcaatattaacttattacttaaattaatggagaaagcatatctccttttatcttatattggcagagttttgatctttttgttcataaagtatttattaggttgctagcaagaaccaagttttttggcttgaacttaagtccttaaatgttctctatctaatgtgactgtagaactttggaaaatcagcaaaatggtggaacaggaatttgtgaatgaagaaaaaataaatagtccaaatactccactaactagagaatgggctctgaactgtgtgtgttttcatattttattctttccccccctcatcttagggtctgcttctattcatattttaaagctactttctctctctttctttgaattgatatactttatttctttctagctattttgaactttttatttatatttatttatttatttatatttcaataggattttggggaacaggtggtgtttggttgcatgaataagttctttagtgatgatttctgggattttggtgcacccaccaccc

SEQ ID NO: 130293 - DNA, 165 bp, Homo sapiens
aaggtcaaggaagagtgcctctgtactcagtagagctctgatatcacatttctccctctgttcttgaccatgcaagtctaattcagtgagatctatccattcagatccagcctggagctcaccgtccccaccttcctggtccagcttagcccatctattacagct

SEQ ID NO: 130294 - DNA, 515 bp, Homo sapiens
  misc_feature (499)..(499): n is a, c, g, or t
tagataacatactgtacggcgccctttttttgtttccaagaagagctaaacaataacagcaacctcacaaactctttgaataactgacattcctaatgtttatgtgtttaataaacaaatcatgttacagtctaatcattttcccagtccaactgtcttttaaaatttgcaatactcactttttcctatttcttgtttcatgacccactgaaatttacttcctccccattgtgacactgagaaagcactctgaagtcactaattaacccatcctgtgggcagtgtcctcattttgtatctccttcgctgacaacccagcaggattctgcatcttgactacttctcctttgtaaaacactttgtcccttagcgtctgtgttccccattgtgggctttcctcctacttctgcctgccctgtttcctatgcagcctcatcttcctatacagagtcattaaacgttaaagttctctagggtttggcataaggctgcatagganaaaaagggcggcgctg

SEQ ID NO: 130295 - DNA, 442 bp, Homo sapiens
tgctggaggtcagcagattggcttcttgctaggaagctgtggtattgccttagctcttaccagtgaagtttgtctaaaaggactgccaaaaacccagaatggagaaattgtacagtttaaaggttggccccggctcaaatgggttgtaacagattccaagtacctttcaaagccaccgaaagactggcagccacacatctcacctgctgggacagaaccggcatacattgaggtaagtcctaagatgtaaaatatgctttcaggcttttccttgggctttgcttgccacctttcaaaatataaaactgaatttttgcaacgttaatgttagaagatcctcctgctttgtgagatttccatcttttggcttgtaaaatgccttgtagtggatcttctatcctaattattttgatcataagtatacattcaagagaatgacagc

SEQ ID NO: 130296 - DNA, 341 bp, Homo sapiens
tgctggaggtcagcagattggcttcttgctaggaagctgtggtattgccttagctcttaccagtgaagtttgtctaaaaggactgccaaaaacccagaatggagaaattgtacagtttaaaggttggccccggctcaaatgggttgtaacagattccaagtacctttcaaagccaccgaaagactggcagccacacatctcacctgctgggacagaaccggcatacattgagtataaaacaagcaaagaagggagtgtaatgggagttacagtatcccggcttgcaatgttgtctcactgccaagctctgtcgcaggcctgcaattattctgaaggtcaga

SEQ ID NO: 130297 - DNA, 567 bp, Homo sapiens
tagaggatctcctttgggacggcggggtgacacttgccagtcagatgtgataatgcgtgctaggagggcggtgtcccgcgctggtcacacgcgcagtactgtgcagtgttggaggggccagcctgtctgcagacggtacactctgtttgcccatggagggcccccaggctggccccaaaccgacagggagtggaccgtgcaatgaaggaagaagtgcagaggctgcagtccagggtggacctgctggaggagaagctgcagctggtgctgccctctactgtctttaagtctgaattaaggctattaaaggctgtccgttaaggatctggcttcaaactgcctttccaccttcattctactatttcctctattaaaatatgctttgtgttttaagcaaattgttaatttttttttttttttaagatggagtctcgctcttgttacccaagctggagtgcagtggcccgatctcagctcactgcaacctctgcctcctgggttcaagcaattatcctgtctcagtcttccaagtagctgggagtacaggtgcgcgcctccacacccggc

SEQ ID NO: 130298 - DNA, 259 bp, Homo sapiens
accccatctctacaaaaaatagaaaaattagctgggcgtggtggtgtgtgcctgtaatcccaactactcgagaggctgaggtgggaggatggcctgagcccagagaggtcgaggttacagtgagctgtgattgtgccattgcactccagcttgggcaacaaagtgataccctgtctcagaaaaaaaggaagaaagaatttttttactgtgtgtcttagaatcaatgaattatggcttatcactcttgtgcatacataag

SEQ ID NO: 130299 - DNA, 374 bp, Homo sapiens
gaaaactatttatttaaagaaatagactgacactacccttttgctcttagtatttggtctccagcattaatctgatgatcactgatattgactgctgttcctattaaaccatgtttaatataccataaatcatgtcaaattgtacaagtctatatatttggaggaaggtaatttttaaagaatgttagcctgatgtatttatttgcattctgatttatttacttgcattttttatgtcctagaatctattataatcctctatcaggtgatcaaactttatgagattttaaaaataatagtttcgacttccagcaaatgacatacaaaatactctgatgaaattgaccttatgaacctaagtatttcccagggtt

SEQ ID NO: 130300 - DNA, 253 bp, Homo sapiens
agcctagttctaacaactaaaaatgtctccagacacggccaaatgtccccggggggaaaggagcagcaaaattgctgccaggtgagatcccctgtggcacagcaaatccaccaataagcatgtgacaagacatgtcacctcaatagtcagggaaatgtaccatcagagaagaataagatatttaatagcaggagtgcagggaaaaggatgctttgctggtgaagataggaatttagagccgcgatgggagatg

SEQ ID NO: 130301 - DNA, 719 bp, Homo sapiens
gcagtatgatgtaattactattattaacctgattttacaaattggaaaactgaggcaccaagaagctaagtaatttgccaagactacacagttggtaagtagttgagctaggatttgaaccccaggatccagagtacttgctcttcactattgctaaaatttagaaaaaatatacaggcaaaaaaaaaatacccaaagacaactatagatatggtaacttgccatctttattctgtaacataggcatccatacaactgatcctaggctttgtattcaattttgtatcatgctttttgaaacatgaaccttataatggtctttccatgttgttaaaagcttattataaatattgttttaatacctatttaaaattcccatcacataaatgtaccactgtttgcttagacattctcttatggttggccattttggctcttcagttttctgttttgatcactagcgctgcaatctctgtccctgtgcagaatttcttaatgttcttcagaatatattttcaggatactttatcagaagtgtatttccttaatccaatagtctgaacacttttagggttctagatacaggttgtcaaactgttttccaaaaggcttgtactctcttgcaatgtctacaacattacatagaaatgccttcttcattcacacttcagtgttgagaatgatttttaggaatctttgccaatgtgataggtagaatg

SEQ ID NO: 130302 - DNA, 615 bp, Homo sapiens
taggaagcaatatcccccacccaaacgacccggggctaggtgccagatggctagagaccgcctgtatagcctagagtctgagctgttattcagaccagccagtcttagctatttccctgccctttccttcagaacatacagtagagggtctgagccacgttcctcctcactcctgcttctgcctgtctcccatccttcccctcatggcccggtgtggtctgctgggcctctctttctttcatttctgtaggaattgtgagaacagtcaacgctgtcaatggcatccacctttctgcgtcctcaatcagttacttttatcagacctgggtacaaattcgagtttatgtccccaacttgggggagtgcaatggtggcacttcaatttcttcattatctgtgctcacctaaaagctgagtcactgctaaaaggctattttatagaattcagcagttgagaagtgaaagtcaaggtgaggctgaggtgaggagttgtaaagggaaaaagactttcccctgggagtcagagccagtgctctgaatgaagtgtctcaccccagtagagagggggtgatgctggcaaaggggttcggttatctccctgtgtgggcgatggct

SEQ ID NO: 130303 - DNA, 371 bp, Homo sapiens
gaggcaaagatattgccagaatgaaatgggcaagctatttgtctaatcctgtcccctatcatctgtgtaatggctattttcaattgtttggaggaaaatgtaatttcccaacataccattgaactgtgagctgtctcagtagtaaggaagaaagcaattttgttgcacctggagaaacctgagagagttctctaggataatgaggtgctgcattcagcccacttgatgtgcagacttcacactcatgcacttcccctcatctgtcaagatgctccctgggcagccatggagtcctgtgtttggaagacagatgtggctttttttgttacgtcaacctgcatagtgtgtataggggctctgcaggattttgg

SEQ ID NO: 130304 - DNA, 339 bp, Homo sapiens
aaatcagaaaccgttaaacacaaatgctcatgactgtctgcctcaaacacagcaaaacggaggttggaacaaaggtaacactcatgaccttgatcttattaaccccaatgattcatttgagcactctaaaataacgcttctcaacctttaacatgcatgtagatcacctgcaaatgttgtttaaatgcagattcttattttctaggtttggaatgaggcctaagattttgtacttctgacacgtttctgagtgatactgattcttccagtccatggaccacagtttgagtaataaaactctagttcactggttctcagtacaggatgcacatttgaacc

SEQ ID NO: 130305 - DNA, 264 bp, Homo sapiens
ctcctgacctcaagtgatccgcccaccttggcctcccaaaatgctgggattacaggtgtgagccactgcacccagccacctttctctttagagctcactctagtcattaagaatctcagtctcaatgtttgatttgtaagaaggcctcttgctccttgccaggtgcttcatcagtccactcttagatacaaaaaaaagatcctgctgtttctttatggtttccactgcccttttctcttaaacatcatactaaagtcaggcaca

SEQ ID NO: 130306 - DNA, 268 bp, Homo sapiens
acccacagtatgccagattatcagtaaggtgataatgcttgtatattatacctgcttggcaccatttgaatgaggttccctcaggccacttaaggtttcacttcctgttacttgcacctgcactaatttcagaagcaaataaaaaacccagcaaaaccgtattttaggaccttattcaaaagcaaacagacaaaaaccaaagcaagtcaacacaaaccccaaaacacagcaataaggtaattaacctgatgttccaaagctcatgcca

SEQ ID NO: 130307 - DNA, 387 bp, Homo sapiens
cgtctctactaaaaatacaaaaattagctgggcatggtggcacaaacctgtaatcccagctactctggagactgaggcaagagaatcgcttgagcccaggaggcggaggctgcagtgagctgaggtaagagggatagcgagaagaattctttcaataaatatttttggaaacctatacttgccagacactgttttcagtgtaataaataaaataggcaaagtgcttgttctcctggagtttaccttttagtgagggcaaacagataataagcagatacatatacaatttctcaggtattcataaatgctgtaaagattaaagcggctgggtgcggtcctcacgcctgtaatcccagtactttgggaggccgaggtgggtggactact

SEQ ID NO: 130308 - DNA, 314 bp, Homo sapiens
tagcctcctggtagaacttcccaactgtgagagggtgaatcagctgtgacaggcagattggtcctcttgtcctcttggcccccttgggcagtgatgttgagggacaagaggggtggatcttagtgtgtgctggtctgcatagaggccaagatagaggcctggatgagacagctccttaaggaggattctcggttcttttgcctcccccaagaggggagtcctctcctgactcactggcacaattagtcttgagaattcaaatacaaggcaagcctgaccttgcgggtaaaaagatgacaccactgacccagtat

SEQ ID NO: 130309 - DNA, 472 bp, Homo sapiens
cttgagcccctcaccgctagggtgacaccgctcttctcaccatgtgaaatccaagggtcgagcggacagatttcaccactgtcttcttccttgggctgccagaactcaacactctgggggttctcctcttaccgcactagttgtccctgacccctccaatctctaatatgggggtggtctgggatcagccactggaccctgcccttttctgggtctgcttgccccctaggtgatctcacccagccctgtggctttcagtgttatctacatactcccaagttaaaatctgtagcccctactgtgtatgtacctaaactcactctaaccacctgcctactcaacatctctccctggacagctaataggcatcagaaaacttaacatgcctcgaactgaacccaagcttccctccaaatgggctagtcccatgatcttctcatctcagtcaatggtgactctgttttccagttgc

SEQ ID NO: 130310 - DNA, 190 bp, Homo sapiens
aaaaaaaggctggtgtcaggcagctagcattatttctgaaaattactgagaacttaaaagacattcagaacatctatgcaacttgacagagttcaaaaaattgtcattggaaacagagacaatcttataaccaacatttaggcaagtctgtgtttagaatatggttagttttcaaggcaagtatgtttca

SEQ ID NO: 130311 - DNA, 859 bp, Homo sapiens
gttattagctggaacattctattaggaaaagttttccctcatcaattgttttgttacgcagaggaacagttaatgtagcaagggcaggataaatgcttgatttttgacctttatttaagaggttttaaaataataagctggtctctgtcatcctccaaagggtgacagatgagttctttttggtgtgccttgaaatatttaatgtgctttaatccattccaattagtagctttatcaatagcccatctttggctagtggaggcctctttaagttgaatctcagaccctttcacgtgatgctgtctttgttaggatgcttgctttatgacatgactagggttctaggtccatcccttacacttcctgccccatacttggaaccggtcatatgtataataagcttcagagatgtgatacttagagatcatgaagatctgggtgctgtgacatatatttattgaacttcaacaatgtgcttgtgtttgcattctgtttttcccactaaaattatacttgggctaatctgttgctataggaatttgactagacagttgaaggggtgactgtgaaagatcagatgtcttccttttgagtcctgttcaagtttgcttgaacatttgatggggtccagctctattttaaaacttttcccccccatttcagccttttgctttattgtcggtgttttctacattgaaatggaagcttctttgttttcattctttcttttcctttttccccttcggtagttaacgtcctacctagtgactttgcctttaggcaagacctcaggctgtcactgggagaggaggttggaagctcagttgtcagagtggagtgctgctggtggtgtatcatg

SEQ ID NO: 130312 - DNA, 674 bp, Homo sapiens
tacttcccattgtcttgattctcattgtattttacttttgaatgatttggacatctttcccagaataataggggtgctggaaataataatagtcttcctattaagtgctaaaatatggtaatagtaaaatattaatagattaatgataaaataacaacttttgtttactgaattcctgcaatacgttctgtattatgttccatatatgaatcatctcatttaattaccttaagtgagaaggcatgtgattaagcattcaggctttgaagtcagacatcctgggctcaaattcggtctcatttgctccataggaacctttatgacttgaggaatttaatcatttgtgctttaatttctttatctataaaattggggtagttataatatctatcttacagtgatctcataagtataaaataaagtaatttatctaagcatatagagtcatatctggtgcatagcgagagcccagttgttagcaataataattaactcttgaagcagtggtctcatccattataaaaggaggctcagaagagttgtttcttgactaatattacacagcagtaagggtggagctaaggttccaatgagaagcttctttctgttatatagcccctacatgtatacaccaaaattactaggatgcttttgcaattaactccttcaaaatt

SEQ ID NO: 130313 - DNA, 265 bp, Homo sapiens
ccctgcctcacactgtcaaagccgaggaatgtggacagaggatatgcagccacgggactcacaaaggcagccctggcttcaccatggagggccggccctggggctgcaggtacagagtggacgcccacctgggagcttttgcacgggaagacccatgcaaaagtggacctgctggactgctcagtcattcctcttgagctcgatggccttgtggctcatggcttggagtagggagatgacccaaagacccttcatgattttttcc

SEQ ID NO: 130314 - DNA, 192 bp, Homo sapiens
ttatttccactttttggttactatgaataatgttgcactcataaacactgacacattttgaaacagtgaaaagttttgtgtgtaaatttttgtgtggatatgtttcaatttcttttgtttatatacctgggcatagagctgctgggttgtatgtaactctatgtttaactgtttgaggaactaccaggattg

SEQ ID NO: 130315 - DNA, 369 bp, Homo sapiens
aggcataatactcggtactagggacctaaattatgcttaaaatatataactgaacaccaaaaaaaaaagactgacaggtaaaaataccaaattactaacagctgtgggatatggagtttttttcttccttgagttttccaattttctacaataaactactctatttttatctttggggggaaaaatttttcctttttactgctgccaattaagaaaaaattcccacacagcaaattgatttagtgatttgaatgattaacaggcttgccttctaaaaaagctcctaaactaggcagatttctcaggtctttctttcatgcctgtacctgtttgttaccagtgctatggtaagatatgggagatgtatgg

SEQ ID NO: 130316 - DNA, 153 bp, Homo sapiens
caaccccaactttgcaaaacttccattttttgttcttaactatgctaaagtactcacaatgcattgcaattgtttgtaagcctgtctcctctacaagattctgatttcctgttttgttatgttcatctttgaattcccctactgcttagtatg

SEQ ID NO: 130317 - DNA, 717 bp, Homo sapiens
gtcacatggttttgctcttgggaagttccccactgggtttgtagtagaaacagagaaaaaatccatctgttttttcttccacctcaattttctatccaccctctcatcccctataaaatcattcttctctggttagtcacctttttctcttccttgtgttgataaaaatttaaatctttagtgccatactgtcaaaatcagaacactgcctggtacacctttgtggcttaggaaaaggggatgggagtgttacagctcccctaaattggtcaggtatactccagctttattctaggatagcctttgagactacagaattgaattcccttagtagggaatcaaatgttacaatgtattctaggaacagagagctgacagagaagtggtaagagtgcattgtaagtgtaagaagtggagggtacttatcagactttataggaatgggattgtcaatatcacttggcttagctggagtccgtactgtcagttcttggcctggtagaactcagtagcctttatggtgttggaagtgggtaggtacaccctgtttcttcaaatatgttgatattgccctatatagtggaaatttataccaaaccagttaaaatagtttacatttggcctggcgcggtggctcatgcctgtaatcccaaagtgctgggattatagggcgtgagccactgccgcccgtgcacttctgaatttttgaagggtagg

SEQ ID NO: 130318 - DNA, 1007 bp, Homo sapiens
attcctgccttcacaggccctcagggtctgggaccccacgttgggaatcaatggtttagacatccagcatcctattttactgaaggggcaagcccagagatgggagatggccagcccaaggtcacacagcaagttggtggcagggtgagaccagaacccggttcttttgagggtcccaccagaatatccccagccctgatcctcccctccatgcccctggaactctaggaatcactagccatgcctgaggggctaatctccctctgtcagcacaattccgagtgattcttcccctccctgtcgtctcttcctccctaacgggccctcacccctgtcctcttctgtttccttttcctggtcccacctcctggtatttactacatctgtgccatccctcatccccctgacccccattcaccctccgagcttcccccaggagggggagggggagggggccccgagctggggcctctttactgagactcttttgtacaccacaaactttttgtatatttttaattttgctgcgacatgagatattaaaagtcatttcagtacgtgctgcttgtgtcctattgttttggctgttctgggccaggggaaggagatgaggaaggagggataggtagggtaccacttgccacaatctctgtggctcaagagagaaaggcctttggctgggagagggtgggacattacacaacatctcctgtttattgggcagcatttcaatcaatcaaccagaatcctcaggccaaaagttctacagattatctccaaactcattttacagataaagtgggtggggggagataaagggtggggatacttgtcagagatcacagaatgagtctatgacaaaatcagggcccagactgaagttcctaactccactacagccaatacttattgagaacctactgggtgccaggcagttcttggcatagtgaacaagaaagatataaaacaggcaaggtccctgccctcaaggagcttacatcctatcc

SEQ ID NO: 130319 - DNA, 600 bp, Homo sapiens
  misc_feature (455)..(456): n is a, c, g, or t
  misc_feature (462)..(462): n is a, c, g, or t
attcctgccttcacaggccctcagggtctgggaccccacgttgggaatcaatggtttagacatccagcatcctattttactgaaggggcaagcccagagatgggagatggccagcccaaggtcacacagcaagttggtggcagggtgagaccagaacccggttcttttgagggtcccaccagaatatccccagccctgatcctcccctccatgcccctggaactctaggaatcactagccatgcctgaggggctaatctccctctgtcagcacaattccgagtgattcttcccctccctgtcgtctcttcctccctaacgggccctcacccctgtcctcttctgtttccttttcctggtcccacctcctggtatttactacatctgtgccatccctcatccccctgacccccattcaccctccgagcttcccccaggagggggagggggaggggnnaaaacngtgtcttttgaagcccattctttgtctggttttaaaaacaaaagtgaatgccgtcatgttccttgatgtgtgtttttggcacatatgtttgttgaaatgtttatttactgcgccggtactgcaattaagactcaacat

SEQ ID NO: 130320 - DNA, 344 bp, Homo sapiens
tgggtggctcacctgaggtcaggagtttgagaccagcctggccaacgtggtgaaaccccgtctctactaaaaatacaaaaattagccaggtgtggtggcgggcacccataatcccagctacttaggaggctgaggcaggagaattgcttgaacccaggaggcagaggttgcagtaagcagagattgtgccactgcactccagcctgggcaacaagagtgaaactccgtctcaaaagcaaacaaacaaacaaaaaaccttgtgtgggtgaatcaaacacatctgcaagcctgattcagcctgtagcccaccagtttgcagcctttgtttagatccgtagtggaga

SEQ ID NO: 130321 - DNA, 393 bp, Homo sapiens
acttgtacaagcatatttatagcagtgttgtttgtaaaaatatgaaattattattaaggaagagtagtaaaccaggtcagatttatacaaggaaatactagaaagcagttaaaatggatgaactgtagttacatatgtcagcctgaattaaacaacgttgaatttaataggtgtgttgagaattacaggtacagtatcatacaatttaaatgatattaaagaacatgcaaatgatactgtatttatgcatttatgtatagtgaaagtataaatgcattcattcacatgttgaatactgtatttagataacaagtgctatgtctagagaaggaagagaatgagatgggggagataaagcatcagagatttgtattctatggatatgtatttaag

SEQ ID NO: 130322 - DNA, 533 bp, Homo sapiens
aggctggatttactgtttctcactcaggtctgaatctcattcccatctatagtaccactcaatagggaggaagctaaaatccacagggagtccaagggaaaccagccatgaccccaggtccagctcagtgcagcaggtcctgaggcccagcaccggacaccaactatgtaatggcagaagttaataatacatatgtgagtgattccttaactgaaaccacccccaaatccatttcttctgcacataaaccagatagtccacaatcttaaaaacaaaacaaaacaacaacaataaaaaccagtaaggatttcagggcaaaaaggctgtttcagctaggtctgtttagggaaggaaaatgcttcacagtgtaaaccaaggaatgattgaaaagtctagtagcaatgctgcaaaagccaggaaaataattaacctcactgggtctaattttctcacctctaaagtgaaatttgccttagctctctattctctagcacaataattgcactagtcccccaaagaagtacacctatatg

SEQ ID NO: 130323 - DNA, 344 bp, Homo sapiens
aattaatgctcaaaaatcagttgcatttcaatacaccaacattcaagctgagaaccaaatcagaagctcaatccaatttacaatagccacacacaaaaataaaatacctacaaatacattcaactaaggatgtgaaagatctctacaagaaaaactaaaaaacactgatgaaataaattgtagatgacacaaacaaatgaaaaaatattccatgctcatggataggaagaatcaatatcattaaaatgactacactgcccatagtaatctacagactgaatgctgtttctatcaaattaccaaaatcacttttcacagaattagaataaataattcaaaaattc

SEQ ID NO: 130324 - DNA, 327 bp, Homo sapiens
atgttgcccagggtgatctccaacttctggtttcaggcgatcctcccacctcagcctcccaaaccactgggattacaagcgtgagccaccatgttggcctcttaaaggttttcttgatccatgcaaagcaagtgcatgtcctctggtcacttctgggacttccctcttctctcgtctaagctgagcaccctgttttctgcaatcctgagcccttccctcttcctgggctccccaaggggagggcagggaaacattcttccattccactccgtgccgttccatcccttactacctctccctccctctaaatgtttgcttacctggtgc

SEQ ID NO: 130325 - DNA, 285 bp, Homo sapiens
cgggatgcctctggggtgctgggcctggttaagtgcttgtgcggccccagcaggtggaggggtgactggaggccagtgttttacagtagtgaaaataggtcataaaggcaacccacatgctggatgaagaagtagaaaaagcacttttaaggaaggtattttaacaactcagtgggaccatggaaagagtggcctcttattttgctttctggctttcacctggttattgaaaaaaagatagaagatggtctgtccatatgcaaaaatctgtaatcacccggcttt

SEQ ID NO: 130326 - DNA, 279 bp, Homo sapiens
ctacagttccattccttggacctatctacccgatgcccccacccccaaacctgggttccaataacttccctcttcactccttcagttctcggggaggcccagtttgcactgctgttgccagccagagagaccgtagctttccttatggtttccctacaacctttgtaaatagttcctttattaaactcttttcaaattacccaatttgtgtgatccgtatcttcctgacttggaccctgatatttttactgaatattgactagtaagtgtattgctcat

SEQ ID NO: 130327 - DNA, 348 bp, Homo sapiens
tagctgcctctagaggatacacaactcagtgggcaagctgcatagtggcccgtcagatacatattttaaaaaacagattgcatccaagagtgacagtcaacgtggagtctgtcatatatgaaaagatagcagttcagttcagaagagggtctaagtagaaagaacttagctgtttctgctatagaaaaacctttcttactggttatttttccgagtggtggtctttttgcttgtggctttggggtctatctggaagcttcttttctatcttgcctgagctagaggaatgttgccctgccatcccctcctagtctgagttcccccgcattttaaatcacaactcatcct

SEQ ID NO: 130328 - DNA, 292 bp, Homo sapiens
caggcaggagccatggccaggggtgcaggctggggttttaccataaaaaattgtgggaagccctggagaactctaagcagggaaggaagaggatctcactttttttttcttttttgagactgagtatctcactctgtcacccaggctggagtgcagtggcacagtctcggctcactgcaatctctgcttctcagatttaagtgattctcgtgcctcagcctcctgagtagctaggattacaggcgtgtgccaccacgcctggctaatttttgtatttttagtagagtcgggg

SEQ ID NO: 130329 - DNA, 232 bp, Homo sapiens
gaggttagggagtgggctagtgtgggagttcaagcatacaagcaggggctaatgtggattgaatgtctcaccagcaccaaatgagggtgacccaggctttcttcctaccacatctggatgtagggtacatagtagaaaaggaggaatgagattttattttatttattttatttcatttgttttgagaccgagtttcgctgttgcccaggttggagtgctgtagcgtgatctc

SEQ ID NO: 130330 - DNA, 359 bp, Homo sapiens
atctaatatagaatgagatttccgaggaatgagagtcaccaaggtatgtgggccacacaagagttcaaacaaggtgtgtggggcccaaaaatggtagaaggtgaggtcacttagaggagatgaaccggaaatccttctgggagcacaaataggtgagggcacttggagaagagggacatcaactattggtttttattggttaattttatattggttgctggggcatacatgtgaagaagtgacataagttcctcaccccaactttctcaatttctatatttagaatgtaagattttcttttaaacctaatattaacctaatatcaaaattaggtcaggtgcagtggctcacacctgtaa

SEQ ID NO: 130331 - DNA, 384 bp, Homo sapiens
agaggctgaggcaagaggatcactagagcccaggaagtcaaggctgcactgtactttagcctgggtgacagagcaagaccctgtttgaaaaaatatatatatatttgccctaaatggtggcgtgtgcctatattcccagcttgggaggctgacataggaggattgtttgagcctaagagtttgaggctgaagtaagctatgaatgcaccactgtactccagcctggatgacagagcaagattccatccctcaataacaaaaacaaggcaaaagacccaacagacatttatcaaaagatgacaaataaatggccagaaagccacatgtggtaggtagcacgtgcctgcagtcccaactactcgggaggttgagatgggaggatca

SEQ ID NO: 130332 - DNA, 596 bp, Homo sapiens
gaacaatccctgatcttcccccaagtccacagggctggggacctaggaatcggtaagaattgcagtgtacctgggcctagggtgccctgtagtacaaaaatggctgcagtgatcactggcttagggaactcgtcagcccactttgaattcctggaaggtcctctgaaggacaggtacaaacaagacctgactgcaaaggctggaataaataccttatccttcaatgcccagatactgacaaacatcaacagtatcaataacattgaagccaatatgacctcaacaaatggaccaagtaaggcactcagtgaccaaccctggagagatggagacgtgtaactctcagggaattcagaatagctattttgagaaagctcaatgaacttcaagaaaacacagagaaacaattcagaaatatatcagaaatttaacaagattactgaagtaagagaaaaaaatcaaatgctggagctggaaaatgcattagtgggtctcagtagaattgatcaagcagaagaaagaattagtgagcatgcaaacaagctatttgaaaatagaggagaaaaaagaaaagaagaatgagcaggaacacagaa

SEQ ID NO: 130333 - DNA, 220 bp, Homo sapiens
aaataatttctgattgaacactagattaagaggaaaaaataccacaaatgaaataacttgtatttttgttacgcaaaggattattctaaaaaataataagctgttcctctaagcccttttagaacacatggaaaacttcagaatagtgtgagggcgtcttacatgcacttctttctttggagattgtgataacccaagtagaggatttaggattgtgctg

SEQ ID NO: 130334 - DNA, 668 bp, Homo sapiens
gttcctaatgttttactaccttttgttttctgcagcagagtcacatttctctatgtaagaattaatatggaggcactagatttgggtgcaaaattaacttttctagaccaagacatttttttccccttgaaatcctcattgtaaataaaaactgtaaaactgttaatactgttatttttgagagactcatattcttttttgtctatacatatatttgtaattgcactatagttaatgagcttgttttagcaaaatgtgctctggaagtaagtaaactagaattctacaatataagaaaaagttggaaggatctccagctactcaaaatattaaagttgctttggcgtgctaaactaaattcagacaccaaatgaatcagataatcaaataacagtcaccttaagtagcatgccacttactagtggcatttaaatatttcttttaagatactagagaaaagcttaatcaatagagaaaattattggaaattaaaaataacttttaaatcaatgagtatgatacatcaaattaaatttttgcattttagttacctgtcttgtactctggtaaagataaaagtggcatgtatttttatttgaactttttagttttgtatgtgtagaaacaaacatccaagataagattattttgtggcttgtgctttttct

SEQ ID NO: 130335 - DNA, 391 bp, Homo sapiens
gtgagctcttcagacccacttgggcctgccctggccagacacgcgggatcccgccctgccagcaggagggcctaacatttacctttaagcttattacgaagggtgtgcgggaactctgcggagaatcaggagctccagcaagtatgatccctgttggcagattcagcgttttgatccccagcccttggatggataagctgcaaaacccacaggccacggcatctaggctcggccagcgtgggcgtcctggggcgattcagtggcttgcgggttctctgacccacttgcccaccaacagcagctgcagagagatcggcagcacgtgccccagatggtcgtgctttggagtcatgagcgctggggtcccagtgatgctcactgaacagcaact

SEQ ID NO: 130336 - DNA, 375 bp, Homo sapiens
agttatgaagattggaagggaaaaaaaactaattcacaagcagtaggattgtatatgtaaaaatttcaaaggaacctataggtaagttgttagaatgagttcagcaaagttgttggacacaagatcaatatataaaaatcagttgcaatttctatatgtcaccaacagttagaaaataaatttcttgcctgggcatgttggctcaagcctgtaatcccagcactttgggtggccaaggcgggcagatcacctgaggtcaggagtttgagaccagtttggccaacatggtgaaatcccgtctctactaaaaatacagaaattagccgggcgtggtggtgggcacctgtagtcccagctactgaggaggctgaggca

SEQ ID NO: 130337 - DNA, 331 bp, Homo sapiens
tggttcagagttaccgagagaagagtcactaaccagtgtccctggtctcaagaaacgcacgctggtctcttcaggaccaaggacagagcacaacgtgcgtggttgctatcacaatacttccaaagaaaggcaggatccccgccaggcgccgtggctcacgcctgtaatcccagcactttgggaggcccaggcgggtggatcacctgaggtcaggggttcgagaccagcctggccaacatggtgaaaccctgtctctactaaaaaaaaaaaaaaatacaaaaattagctgggcatggtggcgggcatctgtaatcccagctactggggagac

SEQ ID NO: 130338 - DNA, 281 bp, Homo sapiens
aaggtgggcagtaagaactctgccctccaaaaatttgaggttgtctatcttggttggtgttagtgattccctgagggactagcacagatgcctgcctttctttgacctgctctggcagatttaaagagacagagatccatttctttttttgacccagacatttaaagaaacatgtcaggtcactggcttgggttatttgtttccttactgttgagttttgagggttctttatatattatagttttaaaaaacctttcttagctatgtgatttgtaaatatt

SEQ ID NO: 130339 - DNA, 527 bp, Homo sapiens
gtgctgggattacaggcatgagccaccgcgcctggccacactgtctcttttaaaactgtttcttacatcatgatgtgtgagaacttcgcagccattaaaatatatgtagagcttcaaatgtgcctttaaagtttgaatcttttgtgattgtttcatggtggtaatactgggaacgtatttcttttaaaggcccaatacaggttccttccccttccttcctgggcatggaaatcatcattgccttcctccttggtaaaactcttctgacaaatgttggagtaaagtgttttctttttctgtttctttttctttttcttttcttttcttttcttttttttaagtctagtcaagtgaagcagtgggagtggagaaggaacaaagaaatctgtaagtagttgtgatcagctagttgtaaacaccactgcagtcagaccagccaggggtgaagtgttttctgaggatcctggaagattaatatagtgtctagaaacataaaccagttggcattgtacatgctagaacattct

SEQ ID NO: 130340 - DNA, 625 bp, Homo sapiens
aacgtgagataaagttagagatgtggccctataggcagaggaaccctgaaaaggtaggaagcaggggagggacaaaatcagaggagagtttagagaatgaatcacaagggggcgatactggccacagggagactgaggagtccagagcaatgacccaagaaagaaaggtcagatggtggcaacgagaatgaatggcaaagctcaaacctaatatctgttgtgaagaaattaacaggactttaagtgacagagtaaaatggtgatatgtttatggatgactccgcttttggtttaagtgatgagataaaagggtataccatgaattgagataaattaaaaaggaagaaaatcagttttcaaggaaggaatgaaaaatttcttttagacacgtggaattctaatacatcgtacaagtgggaaactcttggtagatggcgatctatataattgtgcacttatatgggaatataagctacagataaatgtgagtgtgtaagtatatgacatgcatttattagcataattttcttgggtaatgtttagccaccctggtttagaagtacagaaaatggatgcaactttcaaagtcagagtttggatcatctatgaagttccggggatgatg

SEQ ID NO: 130341 - DNA, 149 bp, Homo sapiens
cctgtcctgagctgctctgactagccagggctctcctccccacagtcatgaagcccagactaaccatgttcctactcttatctgggagggcctggttcactccccccaagttctagatttgagttctacatttcacagcagtgaggaaa

SEQ ID NO: 130342 - DNA, 914 bp, Homo sapiens
cagaccagaccagaccagagggatcggaggctcaggccccctgagctgggcctctaagaaccacagccacagagtcaggctctgcagacccagaggtaaggctgcctggctgccccccccagacactcctctccttgcctgcaggctgccctctcccatggccaccctagacagagacaccacccgtgatactctgagggagccagactttcacatgcaacggggcatttggggctggttcgggtcagtgtctacgggtggtggatttagtgaccaccctcctcccacttctttctctgcacgaggagttgggagcctgcctggtggagttgagtgatgcccgtcatgtgcacttgggtctaccaatgtgcttaaggccagatgggcttcctaagagacaagggtgggtggacctaaccaactatcatccccagcgatgttcaaacataaaatcttatctatgtgcagcatgactctctccaggtgacagaaagggctctagacagctgagaggacctgatcatgtagggagggacggggaggggagccaggacccaggagctgcatggctgtaagaggaaggtccttggagggtatcagcagtctcagtgtgatgtgacaactatggacctgtgggtgtgccctggggacccctgacccatcccaaaacactgtggaaagaagggcctcttctccgtggggacccgtgtctgtgggagcgggcacaggtccatgctgcaggccactacggctgctcggcaggagggccgagagtttggacccacatagctgcaacccaagctggcccataatcagcagtggggcccagcagcacaggaggggcggacggttagctttggaaaaaatgacttgattaatctgattcgccaaataaatagattcatgtgaaaaat

SEQ ID NO: 130343 - DNA, 319 bp, Homo sapiens
ccatgcaagacacctgacacctgtttacagccatttctttgagcacattaaaatgtgagctggagtgggtgccgtgcgctgagtggctcccctccagctatgccggatcactgcctggggtgggggtgcccaagaaccagccactgtctagactgcaagtgcctctgacctggggcaggtagggggtgctggagggtgtatgcgtgctctctgaagcatgaaggggttcagggagttcgcagcaggctggatcttttgagagagccacttgtggtcttgctgagagccctaagcaggtcagtgtggttgggtagaaagg

SEQ ID NO: 130344 - DNA, 501 bp, Homo sapiens
agctgaagtggcccacactatactaaagagataattccccagtatgaactccctttgacgattcagagtgaccatggtgcggtgttcatctctcaggtagtacaggaagtgtctcaagtcctagacattgaatggaaacttcatgcagcacagccacagcccaccggaaagactaaaaaactgaatcaaactatttaaagaacaattaggccaggtgtggtggcttatacctgtaatcccagcactttgggaggccaaggcaggtggattatttgagcccaggagtttgagaccagcctggccaacatggcaaaccccatctctactaaaaatacaaaaaaattagctggacgtggaggcgcatgcccttagtcccagctgcttgggaggctgaggcacacgaattgcttgaagccgggaggtagagattgcagtgagccgtgatcatgccactccactccagcctgggcgacagagtgagactgtctcaaaaacaaaaaa

SEQ ID NO: 130345 - DNA, 346 bp, Homo sapiens
tttcttacctgatactggggatctgccgagattggccactcattttgggttgatcttaaaactttgatagaatttaagggccccaaaaatgcctcttggggcctgtcctgctctgagcatggttgttccccttcactttgggataatatcacgggcccgacactgcctatgagaagcagaggctcacctgtcctcctgggcgtctttcggcagccatggtcagaacacatacctggctctgttttagggagagtaaaactagcaggtgggcacagctgcaaagtccccagctttgaacaggaccccaaaggggaaacagtcactagccttctctgtaccccacagt

SEQ ID NO: 130346 - DNA, 816 bp, Homo sapiens
gtttggatcgatagtaaactctttttttcctctactgtacttatcatagtacccctaattctgtgctttgggttgaaaaagttaagctctgtatgctacaggatgtgtaataaataaagcaaatgactttcaagtgaaaataagaattacatttgaaaagaaagaaccatgtctgtttaattttgtgaaaatgttttaaatatgtttctctggaggatgaaaaaaatttttttctttgtttctctgtgtataggggtgtttgtctttttattaatccttaaattatactattcttttagaaaagaaagccttcatttgtgtatcttggctagctttccgaaagcgtttacataattttaaaacatggtcaaatggtccatacatttcccatttcgttctcgtttaatatttaataatatggaattggttcacgttagttttactaccagatctacaaaatctagtttttgtttcaagcagtaaagtctcaagtttgtgtcagtttgatttactttgatatattagcatctttttcctaatgaattttttgtttaaaactgtttcctggtctaagtggtacatctgctcctcagtaactgaccagaaggcacatgaaagaagaaacattttcagtgaagaaaattgcatcagttgtcattttttacctctctgtgacaaggaaatgttgttataatcctgacgtagcacagcttttagttccagtttatagttttgtagccatctaattacatatagatatagttattgtgtcttgtaagcatttctcaattacttttattacacaaatctttgcat

SEQ ID NO: 130347 - DNA, 454 bp, Homo sapiens
  misc_feature (443)..(443): n is a, c, g, or t
  misc_feature (445)..(445): n is a, c, g, or t
cataggagtcaggtggttccctgggctactccatggtgcacaggatgcttcgttacactggtgcccaggacataatcacgtacacaagacacacagttacggggcagactggggatatacggcacaccagcatgcagcgttcaccagtaaaggtggtattccatgattattctaaggtagatgggctgtgctttgtttccattggcttagtccagggattggcaaactatggcccgtgagccaaatccggcccactgcttgtttttgtaaataaagttttattggaacacactggctgctgtagttgtaacagaaactgcatggccctcctttatgttttttgtttgtttgtttgtttgtttgttttctttgagacagagtttcgctcttgttgcccaggctggagtgcaagttagccgcgatcaaatcactgtactcttagncncgggtgaca

SEQ ID NO: 130348 - DNA, 772 bp, Homo sapiens
atctacttgacctcctcacagtctccctttctatagtgcaagctcgactagacagtttgacaatagtgatattaaggctctgcttggtgccatgcaatctgcatttggggtgccagctagccacaggactcatctggaaaaaaacaacggcccaaccctgagaactttgggattcacgggaaattacagttcccctgatgatgcaggaccggaccaggatttcactcatcaactggcctagattaaggagaaagaaatctacatttctgaacctggtaacgtctgagcatactcatggaagaaagagctggcctatgagcgtccattaagaacacaataaaatatcttcatgaatgatcctccatttggaaacaaatgcatttggatgagggaccatctctcgaagctaaggattaaaatatcgcttcagtaccacaaagaaattaggctgttccttttggagtgttttaatagttagctgagtgctcctcaggaagaagccacatacccggagcgtaaccaggagacagtcatggaaccgtaacgcagaccatggactgcagcagcttggtttggagctgggtcaaacctcacagtaaggctccatctcaggcctggctgcaaagtcaacatctctctgcatccatgttttcacatttacctttctggagcggcaataggaaaatgtttccctaaaagaaaagacagtgatgctttcatcgaaagaaaaagtaaagaactattgtgtgtgcctaaccaatcttacaggggg

SEQ ID NO: 130349 - DNA, 783 bp, Homo sapiens
atctacttgacctcctcacagtctccctttctatagtgcaagctcgactagacagtttgacaatagtgatattaaggctctgcttggtgccatgcaatctgcatttggggtgccagctagccacaggactcatctggaaaaaaacaacggcccaaccctgagaactttgggattcacgggaaattacagttcccctgatgatgcaggaccggaccaggatttcactcatcaactggcctagattaaggagaaagaaatctacatttctgaacctggtaacgtctgagcatactcatggaagaaagagctggcctatgagcgtgagtcattcaacaaatatttctgagtttttacagtgtgctagatactctttacatgctgaatgagacagcaaaactaagactgctcaggataattgagaaattatcgctttcttcctgtaggcatcccctgcttttcactaacacttttttcttcttgttggaagggtggatattatggctggagctgcagcagccatcatgccaacatgagggaaaagctgatggaattgtggagactttggccttgtgattcagccctggatgagttgtctccacattacttatcatataagagaaaaacaaaaaaaaaaaaaaaaaaaaacaaaattttgtggggcgggcgcgggccccgaaaaagtttttaaaccattcgtgtggggcggggggcccaagggtgttagtgaccattggccaacagcgggccaaaggaacctgggcagcaaacgggggggtttccaca

SEQ ID NO: 130350 - DNA, 760 bp, Homo sapiens
gcctgtgtgcccttactcagtttctcctaatgttaacatctgttttttattacagtgaaacatttgtcacaacaagaaattaacaatgatatattactattaactaaactgtagactttatttgaatttcattagtttttctactaatgccatttttctgttttaagacccagttgaggatacctcgttgcattcaatcatcatatctccttagtctctctgtcttctatttgattgttttttaaatcccctttcccctctttttccagcaaatggttgttttacattctctttctattcttttaaaaggggttttacattcgatttctagtcttttagaagttaccaacacactgtttcttagggtgtggcgagagagtcacatacgcggttgttgctgtagtactataaatggatacaacttctgaggagggaatttgatgtgcatgtcttttgatccagcagctccactccagggactcagtcctacagatttatatacttacatgcatttaccaaattattcactgtgtcattttttatagttgtttaataggatactaataaagaggtgctttatatatggataagaaataatgcccaatatatagttaaatgaatagggatagggggtgaaaaatgtaaaactgtattttactttagtatgccatgataaaaaggtttccttatcatctccctataccaaggggtagatttgttttctggtctaccctttcaccaaggttcagctcttgaagag

SEQ ID NO: 130351 - DNA, 482 bp, Homo sapiens
  misc_feature (453)..(453): n is a, c, g, or t
  misc_feature (455)..(455): n is a, c, g, or t
  misc_feature (458)..(458): n is a, c, g, or t
tatagcgttccaggcaggaaaacaggaagagtgaagaccaaaggcatttagggaagaacaaggaagtaagtgaaccaatgtggcaggaatgttcagagaggcaggaggaggtttaggaccaagccaggatgctccctacaaaccaagggaagagataagtagaagacaaataacacagtcagcaagtgtcaaatgctggggaaaagtcactggtggccttggaaaggtgctagcagagtggagaggtttgaaagctacaatagtcttaaaggatgcgaagtgaggaaatgaagcagcaagtgtaatctttcaaataatcagaattatctactactactactgctactactattactactactgtagatagcatgattccttcattcatgaggtagaagtgtttgttttatgaaaatttactgtttgaaaaacaaacatgattctaagtttacnantcntggaagatataccacaggaaatga

SEQ ID NO: 130352 - DNA, 547 bp, Homo sapiens
ttacagactgctctggctacagttaggtaatttatacgcacgtgggtgtatttactactagtcaggaacgtagaggagggcatcctttagtgaattttaaaattctactttagcaccttaaaatatcctgtaacacctgaattctgttatttcttttcttgctccttgagattctactccacacaactgtttctagggcacagtaggtagggattcctgagtactcccctgaggacacacctgatggaggtggcagggagtatatatttcattcagtgtagaattgattaaaaagtgtatgaggccgggcgcggtggctcatgcctgtaatctcagcactttgggaggccaaggtgggcagataacctgaagtcaggagtttgaggccaacatagtgaaaccccatctctaccaaaaatacaaaaattagccgcgcgtggtggcgggtgcctgtaatcccagctactcgggaggctgagacaggagaattgcttgaacctgggaggcggaggctgcagtgagctgagattgcgccaccacactccag

SEQ ID NO: 130353 - DNA, 2508 bp, Homo sapiens
atgcacaagctggattacgtgactccgctgctgctgtgtggagagggaggctgctgaacccgagctggtgtgagcttctcttgccgtaagtccacgggtggccaggagcacgtgttagtctggttaagagctctgctcagaagtagccgctgcagctgaaggttttcaggcgggctgaaggctgggccgcttcttcattcatttcagaaacttgaacagtgggccttctacacacgctgtctttgtcagcctcaggcagttcctccatggatgagacacaggggcctctggccatgactgtccatcttcttgccaactctgggcacggatcccttctgcagaggactctggaccagctcctggattgcatttgcccagaggtccggctctttcaggtgtctgaacgggccagtcctgtgaaatactgtgaaaagtcccattccaagcggtaccggcttccagggatgtccgtgttgctcttcctgcacgaaagcccgggagaggataggctatttcgcgtcctggactctctccagcattcgccatggcagtgctaccccacccaggacactcggggaaggctgtgtccctacttttttgccaatcaggagttctacagcctggacagtcagctgcccatctggggggtgaggcaggtgcactgtggctccgagatcctgagggtgacgctgtactgcagttttgataactatgaagacgccatcagactctacgagatgatcctgcagagagaagcgaccttgcaaaagagcaatttttgtttcttcgtgctctatgcctccaagagctttgctctgcagctctccctgaagcagctgcccccgggaatgtcagtggaccccaaagagtcttcggtgctgcagtttaaggttcaagagatcggccagttagtgcctctgctacccaatccatgcatgcctatcagcagcaccaggtggcagactcaggactacgatggcaacaagattctgcttcaggttcagctgaatccagaacttggtgttaagaatggcatcttgggagctggcatgcttcccctgggctccaggctgacttctgtctctgcaaagaggacctcagaacccaggagccagaggaaccagggcaagaggtcccaggggcattctctggagcttcctgagcccagtgggagccccacatcagacaggtgtgctggcacttcgtggaaaagccctggccggtcattccaggtcagcagcccagctatgggtgcccacctgcacctgtcttctcatcaccttgaatccggggccagaatgaaggtcctcaaccgggaaaacagctttcagaagcttgaggccgagacgaatgttgacaccggcttgaccatcataaattctgaacccaggcagacttattttggcggatttccaagggatttacagaccagccagccaccattctgcttgccagcctcttccttgggggtggctacctccaaaaacaacagtgtccttaaggaaagagtctctcctttgccacttgctggccaaagggaccttggtaccgggaagacaatttcagaatgtctccttcatctgcaagttcagggtgaagaaaaagaagaagatgaagaagaattctttatatagcataaaataaatgtggttttctaaaacacaagatcagataaaatgttctagaaatggagtactgacccagaatcagcctgttagttgttcatctgaggggggctgaatgctccccatgcacaatctgtattgattttatttcaaatgttcaaagtctaaaggtgctgggaatgattgtttatttgccgtcacagtcataagagaacacagccaacacacagggaaaaaaaccgaatgcttttgttccgtggagatgcactaacccagctggatgtgttgaatccagcacctatcaggataattgcattgtatgcaaatgaatcggtatgttatacaacactaattagtgtctgtaatttggttttaatttttacttaggttgcatagctcatccccctggacaatatggactgctatttactcttgaatgctttttaattttcatgtgacctcttttggtaactaggccttgttcacataccctccttgtgattttgtctttaaagttgtttgtatctggaatgagtgaaaatgcaaagtgttttgaaaattataaacagttaattttgttttcctgtttaatgagccaaaatactggaagccagaaaatcaggttgaacatgaatgctaggctctagggctttcctgctcatctgcttctcatttgtttctgcactatgtcaaagaggacagtggttcttgttacaaaccaaagaggaacattgagcacagtgggaaaattggactggttgatctggtcactggagcaggacttgggttcttctggccagattttgactcccagattcctttacaaaacgcactcattcattcatttatatatgttcattcaataaacattttttgaatacct

SEQ ID NO: 130354 - DNA, 344 bp, Homo sapiens
aatttctgtcattttttcctgcaggtgaagacctggttccagaaccagagaatgaaatctaagaggtggcagaaaaacaactggctgaagaatagcaatggtgtgacgcagggatgcctggtgaacccgactgggaaccttccaatgtggagcaaccagacctggaacaattcaacctggagcaaccagacccagaacatccagtcctggagcaaccactcctggaacactcagacctggtgcacccaatcctggaacaatcaggcctggaacagtcccttctataactgtggagaggaatctctgcagtcctgcatgcagttccagccaaattctcctgccag

SEQ ID NO: 130355 - DNA, 1003 bp, Homo sapiens
tgatttatgtctcagagttagtgccagtcatagaaaaaaaatttcaataggacaaagaaagcgtcagtatcatctcttgcctttcagttggtcagtgctgcttttatgctgttacctagtacccataaccaccgtcttgtaatacgtgatcactttctaggctctaaagttggctgtccccatcaaattctcttgtggaattgctcagcaagcagtttgagattggatagagctcattcagattttggtgttcatgactaataatttcgaccggaaacagcttgtgcttatagagttgtgttattatctaagttgaaatagatgccaccgcatacctaccagcataatctagcaacaggaaacatgctcattttggtaagaggtactctctcttctaacataaagacttttaaatctcagcaaacttatttctttcttgtggcaatcttgtttttaagaaagtacatggatttaagaaagtaaatattaatatgatcacttacactatattcaagagtagtttcatgtagtacttattctaataaaggtgtttttaaaaaggaaatagtaaatagcatctatacagcatttactgtgttcttgggttggaagactcaatattgttaattgatctgtatatcttttcagtacaactgatagtatacaatagtagaaaaatgtatttcttctatctgaatgcctctggtgaacttctctggatcctttaagacttcctgaatattttatacattctctagttatagcatatactgcatatattaaaatgatttactcatttttccactagattgtgagcttatgtagtatttgttatatggttccatgtttctcctcccttgttttggtactttcaaataatagtagacactggagaaatgtttactgcgttaaaaacaaaaacaaaagtggttaactttgagataatgtggctataatgtgtttatgaaataataattccatgtagaaattaccctcttttacc

SEQ ID NO: 130356 - DNA, 282 bp, Homo sapiens
cagtagcaagacacagggacatcccaccacaaaggaatgaatatttaggtacagtgaggtcaataaataagtcaccaacttactgaaacgcccagcaaaccaaatcacaaatcctttcaaagctgtgtcttctcatttctaaaacagaatatcacactatctggctacattggactattgtgagtgttaaaataagtgaacttagcatagcatatggcatatggtggaggctttaataacaacagttgtcatcatgtgccccctcccatataatctccgatc

SEQ ID NO: 130357 - DNA, 579 bp, Homo sapiens
gacttcactctgcagtaactgctgaactaggctgtaaggcctgtttgtgtgaataagataggacgataccatttgtatgcaaaagtttttcaagtgtctccttgataataggaaacactctggctaaatagccttctggttatatggttaaggaaataattgactagaagtggcatgaagaagcagacaacaaaagtcacttccatcagggaaccaagaccttcattaatccagagggaaaactagtgatttttctagtccagtgatgggcaattcgaagctcaaagtctaatttcagggagaaagatgaaaaacaacctgcatccagccgggcctggtggctcacagctgtaatcccagcactttgggaggtcgaggtgggtggatcacctgaggccaggagttcaagaccagcgtagccaacatggtgaaaccccgtatctactaaaaatacaaaaattagccgggcgtggtggcttatgcctgtagttccagctacttgggaggatgaggcaggagaatcgattgaacctgagaggttactgtgagctgagattgcgccactgcactccagcctgg

SEQ ID NO: 130358 - DNA, 311 bp, Homo sapiens
gcagctgcaaggccgaatatgaccactaacacatttttgtttagtctgtgcattttttaaaaagtttgacttgactgccaacattgggaaatcaaaagattttacataatgtgaactaatggaacttctgaaagaaactggaagatgtggcaacccaatctgtgttccggagctgagcagccattaccctcttctgaagaggcactctccaatttgttgaataccaattctgagacctggtggcaatcgccattatttcatgttgctgatattttccccttgaacctggccgtcttgctcgtgtatttaca

SEQ ID NO: 130359 - DNA, 429 bp, Homo sapiens
caggctggatcacggcttaccacaacctccgcctcccaggttcaagtgattctcctgcctcagcctccttagtagctcggattacaggcatgtgccaccacgcccggctaattttgtattttaagtagagatggggtttctccatggtggtcaggctggtctcgaactcccaaactcaggtgatccacccgcctcagcctccaaaagtgctgggattataggcgtgagccaacaccctcggtctgacaaaactctttatacagctgttctataagacaggttctaggaaatccacaaaagcctgagattagtgaaatgggtgaaaagaggtagaaggggctaatataaggttgccaatgttttcttttcttttttttttttttttgagacggagtctcgctctgtcgcccaggctggagtgcagtggcg

SEQ ID NO: 130360 - DNA, 254 bp, Homo sapiens
gctctacctatactgcctttcaggctaacgaagaacttcagccatgacagtgagaagtatcactcagctatcagagctgacttactgcttccaaactgctgccaatctggggaggcaatagcgctgggcggcgccggtatgaaaatatgagatgcaggctgggcgtggtggctaacgtctgtaatcccagcactttgggaggctaaggcaggcagatcacctgaggtcaggagtttgagaccaggctggccaac

SEQ ID NO: 130361 - DNA, 746 bp, Homo sapiens
tgctcaacgcgatttcccttcgcgcttctccgcaccgggatccccagtccctcaggttccgacagaccctcctgtcaggcccattctccgggccccctcagttgcagtgttaagatcaacagtgttaagattaaagccttgtgatgtgctagccactacgctgaggatatgccgtgtactaaaattcctcaggactcctcacagctgccctgtaaggaagcggccatggccgggttctagcgatgcgaggccgaggctcggggcgctgagtagcctagcgcgtcgccgaggagagctggcacgtgaaccccttgtcgtttgccgtcagaggtgttatgtggtggccctcattctccatgcatggagcagactctaggatctgcagttactgtatgatgagcccttctgagtattttgcttggctttgcacctggcgaggtaacattgagagtagttaatctctagactggaatccatctggaagaccactcaataacttgtgattagctggacctggtgatgcaagcctggagtcccagttacccggaggctgaggtgggaatatcgcttgagaccaggagtttgaggctacagtgagctgtgattgtaccactgcactccagcctgggtgacagtgcaagacctcatctcttaaaaaaaacaaacaactcaaaaaacctcatcattgagcacctatgatgtgccagcaactgtactcagtggtggggacttgacgacaaacaaac

SEQ ID NO: 130362 - DNA, 700 bp, Homo sapiens
cgctcttgttacccagtctggagtgcaatggtgtgatctcagctcactgcaacctccgcctcccgggttcaagcgattcttctgcctcagcctcccgagtagctgtgattacaggcatgcaccagcacgcttggctgatttttgtatttttagtagagataggttttgttatgttggccagcctggtctcaaactcctaacctcaggtaatccgcccacctcagccttccaggtgctgggattacaggcatgagccaccgtgcccagccaataagaatttttcctaatgtctcacttgcgtgtcatcctcgctatctagatgatagcgcagttgctatcagtaaagacttgtatttagttatgtatactcggctcctaaaacagtgtctgacacatagtagttattttataaatcttggttgtatgaagaccatttaagagaagaccagtttaattatccactcagttctgtggtggagcctgacaacaagttagggaaaaaagaactgtggtaacaaggaagccagagctttatgctaccagcttccttcaaaagtcttagctaaagtggagctgctaagaagtaagatgtttgcttcagtagtatggccagggcaaatagcagtatatatcacatatttattttaaagtttttcataagctattattttatttaatcttatcgagattgcggtgtttg

SEQ ID NO: 130363 - DNA, 158 bp, Homo sapiens
agaatgaaactctgtctcaaaaacaaaaacaaaaaaaaccctttgaaatcctgaaaaggatatgctgaggaagcagctttaattattatcctgacaaagctccaagaactagtagaaaattgaattctaggagttcgagaccagcctggccaacatgg

SEQ ID NO: 130364 - DNA, 372 bp, Homo sapiens
cacaggcctatgttatctcatcaactagctcagggccatctgagctggattaaatcctgagatgagtagcttctcaccccctggggataaaatctctgcccttcactactggtctggcctgaagatgtttgggagcagtggaaagagcagagctagagatcagaaagaacatcacctgctctcttgtcaccatgggcaagaacttaccctccccgggccttctttctgcatctgtaaaatggggattttgtttcttttccagctgtatgttgtgagctgtcaaaagagagcaagtctgcagcagcagcttggcacacatttgacactcaaaaacaaagacaaagaaagctgttattattaaggttctctgtc

SEQ ID NO: 130365 - DNA, 260 bp, Homo sapiens
tcaaaccatagtgctctgccagtgcctaagtgcctttatgtccctgtaacaggctgatgtccagttccacttactcctagcaaacaggatcccaatttctagaatgacagatacatccctatctcaagcttgccccacctaggtctacttcctcttattttcccacccccacttccctacagccccacaacagtatatgtattttgggtaaagtagacagatactcaaataggagtcagaagaccttggttctacctcta

SEQ ID NO: 130366 - DNA, 185 bp, Homo sapiens
gctgcagggtctggggctgcagggacagagaggacgcaggacccaagagacatttatttggaactgaccactgtgggaaatgacttagagctttctggcttggcctaccaggaagaggggaagacagatgggaatgcaggttacatggtgctagagactgaactgcgtccccctggattcatgta

SEQ ID NO: 130367 - DNA, 418 bp, Homo sapiens
gggaggcgtggcagatgcctgggagcaaagtcctcgagaagaggcctccttgaggacaggagtcatttgcgattggaatgatgatggagaatgggggtgcagaagcttctgggtttgtgacttggcagtggtgggtgaaggcgttcctggaagggttattagatccagagaagggaggagagctgtgtgggtgagaactgggaaaggaagatttacagacagagaatctgaggactgagagagttggctcatggagcaggaaagcgagtgtaccagggagacggtgagacccacggcccaggcctcttggccttctgcctggctcctgctcggctgcgcagatggctgtgttctcagaggctacatctcatgcctgcgttgtcttcctctccccaggacctttattgggcttgaggtc

SEQ ID NO: 130368 - DNA, 370 bp, Homo sapiens
tctcccaccatgccctacaccctatctccaacactggggattacatttcaacatgaaatttgggtggggacaaatatccaaactatatcaacaatctacttaaatgttaattttgagttacactagaaaaggaactctgctggccgggcgtggtggctcacacctgtaatcccagcactttgggaggccgacacgggtggatcacgaggtcaggagatcgagaccatcctggccaacacggtgaaaccccgtctctactaaaaatgcacaaaattagccagccgtggtggcgggcgcctgtagtcccagctactcagaactaataatttcctctaataatttagcatggtcataggatacagtagggaga

SEQ ID NO: 130369 - DNA, 365 bp, Homo sapiens
tgctaacgggcgggcagaagccggccaggtgaaaagaatggggcagaaactgggggacagaggaggaaagggaggagaaacatgtggatgggggtacagctgcctcccagcaagtcagagcacagggtccccccagcacttcctgggttactagggtgatggcaggtgaatacagaatagcagggccttggaatgtctgccgtattataaggttttttgtttttgtttttgtttttgtttgcaggtaaaatatcctctgcctagtcttcccaggatggagggtgttgcagattgaatggtctctcctccagattaatatgtagatgtcccaactcgcaataactcagaatgtgaggtttttggaa

SEQ ID NO: 130370 - DNA, 323 bp, Homo sapiens
ccccaatagctgaagggtaaacggaagttgagagaatagaaaaagtgaggagtgttccgggcagaaggaatagcactggtaaaggtcccctggcttgagggaagttggcaaataggagcttacagaaaacctgcagggctggatcacacagaatgcaggacagtgtggcacgagggagaatgctggcaagacaggcagggatcagaccgtgcaggggcttgcgggctgggtgaaggactttttttcagtcttaaataattgttaataaaaacaccaaataggaaacaacttaatgtctgtcagtttgttaagttatggtacat

SEQ ID NO: 130371 - DNA, 419 bp, Homo sapiens
agaaaaacaaaagcaggtagaaaaacaaaaaactccccccaagaagctgcaatcacaaaacagccctcacacagacttgcagtccaaagttgtactacctgggcgatcagaaaatactcagtgctcctactgatggcaggagaagggcaaattagttttcaaaacctcaaatctttggtttcggataacctagaagagttagacatgccagcaactccactcctagtttataccccacagaaattcttgctcatgtgttccaggagccatatgtaagaatgttcctgctggacgtggtggctcatgcctgtaatcccagcactttgggagcctgaggcaggcggatcacctgagttcaggagttcaagaccagagtgtgttgatcctttctgttgccctgttgccaagaaggccttggt

SEQ ID NO: 130372 - DNA, 349 bp, Homo sapiens
aatgtaacataagattatatcaggtagacttaacattaaaaaatttacttttacatcacaagacaaatctgcagccacaaggtggcaatgtgccatagacattgaacaaaatgttccataacagctactatttaatagtcctagtaaatgcactaagaatggatgcctaccctgtgaagcaatcaaacaagttagggtccattctacttacttattttctcttaattatgagtgacagctgcataaaatacaaatatttctcatttaaggttcatcagcatctgctacttatttttcacctgatgttaaattttttcagcttgtagaattacaattaattactctgggg

SEQ ID NO: 130373 - DNA, 451 bp, Homo sapiens
ggattgtcaggccaagggtggggttggggttcccacagaaggtaagaaactgagtgggacagaccatacccaggaacccagagagtctgggaacagtgttccaaccatgagccactgtgcatgtcatatgatgatatctattccacagtaggtattttagtcattacattcttaagaggaaacaccattggctggcttggaagctaatgtaaaatagatgcttcctaagtctgaaaggctaactattgagcctgttcagccaagctggaggtgctaccatctagcctgagcaactcctgcaattactcgaataatcccttagataaaaaatataggtctggctatgtcaacccacccatgtagagtaacagcactgctcttggcacagagctacacttggggcggtgtcccaggtaagataccacatagcactaaagtgaagaaggtagca

SEQ ID NO: 130374 - DNA, 440 bp, Homo sapiens
ctgctccaccctcaactgtcattggccaggtgtagggacccatatagtgttatatcaagattgttgccaatctagagttaccgaggcagacgggcagactgggagcaaggtctggactgcaaccttctgtgctgagcccagccttagggtggtcagggtggatgagcaaggagatcctggccccaggctggcctggcttcaagctagccaggaaggagaggaaaggaggcccaagaggcgttcgacctgcctgaggccatgtgtgggactctgtcctgcgttttgtcagcccaggctgctctcctaagctccgatgaagtctcttccctgggcctggtgctccacgtctccctgtctcttccctggggcctggggctgagtcaggcctgggggctggtgggcactgaggtgacaggtcagcagggctcgaggagatggtg

SEQ ID NO: 130375 - DNA, 647 bp, Homo sapiens
cctcaaggtgggccgaggggtcgcgcctccggtcctaggccgctcccgggtctccgcgctccctcctgtgggagaggcgggcgcacacacgccttccgggtctctccattttcgctgcagaagcgcagcagggaggtctagcttctctctccccgccttgccacgcctcgtgggccccggctctccccagcccagactctgagggcagctgagcctgccccgcgccccgcccgcaccctccacatcccacggcttggcttgtgcgtgttccctccccgccatctcacacccctctctccttgttgtctccctcccccgagcaatttcaattacaatatatacaccaacaagacaatgttcaagcagtaactactactaatcaacgcccataatcatacaaagcccccgcaccaataggatcctcccgaatcaacctgacccctctccttcataaattattcagcttcctacactattaaagtttaccacaacacaagcccatcatactctttcacgcaagaccaattcctacctccatcgtaaccccataaaacatcaccaagacctcaaccccgtgaccccatgcctcaggatactcctcaatagccatcgtgtagtatatccaaaagacaaccatcattccccct

SEQ ID NO: 130376 - DNA, 532 bp, Homo sapiens
ggccaacatctaaaacctttacttttctgaggagacaagctataaatctatacggatatttctacaacgagaattcactattacatatgaaccaatataatttgatgtcaaatattcacaattaggttgaaaaaatcccctacttggccgggcgcagtggctcatgcctgtaatcccagcactttgggaggccaaggcgggtggatcatgaggtcaagaaatcaagaccatcctggccaacatggtgaagccctgtctctactaaaaatacaaaaattaactgggcgtggtggcaggcgcctgtagtcccagctactcaggaggctgaggcaggagaatcacttgaacccaggaggcagaggttgcagtgagctgagatcgcgccactgcaccccagcctgacgacagagtgagactcagtctcaaaaaaaaaaaaaaaaaatcccctacttatgttaagagtaccaaaaatagggccaggaatgatggctcatgcctataattttggcactttgggaagccgaggtgggaa

SEQ ID NO: 130377 - DNA, 361 bp, Homo sapiens
agcagagattgaaaaggatgggtcaaaggatatctgtaggtacaaatttgagagatagtgccaaagagtttttcaaagtgattatacctgtttactctctaaccagcagatgtgtaagaacttcagttcttctactttgccaataccttgtacagtttaatcttctaaaattgtaattttcttcctcgtgtctattgatatctcattttggtttacatttttatttccttagtaactgagactgagcaccttttcatatgtcattgaccagtagcctatgttgtgaagtgccagttcaggttctttgcctggttttcttttgaatcatttgcttttttctcattgatttttaggaattatt

SEQ ID NO: 130378 - DNA, 810 bp, Homo sapiens
taaacatttatagttttttagtttaaatttctaaaaggaactctaaaccatgtataagtaacaaagcaaacagaacttgaaataattaccaagtaagcagttaccgagttactaaggtaacctaccaggcaagttaacattgtaagttaccagataggtgtttaaaatccatctctggccgagcacaatggctcacacctgtaatcccagcactttgggaggccgaggcaggtggatcatctgaggtcaggagttcgagactagcctggctaacatggtgaaacctcatctttactaaaaatacaaaaattagctgggtgtggtggcgagcacctgtagtcccagctactcgggagaatcgcttgaacccaggaggcagaggttgcagtgagccgagatcacgtcactgtgctctagcttggatgacagagcgagactctatctcaatcagtcagtcaatcagtcaatcaataacaaaatccatctctgctccatgagacatacatgctcttagaaaagtgaatttgccggccgggcgcggtggctgacgcctataatccgagcactttgggaggccaaggcgggtggatcccaaggtcaggagatcgagaccatcctggctaacacggtgaaaccccgtctctactaaaaaatacaaaaaattagccagtcgcggtggcgggcgcctgtagtcccagctactcgggaggctgaggcaggagaatgggtgaacccaggaggcagagcttgcagtgagccaagatcatgccgctgcactccagcctgggcgacagagtgagactccgtctc

SEQ ID NO: 130379 - DNA, 400 bp, Homo sapiens
ttcttcagttatttcaggcaagagggtaaatccagttccttacttcactccagctggaggtctcctcctcattattttatatacgttttgtggaagattaactttacaatttagtttttaggtaacagaatattcagacaggactgcgactccattcatggagtaattatcgtagctcagagatgaatattattactctctcccagagacggatgcagtgacttttgggactttgtgtgtctcttttctcaaggagagactaatagcatctttatttctatgaagaatagttgcattgtgttagatagaaaagaatattttattttattttattttattttattttattttattttattttattttattttattttatttttgagacagtctcactctgt

SEQ ID NO: 130380 - DNA, 417 bp, Homo sapiens
tttctccaccagtctctgggaggtggaggaggagggaagaagagcagagtgatctattgtaacatcgacatataaataatgccacttcatttagaacataaacgtggcgatggtcggttttggtttaacgtagctcttcaaaatagctcctctcttccttcacatgagtatctgggtgaaggtaggtgagcaggaaacagtcaagactatgttaagaatttgcatatggctaacaataccgtactgtgtatttgttaagatgaccgatctcatgttaagtgttcttaccacaataaaaacatccaaacaaataaataataaaagaatttgcctgctctatgaaacagtttgcaagctgttgctaggggcagccttatttatctgtatgtaaatttaagatgggggtctgcactggaa

SEQ ID NO: 130381 - DNA, 394 bp, Homo sapiens
tccaggaacagtagctcacggttgtaatcccaatgagactgaagtgggaggattgcttgaggctgggagttccacaccagcctaggcaacatacagagactccacctctacaaaaacagaaaaattaatgggtatggtggcgagcacctgtagtcccagctactcgggaggctgaggtggaaagtttcctagatcttgggtggtcaaggatgcagtgagccatgatcacactactgtgctccagtctgggtgacagaatgagatcctgtctccaaagaggggaggggaggggagggaaagcccacctctcactcaccacagcaagcgggaagccaactgcagagtcccatggtcagccatgatgctcagtgggtaagacagtattttgtaaagg

SEQ ID NO: 130382 - DNA, 299 bp, Homo sapiens
ccataaaagaacactgggccaaatgatgtgggatgcccctctcttccactatgaccaaggaaacctgtcagtgctacaaaaaggacctcaggagccacttttgcctttgcctgatgggaagaaaaagggaacggtggattagaagctcaccaaggctgtgattcagatgttcccatcctaaagtgatctgacttggctcagatttttataacattaaataagtaccagtaacaacttgtgtaagtcctgaaatgtttcgtattgccgcataatgaagtacacaaacttagtggcttcca

SEQ ID NO: 130383 - DNA, 744 bp, Homo sapiens
attctgagaagaggtatataggttttaccagactgtcagaggagtacatggcacaaaaaagctaaagaactcctggggtggtgggctcaagtcctgctcagtctcctagccgtggaactttagaatagcaacatctgagactcagttttgtcatctgcaaaatggtttaagatgagtgatgattttggtgaagtgggtgagaatctcagtcaagggatgacttcttcttcctctggttacattaaaaagtgtgacgccttctttaaagtactttgcttttaaattaatgaagtagaatcattaagaaatcacccgaaatcttcaaatctgtttatttgcatttgtcttctcagtcaacagcagtgttgtaaaatatactaaatttatatttaaatatatgtattaaatatataaagttacatacactaacatttttacctttttagttgttgcattttaaaatattttgtagtctctagttttctggtaaggagataacattgtattccttactcatacttttccctatgatataacatcttttgagttttttttttctttttgtttgattgtttttgtgatgtgtaaaaattcaggagtggagcagcagggaaggaagggactgccaaccaggcagttctggaacattccaggtgttttttctctagtctatcacttttccttttaatgaaaaattcatcactacagtcccaatatgagtaatcttcctatttatttttatgt

SEQ ID NO: 130384 - DNA, 372 bp, Homo sapiens
aatcctagtgaaacagattctgtgtccatcctcattttatggatgaagaaactgaagctcaggcaggttaattattgtcttagtccatttagcattgctataaaggaatacctgaggctgggtaatttctaaagaaaagaggccaatttggcttatgggtctttggctttacaagaagcatggcactggcatctgcatcaggtgagggcctcaggctgcttctactaatggtggaaagtgaaggggagccagcgtgtgtggagatcacatggcgagagaggaagcaaggtgtggaggcggtgccaggctctttttaacaatcagttctcccggtaatgaacagaggaagaacttacccttgagcgaaggcac

SEQ ID NO: 130385 - DNA, 661 bp, Homo sapiens
agatgttctgtggggaacaaaatagaaaccgacaaagctcaagtcacacagttctgaaaatgaaaggaagggcttcctctcttgaatacctgcagtatgctctgccgtcacaagcataaaatatatcatgatttacataagattttcttcttatatctaaaaatgaaacccttctaagttattctttcctggcgccctgtgaggtagcccactattacaacccagatgtgtgactttctcaaggcataaaggttcaacagcagcaaatatagcaaagttaaaaatccttgccatcaaagtcttcattctgtgccctgaattaggctttgcctctcttcatctaatatttggcacctcaaaagagacctgctgtaggtagccagaggtccagactgtctgcacctgcttccctcaatatagcaaactatttttcttaaatatctgggattcagaaaagccccaaatgaaattaattgtgggattttctgtgttttttcttattcctgtaggtatttataaagaaatacaaaccttatgttttgtgctcaagaacctttgattttcaagtcaattctgacagagcaactgacttaattacttgaatgtttatatactaagccacaaaaatgttttgtcccccaccctccccacctctctttgg

SEQ ID NO: 130386 - DNA, 489 bp, Homo sapiens
aggctgaggcaggataatcgcttgaactcgagaggtgtaggttgcagtgagccaagatagcgccgttgcactccagcctgagcaacaagagcgaaactccatctcaaaaaaaaaaaaaaaaaaaaaaaaaaagaagaagaagaagagcttggtctcctctaaaacagggaagatggatagtctccatggctctcaaagcatgttctatgttttggtctaaaaggcaagcaaccacaagatgtagaagctatgcttaatctatttttctaacatgtcctaaaacatagaaaatattttaaaaactaaggccagtatttaaaaatatatctgaagcagtgttttcaagattcgtatttcaaaatactctgagatattaagataattgtagtacaattctacaattaaatattctgcaagcattaaagcttatgaggcaacagtttattgacctgggaaaaagtttacaatatattgctaaatgaaaaagag

SEQ ID NO: 130387 - DNA, 245 bp, Homo sapiens
tggtccaggggtttgaatgagtgtggggagcaggcatcgactagagtagctggacagtgaggaaggcaaggtcatggagaacttgagcgtagatggctattctgaaaagtgtggctatgaaaaaggggaacagaggaaaggggcgggtgagaggcttgtttttgtacaggggtatgttaaagttggaaaagcttagacatgtttaaatggtgatgaaatgggtacgggaaaaagaggaacataag

SEQ ID NO: 130388 - DNA, 718 bp, Homo sapiens
tgcacttctccttcttgccatcatgtgaagaaggacgtgcttgctacccttccaccatgactgtaagtttcctgaggcctccccagccttgcagaactgtgagtcaattaaacttctttcctttataaattacccagtctcaggtatgtctttattagcaacatgagaacagactgatacaccgacatactctcttatctgtttctccattctcccctcctcttgctttccccaagcccaatcttaactgctccctaagagaaaaagcatacctctgagaaccttccagcacctccagcactgatccagtttcttagatctttgtttcaacttcagtgggagataaaggagagaaataatctctcaatggagagtgaaaaaacgagaagagaatacccaaagaataatctgatgtaaagatataactctaccatgctgttttcatattttgataaagacgctggaagaaagacataatttcctactaaaagagaaatgagaaagtgcaatgataagtgtagtgaagtcacagaaacaagtagggactgtggaggacacatgcctgtctaaagagggcagcagccatccagccagcctgggactgcagtgcggtaatgtgagcccagtgttcccagatctcctaattttttgagagatgccagaaatctggatttttatgtgaaagcatccaatttcataatgttggctcaggaaagtt

SEQ ID NO: 130389 - DNA, 347 bp, Homo sapiens
ctttgataaggggcagctctttatccctggtttgttggggtttgttgattcagtgactgggctcccacagaagccggggatttcgtggccacacggggcaggtacagctgacagatcagcttccctttcctgctccaccacgaatgactgcgaatcagaggccccctgcgctgcccaagttagtgcctggggtgagcgttgtcttatcctctcctgagttggtttgggggcttcaaggcctggccttagtagtccccttagggaagccctctgtacttcagcctctgaagctccccctttttaaatccccctggagccggacacctggccatatgttctgaggagct

SEQ ID NO: 130390 - DNA, 167 bp, Homo sapiens
tctaaaggagaatttattccactgcctcttgcaatgggcttttcttcctgaaaagtgttacctacaagtaaataggagaaataaagagataaagacagttctttaaaaagaaaagagcaagagaaaggaagccaaaaaaggaaagcaaccaggtcagcaggttgatt

SEQ ID NO: 130391 - DNA, 512 bp, Homo sapiens
tgagagacagagtctcgctctgtcgcccagactggagtaaagtggcacaatctcagctcactgcaacctccacctcccaggttcaagagattctcctgtctcagtttcctaagtagctaggactacaggtttgcgccactgtgcccggctgatttttgttattttttagtggagatgggttttcactatatgttggtcaggctggtctccaactcctgacctcaggtgatccacccacctcagcctcccaaagtgctaggattacaggtgtgagccaccatgcttggccttgaaaacaattttttaaaagaacaaatgtatgcataatatatagaaagcaaatgcaacacattgacaacaatcaaatctaggttaagagtatgtgtgactgttacattggtgttaaaatttttctgaggttttaacttttccaaaactaaaaaaagttgacagggaagaattttaatgctgacaccaatgtctgggaatgaacaatacatagtttataaaag

SEQ ID NO: 130392 - DNA, 505 bp, Homo sapiens
  misc_feature (176)..(176): n is a, c, g, or t
tcccaaacaccgcaatctgccttttcttctgccttctgtgataggttaaattttttctttctttaagacagggtgtagctctgtcaccgaggctggaattcaatggaacaatcatggctcactgcagccttgacctcctgggctcaagtcatcctccttaccttggcctcccagantagctgggaccacaggtgcccaccaccggtacccagcgaaatttaaatttttttttttttggtaaagacgaggtctccctatgtggcctaggcgggtcttaaactcgaaggctcaagtgatctgcctacctcatcctcaagggatcttcccacctcggcctcccaaagtgctgggattaccggtgtcagccaccgcccccggccataccaccttctctttatctattcatctgttgctggacactttgattgcttccaaatcttggctattgtgaacagtgctacaacaaacatgggagtgtggatacctgtttgatacacttacttcc

SEQ ID NO: 130393 - DNA, 422 bp, Homo sapiens
ggttaagtcaaaacattagacaaggtcataatgttaattatttgaatatgttaaactgctgaatatacatacgttggtgcaaaagtaattgcaatcttttgcaccaacttaatatatacacaagtgtatatatatttgtgtggtggtaggactaattacttaaataatttttctcaactttgcatatacttttttcttcctgcatttaatctagtttcatttggattatgtctagtttctgtggaagtagcttcataaataatttaaatgatctttgatttgagactgactcttaaaaatggaaattgcatttatctgggttagaattttatctaggattttaatttaatagctgttatttttactttcaaattcatattttaatacaattaaaagttgggttttttaatttggggacagac

SEQ ID NO: 130394 - DNA, 450 bp, Homo sapiens
gcatcaagaaccaatatagatttgttgaatgaacaaaaactgattttacgtcagcttgtgagcctcacagaaagccacttcaaaagaagagaatttggctgggtgcagtggctcatgcctgtaatctcagcatgttgggaggctgaggcatccaatcacttgaagtcaggagttcgagaccagcctggccaacatgatgaaaccccgtctctactaaaaaatacaaaaattagccggggtgatggtgggctctaagatatttaatacctaggaaatccaagagaatcaactgataaactgctttagtaggtcagcagagaatagacgtgtaatgttcattgtataacaggggtaggagagatatggagtctacttctaattagtaatgaaagtccacaataccctgagatagccttaaaagaagcgtcggggccgggtgcagtggctcat

SEQ ID NO: 130395 - DNA, 631 bp, Homo sapiens
tagagaattatatctgccctctaccaaatacacaggaataatctgagtaatgtttataactgtgatctgagaactttttgagtcttttgcaaatctgtaaacacagagtgagaatgagatatgacagtgtggtaaaagaggacttttgagatttattaatatttagaagtacaagggggaagaatacttttatagtatgattataatgttaaagatattcttcctttagttttataaaatgtggcttttgatcagtaagtggcaacttagaagaaaagtctatcctaagttgatttgctattccttgaccttaagaactatagaacactttattttctcctaagaccacttttttgtttttattttactccattcattaattcattcagcacataataacgaagtatgtacttggtggcaagcactgtggtaggacctggggatatgaagttgaagaagacctgggccatatctctaaaaaccttgtgaggggaaaccaagggggaaaaagtttctactattttaaataattagaatagattttattttatagttaaatttgaagaaaactacaattttagttagatttactatgccatctttactcatttgttcactcccattcgttcat

SEQ ID NO: 130396 - DNA, 201 bp, Homo sapiens
caccagttgatggacatttggattggctacagattggggttgttgaaaataaaggtgttatgaacatttttatacaagcctcgtgtaaatgtgtaaataaatgatttcatttattttaggtagagacctgggagtagaattgctgggtcaaatgctaacccgatgtttaagattttagaaactgaaactgtttttcaaagt

SEQ ID NO: 130397 - DNA, 154 bp, Homo sapiens
tctgcctgccttggcctcccagagtgctcagattacaggtgtgagccaccgtgcctggcctattatagatactttaaaacaagtgttactgaaatataattcacataccatacactttacttataacttttaacgcacatttttcacttaatat

SEQ ID NO: 130398 - DNA, 724 bp, Homo sapiens
aacctgtggtaaaacgattggctatgagcatttaatcctctttgaaatgaaatgaatactaaacaattctgggaattaggaaaaccaagagaatgtgaatgtataaatctaggcagtttcacaattataattaacaaaaatagggaaatgagggaggggaattagaagggtgcatgagaatgctaatgtcttcatcttttgttgaaggcaggatgtcagttggtaccgtctaaattaaaacatgtagttaacaaattattctagcctcttaattttttttcaaaattctcttttaaaaaaaatttaaagtgatcttctgagaaatacatctgcagttaaaaagtatttttaaggttcactttgttttttctattaattttaaattgagttaaacttaatgctcagtaaattaagattaataatcatacgagtttgtttttttaatgtgtatgtttctatcgtctgtatacccttctgtgtacttgtgtgtgggcacatgcacacacacacactcttctagattactgtctgatttgatcttctaatattgatgattatttctgttttggatttaagatagctttttcttctttttgctttcatttttatactattcttcattgttttaagtctctatactgagaatatcttattttcattaaagtaattctgactgtttaaaaaggtgaggggttggtaaaggagattagaagcaaacgtgcca

SEQ ID NO: 130399 - DNA, 463 bp, Homo sapiens
tccaaatagctgggattacaggtgcccgccacacgtctggctaatttttgaatttttttagtagagacggggtttctccatgttggccaggctggtctcgaactcctgacctcaggtaatccgcccgcctcggcctcccaaagtgctgggattacaggtgtgagccaccacgcccagccttgatttatatttttaaatgatcaccctggctgtcatgttgagaatgggcagtaggggtaagacagaagctgagtgcacagaaaggaggccgtggcaggaatccacgtgagtcagggggcctgcagcaggagggagcagtgcaggtgctgagaagtggttggctttggatctgacttgaaggtaaagctgatttgctgatagattggatgtggggtgtaagagaaagggaagactcaagggtgactgagttttctggccagcatagctgtaagaatggagcgtc

SEQ ID NO: 130400 - DNA, 428 bp, Homo sapiens
aatctaagtgctaaagtttgttgaattgagtggaaggaaaataaaggcccatagttatggtattaagtagacctcaattaaattgatattgctgtcatttgtatgttataaccatgattcaaatactggggaaagaattatatttcatgtaaaaagcttttacagatgttaagatgtagagtctatcctctaggcttaaaatagcttctttcataattttttaaacatatgcattttcattcaggacagcagggggcagctttattagcaatgttgatcagttaaacagtaagttatcgtaaacatcttgtactgcacattttaccctaatcgggtggagtcaacaaatatgtaagtgatatctctgtttatatattgtcaatagtatttatttgcttaataaagctcccgatgtggctggtaattgg

SEQ ID NO: 130401 - DNA, 615 bp, Homo sapiens
aggaggggaacaaaatagatgacccaaagcactgaaattcctatttaggtgaaaactcagtatgatcagggcactatgaccctaactactcttcatctcctcatctcacttaccaaatgaagatattgagagcactaacctgacagaagtttgaagaacaagaaaaaaactgagttatgcataatgtgtttcatatgattatctagctttttttattctttcttaaggagccagataaacacgtagttaacgaattatgatatgaagtaattcataatgtatgatcttgtcccttcctaaaatcccatagtacacattctctgtattcctctggggcccatctaccattttctaccagaaatttccatggtttatgaacttgcatcattgtctctatttgtcttcaatgttatctctggaggtattcacatattttggagtaaatccggatttaaatccagattttatatttattagctgtaaaactttgggcaaattactcaacctctctgagcacctagcaattttctattttataggattatatacaataatgtattgagatgtctagcatttagcaaattctgaattaaaattgaatttgaatgcatgagt

SEQ ID NO: 130402 - DNA, 622 bp, Homo sapiens
tgttctcaatgccactaacataactgctcactataaagtggttaattttagggtaggtgagtttcaccgaaataaattattcttaaaattgacatgcacgcataaacagtattctgaggaaggtgtgcaataatttccttgctgcagaattgaaagtgctgttagtgactaaaaacatatggtaaccagaaccttcacaccgtctccccaaccacccatcagcatcaacagttgggaaaactgatgaggtacaaacatatccagactttgtaattatccgtggaacatcacaagcatatacaatgccacatagtaatcaatctggttccctctgtttatgagtatttgctttacaaatactttctagttcaggtatttcccattcagcagcgacacacacaaatgcacatgacaagctggtggcctcctgtgcctcttcattaccctctcaggagcctgggtggttttattttcttagggcttctctaatactttgaaaacgtcaaataaaaagtaagtgactcaaatttctcccagaatttttacagcatttctgaagacaggtttatttacctatacggaattctgattacctaataagaaatgtatcaccacgcctaga

SEQ ID NO: 130403 - DNA, 295 bp, Homo sapiens
aggagggactatgtttatcttgttcacctttgaatccccagaacctattaaagtttttgaaactgagtaggtacaccataaatatttgtccaaataataaatgaataagtaggcgtagagaaacggtgggtgttcctgagtagtatgagcgggtgtagacatgagtgtgtgcatggcaggctgtgaggttctgtgtagattgcatagtatacctgtgtgtggagcagtggaacatgattgtgagggtgggttgactgtctaatatcagggaaagaggttagtctttttctattgg

SEQ ID NO: 130404 - DNA, 465 bp, Homo sapiens
tctttcctgcataatccctattcctaccaagtaaaacataaaatgcttttccgaatcaaatgctgaaacttgtttctctgagcccacagcaaatattctctgtgtttgtattcagagaaatgttatggacattccactgagtgagtatgctttaggtttttatagggcatttaagagtctaaaactagacagatctgataaaactattataaacaaatactggatccctaaaaaaagtttttaaatcaagcaaaagttaagttgattagaaattgtatattcacggtcatggattataggttactcaattttacaagtgttcaatatttttataaacttcattagaaatataatagttatctgccgggcgcagtggctcacgcttgtaatcccagcacttttggaggccgaggcgggtggatcacttgaggacaggagttcgagaccagcctggccaacacagtg

SEQ ID NO: 130405 - DNA, 547 bp, Homo sapiens
gatgaggcttagagttctcatttccctcctggttgatgaaacatcttccttgaacatctaattcagggattggagcaggaggtgggagggatggggaaggcccaggggttgttagcaacagcttactgccatgataaggcttggacaagaatcgtgagataaagcaaatttgtccaagactttcctcctcatagtcagataaatccttccataaactcacctctgaagtttccttatatttaccatcattcagtatcatccagtgcccatcttctccctctgtgcatattttacgttcgtatttccacatgacacccatttcaaagaaagaactatagtatcccggccctcccacaattctgccacaatcccaagtcaataaaggtttcttgggctcctcgccggcttctagaggtgatattaaagtaggagatgaaagtttccctaggaaccatgaccataagaatgtgtaatttttaaaaaaatcatggatacataacagttgtattaatacacatttatgggttacatgtgatattttgataca

SEQ ID NO: 130406 - DNA, 451 bp, Homo sapiens
tcattgtgagacattcacatgtctgactgagatactgctgatctgtagaattaattatagttaaatggaaaggtggcttttgctcatgaagaaagtcgttagtctcttgataaacatttttaattatgattaactttagtcttcctccaaatactttccattagaaaaggcattaatgttctggttcattagaaatagagcaatccttttatttttggtttgcagtccattttgttcttgaaagatattggtccacttttttaaaaaaaaattggtggatgttgtgttgtaaaaaacatataagtttccttttgcaagtgcatatcagttttttcaaaggtaacttacactttaattttgtgtgttgtgtttgcaagagaatgcttcttggtttattcatgttgacaactgaaaagccttagacctaattaaaagaatttccatgagcacc

SEQ ID NO: 130407 - DNA, 319 bp, Homo sapiens
ctatggaatcaggcagttctccaacacagaggcccccacctttcctaccctaggctgcctctttctttggagcaaagattcgaggtggaatgaaagagattatccaaagaaaggtcaggattacacccaacattatcccatataaccccctcccaaactccctcctacagagaaacatagaacactacagaaaaaaattgcaagtatagggaagtagaggacagagagatacagtaggactaaaaattaaacagctggtaaaacaaattatggtttgaaaaggaagataagtagactgaagatattaaatacacaggac

SEQ ID NO: 130408 - DNA, 204 bp, Homo sapiens
aataagcatgttccacctcaccacatttcctccagaatagggtccaagcgcatttctgtgaacatattttacagtcacccgcttccctaacataacacaccagcccacccaggcagtggagagacatcgttaggagcaaaaggctttgctgtcccagaagtctggggttacacccgtgctctcctattcacttgtatgcttgag

SEQ ID NO: 130409 - DNA, 461 bp, Homo sapiens
agcagacgcgaggattacagattccagagtaaagacggggtttcgccgtgttggccaggctggttacgaactcctgacctcaagcaacccacctgcctcagcctgtcaaaatgctaggattacagcggtgagccaccctgcccagccaggaatcttgaaatttaatgtttcttaggttattgattagaacaacaaaaacaggaataattcatacttgaccagagaaaaatagatttagatttcatttcttctatgaaactctgatttttctcttatcctttataaattttgatccattttctctagccatgttgaggtataattgacaaaattcgtatatattcaaggcatataatgtgatttgataaatgtgtacattgtaagttgattaacacaatcaaattaacatgtctttaaccacacagttaccattttgtgtgtgtagggaagactcttaagat

SEQ ID NO: 130410 - DNA, 552 bp, Homo sapiens
tttcacacctctacaaattgcttttgtgtgatacactgcaccacaggacacttatccaaagagctaatgtaaaaacctcattttgagaaacaaaagtagtgtcaatttatatgtcaagagaatgaatactgcattccaagttgatacaggatctgacatttcaaatccaacataaattatttggaagactcctgtctttttccctgatctctgtattaacagcttttgtgaccttgaatgcaaatgaagtacaatactaaggatgttcttcatcagtatgaattagaagttttttaatgtatgtttctgtgatcatcagcttattttccaacatttattttttatctccctaaatcagtttaaccagcagcatgttgcgaatgtgactcatgtcatctgtgcctgtggttaacattatgttgctgcaacaagtccacctgacagattttttgagcctaggaagttgtccatttcaattaacaggatgcccaggacatttccctggcagaataataaaagctcacactggttctcctcctctctgaaaaagaa

SEQ ID NO: 130411 - DNA, 325 bp, Homo sapiens
atttcagacaacagatgttttgagtttagatcatttgaacaaacttgcagtgagaactctgtcagtagagaataaactgggacagggggaccttcaggtaatctcctcgagagctcaaggggttccaggagacacctgaattacaccaaaccagagctgtctcacagatgtgataaaagctctaaacagtctgggtattgtcgctcactctgggagcctaggtgggaggactgcttgaagccaggagttcaagatcagcctgggtaataaagtaagactccatgcctacaaaaatgatttttcttttttttttttttgagatgga

SEQ ID NO: 130412 - DNA, 649 bp, Homo sapiens
gattcctatctagtagcatgtaattgaataaattccagtgcattaaagactcaaattttataaagtcataaaacctgtgtaaggcatattgatttaaagtgatcactttctccaacccagcaaatcagctgctaggattctttcctgtggaaatatgatcatatagggctgggcatggtggctcacacctgtaaatcccagcactttgggaggctgaggtgggtggattagttgaggtcaggagttcgagaccagcccagccaacatggtgaaaccccatctctatgaaaaatacaaaaattagccaggtgtgatggtgtgctcctgtagtcccagctacttgggaggctgaggcatgagaatcacttaaacccaggcggcggaggttgcagtgagctgagatcacaccactgcactccagcctgggtgacagaatgagactttgtttttttaaaaaaaggaatgtgaacattcataagattatatttattatataattttaagagcaaaaatttagaaccaatctatattaaatgtcctttaatagggaatgtttaaataaattctgtatagacatattatagaatacaatacagatgttaaaagagtaaaatagatcaatattaactgacaagtaaagatttccagg

SEQ ID NO: 130413 - DNA, 340 bp, Homo sapiens
ccttcaattgtcagagagtcattatatcataccacagtagaggctcttgttctcatagatgaagagatggcatgagaagttcaataacttactcagactgatctaccagaaaatagtggagcagtgtctggagtctaggttttcctcaagttcagtgattctcagccactctatacttgttacctctagggtagcatgaatcttttttgatcattttcaatttgggagataaacatgtaattttaggaaagatttttaggttgggatatttatacagtagtgctgtggaaatttttaacttcttttaaacatggttatattattaaaagtatctgaaatt

SEQ ID NO: 130414 - DNA, 457 bp, Homo sapiens
ctcttccggtccctccccggtctccctctgtctcttttcctcctagtctgccttttgctggctctctctggcttcccccacccatctctctccctctgtgccagttgtcagccctgccccaccttctctctcagctcatgagcttccacagtttcagctcgccccttgatgcactgatgactcccaaatctgtatctctagccttgacctctctccttaggcccagaccagaatttccagctgccagcaacttgctgttaattggatgaccaccaagcccctcaaactcaatgtgtctcaaaccatactcattatctgttctcataaacctgctccccaccccctatgcccagtaagcagcgtgtttcctagcttacttaacggcactaccgtcccctagcctggaaatttccgccttgtcatcttcaactccttctctcccctgccgcccatattc

SEQ ID NO: 130415 - DNA, 800 bp, Homo sapiens
ataagttgttgtaaccatttaaaaagtaactaaacaacatacatcaagaatcccaaatatggttataatgtttatttaacccagtaattcaagaagtgattctatgagaagacagatgcacatagattttttttatccagttgctgtttaccaatatttatagtgtaaacaaaaaaggaattgtgttgtatttatatatattataaaattatgcattatattatataaaatataatgcaatatgggaaaaacagctgatgatagaagaagtgaaagaacagaaccacaatctttatatattacactgtataaatcttgtatacatggaagagactggaatgagataagcaaaaagaatcatctccatattgtgataagacagattatttttgtgcattttaaaatttcccacattttatataatgagcctgtattacctttttaatcagaaaaagtaggcatatgtttttagaaaatacataacatttttcataaaataagttttacacacaatttagagttgatatataagtactgtttttactcttgattttcctgtttctattttcttaaaaatatcattttagcttccgtgcttttttggtaatctgcttatcagtatatttgcaacatttcccccaggatatgaatatttttgtatcgactccttcactaatgggtaattttttctcctatcaacatgctatagtttacttaactatttccttattattctatatctattttctcaatttctgttcttacccacatggctgtagataagactttgaatatatttg

SEQ ID NO: 130416 - DNA, 420 bp, Homo sapiens
tgtgtgcgtgtgcatgagtgcatgtgtgtgcaagtgtgaacaagtgcatgtgtgcatgaatgtgtgcaagtgtgtgagcaagtgcatgtgagtgcacgaatgagttcgtgtgtgagcaagtgcgtgtgtgcaccagtgtgagtgcatgactgagtgtgcaagtgtaagtgtgcgtaagtgcgtgcgtgtgcatgagtgtgtgtgcaagtgagtgtgaacaagtgtgtgcgtgtgcatgagtgcatgtgtgtgcaagtgtgaacaagtgcattgtgtgcatgaatgtgtgcaagtgtgtgagcaagtgcatgtgagtgcacgaatgagttcgtgtgtgagcaagtgcgtgtgtgcaccagtgtgagtgcatgactgagtgtgcaagtgtaagtgtgcgtgagtgcgtgtgcactctcatga

SEQ ID NO: 130417 - DNA, 112 bp, Homo sapiens
ttcactggaattgactagaggataggtgtactgttactatccccctttataggtggggaaaccaaggcagaaaggtcacctagctgggaaacgatggggctaataagcagtg

SEQ ID NO: 130418 - DNA, 390 bp, Homo sapiens
  misc_feature (14)..(14): n is a, c, g, or t
cgaggctgaggcancaaatcgtctgagcgcagctgagacattgtgagacccatctctacaaaaaatacaaaaatgaactgggagtgggcttcgcagtactgtggtcccagccactcaggaggctgggagaatcacttgtgcctgggagattgaggctgcagtgagccattgatatgggtaggctttgtcttcccacccaaatctcatcatgaattgtaaaccccataatgcctatcatccccacgtgtcaaggtagagaccaggtggaggtaattgaattatgggggcagttacccccatgctgttctcatgatactgagttctcacaagatctgatggttttataaggggctttttcctctttgctcagcacttctccttcctgccacc

SEQ ID NO: 130419 - DNA, 256 bp, Homo sapiens
aagattatccaatcaaagtattccttagatgtttcaatatcagtaaatgatcgtgtactttgtgtttgaacacctccaatagttgtgaatctatctctttaaaggagctcattctgtgtggaaatatcttacagagttaacttttcttcatttgtagttgaaatcatctcattgacacctatctcatgctgcgccttagctcagcgtgtgtgtatcttaataatctttgccaaaatcaaagcaagtttcactctgg

SEQ ID NO: 130420 - DNA, 616 bp, Homo sapiens
tggaaaaacaatttgcgcaaggctcaagaagatgagatggtcttataaacagtaattgaaatatgtatattttttaaaagtctgtttcaaatttcaaaccttattttaaaaactatgtgaaagcctcttgtgaaactcaactgaagtaggcatggctgagtccagaggagcagtgtggaggattagaaaaataaacaggcaggagtcagacagtcctggattcaaatcccacttctaggccttagagaaataatataatagtaggggataataatattcaccctgaagagtgctgtagggatcatcaatatttcatataaagcatgtcatatgggcagtgctcaatgaatggcaatgcttttgcccaggtatagaacttcttagtataaaagttttgtctttcagaaaattaacaaagatattcaggaccggaattcagctctggatcaagtagacctgatagatatctacagaactttctatcccaaaacaacagaatgtacatttttctcattgccacatgtcacttactctaaaatcgatcacataatcggaagtaaaacactcctcagtaaatgcaaaagaactgaaatcataacaaacagtctctcagacc

SEQ ID NO: 130421 - DNA, 429 bp, Homo sapiens
caagaaaaataaattgatatttaaaatgtatgtagcatagtgcttggtataaagtcagtgtccaatagactgtagatgctattgtgatcactgtaattattattattttttattttactttaacttccaggatacatgtacagaatgtgcaggtttgttacataggtctacatgtgccatggtggtttgccacacctatcaaccaatcatctaggttttaagccctgcatgcattaggtatttgtcctaatgctctccctccctttgcccctcacccctcaacaggccccggtgtgtgatgttcccttccctgtgtccatgtgatcactgcaattactactgttattatgtaaaattttctgtgcttcttagacatctacgtttggatgtcaggtagactgaagtttagaggagaccctgggcctggtg

SEQ ID NO: 130422 - DNA, 753 bp, Homo sapiens
aatgtggccgggtgcggtggctcacgcctgtaatcccagcactttgggaggccgaggcaggcagatcatgaggtcaagagatggagaccatcctggccaacatggtgaaaccctgtctctactaaaaatacaaaaattagctgggcatggtggtgtgcatctgtagtcccaggtacttgagaggctgaggcgggagaatcgcttgagacaaggaggcggaggttgctgtgagccaagatcgcgccactgcactccagcctggcaacagagcaagactccgtctcaaaaagataaataaataaataacatataaaaggtaagctgatatataaaatgtgatcgtttgtaaaacataccagttgtaaatggtaatagaaaaaaatcactagtttcttggctcttaacataccacagagtttttgtttttttttttcctcattcacagcgaagagtaatgacctgcaaagtgataggctttaggtaaaaaagtaaatgtccatttttcattttctgacatcgtctgaaatactagaggataaatgaaacatgttttaaaataatcccgagaaaaaaggccctttgagttgttgcttaaaatggcatctactgaacagtcagaaaacatgaattttttatgtaacaggtgccatgctagctgggcccaggggagacaatgatgaataaaagtaattgccttctaaagcatatcaaatccgtgtaaacacggccataggccattggatgagtgtcaca

SEQ ID NO: 130423 - DNA, 346 bp, Homo sapiens
ctaaggatttttttgttataatagcattgtagccatgttcttaaaagagctcttattttttacaggtaatatcaaaatatttaagaatgaaatgatgcaatgcctttgatttgctttatttatttatttttttttgagatgggagtctcactctatcgcacaggcttgagtgcagtggcacaatctcagctcatagcaacctccacctcctgcgttacagtgattctcctgcctcagcctccccagtagcttggattgcaggcgcccgccaccgcactcggctaatttttgtatttttagtagagacagggttttaccatgttggctaggctggtctcgaactcct

SEQ ID NO: 130424 - DNA, 471 bp, Homo sapiens
tggtgcgaggtggtttatgcctgtaatcccaacagtttggaaggcagaggtgggcggactgcttgaggccagaagttcaagaccagcctgggcaacatagcataaccctgtctctatttgaagaaaaagaaaacataaatctgtttctggacataaaggattattagaatcaaagctacctattgaacaagttatgcaacacacacccaaatactatttgctaccagaaagttataaatgggtatatacctgcgtcacattgccaacaatataggcctacctgattactgcactcacacttgtctgtggtcaaagggctaattactatctaggcatttccccctttgcttttaattcaggccagagttcattttcaccactcagcacacttttcatttctttccctctccttacagaattgggctgcacatggaagtaaggtcaatttaatactttagcacttggtatacc

SEQ ID NO: 130425 - DNA, 235 bp, Homo sapiens
gcagtcttgctgatccttctgcaaataagacccctctgaggccaaccatgtacgtggaaaggagcatgtgctcctaagttttccaggaggggaaaggaccaagttcatgtgggacccagctcagagcacagctcacccccggggcagggcagctcatgctaccattcgagcgagtggtggcctcagtgccagactcagcccagcgccaggaacccaggaatccctctcctcctgc

SEQ ID NO: 130426 - DNA, 501 bp, Homo sapiens
gggtgggacgacggcaggtgtactgggattgacctggtctgaccatcaaaatgaaggaggaagagaaagatgggtgaggaaagcaggaataggggcagtcacaggaagctgcttgcaggaaggaagatgatgagacctgagcatgtgattccttttcctgcagacagaagcggccagggtgaggagggagataatgcaagagcaatggcagcagaacagcactcatgctgtgaatggcagtgcagtgtcaagcacactgaataccatatcccttatgtattagtccgttctcgcactgttacaaagaaatgcctgagtctgggtaatttaagaagaaaagaggtttaattggctcatggttctgcaagctgtacaagaagcatgacagcttctgctcggcttctgaggaggcctcagggagctttcaatcatggtggatggcagagtgggagcaagcatctcacatggtcagagcaggaggaagagagaaaggtgggaggt

SEQ ID NO: 130427 - DNA, 648 bp, Homo sapiens
tctttattatttccttttttctcctaattttgggtttgctttgttcttgcttttccagttccttgagatgcattgttagattgttaatttttaatctttctactttttcaatgtaagcatttattgatataaatgtccctcttattactgcttttgatatatcccacagattttgctatgttgtgttcgatttttatttgtttcaagaaatttgaaaatttccatgttagtttctttgttgacccaatggtcattcaagatcatgttgtttaatttccatgtacttaaactggactttacaccagtttaagtttttcttggtgttggtttctagttttattccattgtgctctgagaagatgcttgataggattttgatttttaaaaatttgttggctgggcgcagtgtctcacgcctgtaatcccagcactttgggagaccaagatgggtggatcacaaggccaggagatagagaccatcctggctaacagggtgaaaccctgtctctactaaaaatacaaaaaaaaaaaaaaaattatccgggcatggtggcgcatgcctgtaatcccagctactcaggaggccgaggcaggagaattgcttgtacccaggaggcggaggttgcagtgaatctcaaaaaaaaaaaa

SEQ ID NO: 130428 - DNA, 323 bp, Homo sapiens
tttaaagaagagctatcttggaccagttatgctccataaatacagcatataagcattaaacttaaaagagtctagtatctgaaacagttattgtctactcaccaaaagaactggaatgattataggcagcccaggccaggtatgtaatgtgggtgttaagactctgtttacaaaaaccaatgtgggaaggcatggaatttccagactgagtgctacttgtgtatacagttcctcaatttgtattctataggaacccaaagtttgtttgtttgctgcgggagcaaatctcgcaatgcagcaaagctggacattccatagctcct

SEQ ID NO: 130429 - DNA, 243 bp, Homo sapiens
tttagtagagcatcagtcaccatccatatctgggaacaatgattgtaagaaacagaaacccatttgcatgagcttgaggacaagaaacacaccttatctctaacaggcaaactcatgggcacaagaaacaaatgagaggccatgagagaatggaaactgcagttacagaaaccaaaattcctctttcttgctctcagaagcccatggtctctttttttttttctttttttcttcttttttttt

SEQ ID NO: 130430 - DNA, 517 bp, Homo sapiens
ctcctctctcggcctgctcagctcttcccacaattacctaccctcatcctctgcggatattactcaaataccctcttctcaagaatatcatgtctaaaattgcagctccctgacctgtccacattgcctctgccttatatttcttctttttttttgagacggagtttcgctcttgttgcccaggctggagtgcaatggcgcaatcttggctcaccacaacctctgcctcccaggttcaagcaattctcctgcctcagcctcccgagtagctgggattacaggcatgcaccaccatgcctggttaattttatatttttagtagagacagggtttctccatgttgaggctggtctcgaactcctgacctcaggtgatctgcccacctcgtcctcccaaagtgctgggattacaggagtgagccaccgtgcttggccttattgtctcattctagaattcactaaggatacggggtcctctagagtctagctgagggaatgacagcttgtaagtgaccgtg

SEQ ID NO: 130431 - DNA, 193 bp, Homo sapiens
tcggtaccgagatagtagtgagggactcaggttccacagcttgtgatgggagaaacaggtgaatgtctcaggctccagatcagtgaacacagcggggatttggctgggacttcagtgttgcgacttggctcacagggtcactgtggcccttccacagaccaggattttcccttccctctgacaatgtcacctg

SEQ ID NO: 130432 - DNA, 407 bp, Homo sapiens
gaagtaatggtcttctcagctttttatatactaagcagaaactaaaaatgtaggtgtatgttctcaaattcaggatgtggttactatttctgtcagatatattgaatctttacagattgtactggagttgattttgagcacatctttcataatttttttaaactgaaagggagatagaattttctattaaatacttcttgagactttgaaatagaagttatcttgaatttaaagtgtctcacacgtccctgtgaagagaccaccaaacaggctttgtgtgagcaacaaggctgtttatttcacctgggtgcaggcaggctgagtccaaaatgcgagtcagtaaaaagtgatgggattatcattagttcttataggttttgggataggcggtggagttaggagcaatg

SEQ ID NO: 130433 - DNA, 208 bp, Homo sapiens
aatcaatattcaaaggtctaatggctatgaatgattcaaatatgataaaaaatatttactcaaattctagaagctctgtgaatcacaagtagaaaaaaatggaaagaaaataaaacttagcacatcatagtaaaactgatgacaaccataagaagaaaatcttaaaagcagccaggaggtggaatgggggaaagtagccaagaaaaat

SEQ ID NO: 130434 - DNA, 574 bp, Homo sapiens
gttaatattttgctgtggcatagaataggaagctatgcttgtgacctgtagggatctagtttaatttgtaatattggccaaagtgtttttttgaaacggtcacttggattgaaagaaataagcttcatcttccagtgcatatgaacattagaaattgcttaatttgacactgaagaccccccctctatcattcactttatcttttcattctcttcttgattaccaactttgttctaaatgtaacacatcgtatggttgcttaactgatgcctgccctttcttctcttttcctgctttgttaagatatttattgagcacctgtcacagacactggggatacagtagtgaataaaacagacagagacccttacctggaggataatactgctgagaaaaataaagcaagggggtttggatatcagagtatgtgaaagggggaacagttttcaaattgggtggtccggaaagttcttgaggaaggtgacatttgcgaaaagatctgaaggaggtgggcattagggccatgttggtctcccatctgtctaaatcataaagtcataattaatatggtaat

SEQ ID NO: 130435 - DNA, 712 bp, Homo sapiens
cggattgcttgagctcaggagtttgagaccagcctaggcaacatggtgagaccctatctctatgaaaaaagaaattaattaaatttaaaaaaaaaaaagaatgggactctagagtcaaaccatctcaattctctacctgtgtgatctcaggaagttacttcatctttctatatctcaatttcctcatctacaaaatagggataaaaatagtactttatatgaaatacacttatccctggtacataataataaatgttagctataaataatgatatttttcttgctttggcagtacatatattaaaattggaatgataaagagaagattagcatggccccgtgcaaggatgacacacaaatttatgaagctttccactttaaaccaattttttaaaagaagatattatcacttgtttatccatacccagttctgtcaaatcctgacattttgttatatttacattgaatcattttatatcctccctcttattgatgggcatttaagttgctgatttttcactattacagtgattcagttagttccatgcctagaatggaactgctaaatcatagaggagctgtgtcttcaacttcactatttccaaattgttctctaaaaaagttataccaatttctattcccaccagcagttagagtttctattgtctgacatcttctgtaatacttgaaattgcctgacttcataatttgg

SEQ ID NO: 130436 - DNA, 345 bp, Homo sapiens
ctggatttgaagcagagtcctccctgctcccctcgataatagggtcattcactggccgatggcccttgatgccagttggtctgagtggtgtgaggggcccagcatggccaggcggccgtcccagcttccagtttagcagaacccctgctgcctcctgctggggacccattctcccatgggaatttaaagcctctaatccagagcctggagtattggtgaggagcagcagaggtgcggtgagcaggcactggatgagggaggggcctttgcgtgttttcccgggctccgggcttgttcttctggctgggggagaggcagcacatccagcagtgtcactggcacccg

SEQ ID NO: 130437 - DNA, 510 bp, Homo sapiens
cacaggtgtgaagaggcaacccaccccttcagtccaggatctcctagaagcagttgccaagacaggatgtgcaggaaatatattagaagtgtctgtgacaggaaatggggctgggagcacaggtgtgatgctgcgtaagggaaggaggaaggaaggtttggtgggtggcagcgtcgtcttagattgcaaatgcaattctggggaaaattcagcaagcctgttgggggctactccagccgaagttacccttcttcagaggggtcctcaggctcccaggaccagcctgccttcacatccttgatacagggatgctaagtcatgactggatgcagcccatgggcagcacagcatctgaatgctaggaggggccctcagccaatcagctctcttccctgggtatggtggcttatgcctgtaatcttagcactttgggaggctgaggcaggtggatcacttgagtccaggagttcaagaccagtctgggcaacacagtgagaccctgtttctaaa

SEQ ID NO: 130438 - DNA, 508 bp, Homo sapiens
gctatgtaactcacttgttatctctttttctccccacattagaatgtaagctctatgagggcaggaactttgcccatttggtttgccactgcattcccagctagaacagtgctggcacgagacgctcaataaacttgagtgaatgaatgaataaaaattttcaaattatgtcaatatacagcaaattcatcaccatcatataagcactctgctctcagatcatgccccagcattttcttctctttgatatttccaactattctctcttcttgatttccataaacatgttcaaaatcctcccatgaggccgggcgtggtggctcacgcctgtaatcccagcactttgggaggccgaggcgggcggatcacgaggtcaggagatcaagaccatcctggctaacacggtgaaaccccgtctctactaaaatacaaaaaaaaaattagccgggcgaggtggcgggcgcctgtagtcccagctactcaggaggctgaggcaggagaatggcgt

SEQ ID NO: 130439 - DNA, 330 bp, Homo sapiens
cgagtggttctcaagcgtgtatttccatcagtgtcaattaactgtggaacttaaagttgatatccctgggtctccagctgcaattctgattcagcagatctagggtggagtttagactttgtaaaatttttaaaagctccgcaggtgattcttaaacataatcagagttgagaatttctaccctagatagatttaaattgtcaggcttaagaaggaaaccgaggatttggggagttgctagagactgtttgatcccttacagtttagggacttagtataatgggcactctgtcttccacctggctcccaatctttgtgtgtaggtgtaac

SEQ ID NO: 130440 - DNA, 341 bp, Homo sapiens
ctttaccttcttttttcttttttgccatttagtcatgtagtcatgacttgagtattccaggtgctattatatattacttcttttgagaaaatacatgtatttaactgtctaacatgagcgtttccttagtatcaaagtattaatattgcatatagtaacattttaacttgtgtcaggatgccatagaatattgaaacattatgaaataagaaggacttctgagtcctttaccttgtgtcctaagaaaggtaagaaaatagccttaatttggccgggagaggtagctcatgcctgtaatcccagcactttgggaggccgaggtgggcagatcacctgaggtc

SEQ ID NO: 130441 - DNA, 438 bp, Homo sapiens
ttcatcttgtccataaagccttttctgatttgtccaacctttgtaatgatcagtttcttactcctcctgccttctattattggaacagagaacgttctgcttggataagctaatgctctgtaagccaagccttcccaacacttgctaccatcagccgaacctctttgtatccataggcaggcaatgcaatttttgttttatgcctgggaggaatattgtgattagaagcagggtttatgaagaggatagaggatgggaagaataacttgattcctcatttttatttttttgcctcttttctaagattgtagggaattgagttttataagatttggtgtaactatttgacttacctggatataagctgatctgctttgggccccatataattgcatgtgacaccaaatgggaaaagaggatgaatattctccttcccct

SEQ ID NO: 130442 - DNA, 643 bp, Homo sapiens
taaaatcaggattctaattaggattacatgatattcctgcattaattgtgagaaaactgataatttagttacaagacttgccatgaggttacatggggtatctttctgtattcagattctatgtttttagtggtttatggttttcttcacataggacctataccttctttattaaaattatccctatgaattttgttttgtcagtgtgaatagaacgtaggttttcttcatttcagaattctgtgtagttgtcactaataaagaaaagctatagacttttctaagtttattgagacacctaattaatttctttcatttggtactttggtttaactagggtttctttcattttctaggcaaaatagcaaaaatgcaatttgtaatttttcagtgtttatgtttactgccttagatgaaattcccataagtactgtaatctactttgattacataaggctacatcttgatgagttttaataaatatatgcacttgtataaatactatcacaatcaaggccaggtgtggtggctcacggctgtaatcccagcagtttgggaggctgaggcaggaagattgcttgagcccaagagttccagacaagcttgggcaacatagtgggatctcgtctctacaaaaaactat

SEQ ID NO: 130443 - DNA, 366 bp, Homo sapiens
aaatacagttatagtggaacacagccacaccccttcatttgcatatcgattatggctgtgtttgtgctacaacgacacagatgattagtgacagaaactatatgggtggcaaagcctgaaatatttaatgtttgcccctttactggaaaaggtttccgatccttgttctaggtattgagaatgaaacaatgaacacaataaggtgatattcctacttttattatagtcaaggtaagacagacacgacacatataaataaatatgtacttacctatacacatatgcacaaaacatctgtggtaataaatgtaaagaaaaaaatacagaaatgtaagacagagagaaagcaggaatggggggagagga

SEQ ID NO: 130444 - DNA, 334 bp, Homo sapiens
ggaaactgagaaacagagaggttaagtaacttgcccaaagtcacagctaataaatggcagagcagcaatttgaacccaaatctgtctgattccacagcccacacccttaacctttatgccgatggttggaaaaagctaccactctgtacattaaagctaaatgctacatgtagagacagaggatagaccactaacctcagtggacttccactgccaaacggacctcccagttgttgaggtaatgtcaaggcctggaattagcatgtggaacgattgtacttttgaaagaaggtataattgtctggtgatttgccactaaaaactaataaaaact

SEQ ID NO: 130445 - DNA, 471 bp, Homo sapiens
cctctgcctcccgggttcaagtgattctcctgcctcagcctcctgagtagttggaattacaggcatgcgccaccacacccagctaattttgtatttttagtagagacggggtttctccatgttggtcaggctggtctcgaactcctgacctcaggtgatctgcccaccttggcctcccaaagtgctgggattacaggtgtgagccaccgtgcccagccagaatctgtcctttaacaagatccaaagggaatgtacattaacgttggagaagcactgtactagactaccctctttttcttttttgtttttttgagacagagtctcgctggagtgcagtggcaccatctcggctcactgtaacctcctcagcctcccaggttcaagcaattctcatgcctcagcctccagtagctaggattacaggtgtgcgccaccgtgcccagataagttttttttgtatttttagtagag

SEQ ID NO: 130446 - DNA, 348 bp, Homo sapiens
cacaccccaagtgacacacagtcttgcatctgaggaatgggctccctgtccctcactctgcctgtggctattgctaggtaaagggagagggtagatggggacttttaaaaaagggaactaagagcccgtgacacatcctgaaggatcgcgtccatctggctcagcaaagaaggcaggccgagggctcagagcgtgactcagacatgtctccttgaaccagctctgctcacaagcttctggaaataaccccatggccaggcttttgctgtactttgagaatggctagagatggggtctgagtgtctctgaggtcaggataatcagtgtgtacatagaagtgggagtctt

SEQ ID NO: 130447 - DNA, 682 bp, Homo sapiens
tggctgacaaagctaacatgagccttcttcctgttccatacacacaaaataaatgttggacaaaatatactttttaaaaaattaagattcatcccaaaagtaaagaaaggaagccccccgggcttaaggaatgcagatataagttgtaagaaatgcaaagccaagctatgagttcagaagctggtgtcatgatgactccaggtagggggtcaggtggggtgggatacaagtagagagaaagcctgagcaaggaaaaagtgaaagataaagtgataggaataaaccccaaagcatcagaaattacagtaaatataatttgcacattaagattcagtgatagtttttatttttattttcatttttgttgttgagatacaatcttactgtcacccaggctggagtgcagtggcatgatttcagctcactgcagccacaacctccagggctcaagcaatcctcccactgcagcctcctgagtagtcaagaccacaagtgcatgccactatgcccagttaaattttttgtatttttggtagagatggggtttcaccatgctgcccaggctagtcttgaattcctgagctcaagggatctgctcaccttggcctcccaaattgctgggattacaggcgtgtgccaccatgcctggccctgtgataggatatattaaacaaaattcagt

SEQ ID NO: 130448 - DNA, 367 bp, Homo sapiens
cccaacccacctctgcctttgccagggactacaggaccgtgatctacatacaaagaaaagcccagggatgggggtttcaaggggagccaggggaagagttccaggcaggaagcctctccttgacccaggaatacaaaccgggttggaactgctgccttcaggtcaaagctgccaaaacaaagttaaaggtgtaaaaacaaagtgagaaggtcacacagctatgggcctctctctctggaacccaggggtgggggtgaggcgtgtgtgtgagaaagacttgactaaaaagcacttttcaaccattttaaccgcagatgtccctccactgcgatgaaagagcgtgagaagggtgggtgcccagcattcg

SEQ ID NO: 130449 - DNA, 320 bp, Homo sapiens
aaaaccaggtctgggcagacgcatccaggaggagtaaacataatcacatgtgacagccttctcaatgccttctagacttcttgatggctcagcactggagagtcttttctgagagaccatcatcaggaagggtcaccgagccaacaatcatcaggatccatcagcagttagtcaaactccacagacttctgggggatggttcaagctagagcagagttcagataagcttacctttgcttagtctctgtaagcctccatttcctcatgggcagaatgggagtcacaatagtatctgcttcatagggttgctatgtaaggtt

SEQ ID NO: 130450 - DNA, 993 bp, Homo sapiens
tagaatgcagcttgagatctagtgtctgatcaaagaacttgaacttgacctggagggctctggggagccatggaaggtgctggataaaggaagggacagtcatatatattttagagatgactgtggaaggctgcctggaaggagtgaacaagagccaggagaccagggagggagtttgtggggcaggtctggagatggcaagggagggatcctgcttggatgaaaggtcttcagggactgtctcaggttacactcaggtgccctcagagctactgtgttcagggttcttgtctccaggatgaaaataaggaggagttgtcagacaaggacatatacatggaggctggcatcttcatgagtgccaatcgtggtcctggtgtggactactgtgggagcaggggtctctccatccagggacatggtggatggaccctacatcactccattctgcccttcctttccctcccattctcctgagggactcaatgcatgggcactgtccaacctctggtgctgaagcagccaagagacccaagcctgccttgctgccacttaggatatgacagcacagccagtggcctctactggatcctggtacccctcagaagacacccagacactgggagtgctgccacctcgtggtgcaagagttctgagggacggcaattctgaagacattgaatgccgttttgcacaccctggtcagaatgaaacattccttgggaactcgggccgtgagaagcatccttcctgatcacctgactgtagaaacatccttatcgcaccctcccgggcaaaggcccaacagcctgactgcaggaacatccttgccatatcctgccgggcagcaagctctaccgcccacacccctccttcccagtcccatgatcaccccagcctgtgagaggcagttggtgctggcagtaagctggtttcctcctctgcagggttttgctagtaataaaggtgttgctgttgaagccgtcaaaagtc

SEQ ID NO: 130451 - DNA, 770 bp, Homo sapiens
taaattactaattctacttcaaagtgccacacagccttcatgtgataaaatgaagcaattggtaagtctaagcattgagaaaaaacattatttttcccagctccattgcaacagttgggacagtgttttctctgtgcctatagaaacctcagctagtgtgccgaggagtctggtccctttggggaatgtggcagtcaggttctggcagggacctcgaagtggctggtaatgtctttcattaccaccaccacgtgacctggtcttacgacctgttagcttccttcatcaggcatgagcaccaggatggcaggggcctcatctgtcctgttcctcctgtggcctgggtcctagcaccatgtctggtacagtgtaggtgctcaagggaagtttactttatagaactgtctacctgggagatgttgctgttagtctaacctgtaccattttgtaaacctgcagccccgttttgcacaccctggtcagaatgaaacattccttgggaactcgggccgtgagaagcatccttcctgatcacctgactgtagaaacatccttatcgcaccctcccgggcaaaggcccaacagcctgactgcaggaacatccttgccatatcctgccgggcagcaagctctaccgcccacacccctccttcccagtcccatgatcaccccagcctgtgagaggcagttggtgctggcagtaagctggtttcctcctctgcagggttttgctagtaataaaggtgttgctgttgaagccgtcaaaagtc

SEQ ID NO: 130452 - DNA, 894 bp, Homo sapiens
tttgtcatgtttcatctgatagcaaaaatatcagatcggctgcacagaaaaatggctcaaagtgcttaatgaccagaagaaatctgggagtagcaagaaggtgtggggctgggtatggtcactcctgctggatgtctagaaggtgaaaaccaaggacctaggaaaataccagatacagcctttccaccgtcatccagagcaggacaaacacgccaggtggtgtcaggagcccaggtctccagctggagggaatgtcaaccctgcagtgggagcccatcatgcatcctaggcacagatgctaacgtaggcaccgcaggaatcccagtgaatatattgccaccatcttggagctcagtgccctcatagtgtaacagcaccagcagatctgcctgtgcacagacttcctgtactacctcactcctgaggggagatgcttctgcagggcctgcgacctggtgcacaactttagacaccatcatcctggagcggcactgcaccctcactagccagggtgttgatgacttcctcaatgccaaggccacgttcaagattttcgacttcagtgatgcgtttgtgctgagcaagccgttttgcacaccctggtcagaatgaaacattccttgggaactcgggccgtgagaagcatccttcctgatcacctgactgtagaaacatccttatcgcaccctcccgggcaaaggcccaacagcctgactgcaggaacatccttgccatatcctgccgggcagcaagctctaccgcccacacccctccttcccagtcccatgatcaccccagcctgtgagaggcagttggtgctggcagtaagctggtttcctcctctgcagggttttgctagtaataaaggtgttgctgttgaagccgtcaaaagtc

SEQ ID NO: 130453 - DNA, 947 bp, Homo sapiens
tagaatgcagcttgagatctagtgtctgatcaaagaacttgaacttgacctggagggctctggggagccatggaaggtgctggataaaggaagggacagtcatatatattttagagatgactgtggaaggctgcctggaaggagtgaacaagagccaggagaccagggagggagtttgtggggcaggtctggagatggcaagggagggatcctgcttggatgaaaggtcttcagggactgtctcaggttacactcaggtgccctcagagctactgtgttcagggttcttgtctccaggatgaaaataaggaggagttgtcagacaaggacatatacatggaggctggcatcttcatgagtgccaatcgtggtcctggtgtggactactgtgggagcaggggtctctccatccagggacatggtggatggaccctacatcactccattctgcccttcctttccctcccattctcctgagggactcaatgcatgggcactgtccaacctctggtgctgaagcagccaagagacccaagcctgccttgctgccacttaggatatgacagcacagccagtggcctctactggatcctggtacccctcagaagacacccagacactgggagtgctgccacctcgtggtgcaagagttctgagggacggcaattctgaagacattgaatggtgggtgctgggcctcatggctgttccccagcccctctcattggctctgctccaggtggagaagggggatgatgtctctgtcagttctgctgttttagcctagaaggaaaagaagcagagcccagaagcagggcctggtacccagcctgcctaacaagggagaatttgtaggctttgtggacagaaagatctgggactccatgtcacccactaacttgctgagacattagtaaaatcagttttcttttctgaactatgtttct

SEQ ID NO: 130454 - DNA, 349 bp, Homo sapiens
ttctttacttatcggaaaaaagagtcttcggatactggccccgttttgcacaccctggtcagaatgaaacattccttgggaactcgggccgtgagaagcatccttcctgatcacctgactgtagaaacatccttatcgcaccctcccgggcaaaggcccaacagcctgactgcaggaacatccttgccatatcctgccgggcagcaagctctaccgcccacacccctccttcccagtcccatgatcaccccagcctgtgagaggcagttggtgctggcagtaagctggtttcctcctctgcagggttttgctagtaataaaggtgttgctgttgaagccgtcaaaagtc

SEQ ID NO: 130455 - DNA, 802 bp, Homo sapiens
agtgcttccagggtttcatatgtgttatggagatgcttcctctctccaacctcaccgtgcaggaatcccagtgaatatattgccaccatcttggagctcagtgccctcatagtgtaacagcaccagcagatctgcctgtgcacagacttcctgtactacctcactcctgaggggagatgcttctgcagggcctgcgacctggtgcacaactttagacaccatcatcctggagcggcactgcaccctcactagccagggtgttgatgacttcctcaatgccaaggccacgttcaagattttcgacttcagtgatgcgtttgtgctgagcaagccaagagacccaagcctgccttgctgccacttaggatatgacagcacagccagtggcctctactggatcctggtacccctcagaagacacccagacactgggagtgctgccacctcgtggtgcaagagttctgagggacggcaattctgaagacattgaatgccgttttgcacaccctggtcagaatgaaacattccttgggaactcgggccgtgagaagcatccttcctgatcacctgactgtagaaacatccttatcgcaccctcccgggcaaaggcccaacagcctgactgcaggaacatccttgccatatcctgccgggcagcaagctctaccgcccacacccctccttcccagtcccatgatcaccccagcctgtgagaggcagttggtgctggcagtaagctggtttcctcctctgcagggttttgctagtaataaaggtgttgctgttgaagccgtcaaaagtc

SEQ ID NO: 130456 - DNA, 301 bp, Homo sapiens
catgcttcctgggtgacctcatcccctcccgaagtggaaaccaccacccgcgtgctgatgactccagatctgtagccctggccccaccaagcccctcagctccagatgcttgggtgcagctgccttctgggcaccctgcctgtgtgtcccccaagggttcagttagaggtatgtgtgtgtgtgttttcttttggagacggagtcacccaggctggagtgcagtggcgtgatcttggctcagtgcaacttctgtctcccgggttcaagcaattctcctgcctcagcctcccaagtagctggg

SEQ ID NO: 130457 - DNA, 136 bp, Homo sapiens
acccccgcccacaatgcggggtgtcgtcaatgtactttaaagatgcccctgctgtagtacatgttgtatttttatggcttgtttaaaaatcagcatatccggccaggcatggtggctcacgcctgtaatcccagca

SEQ ID NO: 130458 - DNA, 421 bp, Homo sapiens
gcactcctagagccactccattatctacgttaacaaaaagatgaaatggtttttctagagagggtagggccaggacaggagcagttatgagtctttccttttactccccaacctgatcaacctcttcagaagtccatatgaaaagatcaggttctcctttagttagcttctcatatggaagtttactttttaatgcatatgagtcaatccataaatggcagtatccaactaaccctaaaaatttcctgagttcttgcttggtttgaggcaagggcaaagacacaattcctttgacccatttgggtcctattcttcctttgtctgcatttattaaatggcctaagtatttaacttcaggttctacatattgaagctttctctttgagacccatacccttcaaactgtaagtggttaagaacg

SEQ ID NO: 130459 - DNA, 988 bp, Homo sapiens
aaagtcgtattgtgcagagacagataaatggaaagctaagcaaaataatgattccagaaatcaatcaataaacaaacacatatacacatatatttgatatatgactattgccattgtagactaacaggaaaaagagaagcaattcagaaaataattaaaaattagttatacatatgaagaaacatgaacttagattaataattccttccttatattacatacaaaaataaatgctatatttattagtctactatgtaaaccaacattagaaagtttttaaagaaaatataatagtatgtctttacaacacaagatatgaagagcattctaaataaaaactccaaaagtgaatcataaaaatgattgataattttgattatattaacataaacatttatttcctgaaataaacattcttcctgtgcatgcacatgcatctgtaaatttaaaataaaaacaaattcagtacaatatttatttgtaataatactagaaatcttatgtgatattgttctacaagtactagacattttatattaagaaagcattgcaataaggtgtataaatattgatacatgggaagatataagttccgtgtctgtagctaatatgagcataaagctgtagatcatgagagaataaagaatattagaaaactgacactgttgataagccaattctctttaaatgtaagacagtcacaaaataaaacttttcttgaattattggaattgcataatttctacttatagaaaattattaaatatcttctggaacagttaagcatttatgatagcaggaggtttatgaaaaaataattttgaagagtcactagatctttcagatagagttagcatgctttacttattaaaactggataatattgtcacaaaataaacacattaatcaaaaagatgtatgtagatgaattttatgataaagctaggatttccaatcattaaagaaataaagatgaattgttcattga

SEQ ID NO: 130460 - DNA, 614 bp, Homo sapiens
tctatacagaattctgtagcctcgggatctagatccctttatctccactaagtacaataattccttctagttaaaaaattctatgattctaactaatgaaagatttaaaaatacagatactatttaataaccttttctttatttttctcaaaatgtctttcagatccactgttagtcacttttggtttcttaatgttcactcttttgactcttacaaacattccaagctcatgactcttgtaatgaggaagagaaaagtattttatggttttagttgaagtgatcacttttgatgaaattctgtgtagaagagtaccattgacagtatgaagcatatagacaacttaagtttttctttttaaatgtttaaaatttctcaaaatacttggcgtatgaccaaagtactttgaattttgtttatctaaatctataagtattcaataattttaaacttgtctttcctcggggaaaaagttaccatttgattgatagtgaagtagaatataaaaggtaattaagtcctctgaaatactttttattgtttttgaaaggacatatagaaaattattgctgaaatagataaaagttgtaataggttgacttttgtttggggg

SEQ ID NO: 130461 - DNA, 421 bp, Homo sapiens
agttttaaaactatgagaatgtcattttaatatttacttctgtatttgaagaacaggccacaattagattttagcaaattcagtgtgaattacaatttgacatttctcatgcttccagtctgtcttttcttttttgtcattaaagatgttatcctgttgtacagcccacatagtatctgtgggcgcaaagtactgtttgagttgtttttgtctttgtagtgaaattcaggttgcttttccttggcattcattccctctacggtcattcttccaggattgtctgtgttttccgctattgaaggagaggcaaacaagtatgtatcaagagcttctgcaaacataggtgcttcccacctatgttccacagctgccaccttcaaattctgcctcaggtgccccgatcacttttgccctggatctt

SEQ ID NO: 130462 - DNA, 121 bp, Homo sapiens
cttctaaagtttttgaatctagcctaagaatcctgaatggcacttctggacccactcagggcctaagggaccctgacacactaaaggaagaacacaggcttggctggcttttccacctgct

SEQ ID NO: 130463 - DNA, 739 bp, Homo sapiens
ccggctaattttttttttgtatttttagtagagatgggggtttcaccatgttggtcaggctggtcttgaactcctgatctcaagtgatctgcctgcctcggcctctcaaagtgctgggattacaggcgtgaggcaccgcacccagccagcctacctgtttgttgactaaagtgaatggagttatacctggcacctgctgttgttactaggtcacttacctcacctggccactctttttaaacaagtgctggagtgagaggacactacacctcctgccttcattaccacttttgcttatgaattttcctacttaggaattcatatgctgtcaaatggcttataaatcactcattcccatacatgttttaaaaagtgggaactaatatatatccaagttactaatatgtacttatatatcttttatgtaattcttccccaaatttggggtagcttttaaaattaaggcaaaatagaagattgaaactgtaggtatcataaggagatcggaaactatttaaggaaagacacaaggaagctcagagggaggcaggggcacacaaagtggctctgagttcctggtaggaaggccgggaaggggaacagataggactcatttgtctgataaaatgaaccataaagtttgaaaatataaacttttacttgcactgaattctgagaaaaatttattacagggattcttatatagaaacaatggatatgtaatagataatgccttcag

SEQ ID NO: 130464 - DNA, 424 bp, Homo sapiens
agtctacatggggttacctctgcccccactgtggctggcccagcacctgcattagacatatcttactggaaggatagaactttagagaacactgatatttgacaggtagatagaaaaagagggctatcaatgaatcagaaggaatattaattaatgaggaagtaaacaagtgtcttgtgaaggtttaaaaaagaagaaggtacacaatttatcagaagttgaagagaggccaataagaggggaatgaagaaagtctgtttcagttttggcaaatgagtcgtgattgactttggtcatggttgccactgttcattcgggggaatatagaccagggttgaataataatcagacgtgagaaaatggacatagtttgggggaaattttaaatgtttctgctttcagtaactaaaagcaatcagaaact

SEQ ID NO: 130465 - DNA, 386 bp, Homo sapiens
atgtttttctatttaccagtataagtgtgcacatttgtgtgtgtgtgtgaatgaaattgtgtggggagttttgcaagagagatggaaaagggagaggtgttagcattggagctgatgacagagataagaaaagctatggcaagaagagaggcagtcttttgccatgtcagtgagtcattcagttggcatctagcttcaaatttattgatttaaatccaaatatcctaattaactcttataattttgtacagatggacagatggaagtacagtttagaaaaggctgatggtgaccagctgttcaccagctctgctgagcaaactgagccaagctctaatgtgaagacttcaggttagtaataggaaaagttcacctgtggtgaggtt

SEQ ID NO: 130466 - DNA, 303 bp, Homo sapiens
ccctttgcttttcactctgctctgggtatctcggctgatgaaatacctgtctcttcatgcatattgttcagcttttccactactgcctttgacatactaatctattctattgaacatattaatcatagttattttaaagtccttacctgttaactgcaataatactgtggctctaatttcatttcctatttttttctcttgattatgggtcatatggacatgactctttcacatccctggtgactttggattgaatgaatgttggacattgtatattaaaaacaggagatgtattcatctgtt

SEQ ID NO: 130467 - DNA, 412 bp, Homo sapiens
tgttttgaggtttatttgatactagcttcctacagcctcaactagcatgtatgatgcttataaattctgtacaaccaatgaaaaaaaaactaatttaaatcatagtgtgaaaatcaggaacaaaatactaatagtttgataaacaacataactattcctttctctctccctgtgttggagacttccttaaatcaaacaaaaccacagtttaggtgtgccagactataaaaatcattgctgcttaatgttagttgtgctttatataacaagccttatctgcttctcacaaaagttaccacccagaggaaggtttatttgcaagaatactatacaattttgcagcagaatattagagaatgttctgggtgttacttcaataagaatttccagcaaatcattttctcctaatact

SEQ ID NO: 130468 - DNA, 191 bp, Homo sapiens
agtaaaatttctcccaaagtttgtaactcattgtttttcatttagtcactcatttagcacatttgctcatttaataatcattccattgcatccatcaaatctgtttttgaagtaggaaacataaataagaaataaattgcccactcacttagctaagtaacacacgttaccactatatgtgtagtatattt

SEQ ID NO: 130469 - DNA, 482 bp, Homo sapiens
ttatttacttcaagagttaagagtggcagtctggggatagcaccaggagatatcagctgtgatggcttggagaaacagtgtaaactggcagtgtaaacaagagcacggcatgtatgagtagttgagaacggtgaataagagtatgactagacagagatagtagggaagacaagttttttggggcacagtctaagatggtctggtgtcaaatgaaactggggcctaataaaaaggagcatctattcaggagctcaaatgggctgtaccctgtagcattctgaggacaggtctgacttctgagaagggaaagtggtaaaatattgtccagtccatttttaagttggtggctgagcttggtgaggtgtgtttttaaaagacctttagtccgttctacctttcctgaagatggaggactgtaagggatataaaggtttcactgaatactaagagcctgaaaaactgcttggctgatttcactaata

SEQ ID NO: 130470 - DNA, 313 bp, Homo sapiens
acaagatacaaagccactaagtcagcgttcagcaaagactgatggatgaattgtcacccagcctaaaggactggcccagctaccaactgcccctgcccagcccaagagggcaagaacacaatagaccgcacacccacgtctcatccccaggcgcacaccacttcaaaggctacagcaagcagacaacataacctgcctcttctgcggtgtctttcattcagttctgtttcttcatgaagtgggaaggaaacaagtttgggcccacctgagattggggtgtagacggaaggagtggggagagatgcaaacgaca

SEQ ID NO: 130471 - DNA, 500 bp, Homo sapiens
ctggagtccactctgtcactgaatatcttcaacctggttctttaaggactgacatattcttgagttcctaccatgtacttgagttcctacatgtacaacgtgaagcagctatatgaaaagtggagtgactgccatcagttgaagcagaaagaagtctttataaacatgggatttgaactgatctttaaaaagtgtgttccggcctcttaaaatcatcctcctggggagttctcccacttagaagtttcttcagggttggtaacacatggaatgtaatgatttcatgtaaatttaggaaagaaaatttccactttgttttcagtctctttagagtccagcactttccgagctttagggataacgtctttggctagggtaactttaaagaataaacacagtaaggctgggcacggtggctcacgtctgtaatcccagcactctgggaggcctaagcaggcggatcacaaagtcaggagatcgagaccatcctggctaacaag

SEQ ID NO: 130472 - DNA, 157 bp, Homo sapiens
atgcttaaagtaaggagcaactccaggacaccaaggcaggcctcgtctaccgacaatactcccaaactcaagctgaatgagcaggtgttaataagccatggattcactgaggcgagcacttcagagcccacacacagcgattctcctgcatggctgt

SEQ ID NO: 130473 - DNA, 459 bp, Homo sapiens
gtatcttaaacagaataagtacttattaaatattcatttccttgaaattcagttgttttcccactttgtccctctgcagttttcttctcttcctctttttgatcaaggcctagcactgagatgacattatcagcctgcctctctggactctctgtgtcctctagagagaataaccagtgaaagaagacttggcatcaaggacagatacttcttcagtttttcttagtcttttccctctcaatttacagtccatagtgagggagaaatgaaagctacacacagaagcattttgtcattcatgggtggatagcttaggaagaaaattggtctccaaggaaaaggtttaaaacagacaaacaaatgataagtacttgccagaccaaacttaaaccatcatgcaaaggagtaatcctgaaattacttgggataaatgccagcctttattggatgctcttttaa

SEQ ID NO: 130474 - DNA, 948 bp, Homo sapiens
tcagcaatagacccagcagccaatcctgttttaacatcgaatgtttaacactcaacttcagaccttgaatgattgactgaaaatggaagctcccatgttggggttactcaaggtccttattggttcttcagcattttgtggctataaatatttttaaataacagttgtattgagatataattcacagaccataaaattcacccaactaaagtatacattttaaaagtttttaggccgggcacggtggcttacgcctgtaattccaacactttgggaggctgaggcaggcagatcacctgaggtcaggagttcgagaccagtctggccaacatgatgaaaccccgtctctgctaaaaatacaaaaattagccgggcatggtggtgcacgcctgtagtcccagctacttgggaggctgaggcaggagaatcacttgaacctgggaggcggaggttgcagtgagtcaagatcatgccattgcactccagcctgggtgacagagtgagatcctgtctcaaaaaaaaaaaaaaaacaacaaaaacaaaagaaaaaaaaaaaaaaaaaaacaaaacagagaaaaatacattacaagaaagagcgagagaaaaacaggaggcccacaaaaataagcgaaccatcaagcgagtaaactcacccgaccacgaggggggagaagaacactccacaacagaaggggtgggtacgaacgcatgtcaagataaacagtcaaccgaaccaacaagaccatcttccaaaagagcgacagaaacatggcgcgacagggatacctcagcgggacgtgcgtgacgagtagaaaacacagcgccggcctcgtctgaaaacgacaccacggaacgaaagacacacacgaacgacaatgagcgagtatcgagcccagcggggaaaaaccatcaacagtgtgcgtgagaacaccacacagggggcgctga

SEQ ID NO: 130475 - DNA, 726 bp, Homo sapiens
gaagccaaaaggccctgcagcaaatcagcaatagacccagcagccaatcctgttttaacatcgaatgtttaacactcaacttcagaccttgaatgattgactgaaaatggaagctcccatgttggggttactcaaggtccttattggttcttcagcattttgtggctataaatatttttaaataacagttgtattgagatataattcacagaccataaaattcacccaactaaagtatacattttaaaagtttttaggccgggcacggtggcttacgcctgtaattccaacactttgggaggctgaggcaggcagatcacctgaggtcaggagttcgagaccagtctggccaacatgatgaaaccccgtctctgctaaaaatacaaaaattagccgggcatggtggtgcacgcctgtagtcccagctacttgggaggctgaggcaggagaatcacttgaacctgggaggcggaggttgcagtgagtcaagatcatgccattgcactccagcctgggtgacagagtgagatcctgtctcaaaaaaaaaaaaaaaaaatttttttagtatatccacagagttgtgcaaccatcaattttagaacattttcatcacaaattttgtgcctgtaatagtttcctagagctgtttcttaacgaagtaccacaagctgggtggcttaagacaacagaaatgtattcctggccgggtgcagtggctcacgcctg

SEQ ID NO: 130476 - DNA, 714 bp, Homo sapiens
tcgtgtagtagatgttattaaccgcattttaaatagatcaggagagagcaagagaataagggcacccaaataggtaaattcagtaggcggctttattggacctcatgtttgattctttactataacattttccccaacctgggcaatgtggcgaaaccctgtctctacaaaaaatacaaaaatgagcctggcatggtggcgtgtgcctgtagtcccagctactggggtgggaggattgcttgagcctgggaggtcaaggctgcagtgagctgcaatcgtgcaactgcactccagcctgcacaacagatcaagatgctgtctccagaaaaaaaaaaaaaaacaaaaaacaaaacatcttgtgggggggcgcctggcgcccctgagaagaagagtttttcaaaaacacccattcgtctggttggggggccgggaggcccgccaggtagggttgacgggcggcaccatggtgtcacgaagctgtggtcaccagaagagagaaacatcccgcgcccagaggaactgagggtgtctggtgattatctcccaccccaaagaataaaaaaaagagcgccgcgggcgggacacaccggacgcgtttctcgggacacaacttccaagaaggggtcccaagaagccccagaccggcggctcaagccaacgagggacgtcccaggggagacgacgaaaaaaaaatagcgcagggcgggaggaggt

SEQ ID NO: 130477 - DNA, 303 bp, Homo sapiens
gttttctatgcacatattatgtcatcttcaaacagggaaaatttgacatccttgccctttatttctttctcttgcctgatttctctggccaagacttccagcactatgctgaataaaagtggtgaaggtgggcatacttgttttgttccagttcttagaggaaaagctttcagtgtttccccattttgtatgatggtggctgtggatttttcatgcctatcctttattttgttaggtatacttgttctatatatttattttgttatgtatgcttgttctatacctactttgtttagtgttttt

SEQ ID NO: 130478 - DNA, 539 bp, Homo sapiens
aaatcccgttgactctgaacttcaaaatatccagaatctagtgagttctaagccaccacagactcttgtctctctaataacaagtttcttatctctctgcttccaccttggctctcctgcagttgattctcacacagcagccacagtgatccttgacaagctttggtcagattatgtgatgctctgcctagatctctctagtggtttctcacccactcagattaaaactcagtatttgtctcgtggctttgaataaggctttattttattttattctattttatatttatgtttatttttattttttgaagctgggtcctgctctgtcacccaggctggagggctgtggtgtgatctcagctcactgcagcctctgcctctcaggttcaagtgattctcctgcctcagccccccaagtagctgggactacaggcgagtgccaccacaccctgataatttttttgtatttttattagagacggggtttcaccatactgaccaggctggttttgaactcctgacctcaggtgatccacctg

SEQ ID NO: 130479 - DNA, 611 bp, Homo sapiens
aaatcccgttgactctgaacttcaaaatatccagaatctagtgagttctaagccaccacagactcttgtctctctaataacaagtttcttatctctctgcttccaccttggctctcctgcagttgattctcacacagcagccacagtgatccttgacaagctttggtcagattatgtgatgctctgcctagatctctctagtggtttctcacccactcagattaaaactcagtatttgtctcgtggctttgaataaggctttattttattttattctattttatatttatgtttatttttattttttgaagctgggtcctgctctgtcacccaggctggagggctgtggtgtgatctcagctcactgcagcctctgcctctcaggttcaagtgattctcctgcctcagcccctcatcctgtgtaactgggatcacaggaggatgccaccatgcctagctaattttgttgattttttggtagagacacgatttcactttgtttcccgggccggtctctaatttctgggctcatgcaatcctgccttgcctcccaagatgctggattacacgcatgagtcactgtgcctgacctaagcttaagatcctggagt

SEQ ID NO: 130480 - DNA, 377 bp, Homo sapiens
gtcttggcctgccgcctgtcttttcttcccaccctctcaagcagcagtgccagcccccagctttgtcaggaggtgggatgtggatgccgcacagacctaagtggcctttctgtggctgggaaactggaccaagaaaggcaggtcgggggacaggcaggggagccatctgtgcagggtggcagtggtgagggtggaggatggggacagcgagggagggcaggagaagctctggacggggcaatgcggctgtgcagagaggatcaggatgagggagctagttctgactccttcactaactagccaagttactgtgggcaaggcgctttcttctcctctccaggacttagtttcctcatttttttttttttttttttttt

SEQ ID NO: 130481 - DNA, 449 bp, Homo sapiens
atcaagttcctaggaaccttcaaagagacttagactcccacacaataacagtgggagtcttcaacacctcaccaacagtattagacagatcattgagataaaaaattaacaaagatatttaggaactgaactcaacactgggccaaatagatccaaatggacatctatagaactctaccccaaaacaaaagaatatacattcttctcatctgcacatggcacatactctaaaactgaccacacagtcagacaaaaaacaattctcagcaaatgcaaaagagcggaaatcataccaactactctctcggaacacagcataataaaaatagaagttgggactaagaaaatcactcacaaccatataattacatggaaataaaacaacctgctgctgaatgacttctgagtaaggcagaaaccaaagaagttctttaacattagtgagaaca

SEQ ID NO: 130482 - DNA, 465 bp, Homo sapiens
taagtatgtccaaaaacaatgtcagcaattacctgaaaaggctattattaaaatgcttatcccttttccaaataggtatctatagatgccagatagtcttcatttatttcaaccaaaacatacaacagactcaacacagaagcagatgtgagaatctagttttcttctcttaagccaagcatttttaaaagatttgcaaaaatgtaaaacaatgctactcatctcacaaaatttttttgttttggaaaatatagttatgtttcataaaaatacattgtggtaacatgtaataggtttataatttttgatgaataaatgaacatttcaaagtttccaaattttaattcctaatatgataaatgttaacagatataactttcataaataagaggtcttgagggtcatcaataacttttaaaattataaaagttactaacaccaaaaagtctgagaaccactgttaca

SEQ ID NO: 130483 - DNA, 175 bp, Homo sapiens
tatggatttatttgactagtcctctacagatattcatttaaccatttacaattttttgctattacaacaatgctgtgatgaacatccttgtatgcgcatcttctgaatgatactctagaagtaaaatttctggcccgtcagtatggccaagctaccttccaaaaagacttcaatt

SEQ ID NO: 130484 - DNA, 340 bp, Homo sapiens
catgttgctctgttttcccagcttgctgctcctgttggtgcagctgccaacgccccagggctgcagggttggggtgcagggacgccgaggagctgaagagtagcatttaaaaagtttgaatttttcagcttccttccctccctgcacattcccaaactccacttgccagcccggctgccagcgctccccaacatttcttccttcttttctcgactctcccgctctttgatctatttctttctttggcccccctcccccctcacgactttttaaatgaacctcattgttgggaaccagctctcgactgggttcctgtaatcctctcggtggggtggttgca

SEQ ID NO: 130485 - DNA, 290 bp, Homo sapiens
ttttcttgatagaacttctgttcgtttgtttgtgtgtaagttacgtttgtttgtttaaatactgacaggatctcactatgttgcccagccaggttggtcttgaactcctgggctcaagcagtcctcctgcctcagcctcccaaagtgctgggattataggctgaaacttagtgttcatcctctttcttaatgaattatgccaaatacttacttgagccttttggaggtggctgggaaggactgcctgtgtgactaagacagtgataatggagtagctgcttcctgatgtc

SEQ ID NO: 130486 - DNA, 380 bp, Homo sapiens
atcagagcatacctccactgagcctttaattgaaggtcaactgagccaaattgctttggttcaaatcctggttctgcaccttttagctatgcgtgatcttgaacaagtcattgaaccttttggtgtctcagcctcatcatctgtaaaatggagataggattgttaggactgtgaattaataaacagaagtcattaatgtgtaccacatggtaagcacttaaaatttttaattgctattattatattcaaggaacctcaactttaatatctctttgccttactctaagacttctatttctcattgtcaagatttgagagtgttagggaggggagtgggaactgtagtattaaaaaaaaaattgtgtgtgtgtgtgtgcgtc

SEQ ID NO: 130487 - DNA, 835 bp, Homo sapiens
ggattagagccaagtgtgaggatagatcccctcccactgggccttaaccctgcttccaggtgctgagtttgacaaggtttacaacagaacctttcatagcatgcacattacagagctttaggaattctgccttcgagaatagttcatgtgttcctttcttctaattgcagtttttccactactcccaagggcaacgtgtaccttgggaacttatccaccatttaaagacacgaatcagctgggctggcagaccttgacaagaaagatgcatcaatcaacactagaaaacatcatgcagtcttatacacaatggcacctatatctgtgatgtcaaaaaccctcctgacatcgtcgctccagcctggacacattaggctctactgctcgtagacaaacaggtacttccttgagtatccccggcagtcaataatgcagtctcctcttatctcatgtccggctggaaaacatgagtcgcatactcacggcggcgcccggagggcaggaatcccagccatacagccgtgctccctgtccgccacgacactgcggctctaccaacacacactcggcgcctgcggaaaccgtcgctcatcctgacccacaagtggcctgacttctccatccaccatacctaacagactggcgcccatcggcctaatccccacgagccacgactcccccacccgcccaccccacaccaacgaccacctccaccactgccgcaccgtgactgcgcaccgcccaacgacggacaccctacgcgctcacactccccacgcacaccccccacaccagccagccaccccacccaagcccagcacccaccgacaccccg

SEQ ID NO: 130488 - DNA, 256 bp, Homo sapiens
gatcactgaggtcgcgagttgagaccagcaagaccaatgtggagaagcctgtctctactaaaaatacaaaaaaattagccaggcgtggtgactcatgcctgtaatcccagctactcaggaggctgaggcaggaaaaccacagtggataagatctgctgtcaaccttagcttttctgattacacaaagtgcaataacatctattttttttaatccgaaggaatcctctgacaccaccaagcatcctgcccactcctc

SEQ ID NO: 130489 - DNA, 791 bp, Homo sapiens
taacgcattattttgcatccttccacttggcaaagtgtgttagaagtgattctgaatgtggttggaaacacgtttatagtactcagcaaatgcaatctaataaccatattattcaccagttttggaaaggaaacaagtattttatggagctatggttatcatcaaaggaagaaaaaaccctttttaatagaattttaatatgggttttcccccatttatagcatgtactaggtatcactaagattacactgttacaggtgtctgtggtactttgtaatgaagctgaatttgtcaaagagaataagactttcattttccattgagcacctgttttcatcttgaattttcagaagcagtcagcgaaaagtcaaaggtttctttttattctggccccatggggaaagatttgccatttgatcagcacagtctgcttttctgtctctacttggagtttgctatggccatatggagtcactcctctgaacactgatctctgcctcttgcttttatctaagggtgatatgcaaaggtgtatttctaccaacaaaccacacatttcactgttttgaaggaaccagtaatgcagtgacattcataaagatacataccattctatagaatcattaaatcaaaaaaaaattctacgcaggaaaaaaaaatagatggcttttgcagagaaaccaaagcatgcagaaatcaagatggttacagtaaaaccagttatcacttcagtgcccaaagtgttttcacatatgctagctgtctgtctgacagaattaggaatctgaaga

SEQ ID NO: 130490 - DNA, 371 bp, Homo sapiens
tactgaagtcaaggggaatctcactgactcctcagactagcctgtggggtagattatcatctccattttacagatggggaaagtgaggcttagagatgttaagtaatttggccacagtcacacaactatggggcggcccaattgggattaaaggccaaatatgtatcacccccagggtccttacttaatgactatctacctttgagtaaaactttagaatttcaatttatacactggctttgtatagtacagctatgacgaattcccaaaactttttgaagattaacatgtattatcttgtgactgttaaatgcatcattatcttctcttttgcttggaatcttcataaccgcaaaaagatataatcctac

SEQ ID NO: 130491 - DNA, 332 bp, Homo sapiens
tatggtgccaaagcatcacatcacagattatatatcaattaccacaggaaaactgtatgtctacaatggggagatttggcagtcacctccttctttaatcaagtgttaaaacgtagcatcacaaaccacagggtaaccaaccattaagtgcctggtgagctgatgctatatgaagtacacagtactgcctatgaaatattcttgcccaaaatgtttaacctgaacatgcctgtagacctaacttcttgtctacaagtaatatatatggacaaacaagttaaattatatcacaagaaaagagagacatctaaaatgtgggccagctagtcgtg

SEQ ID NO: 130492 - DNA, 786 bp, Homo sapiens
ggtcaccagaaagaccaacacaggattagaggttggaacttccaaccctacctcccaacctccagggagaggagaggagctaaaggttaagttgatcattagtggccatttaatcatgtccatgtaataaagcctctaataactaaaaaggatagggtttggagagcttccagataactgaagatgtgaaggttcgtggtgggtggtgccccagagagggcgtagaagctccatgctccttcccacgtgccttgtcctgtgcacctttttctctatatcctttgtaatagtctttataataaactggtaaatgcaaataaatgtttccctgagttctgtgagcccattaacaaattaatcaaacctaaggagatggttgtaggaacctcgatttatagctggtcagtgagaaacacaggtaaaataattttgaagcttacaattgatatcagaagtggacttcagtcttcttagactgaattttcagcttgtatgatctgagttatttccaggtagatagtgtcagaattaaattagaggacacccaatgggagtatgctatcaaaattactgattggttactggtgggcgaaaagtagtatgtgaattatatctcaatgaagttgttacaaaaaagtacagtaagccaatgtaagtaaaaaaagattactaacgagaaattactggtatcagaaatgaaagaggagactgtactctaggtcccatatatagtaaaaggataatataagaaaattatggaacaacttcatgattaataaccttcca

SEQ ID NO: 130493 - DNA, 583 bp, Homo sapiens
gctacatccccagaagtggtattatcttatcaggatactgaaaatctcaaaacgctacaattcaaatttttaaacctaaatcagactttaaattcatcccttactgaatttttttctgttttctttttaatttgcactcctaattctagacgactgaaccttgatttgtctgcaaaaccagcaattcctctcacttctgcgccactaacaaatctgatgagcgcgccttctctgtcttcaccgccaacactgggaaaatgttgaacagatcaaggccaagaatagaaccctactgtactcattttcagatctccttccaggctgcctcagtgccaataattaacagtttcacataggattgttaaattaataacaccatccagcccacgtcttaccacttatgatttaataaggaccatcatacctcaaaaaactgttaaatactttactgaagccaaaatgtaccatagttgctgcactattctctggcctagtaaacaaaccaccatataagacaggaaatagatttaatttgatacgattcagctggcttctggttatccttgcatccgatagccacaca

SEQ ID NO: 130494 - DNA, 184 bp, Homo sapiens
aaataatcactgctcgataacatgattatgagacaaataatcataaggcagaaatatgagcagggattatatgggccaatcagaatggattttggctgtaacctcagatcaggggtctgaaagtccactatggtgccagagaataaacttttagttgcttgattttggagtaatggggaatggg

SEQ ID NO: 130495 - DNA, 343 bp, Homo sapiens
cgccggttctagaggatccctgcttacctgggcgtattctatctacccagctacttattttattttatttttttgtagcaatggagtcttgctatgttccctaggctgatctcaaactcctgggctcaagtgatgccgtttcagcctctccaagtgctaggattccaggcgtgagccaccatatgcccagcctcaaaaattttgtttaagacctgtaagaagaggacactttttgtctagggttgtttgagtttagtgccactgaaaatcagaatggagccacagactcagaagtgagaagacctgagtttgggtcttggctcaaccttgaccaagttattta

SEQ ID NO: 130496 - DNA, 443 bp, Homo sapiens
catggcctgcatctacttctcacatttctgactgcctaccaggttccaggcactgttctaggcactgaagatgaaaagatgaataatatggagttcccatcttcaaagaagttacaattttaaggaagactggcaaataaaagttaccccacaaaataataaaaatacaggggtaaaactagggcatagttatattttggctggtctctttacctctgaggttcttttgctttttatgtaattggattttaacctcagaagactgtaaggttaaagatgataatgtataaaatcagtactctgagtaatgatcaaaattttctgttgccatccacacatttgagtgagatgtagtgagtgctagaaaataaagcagttcgtatcaaaaagggtgtgttgaaagaaataaactaatccttgagaaacactgtcatgcaatctca

SEQ ID NO: 130497 - DNA, 380 bp, Homo sapiens
tgaatcctcacctgagtttccatctcactaaaatgaaatgctgaagtctttattgttgcctacacatctcaagatgtaccccttctatatgtcttactactttcccttttccttcacttcactccagtcatgcagtcctccttgagcatttcagacttgctcctacctcaaagcctttacacttgctttttcttctgcctggaatgttctttcagattttcacataactagttcgctcacttccttcaggtcagattaaacattgttagtagagccttcctcaataaccttatatattacccttcctctagtccacacacactgcctgtcattttcagcttgctttatttttctccattgcacttatcactacttgacat

SEQ ID NO: 130498 - DNA, 761 bp, Homo sapiens
taactggttaatttttgtatttttagtagagatggggtttcaccacattgatcaggctggtctcgaactcctgacctcaagtgatccacccgtctcagcctcccaaagtgttgggattacaagcgtgagccaccgcgcctggcccattcaacagacttttaatgagtgcctaccattgtgtcttagcagtatggcaagcacaagagaccttggataattaaatttttattatttttttattttttgagatggaatctcactctgttgcccaggctggagtgcagtggtgtgatctcaaaaaagacaaaaaaaaaaaaaaaaacaaaaaacaaaaaaaaaaaaacaagtaggcgctatgtgcaaggttctgtgccaaagtctattacattggaatccgatatgatttgctggctttcaaggaaatcacaaattcacactgtgtagtacggataccaatatttatctaacattagtaaacaacactcatttcatttccataactacttatttggacgcattcctgtgtgtggttccacaggacacgaacacttagcatggcccaatttaaagaaacgtaccggctgacctggagctgggatgtgggtgcccattcggccacaaaacctcttcacaaaattgaacaccggctgggcccaggtggttccacggcttggtaatcccaggcaattgtgggggggacgaggccgggtgaacacaagaggctcaggaatttcgggccccgcctggcccaacatggtgac

SEQ ID NO: 130499 - DNA, 613 bp, Homo sapiens
gtgagccccatgttcttcctatatttcttcccaacgtagtttcagaattgtgggacaaggagtgagaatccagagtccagtaatatcattgagttgaagagacagactgaagtttggagaggccgcagatgtagaatttgctagcagagtaatagacgggaaagagctatgcagagaaagagctccagaattctgtctcctgaatgttgactgaatactaatccatgcatgtgtaggatgaaacttcatgtaactatggaaagaactacagagtgaagaacaattacagggagttgtgagccaaacaacactcaaaagtaatactttgaacaggcttgggcaaccagcagccagaatggatagaccttgttgaataaatgagacattcagtgaaaaccccagatgcttcacatcttcgtactgggggtaaacgagcatagagtaaaagctcccaaagatctgccccaaaaaacttaaaagcaagcctaataaagatcaagctgatctctaacaaacttaattgcctgacaaaacgaagttaactctttaaaagaatacaagaagatatagcttatacaaatgtaaaattcccaatatacagtatccaatttaa

SEQ ID NO: 130500 - DNA, 668 bp, Homo sapiens
aaacaaggttgagaattcttacgctttttaaaaatataggtaaattcaaaatcttttaattttgatggtgattacatgtaatacagatttgcagaaaaatccataattatagaattggtgctgactcactttccagtgacctgataactgtctgcatcatttaccattgtgaatgaattacccaagtcagttttcagacaaatttgcagaattaaccttagtaactgttgaacacattgctgctttaaacaacatattgttacattttttaaaagaaaaaaattaaatttgtaccttgattctgtaaaccatactttaatctttcaaggaggaagaatgcgttctctgtagaaaatagattaaatagaatcttctctcctagtgatttaaattggtttaattaaaaacaaattctatatctgcaagagaaacagttgctcatctaattcaaaaagtaactgctaattgagaagtcatttatagtctgtcttaccatacattatctgatttccttgtagtagatatacattctgaattgcttttgaagtagcatcagagtaggtagtaaatatgtggtaggtgttagtttgggattaaaatatgtaacaattctgcaaatgaattatataaaatggtcatattgagggactacacagtatatgaaggtc

SEQ ID NO: 130501 - DNA, 572 bp, Homo sapiens
ctgcccaccttaaccctcccacagctgggaccatggctgtctccctctgctgctgtcccctgctccatcctgggaccctaaatgctgggagaggctgcattctgaaaagtcagtcaatttatccatcaacaacagaacctagatccgacaaatactgattgttttaaaaaactttaagatattcaaaggcaggtacaatagaagatacccaaaaggggacagatcttcttaaagggacacgaatcttaagagacaggaaatgattctaaatggacaattaacaatttaaggcaactgggtcttttagattacagggaaagtaggcaaaccaggtgaaggagacctttcctttctttcctgccccagccccacagagcagagccgccgctaggtaaaacacacccaccctttctcctggcctccgacagctcctgaagcagcagcagcagctgccttcagcctaacttcctgaggatgagcagggtggtgtgtatggaggtagggttgaagctcagtatgtccgaagcagcaaagccccagtctgagatgtccccctgcctgccttatgccac

SEQ ID NO: 130502 - DNA, 238 bp, Homo sapiens
aatttatcaatacaacattcagatgacttgagagtaattcactgttcacaggtaagaggattaagtcagcattgcttctctgtattggtaaaggaaaaattgtatgagattctaacaaaaagtgtgttaaacataagttagaataggtaaaacattaatataagtgggttgcatattgtaagcaccatatgaagaaactcatcagaattttgatatctcttaagataaaatatatctt

SEQ ID NO: 130503 - DNA, 600 bp, Homo sapiens
gttttggataggtactggtaagagtgggcttgttctttgaagttcctttagtttctttagtcatttaaatgtcattgattttttacatcttgccttcttttcttaccttttgttaatacttaaatttatcttaaaagtgatactattttaccctctagaatcttaaaactttgtaaattataaagaattgcttagaaattaggtctttcattttattagctgtattgagtggcctttttgatgctaaacaatatctaattgcatctctgctctttgaaaacatagggctgctatactctagtgtctgaagtctacattaatgacaatatctcctggccttaattctaagagcatgatttcaatggatagtaattcacctcattttttatctaagtatataacctctttcttttctaacattggttggggataatttcaataacattttaaatactcagctggcataattacagttttattttaacaaattttcagtttattcttaaattcttagtgtataattttttcaggttctatgtaccttagcttttcctaaataacattctgagctctataaacatatggtatggatttatctgg

SEQ ID NO: 130504 - DNA, 257 bp, Homo sapiens
gctgggattacaggtgtgagccactgcgcctggccaatccactgtatttttgtaaaccagaagataagtctaagagcttgattcgatttaaattaaaagtttttggcaagaatactcagaaggtaatcttagtttgttctagttggtgataacccagtttgggcacttggttaagtggtacctatctgatctctccattgtaaatgcacgtttccccctttgcagttatgtgatctgtgggaagaatttgtttttga

SEQ ID NO: 130505 - DNA, 489 bp, Homo sapiens
tagctgcctcctgaggtgtaaaaccaccctgactgtatcctaggaggatttaggaggaccagatgtcctcataatgagagataggtttttccccccagataagagaattcctgctaccttatattaactacttaagagttctgtaaattcagagaaaggagaaagaatactataggccacctgtgataagggaagacttcccagaagtggtaataggacaatacttggacttttgtttgtttgtttgtttgtttgtttttgagacgagtctcgctctgttgcccaggctggagtgcagtggtgtgatctcaacttactgcaagctccgcctcctgggttcacgccattctcccacctcagcctcccaagcagctgggactacaggcatccgccaccatgcccggctaatttttttgtatttttagcagagacggggtttcactgtgttagccaggatggtctcgatctccttaccttgtgatccacccg

SEQ ID NO: 130506 - DNA, 738 bp, Homo sapiens
tgtacataattatgcaaaactataaatatctacccccaaattaaataaggacaacccccaagtcttgatgttttaaatgttaatgtagtagagcagaaaagtgagcaagccatgaaggcagatgctctggaaaaatcactcttgttttcatacgcatcgtaaaacatcaccccacaaaccacatcctgacattgctgacattcacccctcctatacatgctcagcctgagcctgtttggcttgagttgcctgacagtaaaacaggattcagagggaagatgaaagggagaaagcagtggactacagataatccactaaacagaaaatcaactcagggaagtctccgcttggggccatgtactttgggaacaggaatgttggtgtataacttgaggtctcatgagtttattcatccaacaaacacttatgaaataccgactacaagccaaacatcatatgtttagatgggtggagtcaagaggcactttttaagcagttagggaaggaaaatctcaggcaagggtacggtaagttgtatgtgtagaactaaggaaaacatcacagacatagtctgatggctgggaggaggcctcagattggcagtagaaaaactgaaagtaaaacaggattgaaagcaacgcttgaaagcaacaccatgaatataaagaagtaaatttgtcttcattcccctgtcctgggacttaagaaaaagagaatttggagctgatcttccactgg

SEQ ID NO: 130507 - DNA, 625 bp, Homo sapiens
tgactctgggccaatcgtgtcatctctgagccttcgttttctcaaatccggggccacagtcctacctggcctcacctccctgggttgtttggagcatcacagaagagaacgtgtttttgcaaaagtcattcgcagacgaggcatcccttctgtccccagcgccttctttcttccagcgcccgctttaaattggctaggtctgagcttttccagatgccagtggggaggggcgtgtgcgttagaggctccataaatacttgtaggaatgattttgtttgtttgtttgaaaggaaagggcaggaactggaggaagtattgcccagatttccttgaggtcccctcacactgagaaggcctgaatgagccctgcatatatatacacacacactggtgcctacgtattcacagccacgcacacactctcacatactcaggctcacacacacccatttatacaccggcaatcacacacacgtgtacatgcatgctcgcacacacactcacatagtgacaactatactcctgagagcgcttctcttttctttcataagaatactattctgatttcttctacctcattttccttcaaggaaactttcaactacttgaccacatcctgtgaata

SEQ ID NO: 130508 - DNA, 845 bp, Homo sapiens
gggctgaggcagtagccacaatcagcaaccctggccaccccagcaaaagagtggttatgcatgttcatgtgttctgaggacaaattccactgtctgcagctgccatcactgtgatatcccccaaccccatcccaagccacctgcctattgctgctccctcttattgccactctgccctccccattaacagggccacagtacagccactgttgcctccacgtgagcattcagccagaggcctgaagattaccctccccctgcctacaagagccatcacctgcacatactacaggggcctgaaggcagtacttcccagcctggatcaatcccctaccttcgtacctgagcacaccatccaagggcctggggattgctcagcctagtccactgcttttgacacctgagcactgctcccagggtctgagtttgggctttctcaacctgctgctatcaacacatctggcacccacccacatgtgccacttgtgggcctggggactgatatgcccagcctgtcacagccaccaccaacaacagagcagacctcttcggcccaagagggttgcctcaccactgctactgatatcacccacaccatgcccactgcccaggggctcaagagcctacccacctgcctggcccactgctgccattcctggtgtctgagcaagccatttggaggcccaataattggcctgccagggcccactgacaccagtgccagtatacaccaccctgaaacccaaagacagacatgttcagcccattgctgccaccactgggacctaaagattggcctacctgacataccactccccaacagaacttgcctccactaataactg

SEQ ID NO: 130509 - DNA, 490 bp, Homo sapiens
gtagctgggactacaatctcccatcaccacacctgggtggttgttttgtttctttttagttagtctcgcactgtgcccaggctggagtgcaaatgatgcagtcacagctcaccgcagcctcgacctccagggttcgctcaagtgatctttccacctcgcctcccaagtagctgggactaccggcacaaaccaccacacctggctaatttttctttcttttttgagatggagtcttgccctgttgcccaggctggagtgcggtggtgccgtgatctcggctcactgcaacctctgcctcctaggttcaagcaattctcctgcctcagcctcctaagtagctgggattaacaggcgtgcgccaccatgcctggctaattttttgtatctttagtagagatggggtttcaccatgttgaccaggctgatctcgaactcctgacctcatgatccacccgccttggcctcccaaagtgctgggtttacaggcgtg

SEQ ID NO: 130510 - DNA, 363 bp, Homo sapiens
agcacatttcccccctttttccaatctgtgtcttcttcagcaaattgtgagtggagatacatatatccattcaatctatacatagactgaatggatcccatagtagttgatgacatccagggaccaggcaccaggctattcctcaggtgcactgattaggacacatcatccattcaaatacctatgaagaaccctgtggtaggtggtgtgggggattcaaagatgaaaggagacattctcactacttccaggagctctggattgagtagaggaaccaaggtctgtcacaaacaactatatatcaatgcagagcagcacatatgagtgtcacaaggcaggaaccaaggtgccaagtagggaaat

SEQ ID NO: 130511 - DNA, 340 bp, Homo sapiens
caaaacccagaaggtttgctgcttatcagcaagtaaccatttagaaaatacaacaggaacatttatccattcacagaatcaataaaaataaaaacaaaatgctcaggcataaaccattataatggaaactgtattgacagcaccagtaaatacccttctcccttctgagtttaaaaccagtcgaagggggtgaaagagagggagaaaaacagacagaccagggattggatgatggagatcagagtatcacttttatttgttttaaaggctaggttgagcaagcaacaaggctttaatctgaagtggataaatgtcttattcatccttgagttaggcagac

SEQ ID NO: 130512 - DNA, 381 bp, Homo sapiens
gtggtttctcactaacaaaaaataaataaataaataaaataaacagaaaaaaatagctttgggaattgtcaccttcagtttgcacttctgggtctatcaggcctcaggagctgttagccaactgtttccctgaaacaacagcctcaggggtcaaacaggtttcagaattgacaacacttccattgtcctgcccaggggcacccctcagcaaggcgtaggcaactactctggccccagggaaccctttccaccaccctcctaggatccacagcacttctacctatgctgcgcaggggagcctctcagcaaggcacagatatctctggccccaaggcgcccctcccaccaccctcccgcagactcggggcggtcggctcgggt

SEQ ID NO: 130513 - DNA, 379 bp, Homo sapiens
gtaatcagacagggatttccgtcatcactgatattgtttcacattgttctaaagcagtgttgctcaggccaggtgcagtggcttacgcctgtaatcctagcactttaggaagccaaagcaggcagatcacttgaggtcaggagttcaacaccagtttggccaacatggtgaaaccccatctctactaaaagtacaaaaaattaaccaggcatgatggtgtgtgcctgtaatcccagctactcgggggtgtgaggcaggagaatcacttgaacctgggaggcagaggttgcagtgagccaagatcacaccactgcactccagcctgagcaacagagtgagactctgcccaaaaaaaaaaaaaaaaaaaaaaaagcagtgt

SEQ ID NO: 130514 - DNA, 396 bp, Homo sapiens
agtgtgccctgagttccttccttcctgaattgtatacccatgccaagtccctggcagcgtgctgggttaggcccatagaagcttcacgtgataggcaagtctcacccttacctttgaactacactggtttgtttctcttcatttttccattttgagctgccgtgagtcaggctgcaggcagctcatttacacaggagtcagcctgaaggaaggtggcttgaagtctactttcattttgtcatgggaggtgttttcctgtggaatcgctaatcaggcaggtcaaagggaaccataagggatctcactcatccctagatggaaacaagtacagcaaagccatctcagaaggagaccaaaaacacacaaaaacaactcccctgacagcatttcttaact

SEQ ID NO: 130515 - DNA, 208 bp, Homo sapiens
tccacgtgcctagatatgcatgcccatcttgttgtggttatgactgcagtgttcaagggaaacacgatgaatctggtggtgcggttccccctggggagtgggattaaagaggttcagaaaggggtgggcaggaggccactatccctttttttttgtatttgaaaattattctggccgggcatggtggctcatgcctgcaatcccagca

SEQ ID NO: 130516 - DNA, 427 bp, Homo sapiens
ctagtcttgaactcctgacctcgtgatccaccctcctcggcctcccaaagtgctgggattgcaggcgtgagccactgcgcccagcctaaattttctaatagccacattttaaaaagtgtgtagaaagaaacacataggctggctcatggtagtttacacctataatcccaaaactttgtgaggctgtggcgggaggatggcttgaggctaggaatttgaggccagcctgggcaacatagcaagataccatctctacagaaaaaatacaaaacttagctggacgtggtggtgcctgcctgtagtcccagtgactcaagaggctgaggtggaaggatcgcttgagcactgggggtcaaggctgcaatgagctacggtcatacctctgcactccagcctggatgacagagcgagaccctgtctctaaaaa

SEQ ID NO: 130517 - DNA, 746 bp, Homo sapiens
gaattgacatgataccagatcctacctggttttctgtgtaaaactacttgtctcagtgcagacttttcattttctttctttttccttcacttcactcaacctcatttactgagttcctgcttccttgattttggttgccaaaacatgtgatcccacaactactaggcgaatgggctggagttgcccttcacgcaccagaatgtcaggcaccaaaccctggcacctccaggcttcatcatgctcactgtctccgtgctcaagtcatctggaccctcagccatagttctctatcatctcctctgtgctgttttctaagttcacaactgtcttcccaagctgttcatcttggtgagcaatccacattccaacttcccatcatggtgaacaaggattcccaaagaagaaatgtccaagtaatttttacctcgttgtgtccttgttccttaggaaaaatatggcccagtgtaaccgtgatcttcatcttatctcttctagaatctgccactttgtctaggcccacagtcatggccctggtagaaatgcttgcatcttccactgagacggattctgcttcctgtttgcaagtgaccttgcctctagcattggttcctgacttgaatctttttgccagcattacatcctgtggctttttgaatttgtggccttttgaatcacagtctctgtgctcggagactctttagttactccctgtccgtagtctcttccagtccctctgcctcttgccc

SEQ ID NO: 130518 - DNA, 470 bp, Homo sapiens
gccctactttccacagggcacagggctccttcggcggccagaggagcggggaaaatgccacagggagaaggaagtctccagcgagctctgtaacaactggaatccagccagagcctcctggccagaactccggggagggcgcgaatccggtgcgttttgctaaggacttaaacttaagacctgaaactataaacattatagaagataacattggaaaaacccttctagacattggcttaggcaaggatttcatgaccaagtacccaaaaccaagggctaaggacatcaatagaaaattctcaaaagaagatacacaaatggccaacaaacatatgtaaaaatgctcaacatcatgaatgatcagggaaatgcaaatcaaaaccacaatgcaataccaccttactcctgcaagaatggccataatcaaaaaataaaaaaacagtagatgttggcatggatgcgatgatcag

SEQ ID NO: 130519 - DNA, 356 bp, Homo sapiens
gggaataggaagaatacagatatggatattcaagagacaatcatagggctgtggaaaatggtccttatgtgctgagtccacttctgcttgggaccacagaggagtcgctgttccaggtggagtcatccagtcagttgtcagaaatgtaaaagtctgaaaagacatcttaaaaagccaatcttaagttccacaatagtgatgttatttacaggagcaattggcaatgttgcaaatcttgtgatctctggaacaatggctattaatcatttcactacacctgtatcttagcagaattcaggcccctttcataatcttaaacttgtggccttgtattagttttataaaggcagtttagt

SEQ ID NO: 130520 - DNA, 1080 bp, Homo sapiens
ggaagacaacaacctactaaaacttaaggaaaaaggtaagtgcattctgcgtaacatggaatgggagataaaaaagcaatgctggctgggcgtcctgtaatcccagcactttgggaggccgaggtgggcggatcacgaagtcagcagttcaagaccagcctggccaatgtggtgaaaccctgtctctactaaaagaaaacacaaaaaggtggtggtgtgcgcctagtcccagctactcttggaggctgaggcaggagcatcgcttgaacccaggaggcggaggttgcagtgagccgagatggcgccactacactccagcctgggcgacagagtgagatgttgtctcaaaaagaaaaagaaagaaagaaagaaaaaagcaatgctcattccaagacagaagatataaaacaagaggggaaaatatgctagtgtccaggtccaactttccattaccgctgtacatgttattttcaatacagaagaggtaaaaggaagcctgaaaaggcaagattgctcctcatcccttttcctagtcctgcttaaaaactcgtcactcaataattatttaactagttagtactggttgtcatggaagtaacgaaaaacacaaactgctttgggaggtcgaggcaggcgatcacttgagctcaggagttcaagaccagcctgggccacatggcgaaaccctgtctctacaaaacatacaaaaattagccaggcgtggtggtgcacgtatgtggtcccagctacttgggaggctgaggtgggagtaccgcttgagcccaggaggcagaggatgcaggccaagatcgcactactgcactccagcctgggtgacacagcgagacccagtctcaaacacacacatacacacacagtgagaccaatctcacacacacacacacgtacgtttccagttatcagacccagtctcaaaaacacacatgcacacagcgagaccaaactcaaacacacacgtacgtttctagttatccataatttatctaagaaaacttatctaagtccctgattaggtaaaactcaagaaaaacatcctccttgaaaatactactttcaaga

SEQ ID NO: 130521 - DNA, 242 bp, Homo sapiens
gctataaaagtgggtaccttcagcccatagctcaagtctggctcctaatttcctccagtccaaggaacgataccaggatatgagaatcccatttatgcctacacttgtggaaaacacaacacagctttaaaatctttagtggcaggtgaggcgggaggattgcttgagctcaaggggtcgaggctgcagtgagctatgatcacgcactccagcctggatgatagagtgagaccccgtctcaa

SEQ ID NO: 130522 - DNA, 467 bp, Homo sapiens
gcagaagggaaaaatgtttcagactagtaagccatgactcagttaggagccaggattctgtctgccgaggtttgaatcctggctctatcatgtaccagctgtgttactaggtaagttacacagcttgggtaagttacttaaactccttagtttcttggcctggtgtggtggttcacacctgtaatcccagcactttgggaggccaaggcgagtgaatcacctgaggtcagtagttcaagaccagcctgggcagcatgacaaaaccccatttctactaaaagtacaaaaattagccaggcatggctgggtgcagtggctcacgcctgtaatcctagcactctgggaggccaaagcaggcggatcacgaggtcaggagattgagaccatcctggctaacacagtgaaatcccgtctctactaaaaaaaaaaaaaaaaaaaaaaattagctgggcttggctggcaccggt

SEQ ID NO: 130523 - DNA, 433 bp, Homo sapiens
atccatcacttctaaaagtatcctcatgtccctttgtaaccccttctttcctgctaccctctttcccatccccaagcaaacactgctctgctttctgtcattatagattaatttgcattttctaaattttatataaatggactcagtatgttttgagggaagaaatgtgactcttctttcatgtagtataattttgtgattcattcatgttgttatctgtattaatacttcgtacatttcccattgtatggatataccacaatttacatatccattcatctgttgatgaacatgtgggctatttccagtggggctgttacagataaaggtgctttgaacattagtgtacaattctttgtatgaacatatgcttcagtttcccttgggtttattctgtttcacctaggagaggagtggctggatcatatggtag

SEQ ID NO: 130524 - DNA, 301 bp, Homo sapiens
cacatgccatcttataaagtatcacttgggtgattctatgtgttcatcaattacatgcttgcaccaaaaggtagatatgcctatttatcattggtaatttatgggcctgccatattctaggtgtgtgagaggggaaatatgaaacttaaaaaaaaaaagctactgttgctcaaggtcacagcatggaggctcaatcttatttcacacacacaaatcagatcactgggcgctcgtaggagcaggtcactttcctgaaatagagagctgtcttggactgggacagtccccacaaggatataac

SEQ ID NO: 130525 - DNA, 251 bp, Homo sapiens
gcccggccttgaatgcctcattttcatctggaataatcccctatgaagccattagagtgagcccatgcagcctgtcactctgaggttcaattcaagtctcttctcctctaagaattcttttctgcctagtcattctcatctctggatatctctggttccttggcaagcattgtatcacccaccgccatgtccactgcatggggctgtctgggtcgccctgccgcacccagcacaagcagtctcgtgccaag

SEQ ID NO: 130526 - DNA, 279 bp, Homo sapiens
ttctggtcatggtgtaatattcctaccagcagggacctgatctgtcttgttctttctctttaatacctaaaaaagtgcttgggacaataaatgttggtggaattaatgaatgtcaggaaaatccacttcatctccagtcttccttctgccattagcaagctgtaagtaaccttcacaaactcatctgagctgctttggctacagtttctccacctgtaaaacaagatgtttgcagtacaaagtctttggttctctaagacatgctttctctgttaggag

SEQ ID NO: 130527 - DNA, 488 bp, Homo sapiens
taccaaaaatgctgcccatgtgccccttcctagcttcctgttaccagtcccacccaattatgtgaaccacaactgccctgtttctgcaggttcttaacaccccttttctcagaaggcacagtgtccacctgcctggcctgtaatcactggttaactgcagtcccacataaaactgacccgtgaaagtccacctttagtgccctgatacctgagtataattatatttgacattttagtgacagtcttaaagagaaagggtcacaaatatagctgtgagtgctaaagggcttgtccagtttacaaagtgcagtcacacatgctgctgtgcccttccaacaaccctgggggatgaccattagcatcctgtctcatcagtaagaaaaccaggcccctctctcaaattggatgtatccctcccgctactacacagataggacccagttcaatcacaacccctgcccaggccccacagagctgtatccattcac

SEQ ID NO: 130528 - DNA, 407 bp, Homo sapiens
ctcggcctcccaaagtgctgggattataggcgtgagccaccgcgcccggccgagaaactaatcttttgagatgaactctgagatgtggattttagcttgtttgcagccaccaccactctagttttggaagattttcatcaccccgaagaggcttatactcatttgcagtcagtacccacccacctcttccacccagaccgtggcaacgactccccatctctctagctctggatctgcctcttgtaggccggtcacgtagaccaatcttgtatgggtgtccagttgaggataatgggttggtcctggttgtctgcaatgtgaatcttaccactgaagggtggtccctggagggaagcaggaggctgggagaactgggcggaacatcctttgggaatggagtggggcgg

SEQ ID NO: 130529 - DNA, 448 bp, Homo sapiens
ggtttttttttttcttctcagagttcagaaaactgataggcagtgaggttgaatggctagtgcagaggttgcagtgagccaagatcgctgcactgtagcctgggcaacagagaaagactccatctcaaaaaaataataataaaatagattttgtaagaactgcttacccctttgaaactcacagttaaatcataaccttaattggtgcttgttggtttcacctgtacagttacttttaggaaagtctgaaaaccagaaatattggctgcttggcacagctaaagcaggtaatggggaatttaaaagaattttcttaaagtacattcagcttaactaaaagtgcatacccagattttatacacacacacacacacacacacacacacatatatacatttttttttttttttgagactgagtctcgctctgtagccaagctggagtgcag

SEQ ID NO: 130530 - DNA, 339 bp, Homo sapiens
agccagttgtggtggcgcatgcctgtaatcccagctactcaggaggctgaggcaggagaatcgcttgaacccgggaggcagaggttgcggtgagccgagatcgtgccattgcactccagcctgggcagcaagaggaaactccatctcaaaaaaagaaagaaaaagaaaaagacagatagttgccccttgggggccgcaaggaagaagctgtcctcaggaaggaaaaacacggagatgggggagctcaccaagaagtgaaagggcggttctgagcctcgtgttgaggactgtagacccatgaattgcagattctgcacacacaactctagtcataacaga

SEQ ID NO: 130531 - DNA, 557 bp, Homo sapiens
gacatagtaggttctcagtaaatacgtgtggagggaatggatcaatgaaagaaagaaagccttattgcacatattgtacataattaatatttcagataccataattatatacacttaaaaaattcagccatcagaccatatataactttcctgattaaaagtagtggatgctggttgctttaattctggtgagattcttatgttggataaatggaacctatgttgtctgtggtccacatggtcttttgctgcaacgagagtcttggatatgaagaaaattttaaagcgtgatagaatcagaatgtatattttccccattcttaacagatcaaaatgtgataaagatgttatttgttcccaatatataatatgatttgattgatagctattttctagagggcttcttttgaccttgtttaagatactacttagtattaagtcagatctaatgtgcagtggagtgctatataacctaaagatgcaacaatcctgaaatcactcattttccttttctgactgaattaagggagattatatgaattgtttataaaataggt

SEQ ID NO: 130532 - DNA, 242 bp, Homo sapiens
cagagtccaaacagtgcccagagtccaaacagtgccctggtgagatagaagcaattaaggagagattgagagtaaggaaggagttacagactgtaaactactttttgaggagtttgcaagagaaggcaaagaaagaaagaaagtggatattagctagagaaaaatgaagtagggtcaagagatggtttgggaataaaggtagagaggttggaacctgttaacagaaagaaatccagcataaa

SEQ ID NO: 130533 - DNA, 354 bp, Homo sapiens
ccaagcaggacaagtctttttctttactgtcgcttgtcagaaggacaagtctttttttactgtcacttcttcgccttgtttgggttcagtccccaagaggatttggaaggaaaatccgttgaccactaagctaattaacaatgaagagtttttgtccttgagaactaatcactgttaaagtcactgaagtaagtggctgatacctctctgctttggatgcacagacagtgcctttgtgtcccctgagtcacctactgccaacaaaggcacagtcagagcaagacctgagagtctatccgttccccgttggggaatgtcctgggcttaggggttctgtagtcccaaaatcagggc

SEQ ID NO: 130534 - DNA, 182 bp, Homo sapiens
catttagttcccctaattagcatactaagcaggaatgatttacaaggctagctagcaaatactttggaccatgaagtagaggaatagagaaggtgaatttctgtgcaatgctgtgggaatcagggagcagagggttgagtaaagcaggtacatggcagagataagcttttgttggtgaggag

SEQ ID NO: 130535 - DNA, 497 bp, Homo sapiens
tgcttttacagtatataaaacacttaaaatacagttgcttatttcatttcctcagtaatcctagagagtatttcctgcatcttattgatgaggaattgaagctgggatagcttctctcctgactcttgaagtccgaaaacaagtggacggagctgtagcactaagcctcagcctgctcgtcttcaacctgctcctggctgcagagtcttgattgactctgcctgtctccagtgtgctttcattcccttcagtgggtaacttgtcagacctcgtcttgtttttgagactttggtttctgtcttgccttcttcctaactttggtattcttagttccaaatcctgaataactcctgtaatgggcctcccagtagggggggttcctgtatttatattcacagatgtacgtattttaatagttaacatctgaaatcagtatacatcttaaagttgccatggaagttcatttcttcagtgtctgcctctgctcgtcacttgag

SEQ ID NO: 130536 - DNA, 348 bp, Homo sapiens
gtgctggggttacaggcgtgagccactgtgcctggcccatcctacaagttttgatttgtaatattttttattactcgtatttaagtatttcttttgtaattttcatgtttctttgacctataagttaggtgttcttacatttccaaaaaaaaggtttttttaaatttattttttaaatgatttctaatttaattgcactttgaccagagaatgtggtctttgagataccagttctctgaaaatttactgagatttatttatggcctggtatgtggtcaagtttttaacatattaatgatgttttacctattgattcatcaattacgaagaaatatatgaacatctcct

SEQ ID NO: 130537 - DNA, 114 bp, Homo sapiens
tcactaaggtctctgacaatttcaattctatgattctaaaattcctgtgatatctccctaaagcagtgattagtccagccccctgcagggttccacagctccatgggtctcatg

SEQ ID NO: 130538 - DNA, 766 bp, Homo sapiens
gctttctttacaagtcatttgttgggcattgtttttctagagtgtttttatcaggtgcaagtgcttctcctaattctccaaggagcttctataaattaatttggtaatcgtgactgagagttctccttgctgttctaaggatataaccacaatagctacatgaattttttttaactgtttattgtagaatgtggatttatataaaatgggcatcacagtcatgtcaatgagaaaattttaagaaacaaatattttcagatttgcaaactttaattttttgcttctaaaatatccctaagaatctattacatagctttcatgattatattagaggaaaagttcttctgaaactaggctttaaattctaatatgagaggacggctgtcctcccgcttcagcctccagaagtaatgggattagaggcgtgagccaccacactcagctaattgttttatttttgtagagatagggtctcgctatttttgtagagataggttgcccaggttggtctcaaactcttgggcttaagtgatcctgccacctgggcctccgaaagtgctgggattacagatgtgagtaaccatggcccgctgataataaagatctagtagaattactctttgttctctttcttagaaatatagatatcctggctgggcgtggtggctcatgcctgtaatcccagcactttgggaggccaaggtgggtggatcacctgaagtcaggagtttgagaccagcctgaccaacatggtgaaaccccgttt

SEQ ID NO: 130539 - DNA, 292 bp, Homo sapiens
cgaggtgactctacaggatcttgcgtgtgggcatccctattttacaagcacaggcaagtggctgccctgctctgtcctctgtacccagagtcaggttgtgcagatgccttgagctactgcccaggcaaacgccctgttaacgccattctccagatgcaaatgatcactctctcttgctcttacagcccaagaggcgagcaggccattgaagggacccaaagtaaactactggctttaaccaagaatctcatgcacctgggcaaagatgcccctggcacccagcatggcccag

SEQ ID NO: 130540 - DNA, 231 bp, Homo sapiens
atatgagtatttaaagaatattaatgatttttaagcaagatgactggggaaggttaaaaaaaaggaagattggagtgggaaaattgtataatggcagcactggtttataaaagtaaggaagactggaaaatgggaaacatttatacccaaggaataacagagataaagctgggctggtaattaaaataaatatagacagggaaggggagcttgggaaggggaactaattta

SEQ ID NO: 130541 - DNA, 250 bp, Homo sapiens
ctgctccgcccctctctgttcacgctggaagctgacttgctaggtcttgtatctatgagccaggtgccgggcacctattagcttcctgactgcactccagcctggatgacagaatgagactgtgtttcaaaagaaaaagtagtcagtttacaaatgttattggcggggcgtgggatggaatgaggtggtcaggtaacatttcattaaaaaagtgacatttgagccaagatcaggagagagtgaggagctg

SEQ ID NO: 130542 - DNA, 205 bp, Homo sapiens
attctgagatctaagctgacagaaaagtcccatctggagggttactagtctccatggaagaagaaagaaaactccgaagggcaaggaaatgacctgcctacaagtggtatacagcatatctgctcacgactaactggccaactcgtcacatggccctatccaaacacaaggaagcttggaagaacaatcctagcacgtgcacttc

SEQ ID NO: 130543 - DNA, 343 bp, Homo sapiens
aggcctttagtactgtgggagaatgaatttgttgttttaagccaccaggtccatggtcatttgtacagcagctctaggaaaccaaaggtttcttgaataaataataccaaagagagggcaggcacggtggctcacatctgtaatcccagcactttgggaggctgaggcaggagaatcacttgaaccccggaggcggaggttgccgtgagcggagatcacaccactgaactccagcctggacaacatgagactctatctcaaaaacaaacaaacacaaatcttcgaatacttatgttaacaaagtaaagcaaagaggccaaggtgggaggatcgcttgagccag

SEQ ID NO: 130544 - DNA, 227 bp, Homo sapiens
taacagccagttgtgggccccctcctacgtgactttgctcaagcccatattgaactcttggtcacagggaccaggggttcctggacccctggcccaagtgacaactacccatagtggcagacaagcagcagccacccaaacattttgcccaaatatttttcctcagtctctgtggctgctgggtagattttctggcacctcagtctggacaacgctgttcatgcttt

SEQ ID NO: 130545 - DNA, 250 bp, Homo sapiens
caaaacttaatattgacaaaaaacagcaaaggggggatgctcggggcacatatatcatcatccgtgagtacacagggttccagattctaaaaattagacaatgaacagaacaagttgatttccaggtggttaaataccagggttttcagattgaaccctgaggcagtggtaagaagaacagatcctccttaaatatagcaaaaggagctgctgcaggtcccagagtacaccaagaaaacaacagcttcta

SEQ ID NO: 130546 - DNA, 313 bp, Homo sapiens
agagctgtctcagattttctgagttcacagaagcaactgtcctgaaagaccagaccccactgaccgtagaacttctgcttccctccggagtcagcgtctcacccagaaccctccgtggggatggagggagaccaggtgatgcctgtcacttacgtatgaatgctctggggacaacatgcacccagatccccgggaggacgccttaccagtgtgtcacgcctgaagtcagcacacctttccgggaagctctcgggaaggtttggggcagcaagaaaagatcaactgcataaagggggagactgtatcccatttt

SEQ ID NO: 130547 - DNA, 505 bp, Homo sapiens
gatgatgagatgaaatgagatgaaaagatgaaatgatgagatgaaatgaaatgatgggatgaaatgaggtgaaatgaaattagatgaaatgtaatgagatgaaatgaaatgacataatgaaatgaaataatgaaatgagatgaaataaaataatgaaatgatgaaataatgaaatgaaaatgaaatggaaatgatgagataagaaatgatgagatgaaatgatgaaatgagatgagataacaatgagatgaaatgatgagatgagatgaaatatgagatgaaatgacataatgaatgaaacgatgaaacggaataatgaaatggaaatgatgagctgagatgcaatgagttgaaatgagatgaaatgatgaaatgatgagatgaaatgatgagatgagatgtgatgaaatgacatgaaatgatgacataaaatgagatgaaatgagatgtaatgatggaatgagatgagatgaacatgagatgaaatgatagatgagataaaatg

SEQ ID NO: 130548 - DNA, 407 bp, Homo sapiens
tagacttgaaagattttctgcttctgatctcaatattattttgttgaaagtattcatggtatagttttgactttttaagtgcaacgatcaaaggaatgactttaataaattctacaaaatagtattaaacaatttaatatatttaatcaaatctaagtgaccttgttcaaggtgtcttccctttcattgatctatttaatttttagttctttgccttgaagtcatatttcagacatgtgcacagatacttctctttttcctctgtggcaatgacaacattaggacatgaaagaagacattagacatgaaagaagacaggaaacagtttaaagccaattttattttcaagtccccatttgatagtcattctcgctgactgttctgaaccatgagaaaatgcccaagtg

SEQ ID NO: 130549 - DNA, 325 bp, Homo sapiens
gcaagcaggtgcaaggctgcagctagaggggctgtctgagcaaagaagacctaggctggtggcataggaagacaagagtgccgacaccaggcccagtgaatagaaaacgagttccctttccagactggggttgtgagctctgctctgttttatgagcagaaggcacctgcaatgtcagaagtggaaaccatgggaagtcccccaacacccactcaatcagagctctgagctcatctcctgtaaccttcccagccccatctcctgtaaccttcccagcctggccaacatggtgaaaccccgtctgtactaaaaacttggacctcat

SEQ ID NO: 130550 - DNA, 294 bp, Homo sapiens
acaacccaccagtgcctggccaggtgagcatgtgagctctcctttggaagggtcacggactagaggagaggaagttctgctgaggtgggaaggcctgggccagacagcagagagccctgggctcctccgggcagaggagactccctgagcgggtgaaactaaccatcgtgttttaacaagctattccaaccctaaaccagttctcccaattagtttcttgacacttattgccagaactgtattcactgacctccttcgcttcctccctcctccttccctcaataatgaatactt

SEQ ID NO: 130551 - DNA, 142 bp, Homo sapiens
acaaacaacgtgagaatgagaaaagcagcccctgacgtctgaaagctagcctggtactattagcaaggcattgatgttggtgggaggctgacttgcactcataaccaggccttgttgcaaaacataaacaatttcaaagaac

SEQ ID NO: 130552 - DNA, 265 bp, Homo sapiens
ggtttgtgccccggcccaggcctgacgccgaccgtgcccatggctgccgagcagaggcgggcggcttctcccttgtcccctgcacagcgtccggccctgtttggcctctgctggggttgggatggggctgcagccgtcctagggacgctcaggctgaggctcgggacctccatgagcagagtggggacaccccaaattccagtgtgtccagactcagagaccccacagtgggtgtgggccgaggctccccatgccagggttggca

SEQ ID NO: 130553 - DNA, 440 bp, Homo sapiens
ggtaataggcatcctaatgggtgtgagaatatctcatagtgcttttaatatacagttccctgatgactaatgatactgaacatcttttcatatacctgttggtgatttttacgttttcttttgagaaatgtctattcagatcttctgcccattttaaaatcaggttatttgtttttctgctattgagttttatgagttctttataaattctggatattaattccttagcagatgcatagtttacaaatatgttttctgtgtctacaggctgctgactcattttgttgttttcagaagctttttagtttgatgtagtcccatttatatatttgtgcttttgtggcctgacctcttgatatgcaaaaaatcattgccaaggtcggtgtcccagagcttttctccctacgttctcttgcaggacttttatagtttctgatctt

SEQ ID NO: 130554 - DNA, 967 bp, Homo sapiens
ataaatggaatgatccatacttgagtgtgaggataaatattcagccaggatcataaaggacattccatttgaccctgtcagaagatgaattcctgagttcagtgaatctcctgggacattttatattcctagcttaaatgctagccaaaaattataaaagcttcttgcaaaaatattattgtaaatctagtgacctaatttatgacttgtttttgtttgtctctcttatacagactttcttcattataggcttgtttttaaagtgaaattgggaagttgctcttaagaatgttttcaacctttctttctctctttctctttctttctttcttttcttttcttttcttttctttccttttccttctttctttcctttttttaaatttgagacagagttgtgctctgtcacccaggctggagtgcgatggtgcggtattggcttactgcaacctccacctcccaggtttgagtgattctcctgcctcagcctcctgagtagctgggattacaggtgtgcaccaccatgcccagctaatttttatagtttttttagtagagacagggtttcaccatgttggccaggctggtctcgaactcctgacctccagttatccgcctgtgcctcggcctcccaaagtgctgggattacagatgtgagccaccatgcctggcctcaacatttttttcttacagtgttttattcagaagactgtctcacacatggtccaatgtatttttgttacctcaaaaattacagtatttgtggaaaacaaaagcattctttcgtgcatcattgtgccctttaggaaggctcagatagatagacatcttagagtttatttaatacaaattgtggtattaggacacagagtagcagttccttctttttttcaaaattattcaaaaatatagaatgaattgattttccctccagatatgtaattttgtaattattgtgtttctgatg

SEQ ID NO: 130555 - DNA, 498 bp, Homo sapiens
ggctggtgccacattcacagggacaacaggacaacacaggcagtatgtggagggcaggggaactgggtttctcactggtgaaaggagaatagtaaacgcgaaaggcagaaaactaggatgaaccttgtggcatgagcctggattaaaggtagccaggtgaactcctgtcaatgtatataaagaaatataaacagaaatgtggaatgtacatacaaccttagcttggtccaataggagggcatgaaaacagtgataccccaaaagcaataggcactcctagtgtccaaatatagggttctgcacaccattcttcactaaaagaaaccaggactcctaggagaaatgacttattccaggactgaggcagtcaaagtgcaagatgagccgagaatatcttgttacaggagaaagtgaggagctgctcacagaatgactaaggtcatgttaaaaggacagagatggcttgaagcagctctcagtagacaaactgagacaata

SEQ ID NO: 130556 - DNA, 720 bp, Homo sapiens
  misc_feature (469)..(469): n is a, c, g, or t
ttatgagatcttggtttcaagtctttggaccagttttctgagccacacttctttatattgctgtggcttaaaataaatatcacctgtttcctaatacctcatttaaactgaaaaattgatatacatctagttgttccaagaaaatttagatattcaaaaatatggtatttaagatacctataattatgtaaatcatattgcccttgatatcttttcatatccgtcttagctaaaaatagtacttaataatttatggtatattttcaaagagctagacgagaggattttgaatatactcaacacaatgtaatgataaatgtttgaagtaatgaatacactaattactctgatttgatcattacacatgtatcagaatatcacactgtacttcataaatatatacaattattatttgtcaattaaaaggaaaaagttctcaccaaaaagtgataagtacatgagataatgntgtatgttaaatagcttgttttagacattccacaatgtatacttatatcaaaacatcatgttatataccataaatatatcatttataccataaatatgtccaatttctattcatcaaataaataatttttaaaaaagaaagagaaaaacagcttttcttcccttttttaccatatgaaactctctacctaaataatctcatctgctctcaaatgttcatatttatcaagaatacttggggcatttttaaaa

SEQ ID NO: 130557 - DNA, 529 bp, Homo sapiens
tcagcaccatggaggatggaaaaactagcgttggtagaagagctggaggctgacgagtggcggtctaagtcacatcagacagctgcgtgtggatggaaggagacaacacacggagcacatcacattatgtctgtgccgcttcgtacaggagatgcttcaaccctatgagccatttgactatgtgcatgcgatagggtgggaagtatcagtatgatgagcattttatgctagagagcagcactggggcagagcaggccctctgtaaatcagtgagtggatgctgtcaccgagtgcacacttattttgttacttggctgcagctgccataacaaagtaccacgaactgggtagcttcaacaacagacatcatcttcccacagctctggaggctgcaagtctgagatcaaagtgtagacaaggttgattccttccaaggtccctgtgggaaggatctgtccccagcctctccccttggcttgtagatggcaccctctccttgcacctcttcactccatcttccctctgtgca

SEQ ID NO: 130558 - DNA, 400 bp, Homo sapiens
ctcctctttctaacagaaaatagctgctgccccactcctgtgccaaaatctgctccaagggatcctatcctagtcagaaggctgtactctgaatgctgatattagctacaacaccaaggcttcccactatacaaactggatcctcaaagtcatccacaccaaatgaactctctattctttctcccagtagcctgagaactgggtttaccagccttggcccttcctttccttctagcctcaaaacaggatgggaacagagtctttggctgtgagaatgggctcaataacaaaataaagatgacagaagagtcagtgacttcaatgacagagcgatagaaattaccaatataaacggagagaaaagagattttttaaaaatgaacaaatccccaaggacctg

SEQ ID NO: 130559 - DNA, 287 bp, Homo sapiens
ccaccttggcctccctcatatggcagattgagttgttgcagtggggactatagagttgacaaagccttaaaatatatgctctctggctctgtatctaatcaagccagattagattatgtgggggaatatcaaaggaggtccagtaaagaaacttgagttcatctgtcaggagagagttgaacatgacgatgaacagcatatgatggaccagtgcagtttaacaaacatcagtttagtgcttactgtatgccgggtcctgggcacacagtgacagaagcctcagttct

SEQ ID NO: 130560 - DNA, 427 bp, Homo sapiens
gcacagcatgactagtttgtctgctcaggatttaaactaaagactgaaaacacagtgttggctagactgcattcgcattaggagctcatgtttctaaactcacatgattgtggcacagctcacttgtgattggggctgagaactaaagactgaatttccttacttgatgtcagctaggagccactcccagctcctagagactacccacattccttgccacacagccccctcctccatcagaaacagcaatggaaaactccattatgttttatccctgtcacacttcaaatttcctttgccaggaaatttgtccctttggagggctcatctaatgaggttagccttattgaggaaaaatctctggaccttgaagtcagttgattaaggatcctgcaaaagcccttcgcagtagcacctagattagcat

SEQ ID NO: 130561 - DNA, 506 bp, Homo sapiens
ccataattccatgcttaggtacatacctaacagagagaaaatgttatgttcacacaaaaattagtacaagcatgtatgtacaagttatagcactattcattactcataatagaccaaaactggaaacaacccaaatgtccatcaactaataaacattattcagcagtaaggaatgaaatacatgctatattcatgaacgaaatgtaacactatgctaagagaaagccagtcaccaagattgactccatttatatgcaatatccagaaaaacagacagtaatccacaaaacagataataaactgtggttgtcaggaactggtgggaggaaaacagggcaacaactgctaatgggtatgggtttttctgagggtgatgaaaatgttctggaattaagataataatgaggatcacacagaccttgaatatactaataatctggcattcaataattgtattgaaggccaggtgcagtggctcacgcctgtaatcccagcactttgggagg

SEQ ID NO: 130562 - DNA, 330 bp, Homo sapiens
ctgtgggccttcacgcttggcactggtgcgtcgctttgacgtggtttgtgactgggcaatccctggtcgtccttgctttattttgtgatatagctatatttctccctcctgactgttaacaggaaaacttccttctagattggctaatgggtatgcctcttaggaagcctctttcatatcacttctcctccacaaccttaaataacttttgacacaggacacctcatatctgctgtatgggattccatagggactacctgtcttgtttaattaaagacctgccatgcttttctactcttcctttgcttttcctcaaatactgggagagag

SEQ ID NO: 130563 - DNA, 663 bp, Homo sapiens
gaaatcagaaaatctcaaccagaactttcaaataggctaactgctaaccctgatcttacggcctctgagcttcatttaatgggaaacagtacagtgttgagaggtctgatttctgcttcctcacagctggatactgacagtgtgcacaggcatgatgttggcagtggcagagggatgagaatcttcgtagaccatacaaacccagccccacattgttatgtaaggaattgtccctgacctgtgccttgcaataggaaggggaggcttcacaccatgatggctacgacatgagatgtgctgtctcagcaggcctggtatgaaatcctagttccctcaccatgtgtgagattttagaggagtgactgatcctcagttttctcattcatataatggaacaacctatgagaatattcaggaaatttgtaaaagacactatgtctaatgtatgtccagcccatagtagaggtttaataaatgccctgtttctttgatgcccacagttctcttttgaagtccagacatgtaagagtgtggtcaacaatatttccttgtcaaatcctcacctgcagagattaccagggtgactgagaccttgattttttttttcatttatgtattattaatagttccacttgaggcttgccacagtggctcactcctgta

SEQ ID NO: 130564 - DNA, 357 bp, Homo sapiens
tatgtatacacctgaatgacccaagaactagataacataaattttgtaaaaaacaagagtaccacataaaatagtgaatataaaatgtactattttgtagcattagttttctattgctgcatagcaagttaccacaaatttagcagcttaaacaatttatattatctcatagtttcagtgggttcggcatctgagcatggcttagctgtgtcctatgctgtaatcaacttatgctcaccaggctattatcaaagtgttggctgggctccattccattatatgtcttgagaatcctcttccaagctcaagtggatgtgataaacttcagttccttgcagtttagggctgaggcactta

SEQ ID NO: 130565 - DNA, 482 bp, Homo sapiens
gggctgcagtgagaatgtggcatcactccataggactccggccagagagacatcagacaatcccaaatggaggagcattctgcaaaatgactgccagtaattttcaaagctcctggctgaggaagtgtttcaggctgaaggagactgaagacacagaactaaatgcaatatgtgattctggactggaccctccattctcaaggatgcagttgggacaaccagagaaatctgatggggtctgaggagcacacggcagtgatgtgttgtcacatgctgcatcatgacagttcagtcaacaacaggccacatatgtgatatgcttccataagattataatggggcagaaaaattcctaacacctagtgatgtcacaaagggttgtaaagtcatagtgcaactcattattcccaagtttgtggtgatgctggtgtaaacaaatttactgccagtcatatcgaagtagagcatataaggtcatgtta

SEQ ID NO: 130566 - DNA, 748 bp, Homo sapiens
tgactgaatatctcttaactggtttcttcacttttaaaatgggggaaatcatatctactccatagagttcattgattctacaaatcctgcagtgccaggccctgagctgggtggtgggacgagacagtctttgatgtcaaggatctctgggtggatatgaaaattaaagagataaaatgttcaaagtccaaggaccatgagggatgcccaataaacattaattttatttccttcaaggaggtaacatgattctgcttttcttttctttttttcttttttttggtctaagaagtaattctcaaatttcacagcatggaacaaagagctatgcttctccccttatctagatggaaaatttgaggtacaggtactgttttgagttcaattgtgtccttcaaaagttcatatgtaccttagagtacccgctgtgtgccccagcacctcagaatgagaccttatttggaaatggggtctttgcggatgtagtcaagttacaatgagatcattaggttaggccctcatccagtatgaccagggtccttataaaaagggggaagtttggacagagacgaatgcacagggaaaatgctgtgtgagagttggagttatgctgccacaagccaaggaaatcaaggatggctggctgtcccccgaagccagggcagaagcaggggccagattctcccttgtggcttccgaaggaaccagccctgccaacaccttgattttgggcttctggcatccagaa

SEQ ID NO: 130567 - DNA, 343 bp, Homo sapiens
aagctggcagcatttccaggtcaaaaaaccctccccaaccctcacacagccctggtttgctcgtgagcttgtctatgatatgtgactcccaacagctgcacaacactgcgtcctccctgagagctgcagcagcagtcaccgtccacacggtcagcagggaggataggtaaacacatacaagatcaaccgcaaagtagcattcgtgtttctagctgggacccacagctgtctctgctgctcttctagtcttcggaagtgcctgtctcacatgcactgccaacatctacacaccctgtcacaagagacccccagaccacagccttccagacgtctccatctacac

SEQ ID NO: 130568 - DNA, 283 bp, Homo sapiens
ctgctccgcccctctctgaactgttcttcgttcccatcttaactgatttaaatctcttcatggatcatgagtgggagccttttgatgcaggggaggtgacagctctgggcactgggccatgggaattctctggttataagcctgggacatagggtgggccctccagggtctgctccctacagcttctcatccttctcagtgtgtgggtggctgccttggtgctcccctgcccacccccgcagctgtttctgacattcaggacatggcgggggcgggggtcacg

SEQ ID NO: 130569 - DNA, 431 bp, Homo sapiens
tcttgttgaaggccatgaaaatatttatcagttttgttaaaaatctttcaaaattatgttggcttcttttgctatctttataaacgtgttatatgctatgtataatttaatacttaaatttttgttactaaatatcttgccttcacttatgtttattattgtgaacaccagtttcaataaactgatgcttaataagctcactaaagtttagtgctaagttagcctcagccattcattttacagatgaggaaatagtgacccagagaaattgagagactttgctcagagtcaccgtgtttgttgttagaggcacagtgtgtgtgtgattacagaactttcatctgaatgctataatatgtgcctaaaagaaagcgctatcgcatgagttctggtagcaccttattttctttcttaatttcacagcagaatgc

SEQ ID NO: 130570 - DNA, 913 bp, Homo sapiens
tgcaaggtatgcaaaaggctaaaccaaagctttacaattatttgaaaaaaagtttatgcctattaaatcatttgattctgagcatctgttgatgtgctaatgctttccaacactgctgcaccatcttgtcaagaagtatttagggattgaaaaggaaagtattgcaaaaaaggcaccctgtgtgcaaattgtatttcttccctaaaatgatgtctatattttcaaacacaggttagacgttttatggagtgtgtgattctcaaaaacacagaaaacagttttccattggaagttcgtgatttaaacccacaaaaaaggaaacaaaaaaaaaacacacaataagaaacacaacattgcgtgcgggccgcctccggagccacgcagaggagaagctctcaaaacaccaactaccgtgagtggagccagggggcgcaaaaaggtaacacgcagcaacattggcgccaaaccggggcccccccgagcacatccaggggcaaaggcaaacggggagtggagatcacacaaccaaaaaaaaaaccgcggggaggaacaccagcaggttgtggaacaaaaccaaaaagaggaaacgggacggccacaacaggggacactaacaaagaggggacacagaagaagaccgaaataacaaagtggccccgcaggggggagaaagaaagacgagaaacgagcgataagaaacaaaagacagacaagaaaagacagcaagaacaaaaacagaggaatagagagaaagaaacaaaagactagaggaacgaagcaaaaaaaacaacaatacaagcaacagaagaaacaacagaactcgataaagaaaagagagaggataaaaaagagagagaaaaaaacataaagaacagagaagtaagtagcgaaacaaaaacaaaaagccgaacaa

SEQ ID NO: 130571 - DNA, 285 bp, Homo sapiens
agcctctcttgcagctggatatgaccatgtgactaagttctagccaaaaagctataagcaaaagtgtcatgtgcagcatttaggaagcctcccttaaggaagagaatgcatgctttgcccttttcatcctttgctggctaaatgagaataagatgtctgaaacccaggcagccatatgggactatgaggtagggtgccaagagtgctggtgtggcaagacagagggagcatgggtccccaacacaaggagccaccttcccagtcctgggctaccctccttttagg

SEQ ID NO: 130572 - DNA, 239 bp, Homo sapiens
tcagatcttgtcccctaaaaaatggagtcccggggggttcctgaagaaggacgtgccggtgctacatttactgtgattatgtgtggcctcctctctccagcacacttgactgaaatagaaggcatcttcctctggtggcttcccgcacatggtcagtgctcaggaagtggaaagtgtttgtcgtgaagggagcacactggcctgggcatgcaaggggcaggtggagtctggtttgggtg

SEQ ID NO: 130573 - DNA, 279 bp, Homo sapiens
tgcctgcaatggggacatcacagtgggtgtcaggcctgccctccgggaccttgaggtgaaagcagccaggggcacctccacaccagctcagagggagaagcactctgccttgtctcagccatggctactgaggggcctcaggttcaacagctgtggaccgactgctgcaagaacacccccctgccttggagtcagcccgcttgccactcccgctgccaccccaggggcccctccactggtgacctcgtggaggggcaggtgacaagaggcagggacaga

SEQ ID NO: 130574 - DNA, 908 bp, Homo sapiens
gcctcccaaagtgctgagattgcgggcgtgagccaccactcccagccaaaaattttttaattttaaaagtcaatgtatatcatttgtattttatagttagtgctttttttgtattgtttaaatttttaaaattcttccattaatctaaaatattttcatgtgtgctttctactaagagaatttaagttttgtttttgacattatagtttttaatacatttggatttggatcttatatcttgtatgatacagaactctaattttcgcctttaactacatgcataatcattttttccacctccacttattgaatagttcctaattttcccatcaatatcatgtgtttcttctggcatagccaaagtcccataaatgtgtgggtctgttgtagtttcctatttaattcagttaatttgtccaatttgttttattatgccttaattaccacagcttcacagtaagtctttatgtctgatagggcagcttcctctagtgtcttcagaaatttcctgactttaaaaaaaatccttattgttcatgcttttttaaagaattagctttacatgatgcaagaaaaagatctgttggaattttgattgtaattttgttaaatctataggtcaactaattacaatattgaatcttcttatgcacaaacatggtatatttctccatttattcaggtctttatttaatgtctcctaatgtctttttgtagtttttacttagagatcttacatatttgttattatatttactcctaggtacttggtattctctaagattattgaaaatgctgtcttctttttaattacattttcaggtatttgtcattggtataaagaaatgtatttgacaataatcttatattcaccttaaattctcttatttctaataaattgtactttt

SEQ ID NO: 130575 - DNA, 263 bp, Homo sapiens
ttcttctatggtgtctcacagttctcacatacaagttgacaatttatacttgttaaaacttttgtttgtatcctcttttatttcattgagcagtggtttgtagttctccttgaagaggtccttcacgtcccttgtaagttggattcctaggtattttattttctttgaagcaattgtgaatgggagttcactcatgatttggctctctgtttgttattggtgtataagaatgcttgtgatttttgtacattgattttgtatcc

SEQ ID NO: 130576 - DNA, 790 bp, Homo sapiens
ctggaggacagatacagactggtctttagagaatctcttcagccctctttagctttcagagtgccttttgctctttcttgcgttgaagaaactgacagtgtgagagaggctgacgctgcttttgattctcttccttgtagttcttatctcattcgtacaaactgtgaggtaaattcagaagtgactgtccttcctatccagttttatctttggaatattttagcattagtgatgtaattgtagtcagtgatctaagattttatttatgaggcaggtaacttgagtaaaatttttcatagaaaagttcatgaataacagggccgggcacagtggttcacgcctgtaatgccagcactttgggaggccgaggcgggtggatcatgaggtcaggagattgagaccatcctggctaacatgatgaaaccctgtttctactaaaaatacaaaaaattagccaggtgtggtggcacgtgcctgtagtcccagccactcaggaggctgaggcaggagaattgcttgaacctgggaggcagagtttgcagtgagctgagatggcaccactgcactccagcctgggtgacagagcgagacttcgtctcaaaaaaaaaaaaaaattagcaggtgcctgtaatcccagctactcaggaggttgagccatgagaatcgcttgaacccaggaggcagaggttgcagtgagccaagatcatgccactgcactccagcctgggcaacagaatgagactccatcccctccaaaaaaagtttgcgaataacatatgcttgtgtactc

SEQ ID NO: 130577 - DNA, 693 bp, Homo sapiens
cacggtggctcacacatggaatcccagcacttggggaggctgaagtgggtggatgacttgaggtcaggagttcaagaccagcctggccacatggtaaaaccctatctctactaaaaatacaaaaattagctgggtgtggtggcgggtgcccataatcccagctactcgggaggctgaggtgggaaaattgctggaacctgggaggcagaggttgcagtaagacaagatcgcaccactgcactccagcctgggcggcagagtgagaaaaaaaaaagaaagaaagaaaaagaaaaagaaaagaaaagaaaaaactatagatgaatgacttaagtgaataacaagtcaagtgagtaatgacaatatgtagaaaaatattccaagtagaattaataaattttaattatttgaatgagaaaatgccgccatattcaaaatgaaagtaaaagtaggatgagatcagcatatacaactgcatatatttcattaattaaagatgactaaagaggagactatcaatttgaaagaagattactaagattttgtttttttaaaacatactgaaccaaataaaaaaaaaataacagtaagacataactactaacagaaaattttttccaatgagaatacaagcttattaaccactccttttttcattaatgctcactcagcttctaccagccttctaataagaac

SEQ ID NO: 130578 - DNA, 282 bp, Homo sapiens
gctaaagtaagtaatgaatcaatgaaaatcctaataatacatcatttcttacatggataagtaaatttattaaataaaaactaagggtgaattttggagtaataagagacaattaagatattataatgtggtttcaccatctattttttaagctaaaaacttggaaaataagtatcttcagctttgttttgtattttttcccttctgattttacaaactctaggatgcgcttagtattgcttttctgattcatctctcttcttcatcttccaatatatataa

SEQ ID NO: 130579 - DNA, 487 bp, Homo sapiens
gggctcctacgtccctgggaaggtagtacagctagctaggacttacgttacagccagcccggatctattgaaagaaggaaggagccttaatgaagaccccccagctggggcccacctgagcatcagaaccaaggcttctgacctctgagatccagctctggaaggctcttcagcccccttaggaaggagctgatctaggccattgagggtcgggggcaagggttggttaccttcctgggaatacagcggcttttaggggttaagagaacaggcaggtttttcaggtccacagtggtgcgtcaggttccttctgcccaggggagggctccctggagttgaggcccagagggggaggaggaggaggctggcagctggggaaggagtctaggggcttatgggagctccgcaacaggatcttggatgggatgtggggagagcagcctgaggaactctgaactgtcctcaggccctgaacgcctgcctctgg

SEQ ID NO: 130580 - DNA, 734 bp, Homo sapiens
gtagaagttgcagtgagccgagatcgcaccactgcactccagcctggcaacagagtgagactccgtctcaaagaaaaaaaagaagtatactattttcatagaagtatacttattggcatagaaatatgtttacctgtcaggtatggtagcccatacctgtaatcctagcactttgagaggcctaggccagaagatcgcttgagcccaggagtttgagaccagcctggacaacacaggaaaaccctgtctctacaaaataactttttaaaaaaattatccaggcatggtggttcacacctgtggtcaggaggctgaggtgggaggatagtttgagtgcaggaggtcgaggctgcagtgagccatgattgagccactgcattctagcttgggcaacagagcgagaccctgtctcaaaaaatacatatatgtttatgaatattggaacatttaaaaagcagtaaatatactatgaagtacaattgaattttaatttcagaatattatatgcacacacatatactgtcagcaacaaagaaaaaaactggatagaaaattataacactgttattaattaaaattgttatacaaaatttgagaacaacttgggggttataagaacatgaaaagctgtggtttgcaaccttcatagggtcccaaagcaagatggaaacatcccaatgggaggttaacacttgacaatcttataacaaggtctatatatcaaacttattatc

SEQ ID NO: 130581 - DNA, 278 bp, Homo sapiens
atctgcccaccttggcctcccaaagttctgggattagaggcgtgagtcaccgtgcccatccagcatgtataattttaacgtaatggctaatcactcatgaggggaagaaatggctaatcactcatgaggggaagagatttttgaacatttttaaataatagagacagggtcttgctatgttgcccaggctggtcttgaacgcttggtttcaagccatcctcccaccttcgcctcccaaagtgctgggattataggcgtgaaccattgcacctggcccc

SEQ ID NO: 130582 - DNA, 312 bp, Homo sapiens
gagttggttctgcacagcaagggccacactgtcacgtttcttgaacaccatttcgtaagggccttccccaaacattgtggcatatatcacacagcccagggaccagacatcagtctgttcatcaatgacacagtgactgctcagggaagagctctagggctcagtaggagatggtgcactgctgggtcgcctagtccggcagggtcagggcctggtgggagcccttcatgtgaggcatgcttgattcatggcatccaagtgtattaaaactggctgcccctcgtctccaagcaagatagtggtgggcttcag

SEQ ID NO: 130583 - DNA, 506 bp, Homo sapiens
aacctcttatcacttccctcttcatgtgcagaatttaccttggctgagacacagtcaagaaagaagacaggtggccaggcacagtggctcacacctgtaatctcagtactttgggaggctgaggtgggcgggtcacctgaggttaggagtttgagaccagcctgaccaacatagagaaaccccgtctctactaaaaatgcaaaaatagccgggtgtggtggcacatgcctgtaatcccagctacttgggaggctgaggcaggagaatctcttgaacccaggaggtggaggttgtgttgaggctaggttgcgctgttgcactctagcctgggcaacaagagtgaaactccatctcaacaacaacaacaaaaaagaagacgacaggctgtgtgcagtggctcatacctgtacaccagcactttggaaggccaagtgggaaggattgcttgagcccaggagttcgaaaccagcctgggcaaaatagcgagatctcgtctctacaaaaaa

SEQ ID NO: 130584 - DNA, 417 bp, Homo sapiens
gggggttggatgcctcctgtcccctagtctggtgtcaggataccccactcagactttgagtgctctatatacccccatgtaccacgtattctaagtggctgggtcctgcattccatcatcccctccttttacagtcttgctcttcaatttcaaatggggcaattcctctatctatctgaattcatgggaatgttatccatagcacaccaatgaggtagaaccagctcacagcctagaaaaccttcagcattcgacgattgcatgaatcaagatttatttcccttttcaataagccttgtgcaaggcattctgccaggtgctaagaacacactaccactagtgtgcaattagggggagactgattctaccctcttccatacacaggcatgcacacacacacacacattgtcacagtaa

SEQ ID NO: 130585 - DNA, 655 bp, Homo sapiens
cacagtggctcacgcctataatcccagcactttggaaggctgaggtgggcggatcacaaggtaaggagtttgagaccagcctggctattatggtgaaaccctgtctctactaaaaatacaaaaattagctgggcatggtggctcatgcctgtaatcccagcattttgggaggccaaggctggtggatcacttgagttcaggagttcaagaccagcctgaccattatggtgaaacccctctactaaaaatacaaaaattagccgggcatggtggcgtgcacctgtagtcccagctacttgggaggctgaaacaggagaactgcttgaacccgggagatggaggttgcagtgagttgagatcgtgccactgtactccagcctgggcaacagagtgcaactctgaaaaaaagagaaagaaaaggaaagagagagagagagagagagagaagaaggaggaaggaaagaaagacaccgtgatttacagtcttgccaaaggactgaacctaagtcttctcaaattcaatgtgcctgaacctgcactgtgtgctaatatcgagaggacagggcaatgtgctgaaccgtgccatgagtgtgcaatcagcaaaatacaaagtatgggaaactctataggtcctaggatcaggttcttcaccagg

SEQ ID NO: 130586 - DNA, 518 bp, Homo sapiens
tactggtgaaactagaccagcctccagcctcattgtcagaagattttcttaaaacagaaacttgtacctgatcaaatcccctcccctccactttaaaaatccttcagtgacttctcattgtcttcaggatgaaatccaaaccccgaagcatgacatacaagactctccttgtgatctgatcccacctggccagcctcatctcctaagaccacagccatctcctaagaccgcagcactaacgagctgttgaaattctgcaggcgggctgtgcaccccctcaccttgcaatggtttcctctgagtatgcttgttctgcctttcctcgcctgggcaatgttagccacgggtccttcaagacacagctcagctgagctgagaagcctcaggaggcctttcttgagcctccacccatctgagtggggctccttgctctgtggccctcagcatccgttccatttgtggctcccatgtcaaactcacactgttggaacggatgctgtcgggctagtcgggggggt

SEQ ID NO: 130587 - DNA, 298 bp, Homo sapiens
ctctgtgtgttgctcagattggtcttgaacttttggcctcaagtgattctcctgtgttggcctcccaaagtgcgaggattacaggtgcgaaccattttacctggctcaaatggctcatttttatatattaagagtgcttcagaactcaagtaaaaaagtcacagaaaagagcaatgaggttaaataaaactttttttcagtttctttactaaaactgtaacttacttggaatccagttttgacatcagaaattcaaattcaggtgttttaaaaccatttctgcaagaaagaaatttaa

SEQ ID NO: 130588 - DNA, 544 bp, Homo sapiens
taatgtggccaattaccatgcacaacctctcccaaaagaaatatgccaggcctggctggtctctcaagtaaatccctttgaactcccccaaatgctggttaaagctaatttttcacctgcttcttgcctatataaatgcaggagaaaaacacaaccatgcatgagtagcatgcatgaagttgtatgaaaataaattattcagtttcccctagatgtcttctgaatggaaggcttcaagaaattggagctcatgatttgcaaatgaggggaagcataaaaattaaagaaaccaggcaaggcatggtggctcacaccagtaattccaacactttggggggtcgaggtgagcgaatcccttgagctcaggagttcgagatcagcctgggcaacatggtgaaaccacatctctaaaaaaaaaaaaaaaagatagaaataaaccgaaatacagctatcagaagctaccttcagcattcaggagagctgaggtcgtactgcaaatagagatttcaatttaggctcagtcaccttgctctgtagtctgtca

SEQ ID NO: 130589 - DNA, 190 bp, Homo sapiens
agctgtctacctctggacttcctgttatgtgagagaaaccaacctctgtttatgtaaaacagtataaattatggttttagttgtttgcaatgttttaacattattttagaaaggttaatctgcaatagcacaccagctgaaccggaaggtgatgagaattgaggtggtggttttagcaatatgggtctta

SEQ ID NO: 130590 - DNA, 350 bp, Homo sapiens
ctgcaacatccacttcctaggttcaagcgattctcttgcctcagccttccgagtagctggaactacaggcacacactaccacgcctggctaatttttgaatttttagtagagacggggttttaccatgttggccaggctggtcttgaactcttgacctcaagtgatctgcatgcctcacctcccaaagtgttgggaatacaggcatgagccaccacacccggcctgagtttgtatcttgactcacctgctttgaccttcaaataatctttcctgtgcctcagttacttcataggtttgttgtgaggattaactggtgctaatccatgtaaaacactgaaaaggtgcatag

SEQ ID NO: 130591 - DNA, 595 bp, Homo sapiens
cagtgcccgctgcgggtgctggggaatggcgccttacaggctgcccacctgcctcctcagggtggaaggcggggcttgggtgtgagcgtgctgaatcagaactttcctggaaagtcgccacttggtgtggtcagaggatcactgaagtcctgagtatgtgtctcctctcgccacttccactgcctctactcagttcagcacctcccgagggatgtctaactggcctccatgcttccgctctgcaccccacattccttatcagcacagcaacctgagtgagcctttcaatcaggagctggccgggcacggtggctcacgcctgtaattccaacactttgggaggccaaggcaggcggatcaccaggtcaggaggttgagaccagactgtccaacatggtgaaactccgtctctactaaaaatacaaaaattagctgggcgtggtggcgggtgcctgtaatcccagctacctgggaggctgaggcaggagaatcgcttgaacccgggaggcagaggttgcagtgagcagagatcgtgctactgcactccagcctggcaacagagtgagactccgtcacaaaaaaaaaaaaaaaaaaa

SEQ ID NO: 130592 - DNA, 254 bp, Homo sapiens
cagagatcgatctatattacttgtaatttattggaggaaaggccttcgtcctgaggtcctggactgggcttacccttccattctctcagatattttctttttcttaagtagttgataatttttcatcttcttctggtaccaatatgtggttctgtgttctctgattcatttggaagagatttaagtatatagcatggtgattaagttaacatttctttttctaaaagtatgtactgaaacataatagtgattct

SEQ ID NO: 130593 - DNA, 325 bp, Homo sapiens
taaatgccatattattgtcttcctgaataacagctacttgtaccataaacacatcaaggagattttaccatatgcattataataaagtacatttgaaaagtatagtcatgaaagtatatacttgacctatattttgaaaattcatggacaagtcctactttctagaaagaaaaagctcataaatgtagtactgtactaagccatagagtttactgggaaacctaggatgattacagaatcattctggcccttaacctggaagccacgcagagaaacttccagtaaaataccatgctgacactgcaggtgcctttaaagacacatt

SEQ ID NO: 130594 - DNA, 428 bp, Homo sapiens
gtagaatacggtgggtggccaagaaagacaattatgctgaaaagtacaaagtgactcaaatgcacgtcttgttccaagattctttgttatttagattcctgcattttcttcctgcatcttactcaacacccccatcactcctgcaaagtattacctgacttttagagtctatagtaagagccccacatgttttccatgaataaggctagttttatagtgagctctgatcatctgacaaaataatatttaattgtaagaaatgttttcaataatcatgaaaattcttgtaagtctaacatgggccaacttctattcgggaacgtaatcatgtgtgaagtccctgtggagtaaattggaataatgtgagtaactaggaaatgcaatcattctatccctagttaggagatggatgagacaggaaagctaag

SEQ ID NO: 130595 - DNA, 382 bp, Homo sapiens
cagacggataacttattctttccaaaagaagaacagactcactcagcagcagcttttctgctctctctggaaaggaggtattgagtcgtcttagattaactcatggtcttcctgacaggattgggtatggattttaacagattacagtcatcttggatgccttccagaaactgattctaaactgcttttatttttcataggaaacacccaacaacactgcatagaaattagatactcctaaagtggatttgaaccagtaaaattagctgtaaatatcgaagcataactaaggtttagtgtcttctctttgtaggtaatttgtgcagccctaacatttctcccctctggagcttagctgtacaattctaatcactactgtggt

SEQ ID NO: 130596 - DNA, 730 bp, Homo sapiens
tgacagagatagccaggagcccctgttgggtccccattgtgtcagtatccagaagccagaatgacacttctaaaatagttataatcatgagaatgttttaatcaagggcctttaaagccctcatgtaagccctttaatatcacattcaaaggtcttaacaagctggcctcacttccttttctacttcccataacacaccctacactccaactaccctgggtgatgttttccccaaaaaatgctgtgcactttaaccctctgtttaccatacgtttacctctgtatggaattctctctcccctttctcacattgagaaatgctactcattcttcaaagctcggaacaaaagttgtcttcaagaagttttctctagttcatgccattggtgtaaatcattccttcttcaatactccctggagcacttatctgtcagatttgccttatagtttgttgccagcagagcaaaaactgtgttttatccatatttctatctctagttcagtttttcacgcacagtagatgcccaataaatgtttattcatcaggttaaataatgaagaccacgatttgtaggaaagataagtttttagtaagaatgaagtaatccttttcttggctaatctcagttccagtaagattgagtgtgaatttccagaagtggtgttatcttcagcaattctcagcaccatgcaaataggaatgaaaacatatactgtaggccgggtgggg

SEQ ID NO: 130597 - DNA, 217 bp, Homo sapiens
gaccactacaggggaagagccagggtggaaaaaactacctatcacaggccggcacggtggttcacgcctgtaatcccagcaccaaaggaggccgaggtgggtggatcacctgaggtcaggagttcaagaccagcctgtggccaacatggtgaaaccgtctctactaataaaacaaaaattagccaggtgtggtggtgggcgcctgtaatcccagcta

SEQ ID NO: 130598 - DNA, 128 bp, Homo sapiens
tggtcgatctctagcaggatccccctggagatagtgaccagagacggatggagctggacacacagaagggaccacattgcacaggctgctgtaagattttggaggttctcttatccaggatgaggcat

SEQ ID NO: 130599 - DNA, 767 bp, Homo sapiens
atgtttttagagagtaatttcaaggtagttattgtaattgttgctaataaacacactacattgggcacaagctggactaggaaagagtgtcataaaaagaaatctgtaacgataagggattgtaaattgctaacgaatatcctaacaaaataaagcttttattaaaattaagaatctctttctcttatgaaagaactgggaaggattattttagctttacttggcataggctcttcatgataagaggagtgtatatatatgaattttgagggcagcatccagagcttggaaaaggtccagagaagagcaaatgcaattatcaataggttagaaaattggccctttaacaaaaggttaaaggagttggatgcatttagcctggagtagaagcaatttaataactgttaaagagctgttattaaggaggacactgaccaatgttctctctccccatcgaggacacaaataaaaggaattgtttaaactggaagagaagagagggatttagattaaatattaggaaacatttcttaggagtgagcatcattaaagaaaaaaatgccataagctataaccagttcctgaggaaggctaaggactctgtgtctcgggatattagtgtagtgggcacaacacaggctttgaactcagacagaactgcttttgaatctcagttcttgcctcggctaacataaataaaaggatcttaaaaattcctccactttgtagattttttggggaatgtggaacatagtatttggacacgc

SEQ ID NO: 130600 - DNA, 244 bp, Homo sapiens
ccacaatgcctggcacatagtaggcgctcactaaatattcgttgaattaatcacttacagttgaacattccccttccttaaggccaaagagactgtctctttccattgcccatgaccccctaaaactacaatgaaattttatgacttcttaaaacttttcttattgctgtttttatgtatttgtacaaaaccagacaaatacaaatatctagaggggctcatgtatttaactagatatgcaaat

SEQ ID NO: 130601 - DNA, 1004 bp, Homo sapiens
  misc_feature (685)..(685): n is a, c, g, or t
  misc_feature (715)..(715): n is a, c, g, or t
  misc_feature (912)..(912): n is a, c, g, or t
  misc_feature (987)..(987): n is a, c, g, or t
gagcgcctgggccaccacctgcagggtctccgggcggccttcctgggctgcctgacagacgtccgccaggcgctggcagcacctcgcgtggctgggaaggagggccctggcctggccgagttgctggccaatgtggccagctccatcctgagccacattaaggcctctctggcagcagtgcaccttttcaccgccaaagaggtgtccttctccaacaagccctacttccggggtgagttctgcagtcagggtgtccgtgagggcctcatcgtgggcttcgtccactctatgtgccagacggctcagagcttctgcgacagccctggggagaaggggggtgccacaccacctgccctgctcctgctgctctcccgcctctgcctggactacgagacggccaccatctcctacatcctcactctcactgatgaacagtttctggtgcaggatcagttcccagtgacgcccgtgagcacgctgtgtgcagaggccagggaaacggcgcggcggctgctgacccactacgtgaaggtgcagggcctggtcatatcacagatgctgcgcaagagcgtggagactcgcgactggctcagcactctggagccccggaatgtgcgggccgtcatgaagcgggtggtggaggataccaccgccatcgacgtgcaggtggggctcctgtacgaangagggtgttcgcaaggcccagagcagcgantccagcaagaggacttcctccgtgtacagcagctctcggcgagcagggccgtacgccccagttatacccccagtgccccgatggacaccaacctcttgagcaatatccagaagctattctctgaacgtattgatgtgttcagccctgtggagattcaacaaggtgtcggcgctgaccggcatcatcaagatcagccngaagacgctgccatgcaccggtctgtccctgcaccccatggcacccaggatctggtctcggtggtccttccccgnaggcagttgtcaggacc

SEQ ID NO: 130602 - DNA, 1139 bp, Homo sapiens
  misc_feature (683)..(683): n is a, c, g, or t
  misc_feature (723)..(724): n is a, c, g, or t
  misc_feature (750)..(750): n is a, c, g, or t
  misc_feature (758)..(758): n is a, c, g, or t
  misc_feature (909)..(909): n is a, c, g, or t
  misc_feature (938)..(938): n is a, c, g, or t
  misc_feature (950)..(950): n is a, c, g, or t
  misc_feature (956)..(956): n is a, c, g, or t
  misc_feature (1129)..(1129): n is a, c, g, or t
gagcgcctgggccaccacctgcagggtctccgggcggccttcctgggctgcctgacagacgtccgccaggcgctggcagcacctcgcgtggctgggaaggagggccctggcctggccgagttgctggccaatgtggccagctccatcctgagccacattaaggcctctctggcagcagtgcaccttttcaccgccaaagaggtgtccttctccaacaagccctacttccggggtgagttctgcagtcagggtgtccgtgagggcctcatcgtgggcttcgtccactctatgtgccagacggctcagagcttctgcgacagccctggggagaaggggggtgccacaccacctgccctgctcctgctgctctcccgcctctgcctggactacgagacggccaccatctcctacatcctcactctcactgatgaacagtttctggtgcaggatcagttcccagtgacgcccgtgagcacgctgtgtgcagaggccagggaaacggcgcggcggctgctgacccactacgtgaaggtgcagggcctggtcatatcacagatgctgcgcaagagcgtggagactcgcgactggctcagcactctggagccccggaatgtgcgggccgtcaaaaaacgaaagatgaaaataccacccccatccacctacaaataagcccctgcaccaanagggtgtccccaaagcccaaaacaacaaccccaacaagannacctcccccctgcacaacagcccccnccaccagncccctacccccccacccaaacccccagtgccccgatggacaccaacctcttgagcaatatccagaagctattctctgaacgtattgatgtgttcagccctgtggagattcaacaaggtgtcggcgctgaccggcatcatcaagatcagccngaagacccccctggagtgtgtgccccgcncacctttgggcncttcgngctgcagcaggtgcaagtggactgccactttctgcagctctacctgtggcgttttgtggccgacgaagaactcgtgcacttgctgctggacgaagaggtggcctctgctgccctgcgctccccaaaccctgtgcccatggagcccagtgtggttgaggtcatctgcgagcgcngccaggcgca

SEQ ID NO: 130603 - DNA, 835 bp, Homo sapiens
gtagcaaaagaacataggactggtgatagaaggctttttgtggaggtgttgtctagcgttgccaatggaatgggactggtgtcatcgtcccactgtttaataggatggtgcttttcctgatggtgcccacgtagcctttggtgccaaaatcctattgtaggctgacatgagcaagctccaactggctggacaaagtgtaatactaggtttttatcttcacagtagcactctgaggtctctggattattcatatatttattattcatatgcgatgatgatgggggaggagggcttaaagttgggtggtagagtaggggcctgaaccctggtctttatactttctttctactattatttgtaaacaaactatcacgcacttgagaggtagccaatcagttgcaaaatggggttgaagatgagaaagttcagtcttgccagattaacttgcttatttaaggatttatgctaatgaattttttctttgatgccagtataaatattgactcaagatgtcattaacagcaataataaagtactctttaatttgcaaagaactgtcaaacacagtacttcgttattttcttactttatttatttatttagagatgaggcctgggcgacagagtaagaccctgtctcaaaagagaaagaagaagggaaacagggaactcaaaagccatattggccaaaccaatttagtataaggccgcggaaacggcggcctaggggaataaggcaccttcggtacaagacgggaacccaggaagccagccgggatctagagcacgagaggccaacacaggtggcggaaaactgtgaaataagcccagaaagg

SEQ ID NO: 130604 - DNA, 313 bp, Homo sapiens
gtagctgggactacaggctcccgccaccatgcccagctaatttttttgtatttttagtagagatgggatttcaccgtgttagccaggatggtctcgctctcctgacctcgtgatctgcccgccttggcctcccaaaatgattttgttgctttttaaagttctgaagacacccaacacaattttgcaattatgtggtatatattcccaggaatacttacctctgttaaattttttatttcttcataagcacctgaaactagcattgatggaggtcttttcaggttaccttcttcaggaagaactttgttaaaat

SEQ ID NO: 130605 - DNA, 272 bp, Homo sapiens
ctgagagcaggcaaagagacaggtggggatgacagagaggggaaaaatttgaaagctatttggatgaagaatcgactaactggaaatgactgggaaagataaaaagggagggagcgggagtaggccaaaaagctttcagtccccagtgtagtctggaatctgtgaaagaagagagggaagggcgagttgtgtggaaagggcttcagacaacagtatagctctgagacagtttcagtcagcagtagggaacccccaagcaaagattgcctgtt

SEQ ID NO: 130606 - DNA, 211 bp, Homo sapiens
gctttctaaatgaggttatatgctgagggaaggacggggtgggggaagtgggggacaggacactaggtgaagttcaaggagaagtgaaaaggaagaaatgacttcagagagtggagaacatattaaaggaggcagtaacacttccgggtcgagtgtcatttgagatttgtggcaaattttaaagtaaccctggtcagaactgctggctttt

SEQ ID NO: 130607 - DNA, 229 bp, Homo sapiens
tgacatgcatcagctgggagtgaaacttgcagcagtggcctcagtgcttgaatacaagccccaggccagtcactggccacagcaggtcagctggggctggcaggaagggccagagtagatgggtgttattcttccctcagatcactaagggaccaacatatttttctatcttaatttggctttccaagtcagctttccacgcagcagcaaagatttttcactgcagact

SEQ ID NO: 130608 - DNA, 403 bp, Homo sapiens
tagcttatcagctatcattggtgttagtgtattttatgtgtggcccaagacaattcttcttccgatgtggcccagggaagcctaaaagttggacaccctgatgtagacacttaactagcaattaggttccacacaggtggtaccattagtgtgttaagagtttaaaaagggagtgtgggctaggcactgtggctcatgcctgcaatcccaactacttgggaggctgagctgggaggaccgtttgagtccagaagttcaagatcagcctaggcaacgtagtaagactccataactacaagaaacttaaaaattagccaaatctggacctgcggtgtggtgtgtgcctgtagtcccagctactcaggaggccaaagtgggaggattacttgagtccaggagttca

SEQ ID NO: 130609 - DNA, 226 bp, Homo sapiens
gcccatggctggggctgggccagagccaagcacctggggtccgggttcttccctggccccagtgctggccggaggggagatctggggagagggtgggggtttcttgcctcctgtgactttggaagactggccccactcttggtgcagagtgggaaggcccagggggagcctggggaggtcccgccacccctgtgggctgagctggcgatttcttcctcatcgctct

SEQ ID NO: 130610 - DNA, 615 bp, Homo sapiens
ctcccgagacctggggttggcggctgcgtgtgcgcctggcaggtggctacgcaggcttgcagcccagcaccacgctgttcgttcttggcctggatcccttttagttctccctctgccagggaagtggatctgaacctccccctcctcagaaatgctcaagttttaatgtcacaatttattctcagcatgtggaatgagatggttattagctggttgagtccggacaggtgtgggtggccccaggcaggtcccctaacctctctgagtgcatttatctcgagggtgtggccgtcccccgggcttgccgttggcttgaggcaggatacagtgaggagagcattttgaaagaacggaggctgctgtcgcccgaggtgtttggcaaggtcgtgctcccctgggagaggatgctggcaccagccctggagccacagcgcctgcctccatctgcgcacctggatctgctctgcttggcctcgtgcaaagaacgggcctggaatgagcagagccaaaggcgttcttggtgccggccgcgcccagctctggctctcgtgctgtccttcctggttttcatccttggttatttttctctgtttgcagccccgttgccgcctcaca

SEQ ID NO: 130611 - DNA, 428 bp, Homo sapiens
cttccctcccttactctttcccaaccaacagggctttatcaggcatcacctccatgccaaaatggtaatgttaattatggtggtctattcagagtaaagaagaatcagaagacaaaagtcctggtgctccaaggtctgggggagacaaaacacattgtactctgtccatgaaaacagtaaagaacaatatagaaaatctgttttcaagattgtattgacagagaatagtgctttaatcttaggaaaaaaaaaaacaacaaccaagttttctgtgggctagagtaggtggctctgagcctccctgtcagaactgttaacaaagttattagttccttgcagtaccttcttgtccttgctttttgttcagccagagagaccaggggaacaatgatatctgatcaaccatttatcttgtgtatagagggaaa

SEQ ID NO: 130612 - DNA, 366 bp, Homo sapiens
ggatatgctgtagtaaaaaagagcctcaacacctttgtagctacaacaaaggtttagttttttgctcattctacagtctattgaaggtcacctctgagctctgtccataagtcctgagtctaaggttcaggctgatgaaacaatatcatcatgagcactgcagattaccatggcagatgaaagagtgtgaaagcattttgcattaataatgaagtgttccaatacttatcacttctgttcacaactcattggtcagaaatgctcccatctaattacaagggggtctgggaaatggaatctcaccaggagcctggaagacagagagccagaactatttggtggtcaacagtaatgaataacacaatc

SEQ ID NO: 130613 - DNA, 627 bp, Homo sapiens
gtttaactttgtgtacatttttgttaaatggaaaaatttaatgttttattaaaatgggtttctagtgtaattatttttatgtcttggtgtcaaggttatatagaaaaaacattcactgggtgggcacggtggctcacgcctataatcccaaacttgctgggattacaagtgtgagccaccatgcccagcccaagggcttttttgagacaaggtctggctctattgcccactgcacttccagtctgggcgacacagtgagactctgtctcttaaataaataaataaataaataaacataagaatagtacatgaatataggtggaccaactcaagtggtgtggttagaaataatgtttctagctaaagtgaaaatgaaaacttaaaattacattttctaagctctaaaaagtaagacagtagtcttctaagcctttcctgacaaatttctgtagccagagtagaagctggaaaacaaaaaaaaaccaaaaaaaacccagttgtgacgggggagtctttatactaagggttcactcaccagttaatgtctccatgatatatggccgaattggatttttagcctctcaaatttcaaagcaacctatttaaggtttacccaaggtgaacaat

SEQ ID NO: 130614 - DNA, 475 bp, Homo sapiens
tcccagatcaagcgattctcctgcttcatactcccaagtagctgggactacaggtgcgtgctaccacacccagctaattcttttgtagagacagggtttttctgtgtagcccagggtaatctcaaacttctggcctcaagcaacctcccgcttcagcctttcaaagtgttgggattataggcgtgacccacagtgcccagcctaaataaacatttttaatgggtgcataatatcttattggatagatttatttaagtttacttaaccattgtcctattagtggacattttaataatctctgatttctcaatattctaaataacctaacaatgaatatctttgtggataaagaattttgtttctctttctctaggattttttccttaggatagattcctagaagattgattgttagatataaacatttaaaaaccatggaacactttgattctccttccaaaaggaaagaagtaat

SEQ ID NO: 130615 - DNA, 695 bp, Homo sapiens
cagcttactacaacctgcacctcccaggttcaagcgattctccttcctcaacctcctgagtagctgggattacaggtgcccaccaccacacctggctgattttcatacttttagtagagatggggttttgccatgttggccaggcaggctggtctcgaatccctgacctcaggtgatccacccgcctcagcctcccaaagtgctgggattactggcatgagccactgcacctggccacattcagcttttttacttagcagaatagcacattataaattccttagatacttgatttttaatggttgtgttcatagactggctgtaggataattccttttactactgtcatgcaattatttccaaagcgcggtccttagaccaccgctgggtctataccccaaagaaaggaaatcagtatatggaagcgatatctgcactcccttgtttgttgcgacactcttcaccatagccaaggtttggaagcagcctaagtgtccaccaacagatgaatggataaagaaaatgtggttcttatacacaatgaagtactattcagccataaaaggaatgagatcctgtcatttgcaacaacatggatggaactggaggtcattatgctaagtgaaatgtgccaggcatagaaagacaaacatcacatgttttcacatattgtgggacctgaaaatcaaaacagt

SEQ ID NO: 130616 - DNA, 372 bp, Homo sapiens
atgccatagctgactcctgagggtaaaactacgtcagggaaagacgaaattatgaaaaaggttgtttcaacactaagcagctttttaagaaattgtttaacaaacattgatgacatgtcttctgtgcactaggtactgcaataatcatcatgaccattctgaaagaagttgcttgactctggagccaaacagacctagctcaacatcttggtcttgttactcatttgtttagtgactttgaaagagaaacttactcactttgagtctgtttcttaatccaaagacagggagttagtaataccttctgaggttgttgaaagaattggtctgcattaaagtgcttgacacagtgcctggcacatgcaaggttct

SEQ ID NO: 130617 - DNA, 327 bp, Homo sapiens
agtttaaaaaaaatgattatataaacactaagcagctttttaagaaattgtttaacaaacattgatgacatgtcttctgtgcactaggtactgcaataatcatcatgaccattctgaaagaagttgcttgactctggagccaaacagacctagctcaacatcttggtcttgttactcatttgtttagtgactttgaaagagaaacttactcactttgagtctgtttcttaatccaaagacagggagttagtaataccttctgaggttgttgaaagaattggtctgcattaaagtgcttgacacagtgcctggcacatgcaaggttct

SEQ ID NO: 130618 - DNA, 543 bp, Homo sapiens
ctggctctgggaggctcatgcagcagagccggctgcactggatccagccctcccggttccggggccatctggactcagattcagttcctcctgcaagccctgaagttcccacaggccttgggaaggggagtggagatgaggtctggagaggccccagagggtagccccagtctgggggattctcaaatgctttgaggctccacctgggccttgaaggatggctaaggtcaagactagacagagaaaagggaaaaggcattatttctggtgagggccatgagcaagagcccagccaggctagggaaaagggccaggctgggagagggagtgacagctgggatgctgggctgtgagatgacagagacagcaccgcttggcctcaggcaggggctggctcagcaggaggggctgcacccaagcctcactgtcctctgctgtaaagcaggacatttggaccaggtgggagaaggggcaagatttgccatttactgagcacctagtatgtgccacacacagactaggtaggggctggcacatgcacgt

SEQ ID NO: 130619 - DNA, 790 bp, Homo sapiens
gtttttgttttggttttctattgtgaactggcttgcaagatagttccatttgttttctcatcactgtataggtcaatattgtgtcatcagtaacaatgtgaaaagacatgtataactgaaaggaagtagcagctttattctgctaccttttcacatttttaaataaagagttgatctttctttactaactaccaagtgcaccaggttccagtctttgtcagagattggcattctgactctaaacaaggcataaaatttggtggatgctgtttcctcatctgtgaaattgaacctagaggagggcattatggaattacagggcacattaaagtcatggtctctggagtaagactggtgtggatgggatcctcttgctactacttaccagctctgttcttttaagaaagttatttagcatcccctacattccctcatctgtaaaatggggacctgagacattgactctcacagttgtcttgaggattaaaataaattgtgcattaaagtgcttagacctagtaaaagcactggccctcctgctaataaaagatatacttaatgcatgcaatgtttttaatagactgcagtcaggcaaaccattgcctatgactttgtcctgtggctcttgttagccttaagcattgggtaaacttgctcactctgactttgctacttctttcattggcatttcaagacctctctctgttcctcccccttttaaaaaaattaataggactgacagcttcatggtaggtggacaaaaattcaagttgcataactcgtttctacc

SEQ ID NO: 130620 - DNA, 237 bp, Homo sapiens
ctagacatgagcaatttttaaaaagataatgtatataaaatgccaagcacataaacagttctcaacaactgttagttcacctcccctatcccagtctttggctagcaattttttaatgttaacaactgagcagacactcctctaaaggacaggttcaagtaactcttaaaacatcccttctaattaaaagtatgagagaatgcttaaagaattaaaaaccataagcccaaagactgg

SEQ ID NO: 130621 - DNA, 334 bp, Homo sapiens
  misc_feature (285)..(285): n is a, c, g, or t
gtcgctctagaggatctcgatcagagcatacccctccatccaaacccatcaacaacattccagaagaaaagaaaagcctgtcggacatacatgttcatttaactcccaagtccaactgcactaaggtgtttcatgccactccaaccttgggtcctctgtcacctgctgttgccattcagctgaggaacaggtggtagttctacatccacttctgccccatcccaggaggtctactttgacctagttcaatctggagttctatggggatattagaaatgtaatccntctgcaaggacagacacaaagcgatcctagggcgtatggctctgatcgc

SEQ ID NO: 130622 - DNA, 269 bp, Homo sapiens
gatgggattgaacaaacctggtgacatgaagactgactggtctctgggcccactcagaatttgtttcagagggagaatttctggcctctgcatgtgtggtatattcatgcatttgttaattcaataggccaggggcctgcaatatgcaagatacaagacactttgcatgaaaactcgtggtcttatgaagaaatgtacgtgtacatcagccgtagagacggacaaatgctacaccttataaacacagtacagtgcaaaccaaatgcttt

SEQ ID NO: 130623 - DNA, 353 bp, Homo sapiens
tgtagtgtcagaggctaagtcttacatcacagtccagttcccttgtttctcttgcaacactggcctttggagcctccaagcaagcaggctggttgccctgaagccagcatgctggacaaaagcccaaactagtccacttggaaaaaccacattaggagagaaagatgcccggccatcccccagctgcttcagtcccctgctgtttcacctccagtaacagtctaactacaactgcattagagacctagccagaactgcccagctgagcacttcccaaactcctgacccagagaaaccacgagcaataataaaaatgattgctgttgtgttaagccaccaagttttggggcaac

SEQ ID NO: 130624 - DNA, 735 bp, Homo sapiens
gaatgccttaaaccatgggtattactgaaccttatatacactgtacatttttttcctatacatacctatagtataatttaaaaagaaattaggcacagtaagagattaacataactaataaaaaacacagaacaattatgaaaatgtaccagcatcactgttcttgcacttattattaataattgctattattaagtaaagcaattgttacttgaacacaagcactgcaatactggatactgcaacagttgagatggctactaagtgactcacaggcaggtagtacatatggcatggacacactggataaagggatgagtcatgcccacaccagttggagtgagatggtgtgagatttcatcaggctattcaaaattgcatgcaatttaaaacttatgaattgtttatttctgaaattttctgtctaatattttcagactgcaattgaacactgttaactgaaattgtgaaaagtgaaaccactcataagaagaagaaactttgaaactttgaaagacaagtaacagattttctcttactgttgtcaacaccaggtctgtcattctgaaataaattaaaacatcaaaaacataaatccatgaaaggcatttgagataaagaaacaggatttttattctagggtgctattccaagtcaaagcatatctctgaaaattattgattgcaagcaaaagaatatcattttagaaatctttttggcattcttaatacaata

SEQ ID NO: 130625 - DNA, 631 bp, Homo sapiens
gaggcaaaagcagttctaaaagggaagattattgtaataaacacctacattaagcaaaaagaaagatctcaaataacaacctaactttaagaaaccagagaaagaagaacaaactaagcccaaagttagcagaaagaagaaaataacaaagattggagcagaaataaataaagactagaaaaacaatagaaaaggtcaagaaaactaacaattggtgttttgaaaaacagaattgacatgttttgaaaaacagaattgacaagccgttagctagactaagaaaaaaataagaaaagtctcaaatacataaagtaagaaaagaggagagattacaactgatatcacagaaatacaaaggataagagactactatgaacaactatatataagcaaattggataacctagaagaaatgaatgaattcctagatacatacatcctatcgagaatgaatcatgaagaaatagaaaatctgaaggtaccactaataaggaggttaaatcaccaatcaaaaatctctcaaaaaagaaaaagtgaggaccaggtggcttcactactgaattctttcaaacatttaaagaataagtaatagcaagtcttctcaaactcttcaaaaaaattgaggagaatg

SEQ ID NO: 130626 - DNA, 304 bp, Homo sapiens
ttgaatagactgtcaccaggttattggctgtttgaagattctcatttgtctgctaactatacctctattttttttctacgttcacctggaagacatgtcttcttcaagagcaccttgactctgtccagaaggagttcataattttcaacagagaaaaagtaaacagggactttaacaaaagacaaccaaatctagccttggaacaaaccaaagacccacaagtgacaaatggacaaatggacacaggactcagtgagacttttcagacctcgaaagtttcataaagtggtcagaatgccccagg

SEQ ID NO: 130627 - DNA, 795 bp, Homo sapiens
agtctggcatctgatgttgccatcagatgagaaaaccaagacataaagatattttaataatattgccacacagtcctagtagtagagctaggatttgttatattatttgtaccataccgcagtgcgttccatggaagatgtgaggatttaaatttagctctttaaaatccttgtcctatgtctgacttgtttgaatggatgaaccacttattctgtgcagagaattcctggcacaatgtaactaattcctgaacaaataatacttcatttgctgtcatatagaaaaaaattagaggtgatacttgtttaaagttaggactgcaagtcttaacctgtttttgttactagttcttgagaggttgggcaagtctgtacatcaggttctagctcactgtaatagtgattaggggatgatttgggagaatgacctaattgaattgaaaagcataataatagccaacatttcttaagtactttctatgtgctaggcactctgctaaatacattttattgtcttatttaatcttcacagtggaaactactattatcctgttttacagatgaagaaacttagggacagcgactaatttgccaaaagttatgcagattgaaaggagtggagccagaatgatatccccaataatttttatctcagagtttatactcttaatgatcatattggctccataaacagctttacacatgtataacctatgtggtgattagcacttgttctcaaatcaagtaatcagattgagatctttagtccctaacctgcatgccggcgaagaatgg

SEQ ID NO: 130628 - DNA, 934 bp, Homo sapiens
ctgtcccgggtcccccaaatctcatgtctttctcacattgcaaaatacaatgatgccttccctacagtcccccaaatcttaactcattacagcatttactcaaatatccaaagcccaaagtcttatctgagacaagtctacagtcccttctgccatgagtctgtgaattataaagcaacttaactacttccaagctacaatgattgtacaggcaatgggtaagcattctcaaccaatagaaaaaaaaattgctggaaagcagcacaaaacacagatgggattcataggatacataaatgtccaaaacccagcaggccagtcactcaatcctacagctccagaatcatcctttttgaatccctgtcccacatccatggcacaggtgtatgagggctggtcttcctaggccttgggcagatctgcacctgtggctttgcagtgttcagcccctgtagctgccgtcatggacagggctggtgttgagtgcctgtagcttttccatactgagggtgcaagctgtttgtgggtctatgaatctggggtttggagaatgatgcctccctgtatgggggcctgtgacagcaagggctgctgcagaggactgtgaaatgccttcgaggcctctttcccattgtcttggctatttgcactgggcttctttttatgcagatactctaagcctccttgaattttcccccggaaaatcatcttttctttttgaccacttggccaggctgcagattttccaaactttaggtctccacttctcatttcaatagaagttccaacttgaagtcatttcttaggtcacgcataagaacacaggctattcaatgcagacaggacacctcgctatgctgcctagatgttcattccaccagatacatcctaaatcatcacccccaaattcatagtttcatagatgtccagggca

SEQ ID NO: 130629 - DNA, 847 bp, Homo sapiens
gagcaaaccctcgaagaagttggggattatgttaaatgactaaacctaagaataatcagtgttcctgaggaagaagagaaatctaaaattttggaaaacatatttcagggaataatcaaggaaaacttccccggccttgctagagacgtagacatccaaatacaagaagcacaaagagcacctaggaaattcatctcaaaaagatcttcgcctaggcacattgtcatcaggttatccaaagttaagatgaaggaaagaatcttaagagctgtgagacagaagtaccaggtaacctataaaagaaaacctatcagattaacagcagatttctcagcaggaaccctacaagctagaagggattggggccctatcttcagcctcctcaaacaaaacagttatcagccaagaatttcgtatccagtgacacaaagcatcatatatgaaggaaagatacagtcgtttttagacaaacaatgctgagagaattcaccatcaccaagccaccactagaagaactgctgaaaggagctctaaatcttgtaacaaatcctggaaacacatcaaaacagaacctctttaaagcataaatcacacagggcctataaaacaaacatgcaagttaaaaagcaaaagccaaaaccaaaaaaaacctaagtacacaggcaacaaagagcatgatgaatgcaatggtacctcacacctcaatagttacgtggatgtaaatggcctaagtgctccacctaaaagatacagaaccacagaatggacaagaactcaccaaccgtctgcctgccttcaggagattcacctaatacgtaaggactcacatctcacataaacttacagg

SEQ ID NO: 130630 - DNA, 338 bp, Homo sapiens
ggcacaatgacggctcactgctacctccacctcctgggttcaagcgattctcctgcctcagccttccgagtagctgggattacaggcatgcgccaccagacccggctaattttgtatttttagtagagacaggggtttcaccatgttggtcaggctggtcttgaactcccaacctcagttgacctgcctgcctcagtctcccaaagtgctgggattacaggtgtgagagaccgtgcccagccaggagagtttttttgttgttgttattttaagaaaattgaaaaggaggtagaagaaaaccaagagaaaaaaaaaaaaaagacaaagcagcagcatga

SEQ ID NO: 130631 - DNA, 554 bp, Homo sapiens
attctggcccagcccacccattcccaacacacattaaagcaaagagaagccataagtaaatctgtccaggtacaactataaattaacaagattgccttcttgtatggtttaaagccactggtctcattaattcacagtcacagtgcagtttacggcttgaggaatcttcccaggaaaagcttaattcaattagggctctcggcagctccccaaggaagctctggtatcttacttttacttacacaaattgagggcagaccaaacagatccagatcttcccagagagaccccacccggcccagagaagatgcccttgcagaccctccattagagccaagccgagggaggtggccaaggcagcaccacttaaacactggctggcgcctaaggcatcattctgtgagtgtcgctcccagcgagctcagttaaactccttggcttggcagtctggtgccaaggagcctctgcaacctttgctctccctcctctctgagcagtcaaactggtttcttgtctgccccagggctttgcagggatcctatctttacactgaa

SEQ ID NO: 130632 - DNA, 261 bp, Homo sapiens
gggtaaccagtgctctacctctgaagacaaagataactcactatacgggaagaaaaaggatgccccacagaagaggaaaggaaagcttggaactatcaactacatttgacagttcccggtaatttaatcaaggacttcaagggaagcttgaaccaaaatctaaaataaagcacaataaacatgccaaatcccaaagtgaacccaaatttttaattattttttactgaacaaaatacaaactaatgaatccactaaactgag

SEQ ID NO: 130633 - DNA, 489 bp, Homo sapiens
cttagaatagtgcctcacacatagcagatgctcaataaagatttgttgactaaaatgaattgacagagggctcagggctttcttaaagcattaggtgtccctgccaactggaagtcaataaaaactgaagaccaatcagcccttaaagtataagtcaactgaaacatgtaattacatttatattttcaaataatatttcagccatctgtttattctacaaagtaaaatgtacccgtattttcagctttgattaaaaatataaactaccctctgtttgaccttttgattgagccacacttctgttcagcactaggtcaatgaagcatgactggaatattaaacggtgcttctattcttggttcagcctatgagtcagtttctttttcatttctccttcctttcagtggccaaatagatatatcgacaggcaatgaattattactatgacagatgttaagtttcatgaaaatgaaagggtaagtcaccatt

SEQ ID NO: 130634 - DNA, 379 bp, Homo sapiens
aatgattaaccgttcacacaggtttgaaggctattccaaagactgtctcaaaatcccttaagcagtgagaacattgaaataagcttaaaatttggctttaggctggaagcggtggctcacgcctatacccagcactttgggaggctgaggcagatggatcacgagctcaggagttcgagatcagcctggccaacatggtgaaaccccgtctctactaaaaatacaaaaattagctggacatggtggcatgcacctgtaatcccagctactcaggaggctgaggcaggagaattgcttgaacccgggaagcagaggttgcagtgagccgagattgcaccactgcactccagcctcagcgacagagcaagactctgtctcc

SEQ ID NO: 130635 - DNA, 513 bp, Homo sapiens
agtgtactaatcaactctaacagacattcaaagaaaaatatagtgggagaaagtaatgtatttcacagacaactgtttctccataaacttgattcacctgattcacattaaaatatgccctttatcaactgtttcattaaataagtagaaatacagataaccagaaaacttcctggcagttgtcctatcaattcctttatatcagattacccagttttaatactggctgtcatagccagactcagtggctcatgcctgtaatcccagctctttgggaggtcaaggcaggaggatcgcttgagaccaggagttcatgaccagcctgggtaatatggtaagaccctgcctctacaaaaataaatttaaaaaattagccaagagtggtgtcatgcacttatagtcctggctactttggcggctaaggcggaaggatcactggagttcaggaggtcaaggttgcagtgagctatgatcacaccaccgcactccagcctgggcaacagggtgagatcc

SEQ ID NO: 130636 - DNA, 1931 bp, Homo sapiens
ctcccttccccagtctgggcccccgcggcacagggggccgagcagaagcccccagcgtccagggccgggggagggtccgcctgcgcccccaggcccgcgtggtcgggccctgcagggcgggaggcgcggcgcggggcggggccggtgacgggacgcggagaccccgcgggcggcgggaggggcacgaggcgcgcgtttgcacccgagcccggcccgcgccccgatgcggagcgatgccgctcggcctggccgccccccgcgagcaccgcgctgcagacgaagcccgcgcgtgatcccgctccgggtgacctcaaagcagaagctctgaattcacctctcatctgacgactgacagctgctgccaccgccagcctctgtcccttgcccaggcctgtcacacggctgcctctcagcaggggcagtagaatgaaagagggcatgtctaataacagcaccactagcatctcccaagccaggaaagctgtggagcagctaaagatggaagcctgtatggacagggtcaaggtctcccaggcagccgcggacctcctggcctactgtgaagctcacgtgcgggaagatcctctcatcattccagtgcctgcatcagaaaacccctttcgcgagaagaagttcttttgtaccattctctaactccgtgtgtgatgaaaacgcctccttttctgaccttcaaagtcccctgtagagaccatgcatgctctaagccttagggagtgagaccaacacccatccctgcccagccaacagtggccggggcttgtcttatgtttccatctgttttcttcgtggcattcaatttcatttttttccttttcattttcatgttattttcattattggcaaagaaaatcaaaatgtttatagccaaataacaaatgtgccatgtaaaagtaagtctggacttaagagtttaaaatttttaaacatcagtttccaagtttatatcatattaatacatttcagtggataatttatttaaaaaaaaaaactatgcctaaatatcccttatttgcaatattcagtatcaaattagagcattttgaccaactgaaacatataacgttttcatctcctttcctggagaaagcagctgcagaggttctgtatttcctgcatttccatcatcctagtaaaaagacaacaacccacaggattggaatggttttcttttgttttttttttgttgttgttgttgttttgagatggagtctcgctctgtcacccaggctggagtgcaatggcgtgacctcagctcactgcgacctccacctcctgggttcaagcgattctcctgcctcagcctcctgagtagctgggatcataggcacgcgccaccacacccagctaattttttgtatttttagtaaagacggggtttcaccatgttggtcaggctggtctcaaactcctgacctcgtgatccacccgcctcggcctcccaaagcgctgggattacaggcgtgagccaccacacccggccgtggaatggttttcttagcatatcctcctggggccgtggcgccccggctgtgggccgtggtggatgtcccttgtttcagtggtcctacaaaggtagatggtgggcggacaccgaagtcaacttgactgtaaaagtaccccataccgttgacgcgctgtggcagacctgtgggtgcggtctcccctctccaaatgccacctcttcctgctccctcctcttttggctcctactcagtagttccattgtgggctgcagtaatataaggacctgttctggacacagcactgggcccgctggggttttagtagggcagccccttccctgcaggagtgaggcatggtgacagcagtcccctatgtgcccccaagtcatctgagcattggtgtgcattaaggtactcaatcttccaacaataaataccataagtgca

SEQ ID NO: 130637 - DNA, 1838 bp, Homo sapiens
agcggcggtgccacagggacgaggcctggagagcagtcgctcctagaaccggggcgcgaagggcacccccgcctccagcacgcgccctccgccctcccggcctcgctccccccggagtgggggcctcgccggcccctggtccccgtcactcagcaacgtcgggtcagccttcgccgggttagtggcgacgcggccgcgcgaattcgcacaggtgacctcaaagcagaagctctgaattcacctctcatctgacgactgacagctgctgccaccgccagcctctgtcccttgcccaggcctgtcacacggctgcctctcagcaggggcagtagaatgaaagagggcatgtctaataacagcaccactagcatctcccaagccaggaaagctgtggagcagctaaagatggaagcctgtatggacagggtcaaggtctcccaggcagccgcggacctcctggcctactgtgaagctcacgtgcgggaagatcctctcatcattccagtgcctgcatcagaaaacccctttcgcgagaagaagttcttttgtaccattctctaactccgtgtgtgatgaaaacgcctccttttctgaccttcaaagtcccctgtagagaccatgcatgctctaagccttagggagtgagaccaacacccatccctgcccagccaacagtggccggggcttgtcttatgtttccatctgttttcttcgtggcattcaatttcatttttttccttttcattttcatgttattttcattattggcaaagaaaatcaaaatgtttatagccaaataacaaatgtgccatgtaaaagtaagtctggacttaagagtttaaaatttttaaacatcagtttccaagtttatatcatattaatacatttcagtggataatttatttaaaaaaaaaaactatgcctaaatatcccttatttgcaatattcagtatcaaattagagcattttgaccaactgaaacatataacgttttcatctcctttcctggagaaagcagctgcagaggttctgtatttcctgcatttccatcatcctagtaaaaagacaacaacccacaggattggaatggttttcttttgttttttttttgttgttgttgttgttttgagatggagtctcgctctgtcacccaggctggagtgcaatggcgtgacctcagctcactgcgacctccacctcctgggttcaagcgattctcctgcctcagcctcctgagtagctgggatcataggcacgcgccaccacacccagctaattttttgtatttttagtaaagacggggtttcaccatgttggtcaggctggtctcaaactcctgacctcgtgatccacccgcctcggcctcccaaagcgctgggattacaggcgtgagccaccacacccggccgtggaatggttttcttagcatatcctcctggggccgtggcgccccggctgtgggccgtggtggatgtcccttgtttcagtggtcctacaaaggtagatggtgggcggacaccgaagtcaacttgactgtaaaagtaccccataccgttgacgcgctgtggcagacctgtgggtgcggtctcccctctccaaatgccacctcttcctgctccctcctcttttggctcctactcagtagttccattgtgggctgcagtaatataaggacctgttctggacacagcactgggcccgctggggttttagtagggcagccccttccctgcaggagtgaggcatggtgacagcagtcccctatgtgcccccaagtcatctgagcattggtgtgcattaaggtactcaatcttccaacaataaataccataagtgca

SEQ ID NO: 130638 - DNA, 2246 bp, Homo sapiens
ctcccttccccagtctgggcccccgcggcacagggggccgagcagaagcccccagcgtccagggccgggggagggtccgcctgcgcccccaggcccgcgtggtcgggccctgcagggcgggaggcgcggcgcggggcggggccggtgacgggacgcggagaccccgcgggcggcgggaggggcacgaggcgcgcgtttgcacccgagcccggcccgcgccccgatgcggagcgatgccgctcggcctggccgccccccgcgagcaccgcgctgcagacgaagcccgcgcgtgatcccgctccgggtgacctcaaagcagaagctctgaattcacctctcatctgacgactgacagctgctgccaccgccagcctctgtcccttgcccaggcctgtcacacggctgcctctcagcaggggcagtagaatgaaagagggcatgtctaataacagcaccactagcatctcccaagccaggaaagctgtggagcagctaaagatggaagcctgtatggacagggtcaaggtctcccaggcagccgcggacctcctggcctactgtgaagctcacgtgcgggaagatcctctcatcattccagtgcctgcatcagaaaacccctttcgcgagaagaagttcttttgtaccattctctaactccgtgtgtgatgaaaacgcctccttttctgaccttcaaagtcccctgtagagaccatgcatgctctaagccttagggagtgagaccaacacccatccctgcccagccaacagtggccggggcttgtcttatgtttccatctgttttcttcgtggcattcaatttcatttttttccttttcattttcatgttattttcattattggcaaagaaaatcaaaatgtttatagccaaataacaaatgtgccatgtaaaagtaagtctggacttaagagtttaaaatttttaaacatcagtttccaagtttatatcatattaatacatttcagtggataatttatttaaaaaaaaaaactatgcctaaatatcccttatttgcaatattcagtatcaaattagagcattttgaccaactgaaacatataacgttttcatctcctttcctggagaaagcagctgcagaggttctgtatttcctgcatttccatcatcctagtaaaaagacaacaacccacaggattggaatggttttcttttgttttttttttgttgttgttgttgttttgagatggagtctcgctctgtcacccaggctggagtgcaatggcgtgacctcagctcactgcgacctccacctcctgggttcaagcgattctcctgcctcagcctcctgagtagctgggatcataggcacgcgccaccacacccagctaattttttgtatttttagtaaagacggggtttcaccatgttggtcaggctggtctcaaactcctgacctcgtgatccacccgcctcggcctcccaaagcgctgggattacaggcgtgagccaccacacccggccgtggaatggttttcttagcatatcctcctggggccgtggcgccccggctgtgggccgtggtggatgtcccttgtttcagtggtcctacaaaggtagatggtgggcggacaccgaagtcaacttgactgtaaaagtaccccataccgttgacgcgctgtggcagacctgtgggtgcggtctcccctctccaaatgccacctcttcctgctccctcctcttttggctcctactcagtagttccattgtgggctgcagtaatataaggacctgttctggacacagcactgggcccgctggggttttagtagggcagccccttccctgcaggagtgaggcatggtgacagcagtcccctatgtgcccccaagtcatctgagcattggtgtgcattaaggtactcaatcttccaacaataaataccataagtgcaaaaaaaaaaaccaccgacatcaaacagcaaccacacacccgcggccctaacatgtcgggggcgccgaacacagacgcgttacagcaccgtgcgcccctgtgcacaccagccgtgcgtccgggcgcccgcactcctgtctccagggggcaactctggcgcggccccaatgcggcgggacgtaccaatccaccacccaggtgtcccttcttaagccacgcgcaaccgcgtaccgccgcccttgccccgcgcgagcacgcgggcacggcaccagctcacacccgagccacccacgaccgcgcaccacacctgccaaaa

SEQ ID NO: 130639 - DNA, 1726 bp, Homo sapiens
agcggcggtgccacagggacgaggcctggagagcagtcgctcctagaaccggggcgcgaagggcacccccgcctccagcacgcgccctccgccctcccggcctcgctccccccggagtgggggcctcgccggcccctggtccccgtcactcagcaacgtcgggtcagccttcgccgggttagtggcgacgcggccgcgcgaattcgcacaggggcagtagaatgaaagagggcatgtctaataacagcaccactagcatctcccaagccaggaaagctgtggagcagctaaagatggaagcctgtatggacagggtcaaggtctcccaggcagccgcggacctcctggcctactgtgaagctcacgtgcgggaagatcctctcatcattccagtgcctgcatcagaaaacccctttcgcgagaagaagttcttttgtaccattctctaactccgtgtgtgatgaaaacgcctccttttctgaccttcaaagtcccctgtagagaccatgcatgctctaagccttagggagtgagaccaacacccatccctgcccagccaacagtggccggggcttgtcttatgtttccatctgttttcttcgtggcattcaatttcatttttttccttttcattttcatgttattttcattattggcaaagaaaatcaaaatgtttatagccaaataacaaatgtgccatgtaaaagtaagtctggacttaagagtttaaaatttttaaacatcagtttccaagtttatatcatattaatacatttcagtggataatttatttaaaaaaaaaaactatgcctaaatatcccttatttgcaatattcagtatcaaattagagcattttgaccaactgaaacatataacgttttcatctcctttcctggagaaagcagctgcagaggttctgtatttcctgcatttccatcatcctagtaaaaagacaacaacccacaggattggaatggttttcttttgttttttttttgttgttgttgttgttttgagatggagtctcgctctgtcacccaggctggagtgcaatggcgtgacctcagctcactgcgacctccacctcctgggttcaagcgattctcctgcctcagcctcctgagtagctgggatcataggcacgcgccaccacacccagctaattttttgtatttttagtaaagacggggtttcaccatgttggtcaggctggtctcaaactcctgacctcgtgatccacccgcctcggcctcccaaagcgctgggattacaggcgtgagccaccacacccggccgtggaatggttttcttagcatatcctcctggggccgtggcgccccggctgtgggccgtggtggatgtcccttgtttcagtggtcctacaaaggtagatggtgggcggacaccgaagtcaacttgactgtaaaagtaccccataccgttgacgcgctgtggcagacctgtgggtgcggtctcccctctccaaatgccacctcttcctgctccctcctcttttggctcctactcagtagttccattgtgggctgcagtaatataaggacctgttctggacacagcactgggcccgctggggttttagtagggcagccccttccctgcaggagtgaggcatggtgacagcagtcccctatgtgcccccaagtcatctgagcattggtgtgcattaaggtactcaatcttccaacaataaataccataagtgca

SEQ ID NO: 130640 - DNA, 1588 bp, Homo sapiens
gcaagtcgggagcagctgtgggtggtgtcctacaggctctgctgccgaggaagagctgctgccctgagtggaggggcagtagaatgaaagagggcatgtctaataacagcaccactagcatctcccaagccaggaaagctgtggagcagctaaagatggaagcctgtatggacagggtcaaggtctcccaggcagccgcggacctcctggcctactgtgaagctcacgtgcgggaagatcctctcatcattccagtgcctgcatcagaaaacccctttcgcgagaagaagttcttttgtaccattctctaactccgtgtgtgatgaaaacgcctccttttctgaccttcaaagtcccctgtagagaccatgcatgctctaagccttagggagtgagaccaacacccatccctgcccagccaacagtggccggggcttgtcttatgtttccatctgttttcttcgtggcattcaatttcatttttttccttttcattttcatgttattttcattattggcaaagaaaatcaaaatgtttatagccaaataacaaatgtgccatgtaaaagtaagtctggacttaagagtttaaaatttttaaacatcagtttccaagtttatatcatattaatacatttcagtggataatttatttaaaaaaaaaaactatgcctaaatatcccttatttgcaatattcagtatcaaattagagcattttgaccaactgaaacatataacgttttcatctcctttcctggagaaagcagctgcagaggttctgtatttcctgcatttccatcatcctagtaaaaagacaacaacccacaggattggaatggttttcttttgttttttttttgttgttgttgttgttttgagatggagtctcgctctgtcacccaggctggagtgcaatggcgtgacctcagctcactgcgacctccacctcctgggttcaagcgattctcctgcctcagcctcctgagtagctgggatcataggcacgcgccaccacacccagctaattttttgtatttttagtaaagacggggtttcaccatgttggtcaggctggtctcaaactcctgacctcgtgatccacccgcctcggcctcccaaagcgctgggattacaggcgtgagccaccacacccggccgtggaatggttttcttagcatatcctcctggggccgtggcgccccggctgtgggccgtggtggatgtcccttgtttcagtggtcctacaaaggtagatggtgggcggacaccgaagtcaacttgactgtaaaagtaccccataccgttgacgcgctgtggcagacctgtgggtgcggtctcccctctccaaatgccacctcttcctgctccctcctcttttggctcctactcagtagttccattgtgggctgcagtaatataaggacctgttctggacacagcactgggcccgctggggttttagtagggcagccccttccctgcaggagtgaggcatggtgacagcagtcccctatgtgcccccaagtcatctgagcattggtgtgcattaaggtactcaatcttccaacaataaataccataagtgca

SEQ ID NO: 130641 - DNA, 366 bp, Homo sapiens
aacaacaggcaaaacactagcagcagagagttaagtaagaacttcatttaagtaaggagttcagcggtagtggagatttagtcgccaaggaagtcttgcttacggctttggttcccctaatctggcgtgtaagctttgagtcagggtctttgggtgggacagtctgagctacggctttcctggcaaatttgacatgacttaaaaaacttcagtgttgaccagtgattagtcctgggccacccaggatttagacaccacctgtttacttgtaaacatgcagttattgctgagctaaaaaaacttgcatttgtattcacatttgggttctccaaagaggtgaaactgacccgatgaaacacagtaaaa

SEQ ID NO: 130642 - DNA, 182 bp, Homo sapiens
gcagaaaaggttaaaagacaggtttctctgcagcacgtttatatagataggtacatacatagcagagaagtcaaggctggggaatctggcggtgggtagcgacagtgctgtggcagaggaacactggaatgtgcttatgtaacttttcaccagagacagattttaaagcagcagttgtcact

SEQ ID NO: 130643 - DNA, 379 bp, Homo sapiens
aaaaggtcccccactgggcgggaacagtaggaccatggtaattcttgtataagtctgttaaacgtctttcctttcctgtatgcaaaacctcaggagtttactttaacctcttagaaccagtatcatgtaggttatgtagataccaaaagttagatacataacaaaggaatttgaacaagtaaggttacagaagtggagtttaaacctggactgagacttcaaaatctgacaaataccaattccaaattttttcaattcctagatatttcattcttggggataaagtagtcctaataattattatattgtcagggcttactataatggtgaaagactgtaggtccaagtttacctatacagagtgggaacaaaatcatct

SEQ ID NO: 130644 - DNA, 153 bp, Homo sapiens
tatttttcagttgaagactctgaaaatcagcaagattggctcaatgttaggatgagacaagtatggggcaggattgggccttatgaggaagaactatagtctctctcttcttcttctttttttttttttttttgagacggagtctcaccctgt

SEQ ID NO: 130645 - DNA, 682 bp, Homo sapiens
taaagtgagttaccacagcccagtagaaacccagatctggttgtgtgaccttaatagaggtatctgaaattataaattgattttcttccaatagcccgcatctgaaataactggattgaggttcatgtcagtaaattcttcaatttctatgtagggaaaaatgaggacctttttgtttgtaattattctatttattgaacagttattagttgtacttctaatctgtactagaagactatattacaaagtgtttattttccctaaacaatggcttctcttgattcgtgttcattattgccctaaataaattgaaatttagaaaaagaaaaacccagttttcttagtatcatacatgcaagcttaagttttcttatttgtttgtttttatttgacatacatgaaggttatttccaaagatacaaatggaggccaaaacagtttgacataaagcagaccaaaacagattgaattatactgtacctctacactgactagcattttgatgtctagatggataagtaagcatagtgctaatttacaagcgcaaactcaactagtaagattaactaatttctaggctgtaatgaatttatataaatattcttgttattcagatgggaaacctcataactgtgctgtagattagacttgcattgcctaaaactggagaatgtaacttttt

SEQ ID NO: 130646 - DNA, 444 bp, Homo sapiens
tgttaaccaataattataaccaattaattattattgggtgcctggcagacacccaaacgggtgaacccctgagggtcccaggacaacagggaatggtggggactgtggcaaaggggacccacccaacgaagcagccaaactccatgccagcagagcccacctgctaagaggagctggaagttctaactttcaggtgaaatcttcagatttttaagtgttgtcctaagttcgtaacacgctgtgttggtccaaaggacatcagcggtgtcagggtcctagaggtggatgcagaagcctcactgggtgtggagtggggaggagagggactcagccaggggactgtgttttacaagccctaaccaggcttccttccagggatccttcctcacccttcgagcagctgcgattgacaatttcccccaacagcattggtccccacccctc

SEQ ID NO: 130647 - DNA, 343 bp, Homo sapiens
aaaaaaaaaatgcagtcttacatcacagaacaccttttcctgtagctaggaaatgaggcatgagaatagccttgtctcccacttagagggcatgaaaactgagaagttaatgtttctgagatccttgagtgaaaggcacagacttatctgcttcctgccatagaatgtcctgccttgagatgttgtttatcaaaccattaatcctaatgtgtcttcaccagccagcacttgataggataaaagcattgtcctcttggagtggcagctggcagactctattctaacacgtaggggcctccttagcaataatgtagtgtttctcactggaagcctcacatacctc

SEQ ID NO: 130648 - DNA, 407 bp, Homo sapiens
  misc_feature (407)..(407): n is a, c, g, or t
aaaaggagagaagagagagaaagaggaaggggcagcgggttggggcaggaaaacttagtgcagtgatgtaactatacaccaggtacagtgaggtcacagagaagagtatggccagttctgcctggggtattgggggaagaggaaagggtctaaggaaaaaaaatatgagaaactttgcagacactaccctttcatccttatatccttgtgacagcaaagctaccgagtctctatttcttttagaagcacgcatgcagcagcagcagaaagtatgatgggtcatgctcgcagtgatacagaaatcatggcaggaaattcgtggcccggcaataaatacgttcaaatgagagaagcaagcctcagacctcttattgaacaagaaggagcagaaggagaaacagcttaan

SEQ ID NO: 130649 - DNA, 378 bp, Homo sapiens
aaaggggaagaaagaacttgacaaaattcacagaaattaaaacacacttaaaacacacatacatacagggcttcacatactcaagagagaactgtgtctgacaaggtctaagttaatcttttactgggggctgagactacccaaccccacattaaggttgtccacgtaactctactgtgcttcacctcaaaactttttcacattgctagaccgtggggaatcactgtatatcccagacgagactgtggcattcccgaggaggccagctctggtccctgctgaccctgccagctgctttctaagccatccagtcccatctcagccttactctgtggccgtgagccttttgtttcactgaactttattttacttctagaa

SEQ ID NO: 130650 - DNA, 286 bp, Homo sapiens
actggaaatttgaagctgtagagctcttaaactgtgtttcttgataatcaacatcctttataaatcaaagtaaagatatgattttgaaagaaggcttaaattccaaactcttggctgtgattcgtggggttgaaggatataacttctatccttttgggacagatatctcaacaatatgtataagattacacagtctttccccaacaggaaatttcttgtttatttaaaactgggatttactaaattggtttgaatttaatgctgttcagtagtcaactcagttgag

SEQ ID NO: 130651 - DNA, 361 bp, Homo sapiens
tagagatggggtttcaccatattagccaggatggtctcgatctcctgatctcgtgatccacccgcgtcggcctcccagtgtgctgggattacaggcgtgagccaccgtgcccggtctaatcaattaattttccacaagataattcaatggggaaagaatcatcttttcaacaactagttatccacgtgtaaaataatgaagttattccctatttcacaccacacagaaaatttaactcgaaatggatgaaagatctaaatgtaaaaattaaaactataaaacttttagaaaaaaaaaatatcggattgattcttcttgactttggatcaggcagttgttagatgtgacaccaaaagaaaaa

SEQ ID NO: 130652 - DNA, 444 bp, Homo sapiens
gaaagaaaaacataatgttaaaaaaactccacatttctgagaagataaattgatcttagagataattgaacataagacaccaagccttaaaagtacttatttcaacaaagatatacaatgccataccaaaaatattgctttttcaaaagacttttatttattatttatttgcatttttccatttgtatagttattttaaagaaaggctttttgtgaatgtttgagattgcttaattacagcagctttttggtttcctttatttatatttatctatctacctctcagatgaggtttaaattagagtttttaaggttataggggtttaaaattttatgtacatgtacaaaatctgtactagaggaagaaatactagtgcataatttcaagggatagcgtgaggctggctgaggtcagacccatgatggaatgcagaaattatgaga

SEQ ID NO: 130653 - DNA, 221 bp, Homo sapiens
tataggaatagtgacttaatagaccacatgcagtggctcattcctgtggtcccagctactcaggaggctgaggtgggagcatcgcctgagcccaggagttggaggctacagtgagccatgatcgcctactgcagcccggggcaatagagtgagacccccatctctaaaaaaagaacaagcacacgcctgtgggtggtcccagctactcaggaggttgaggt

SEQ ID NO: 130654 - DNA, 873 bp, Homo sapiens
gaataagtcatcaaaaaccaacaaagaaaatctcagaactagatggcttcaatggtaaatttcataaattatctcaaaagaaactaccattaattattcttaaaccactataaaagcttgaagtggagagaacacttccaaatttattttatgaagacagcattactctgataccaatcaaagacagacaatgacactagaaggaaagcaaactacaggctaatatccctgatgaacacagatgtaaaaatcttcaatgaaatatgagaaaaccaattcaacaacacattaaaagcaccattcaccatgatcaagtgggatttatccctgggatacaatgatgattcaatatataaaaaacaaaaattatttgtgttctgtatcctaataataaagtatttaaaaacaaagttaagaaaatgcatatttacaacagcatcaaaaagaatcaaatacatagaaataaatttaaggtgaaacacataaaccttgaaacataaaatattaaagaaattaaagaagatacaaataaaaacacatcctatgttcataaatttgaagtcttaacattgtttaaatgtctataactacctaaagtgacctaaagattcagcaaaatccctaacaaaattccactgtcattttttacaaatataaaataaacaaaggaccctgaattcaaaagaattttttattttgagaaaaaagaacaaagctgaaggcatcccaccttctgatttcaaaatatattacaaagctacagtaaataaaacagcatagtaccagcatgaagacggacatatagaccaatagaacagagactccagaaataaacccacacatttttgatcaattgatcttcagcaatattgc

SEQ ID NO: 130655 - DNA, 351 bp, Homo sapiens
  misc_feature (8)..(8): n is a, c, g, or t
agagggcnactctagagatccctgatatagctgtctcaacattaatgcgctgttttttttgtgtatttttttttaagagatagggtcacattctgtcacccaggctggagtgcagtcacgcaatcatagttcacagtaaacctcaaactctatttggtgaagatatttctagataaaatgccatgtgataaatatggttaatgaaacaggaggagaaatagtacttgagcaatgcatacactcttcagattttgtgccatcttcctacaagactcaaagcaggtcagcaggtttgttttttaagcaagttagagtgacccaaatcagagaaatacttgtatacagagaccc

SEQ ID NO: 130656 - DNA, 117 bp, Homo sapiens
tgctgggattacaggcaccgcgcccagccaagaaaacttttaatgtaagtgggaataggttaaaaatgcagtcagacttcatgatcacttgaagagagctgcctttttgtctccttt

SEQ ID NO: 130657 - DNA, 148 bp, Homo sapiens
gtatgggagaggacaggtgtccagagaggctgatattctgggcaatcatcaagaatgaggtgaaccagctgagcctcaaagctcaaaatggaatggtggcaaggatctctcacttcctaatgaggtcttgaaagcactttgttttctt

SEQ ID NO: 130658 - DNA, 186 bp, Homo sapiens
ggtggggtcaggagtgcttaaagaaaatgtaacatctgagctggattttgaaggagtttgacaggctgaaaaggacattccaagcagaggagataagagcatgcacaaaggcacagaaaagtcaactcagagagaacaacagtgagacatcagtatcactaatggaaacattagaaaggggtaagg

SEQ ID NO: 130659 - DNA, 397 bp, Homo sapiens
tagaaaggttaaacatgggaaaagacagcgggagctctatagtaaccttgagtgacttctataacagtaggcacatgcatttacgcatttccagagagagatatcaaacatcctccttttggtcctctgactgaagacaaaagatttcttcatgcacatcttctaagggaagggaagaagtcctacctattttactaaaatagttcttattaaaaggccactgtgaaaagaaagaactgaggagtttgtaatggggacccaattctcatcaaagccctgctatagcacaaagtttagccttggactttcacaaaggtaagctggatatttacatggtgcccaacatcggccatgccttagagacttagatggcagtcatccttggaggatgatcttc

SEQ ID NO: 130660 - DNA, 426 bp, Homo sapiens
cctggcgagatctctgcatcatttcttctccccagcttctctctccacccatgccgccatgggagagtttaggctgtctcgtccctgactggcctgaggtagggctgtgactgtctccttttccctctctcctgtcttcctcacctatgcccacataatcagtccaccttccttactgctggatgcaaacctgctgagtctctatggctttcaggatggagttcaaagacatcacctcagcgtgaaaggccctttcaggtctggcccggcacaaccctgacacccgcatgttcctgggtgcaacaacatggggccccagggcagcttcccatgatgcatcagcctctgctggctcctgatgtggcctctgttcctgtcttaggcccctattcctctcggcaggctccacacttgccttactctatc

SEQ ID NO: 130661 - DNA, 323 bp, Homo sapiens
aaaaaaatgtacacttgttagtaggaaagaaacaacattggtttgacagaactttctttaaaactcttacctcaactaatagtacttaaagggtatttgcttgcattaaagtcaggttgcagggttagggaagtcaaacttttattctaggtttgaaattaacctataacttcagctggattaaaagtctacagttttagattgggtcctgtaattttggaaagtttagtcaaaatcccattttagccttggtttttactaagatgcaaagggtattagtatgtctcaatatgaaaataccttagagtaactttctcaacctg

SEQ ID NO: 130662 - DNA, 302 bp, Homo sapiens
ccccttatcagatatacaatttgcaaaaatcttctcccattctgtgtgttgtctccttactttcttgatagtgtcctttcaagtacagaagttttacattttgatgtggtccaatttatgtattttttcttgtgtttcttgtcctctttgcgtcatatctaaaaaaccattgcgtaatctaaggtcacaaagatttacacctacgttttcttctaagagtgttatagctttaactctcgcatttaaatcttgatccattttgagttaacttttttatcggataagtagagggtccactttcc

SEQ ID NO: 130663 - DNA, 387 bp, Homo sapiens
tgttcagggagtgaatggggtcataaaagtcaatgcagttgcctatttagagaatcctaccttgcagaatgggacctttggtgtcagggtgtgaacaataactttatttcaacataaatacatagtaagcattactaaaatttaaaaaatccaaaccctatcactaccggaacttaaaatatattagaagtggatataagcagaaattctatctagatacataacactatcatagtataacatttgaattagaatttaaaattttgcttctctttcttattggtgttcagtttagctcttaataatttagtgtttgcctagtgctctagttaatcttcagaaataaacatgcactgtaggggctcactctttctggtatgctgaggt

SEQ ID NO: 130664 - DNA, 195 bp, Homo sapiens
cagaggaaaaaaaactgccttagtctagtgaaaaaggtatccaatataatgaaaataacagtcgtggcatgcatctaaagcagtatttgtagaaaaatttatatgctacaaatcccagtggatacagttaaacaaaaaggaaaaaaaattacaaagctaaaaattcattagaaacaaagaaaagtcttaaatcta

SEQ ID NO: 130665 - DNA, 299 bp, Homo sapiens
aaggctccccttgtgtcagattagtacatagcggtacaaggaggaggcagaaggagaccctatcttttttaaaaaaaaattgtaaaaatcagccaagtgtggtggcacacacctgctacttggaagtcccagctactagggaggctgaggtgagaggatcacttaagcctaggagtttgaggctgcagtgagctactatcataccactgtactgcactcctgtctggatgacagagcaagactctgtctctaaaaatacacagatacaaataaatactggcttattctccagttcttaa

SEQ ID NO: 130666 - DNA, 378 bp, Homo sapiens
tacacttctacttgtatctgtctctcaaatagtgtgaaacaagctctgtggctctactgtgatctgcacggtggacagccatgtgtcccattcaggaaaaacactgtcaggaggcgaggttcagggctcaggccccagggcagctgacagtgctgccctccctgcttgcttctttgtgcgtgggtaccatgctcactgcagtttatatgcgaatgtgtaatggacatgcaggttgtattatctagttgtaatcaacaaaccctcagaaaatgacaagtggttttatgagatttctaaaaaacccagattgaggctacagttgccctttgaacaacattggtttgaaatgcatggattatcttccgcctctgctgcccc

SEQ ID NO: 130667 - DNA, 335 bp, Homo sapiens
ccctttagtatccagttgaaacatcacctcatttgtgaaagcttcctgtcatcaaacccaaggcagaattaattactctcctctctgaccttacattttcctactagatagaataattacctgtttatgccatacttttttaaatacgaatttcagtcttcaaggacctgaatgtgcagcagttttaggtaatctcttcatatcacttccctgcttatgacctttcaataggtccctcttgtctactaaacaaagttcagattcctcagcaggaagtccaatccaagtctaccttcaggccccttaatgcctctttaacctctctcactactccc

SEQ ID NO: 130668 - DNA, 652 bp, Homo sapiens
gtgaaaaacccacagctgacactatagtttgtagtaggagactgaatgttttctccttaaaatcaggaataagacaaggatatctgttcttgcaacttgtattaaacattttactggaggctatcactagggcaattaggcaagaaaataaaaggcattcagattgggaaggaagtaaaactgtctctatttgcaaatgacacgctcttgtatataaaaactcttaaagagaggagactattaggattaataaattcatcaaggttgcagtatacaagacaaatatacaaaaatcaattgtatttctaaatactgggactgaacaatctgtaaataaaatcaagaaaataatttcatttatgacaatatcaaaagaaaaaatacacttagaaatatacttagaaaaaaattaacaaaataagtgcaagacattctctgaaaactacaacaaaatgttaagataattcaaagacctaaataaatggaaaggcatgccatggtcatggattggaaaatttaatattgttaaggtgacaatactcccccattgatctatagattcaacataatccttatcaaagtcatagctggcttctttccagatattaatgaaatcctaaaattcagatgggaattcaagggacctagaata

SEQ ID NO: 130669 - DNA, 236 bp, Homo sapiens
caggatccccggccgaccagtttcctgagcacctgttacagtgtcagtactgggacctccggtctttccttactttctttctttctataatattttcacctatcctatttcattcacagtggaggttttaatttacttcaagcagtattgccatctggatgtcaaaagacattgaattgacttcttatctgtagatcccaataaaggtctcacctgcctagaaacaaaagatttag

SEQ ID NO: 130670 - DNA, 412 bp, Homo sapiens
agaaagaatttgtagtaaaggtcaagaatccaatagcatttatctctgaaattctgggagaaatgataggcctcactcttaccacttacacactatatcctaggtgtataacctaaatacaaatggagttttgagatgtttttagaaggaaactgtgctaaggaggctcttaaagatgcttgaatctcattgtattggtcagagttcttagttgcaaaccagagaatccacttaaactactttagatagaaaggagtttgtcaaaagacgttagtggcttatggaccctctggtgtagcctaagagtcagatttggccatttcacagcaggaaaaatgctcagctacaccatggaactattctagtgaaatatactgcagcttacttgctcttgagggggaccaaaaaaaaa

SEQ ID NO: 130671 - DNA, 496 bp, Homo sapiens
ttagggacatgtagcccagggtatggtagggtatgagcaaattcctatcagacagcaattccagaatactagtttcaagtgtgtaagtttttggaggtggtctaaatttcaattttgattgtgactgtatgctcttgaatgaggccacttgtttatgactccatctgcctcacttgtaagaggagacagtatcagttgcaatcaatgaacctagccaaaaaggctaactataaatatttgctgaatgcttcaacattcttaggggaaatagataaagttttaatgatgtactttcccactgtacttgcagccaagttgaattttgtcatattcttcctagtgttaacatttaaaagatgtaaacattttcatcatagtatctaaatatagaactcattttgtttcccacaattaaatataatcatcagaaaggaaaatagatgattaacagaaatgtaaatggtaagttatttagtcccctctcaccaaaaccaat

SEQ ID NO: 130672 - DNA, 376 bp, Homo sapiens
ttatgtttctcatcttattgatgatcacttgttctttgcagaaatttcaattaaccttaacttgtcttttcttccttattcccataagtagtctttcactaaatagccttttaattgaaccttaattcagaccccaggtatctctttctaggattattgtaacacccttcaaaactgttcttgttctctgccagtcattctatacctccatatattttcccacatgatatttatacttatctttctaaaacacaaatcttatcatgtatggcatgacctctgatgctctaactcatcctacacttcgtttactgtctctcacatggctaatcttgcctttacatacctctgtgttttttctctcaactgttctctc

SEQ ID NO: 130673 - DNA, 173 bp, Homo sapiens
ccacatgtaactgcaaacaaagcacataaaatctgaaatgttatacctaataactcactatcaaatgtaagaaataatcttttaagaaaaatgcttagagccaagcacaatggctcacacctataaatcccaacaccactctgggaggccaaggtgagaggatcgcttgaggc

SEQ ID NO: 130674 - DNA, 680 bp, Homo sapiens
ggctgaggcacaataatcgcttgaaccccggaggcagaggttgcagtgagccaagatcatgccactacactccagcctgggcgacagagtgagaatctttctccaaaaaaaagccatccgtgtgggtggggtatgtaggaaaagcatgagactctacctgtcttctttgaagttctcatccacacatggttccaagtaaaaagcttttcttgtgtatttttaatgtacccccaaacctctcctcctttattttggtttcctaatagaggagctaagttacagatgagagcctgagtcttagaatataaacttcaagcatctggtaaactttactattttctctctgcttcattaaaactggaggaaagatgtcaactagaacttggtttattcctgttttggtggtaggataaaacaacaaagatcttaatattgttcatctcctattagaatattagctagtaaggcaagaaattagatgggtagctgtatgttgcacttttctttgatcgtgagatctcaaggtaacaggcaatgggcatagcatagggcaacgaatcccacagagctgtcctaataatgtatatccttcatgtcttcaaagtgatgcaatgtcagcagtttccatttgaaggctaaccctttgtagtgcccttccctatgtaagtattcagtcttga

SEQ ID NO: 130675 - DNA, 734 bp, Homo sapiens
attcatagctttaagtgttccttgcaaattctcatgaggtgcagtttatggtaacaaaaaagctcatacacacacatgatgtggtcagtagttttgggtgtttttttatttatttttttgagatgagtctagctctgtcacccaggctagagtgcagtggcacgatcttggctcactgcagcctccacctcctgggttcaagctattctcctacctcagcctttcaagtaactgggattacaggagcgtgccaccatgcctggctatttttctatatttttagtagagacagggtttcaccatgttggccaggctggttttaaactcctgacctcaagtgatccacccacctctgcttcccaaagtgttgagattatagacgtgagccaccactcctggccagtttgtttttttgttgttttttgtttgatttgagacagggtctcactccatcatccaggtggctggagtgcagtggcgcaatcatagctcactgtagcctccaaatcctgggtttaagcaatcctcccgcttcagcctcggcctccaaagtagctgagactacaggcatgtgccaccatgcccagctagttttgtttgttttttagtggagatgaggttgtgccattttgcccaggctaatctcagactcccagcctcaagcgatctgcctcagcctttcaaaatgctgtgattacaggtgtggacactatagcctctggtccattttaaga

SEQ ID NO: 130676 - DNA, 210 bp, Homo sapiens
ctccagcacagctcttcatcctctcctcccctgcggcctttcctatccctcaccctgacccccctgccctcggcccccacctcacccccacctcccaacacccaggccacctctccctgtccctccagcaccgcctctcttttgagcacagctccacttggcctctgcacccttaccctccctgcactggggtctcctcgccatcttttg

SEQ ID NO: 130677 - DNA, 450 bp, Homo sapiens
ctgaaagggatgatataattccagctcagtcacactgtgtcagagtgatacaatgcaaagatcaggagacccgagttccggtcctgtatttgctgccaactagcagcatgagctgaggcacatcatttaatctttttggaattcatttttctcatgcctagaagaacagaagtggattgtattccttcttgccttcttttcctttcttctttccctccttctttccttttctcttgctcaaacatgtattcactaccactcaaaaaccatttgttgaacaaagcaaacaaatgaatctcccaagccttgggcttcatcctgtgatttcctcaattcccacctgccttaaattactcagtgaagccctgtccttggagaaaattcagtgggtggttaacccagagaagctggagatcaaaaagaagatggccaatgaaagaacaaaggcca

SEQ ID NO: 130678 - DNA, 526 bp, Homo sapiens
aatcttatgaacttttgttctctcatgctttccttatgtatctttcttcagtttttaaatgctcatttattttaatggcaatccatcctcttttatgctatttggtttatacagttattgttttgtctgtcttatgcattatatctttcaaaatcatctcacttttaaatttatgtttaatgtattaaatcaggaaaatagatgcaacaaaaggggccagctctgattaatgatgggtgctatgaacaaaaagatgagaaatgtggcacacatgcccagaattcttattgacttagtttatgataaacaacaataaaaatgtgcaccactaacaaccaaattgagagtttggtcctctgaaatataatcctggttttacttctatccagggactctgcagtaacttgagtagggcagaagttctgcacagcttttgaagtccaagaaatggaaaccagttgttttcaaaagtgtaataattctactgcttactttattcttacatcacagtggttgtccctgataa

SEQ ID NO: 130679 - DNA, 328 bp, Homo sapiens
gccggggcttggggaggggaaggggagtgacagctggtggggaccagcttccttgctcccttttggggcgatgagacagctctggaaccagagagtggtgatggttgcacaaccctgtgaaggcaccaaatgccactgaatttcacggtgtggggatcacagcggtgtgggaatcacagctcaatgttttaaagggggagaaatctacaagagctgtgttttgtgtcgctggacagggagttacggtcttcctgaaagctcctgcgggatggtaatgagttttccgcccccatctcaggacacaatggacagcccagaactttgaggt

SEQ ID NO: 130680 - DNA, 306 bp, Homo sapiens
gcatgttaatgagatctctaggtgtattatgttgcacatcaaagtgtgagtagcgctggtttaggtgacacctggtaagaagcaaaggtttgctttgaagcatattccttagatattgctgaacactatatttccctttatgctttcacagatctactatcagttgtgcctcagttatattaactataattcccagttatgaaaaacagagacatgagaagaatttaacttgcccataacaactggcaaaattaaaacggaaggaagagaatgcagaatgcagactcctctgcttccctttccttt

SEQ ID NO: 130681 - DNA, 617 bp, Homo sapiens
tctcccaggctggagtgcagtggcgcgatcttggctcactgcaacctccacctcctgggttcaagcaatcaattctcctgcctcagtctcccgagtagctgggattacaggcgcacaccgccacacccagctaattttttgtatttttagtagggatggggtttcaccatgttggccaggctggtctcaaaatcctgaactcaagtgatccacccgcctcagcctccgaaagtgctgggattacaggcctgagccaccgtgcctggccgtctcctctgacttttaacagcgacacccatccttccaccttctgtgctggggctagcattgcccttgatgacactttgtcaagttcatttcctggcatgacaatgtatttggcttcagcaaaaaggtggtggtccacactgtctccaaggagtaagaccctcagaccaggagccccagtgacagtatgagaggaagagagaggccctcagctgcttgggagtccctgctgcactcagccccccaccacactgaaaatctccccatacacagtttccatgccagaccccctgaagaacagggcctatcaataaagcagtaaggtcctctgtacttagaccaaaaacaaa

SEQ ID NO: 130682 - DNA, 582 bp, Homo sapiens
ttatgccttttcatcgccactgcactttcctaattatcctacctctgatggagcctcttctgattcctcttcttcctgacatttcttaattgtgagtttcccaagcctcaatttctggtcttccattttttcctctccatactcttaccttttggttaattgttcttacctcaaatcttcaactagttccagccagcctagccatagtcccagatggcatttctagaaacatttgcactaatcagtggcaaaggtatttgtttttcacaactaatctttacttctaaaagtagtatttttgcaagcggttataagaaatgagtgtagggggccgggtgcagtgggtcacgcctgtaatcccagcacttggcgaggctgaggcaggcagatgaccctgaggtcaggagttcacaaccggcctgaccaacatggagaaaccccgtctctactaaaaatacaaaattagctgggcgtggtggcgcatgcccgttatcccagctactcgggaagctgaggcaggagaatcacttgaacccgggaggcagaggttgcggtgagccaagatggtgccactgcactcca

SEQ ID NO: 130683 - DNA, 402 bp, Homo sapiens
agtaacatttaaacaggatacgcacaataatagagaaagtcagctggtcatgttttacaggaaatatacaaaacaaaacaaatgaaaacatttaaacattaaatgtaactaaacccactgattggttagttgattaattactacttattgagcacttttaatggaccaggcactgttctatgctttgggattagtttcactgttttatagagaagctctcattaaaggatgaagtcatggttttcttttaaacatttccagtcacgctctatttcggcatctggagaaatcctgtcatggagcagcactccccaggtcaaggcacagcggccttcatgaacatccagggtcacctgtattaagacggtcctccccactaatctcaggctgtggacagtgaaa

SEQ ID NO: 130684 - DNA, 472 bp, Homo sapiens
ggcgagactccgtatcaaaatcaaacaaacaaacaaaaactttcttaatttaaataccaatacactttagatttttgcaagatatttttatatttttagatcatatttttttgagtgcttgttgtttcaggctggtggtcttatccgtttagacatttagccaagtcatgcttcccatttttctgctttgatgtgtggatgctccattctctcggcatttgtatccctcctctagcaatgtcacctcttccccacttttctcacaatgtccccctgaggtttgagggttcctactgacagttaacaccatgaattaaaagtcataaagttttcattttaggcatgttcttctcactattgtacagcatttttattgatttgctaactgcattggattaatctgctaactgcattacactcttattaaattacattgctattccagagaagggacagctaaagctgaaatcct

SEQ ID NO: 130685 - DNA, 529 bp, Homo sapiens
gatgaatttttcccctaagcattctgtagagtgaggtgatctttccaaaaggcctcagctgtcagccttttttaaaactttaaggtaaattgaactttgatttagagtaaaaagtgaagaaccaaattaaataaactgatgttccttttcttctaaaatgttggttcttttgaaaacatagcaaacatagtaaaatagaatatcagcaacccttgcaatgtcagagctagacatccagcttttcctttcctttttgaatagtgggggagaggggagtggacaggagtgggagaagcatagagaatgaatcacaaccataagtaatatcatgctggcttgctttacatttttacctgagaatctcttgatcattaagtatcatgccattttcacgtctacattcttttttatggtgggtgggtgggtgtggaactagaaatttttattactgtatttaaggatttcatgttgatcataaaaggaaacggaagaccatagaccatgttaatacccaaactataattctttt

SEQ ID NO: 130686 - DNA, 263 bp, Homo sapiens
aggatttttttatccttgaaagtcttccaagctatctcaagtgttctcgtgggcagtagcagcagcagcagcaacagcagcagaaggaaatgaaggagtacatggagagaccaaagcttagagtgtcagtggggtttgaaaggatgcccctgaataaaatagaaaggttttaattcataaatgccagcataaataccccctgataattatgacagagtggaaagaaaattaaatatgttgaatttttgtcagataattttgaa

SEQ ID NO: 130687 - DNA, 375 bp, Homo sapiens
aggctgaggtgggcagatcagttgaggtcaggagtttgataccagcctggccaacatggcgaaactctgtctctattgaaaatacaaaaattagctgggcgtgatgttgcatacctgtaatcccagctacttgggaggctgaggtgcgagaattgcttgaatctgggaggtggaggttgcagtgagctgagattgtgccactgcactctagcctgggcaacagaatgagactctgtctcaaaaaaaaaaaaaaaaatctatagcaaatatcatgcttaatggagaaagaagatgccagctatcaactttactaactagaaatgtaaagtgaaaaggtgagagggtgtagtgaaagaggggtcctgcacccaaaat

SEQ ID NO: 130688 - DNA, 640 bp, Homo sapiens
actggtttccgtctgtcctgggcggccccgcgcgggccccacactggttgtgcgtttctcaggccaccagcagcgtccaagagctctggccgatctgcctccctccctgcgtctcggcatctttgtctggcactgctgatggttttgcctaaacggctctttgctgtggggcatcctgtgcaccgtgggacgtcttgtgcactgtggggtgttgagccgcatccgtggtctccacccacagatgacaacgacacccccagctatgaaaccagaaatgactccacacattgccaaatgtcccccagggcaaagtcacccacttgggcgttatgttacccactgatgatctgaatttttgtccatttcacctgtctgagtttgtgtgtctctgagcactggtgggactgagcgtgtccgtggcttgtggccactcctgcttcctgtttgtgaattttatgttcataacgtctgcccctttctttgggtttttcactttattcttattattttgtaaattccttaagtattctggatacttaccttttgttattctattctagtagtcactgtccccaaaacaatgttcataaatttgttcttataaagatgagaaataaaaaacattgaattttaaactgca

SEQ ID NO: 130689 - DNA, 710 bp, Homo sapiens
gaatttgattgcttcacatccctatagcaactctcctggttcaagcccatcatcatctggatttttgggaagtggtcttaactggtgtgctgcccttcccctctgctctcaaccctattttcaacatagcagtcagaataatctaaaatataaaccagatcatatcactcctctgctcaacaccccctcccaataccttcatgtcatcctcagagttattgtccaagcctctaactgtggtctacaagtctttacatgatctgtcctgttacattttccactctcgctccagacctgacctaagaggcttttctctgaacttgctaaacatgctcttacctgagggtccattcccactgcctctgcctggaatgctcttccccagacatgcatctgcgtggatcatttccatgcctcctcaggtctttgccctcatgaagccttccctgacaaccctatttaagattgtaatcccctcccacagtggcccctatctgctagagactgaatgtttttgtccccccaaaattcctatgttgaagccttaatctcaacataggaggtttggcctttgtgagttagttttagatgaggtcatgtgggtaatagaattagtgcatttataagggcgtgaagagccctcactgtgaggaaaccagaatgtaagccttcaccagaacttcttcatgctggcaccctggtcttagact

SEQ ID NO: 130690 - DNA, 182 bp, Homo sapiens
agacttttattacctgtgcacaacgcaaaattatactgttggtttaatcttgatttaattgatgtttacagtgtcttcaaaaagatgctataaaaggtactgagacaaaagtattatttatgcaggcaagcattgagaatatgccaaagtcatttgtatgtaaaaatctgtaagtttaagaa

SEQ ID NO: 130691 - DNA, 402 bp, Homo sapiens
ccatttggcaatatctggggacattactggtttgtcataatgcaagttcatttttatgtcatatttttactgtgtactttttgcattttcaaatgactttgactattgccagagtcattatagacctgcctatgatgtaggagtttattgtatctagtggaaaacatacctgtttgtggggcagaagcttctgttccattcatcctgattttagacacagcatttaacttttcaggttcagttccatatgtataaagtagggataatagtgacatcctagtgtattaagaattaaggtgttattatttctgtcactgttacttcaccctaattttgtttccacactcatctctgagcttttttacttcttatgttgttcagtgttttctaaattaaaaaaaa

SEQ ID NO: 130692 - DNA, 105 bp, Homo sapiens
aaaaagattttagagctgaaagatatccaaatattgtaacatggggagaccgaaagtttctactcctactcttagcaactagctttaaagatttcttctggaatt

SEQ ID NO: 130693 - DNA, 248 bp, Homo sapiens
tgcagataaccacagcctgcctctgcaccgggtcctggctgtcccttccagacggacctgtctcttccactctgagcctctctgagcagaggtcccacagggtgttagtgaccagagatgctgccggttgaggtaccactccccccaaagaccccaaggtggaccccaagttcaaggttccgccttacctgagccccttatttctgcacacattcctgccctctacattctggccctgctgcctcccc

SEQ ID NO: 130694 - DNA, 466 bp, Homo sapiens
cataattgtaaccatattttcaaagtctctttcaccacataatgtaacatattgggggttttaggaaataggacatggacatctttagggggctattattcttcagaaatgatgtaatttcataaatgtttgttgttttaaactttcactttgtcacacgataatatacattcgaagaggaaaagtgtcctgaagttattaaccaggatacagttatatataaggtgttcagtatatcacatatttacatacaaacacacatacttgacaaggtattatattagaggctataggcattatagcatttttcatacagtatctcataatactctgtcaataaccatatattatctataagatgaaactccaggtcattggtagtttagattaaatcccagttatttcaaattcaagctatattatgacatctgtttctctttttcttttaaaatctaaagttccaggt

SEQ ID NO: 130695 - DNA, 395 bp, Homo sapiens
ggaaggggaccccggccagcctgaagtctctcattttacacagcaggtggtagagccctaccaccttttagctgtgtgcttttagcaatgaactcctctgtttgtgtcttggtttccccatacgtaagtaggggtaatcataaaatgacctgtgagtaagaaacaacacatgtgcacgtgtgggactctcccatctcctcacagtactcagtaaacattggctagtattttcagagagaagactgcagacattttttgaagcatacagagctttgtttaacaaatactaagaatttttcctgcttaaatttttatcacagacaaagagtcacatggtagtcaacgacctcaaggtatttttatagcacatgtggagattagttttgtatagttat

SEQ ID NO: 130696 - DNA, 389 bp, Homo sapiens
taagttcatctatctatcgaacatttctatgttctagttattctttgaacaactgccttcttatagataagaaaattttcggtttgctgattggtaaattggtagttactcctccatttttggttcttgttagttttctaacactaggttcaaactcttgaagaaaatattttgttctgcatgcacctttgcagaattcttcgaaaatttgctggcagaatagttgtagaaaaccccaattacagataataattttgccattttcctgatgacccctagagaggaataaatttgcaaaattagtttaattttgttttactcctgtgtcttgtgctttctcatttcctttcctcaagttatagaaaatacataagcccaggtcgacgcgg

SEQ ID NO: 130697 - DNA, 460 bp, Homo sapiens
caaagcctgccagcaagggatgtttcatcttagcttatctgtatactcaaaggatttattgcatcatttacttccattatgggaggaaaaataaaagcagacactcttgggtatgtatgtatatgtgtttgccttttttaaaacaatgaagttgatttattaccttctgggtttaaaatcttatctgagccttttctgcccctaagattctgtgattctataatcagaaatagcttggggaatggataattattttgtaaaggaatctagaaaacttgtctttgaatatgataacagtgaaggtaatattttcattcccagataccccagttttattatctttttttgctagttttattttgttttcttataaactattatcaattttggtaacctggaaaattttattggattctccaaataactggattataaagtatttatggaattatcagagttg

SEQ ID NO: 130698 - DNA, 269 bp, Homo sapiens
aaaaaaaaaggacctcgagaaagggtctgagatgagatctgagggccactcacatgaaagggatgggcaagaggagctcagaggaaggctctggaagagaggcaggaagagagaccgtcatgggcaggggctttgacgcaagaggttccacagtggcttggcccacatgtcagggaggaggagcgaccattcagtgacaagagttgctgcagcccctgtctgtccatccatctggggaggactggggacaaaagccaggctggagagag

SEQ ID NO: 130699 - DNA, 728 bp, Homo sapiens
cctctttctcagggcagcagagcgggtgcagattgcaaatccaccaatggtgcacaagaaaccagaagggtgacagaagatggcatctccacgatgatcaacaagaacaacaattcatgtgtgaatcacttctttggcttttggctgagatcaagtgcaatgcacgtgtgacctctcgtcctctggtgtctctgatgattagatgaagacagttgttaaaacaaagtcttgtttcagcaccaagctgcaacagacatgaactttcaaatggaggtgccaaatgtccacgtgcagatattcatcaggaatttctgagaaacttgctctgaaacactgagactctctcaactacttgaagaatagaaacccaatctctactaaaaatacaaaaattagccaggcatgagccaccgtgcctggcccaaatgtcactcttcttataaggacaccagttgtattagattaagggcccaccctactccggtatgaccacatcttaactaattattgcatctgcaacaacctcatttccaaataaggtcacttttttgaggtgctgggggttaagacttcaacatatgcttttttggggaacacaattcaactcatagcatagggagagaaagtaaaggggtggggggtaacgaaaaggtgagaagtccatcttctgaggtccatcttcccaaaacccctgtttctattctactcagttggtctgtatccttact

SEQ ID NO: 130700 - DNA, 275 bp, Homo sapiens
caaatactgcgtgttgtcacttatgaatgggaacgaaatgatgagaacacgtggacacagagagggaccagcagacactggggtctgcttgagggtggggggtggaggagggagaggaacagaaaaaataactgttgggtactgggcttaacacctgggtgatgaaatagtctgttcaacaaaccctgatgacacaagtttacctacgtaacaaacctgcaacccgaacctaaaacaaagttaaaaaaaacgttgggtttctgcggagagaccac

SEQ ID NO: 130701 - DNA, 447 bp, Homo sapiens
cactgatctcatcagaaaaatctgttaagtattgggcacctttcaagttcatggtgtcaggttcaagttttctaaaattttaatttttctatcaaagctcaaattttatcactggcaattaacattatcagtcttccttgaagtgacatgcttggtttttcaagaaaatgcttgttaaatataaaaaatctggataactttgcatgagtccatcacactttcaaacagatgttttatgaaaaaagcagctagctcagctcacaactcaaaccacttgtccattttctcaaattaaccatcttactgcactaaggagagaagaaatgctttatatgaactcatttcatcacagaatataaaaagacatgaatacaagatctgtgaaattggtttttttagttttgggttttttcttttatttatttatttatttgagacagcctatca

SEQ ID NO: 130702 - DNA, 356 bp, Homo sapiens
aatgtctgggaaaggcattcgtcatctctgttactgtgttttttatttctagcctttgcatttgactcttgcttttttttatctcactgctgaaatttcctgtctcttcatgcatattgttcagcttttccactacagcctttgacatactaatcatatttatgaatcatattaatcttagttattttaaattccttacctgttaactgcaataatactgtggctctaatttcatttcctatttttttctcttgattatgggtcatatggacatgactctttcacatccctggtgactttggattgaatgaatgttggacattgtatattaaaaacaggagatgtattcatctgtt

SEQ ID NO: 130703 - DNA, 426 bp, Homo sapiens
tttggctaattacttattttttgagacttggtttccttacctactaaatgggaatactgacagtaccaacctcagaaagttattgtgaggattaaagcccttgcatagggcatggtacagaatgaatgcccaaagtatgcaattagtgttttagctttaccatgcatttcatgtcaagttgcctgcacataccaagctacttaatgcctacgtccttttacataggtttctgacttaggatgctctccccagaatctaccacaaagttccccaccccacttacttgggtctgacaaatgcttactcataatggaagatccacctccaggatcaaatccctcacatggaattatacttctcaacctattttataataactccttaaccaggccttgagatcactaaaggaacaacccatgactcatt

SEQ ID NO: 130704 - DNA, 672 bp, Homo sapiens
gacttcttaaaatcaacacagggtcatcccttcaacgattccaatgaacgctctatatcctcaccaccgcccaattagactcactgttgttgggaaccacaattactgataagagtgttatatccttcaggttatcgtcagatagaaaaaaggaggagaacccttcttgtagaattcagaacagatagtggtccatcagggaacagaccgcctcccacccactccagtggctgcttcatgtcacatgctgtcctctgcagcgagaaagccagctccctctaggagtagcactagttttaatcatgtgctgaacttaggcagagataataggctagtcatggggtgctcctatgaccctgggcttgctaagctttaattacatcagatatcgttcctgccttaacggatccataaccttggagaccaggtgccttttgatacttttcctccataagacttcctcaagagtcactgttttgatgacatttgagtcctgaactaagaagctaaaaacctgaattcctaggtggtctttgacagattctggagtgcctgcatgaagtgtgggagggccagaagtgctgggagcatttccgaaggggaattcacagctccatttacccagaggcatcctgattctccccagtgcagagctagcctagggaccaaacc

SEQ ID NO: 130705 - DNA, 547 bp, Homo sapiens
attttaaatgaagactttgtaatttccagtcttctaatttcagaaaacagagttttacagtagaagaacatggacttatggatgagaatggaatctgaattagtcattgcttcttagaatcaggcaagatatttactctttcgttattttaggtaaaaaggtactgtgaaaattgaattaaattggaattaatgaactagagttatatttccagcaaaggtaaaattcaaaaacgtaagggttagaaaagcaagttgtagaatgactagtacatgacaccatttattgaatgttaaacaatagtataaattgcttatgaatcacacatatggtagaagtatgaaatgtgctttagagtgacacactcgtatttcaggatagtagtcatctctctaaatgacagcagagtggaatggaataactgtatctgtagctttcttttttaaattattattcaaaagcccgaaggaaatgtagcaaagtgtcaagatttgctaaaggtggctgatggataaatgagtactcgtggtattaattctgttgtgtg

SEQ ID NO: 130706 - DNA, 574 bp, Homo sapiens
gatattcacagggacctgtgggggtaaggggctggggtgtggactaggtttgcatctcagagaacatttggaagctggaattagggagctctggtctggttctcttgtccccatctcttgctggtgatccagcagagagaagaaaatccctgttacactcctctgtttgctctcatcagaaaactaaacagtggacaggcttaaagattatcccacatccaggactgggaaggctgagctgggacggccaagacaggcctgaaagccagcaggaaagcactgcgtgtctaggggagattgtaagattcaaagggcaagggccacacctatcttattcactgtatccgaggccctggcaatttcttagggctcggtcaataatgagccctatgattaggagtatcctctccatcatgtaccccatgaagtatggggactaacatatgcatagacaatcaactgtttggaattatccacagaggattttgaggtttggtttggttttagcaacaaatgcacttttttatccttgactagcccatggataaaagcccataatacctttagtacttca

SEQ ID NO: 130707 - DNA, 463 bp, Homo sapiens
ggagtcaaatgaagaaaacagaagtaaatctcttatactacaggtgccaacttcagtaacctgtggtttaagttaagacaggctactggggaggattattactactactcagtaagagaactctgtctcaaaatctcccccactcaccccagctgccttcccctggctgagtctcaaagaagagcattctttgagacctatctggatatacgtgaggaaacagtttggtagctgctgctttcaggagcagcaatgatttcaggctttgccagcaggtggcattataacttactttatttccacagcaacgttttggtctagggacccttttacactcttaaaaaaatcattgaggactccaaagaacttttgcttatgtaggctgtatttatcaatatttactgtatttgaaattaaaactaatagatttcttaaatgtaataaacccgctacatgttaacat

SEQ ID NO: 130708 - DNA, 623 bp, Homo sapiens
ggttcatattcttttcttccttggaagtttcccaccccaccccgaattaggaagttcctcagggacagaatccatgtcaactactttatcttctgtctctccatgcctagcaaatgctaggtgtttggtcactgagtagatgaatgaatgtacatccctgaccttcacccttgttccttgagtggagaaaaaagaccccaggctgtgtgtactcttcatttctggaatgagggttcttgtacatcccatcatcagctctcctgggcttttattctgaaggctagtggaggcacaactgcaaaagactttgcagatacgacgtgtgaaatgccaagaggaagaaaaattgaaagcaggagttgcatcttgccatgtgatgtgaatacctttctggcactatgacagtctcctcatggtgggcagtgggataccatgtgagaccaagcaagggcccaagtcacctgcagctctgagatgcctgcagaattctgtggaaaacttcccaaatgcacttagaccccagggttttgatgatgttgatggttctctgttcagttttttagtttctgtcaaaatgtattatctaaactctttactcagtcctacctacaaaatacactttc

SEQ ID NO: 130709 - DNA, 169 bp, Homo sapiens
gatactccaattagcatatatgagatgggaaaaaataaagagggtattttctaattaattgaaaatcatgcttagatttagaatggtgtttcccaaactatcaggtctgtaagttcacaagaaagaatcaccaccatttttaagtaacaaaaataaaataatattttga

SEQ ID NO: 130710 - DNA, 586 bp, Homo sapiens
tagggaatgggtgctgggagaagctattggtcgctggatgccggtgattgctgcacaccgcaggagctaggcaatggagaagctacgcgtactgcaggagctagacatggagaggccatgcacgctgcaggaggctagtgccagagacgccacccgtgctgcctgcctactgaacacaccagaaccagggtgaaaaaagcctttccttctgcagtgtctctccagcatcttctactaaccactgttaacatcatgttagctggcaagggaaacacgtttaagggcccagaaccatttttgcatagcaggcagtgaaggtgggtttggggctgagaggcaataaattaataactgactgtctcagtgagtttgggctgctgcaacagaatactatggactgtgtgtcttaaacaagaaacatttattgctcacagttctggaggctggaaatcgaagatcagggtgccaccatggtcaggttcttgcggagggctctcttcctggtttatagacagtgactttcctgctgtgtcctcatgtggcagagagcagaaagagagcaagcactcatgtctctatttacaag

SEQ ID NO: 130711 - DNA, 248 bp, Homo sapiens
gaggacgtggaggagaggggctccaccgccagggaagagaagcccagaaggaaggccgcagcactggcaaagacagaggtgaggctacagcgagtgctaaccagactcagagatcatggagcaaagcagagaggagcagctgctcatcctaagttattgaattgattggtccctgctcccctctttggttcaaggggcgctgaggaaggggcctggacacaaagacctctgtgccccgaagagcttgg

SEQ ID NO: 130712 - DNA, 429 bp, Homo sapiens
caggctgtcagcccagagggcgataacatgagaattcctgttgtgaggtcattgtcatgacctcatagccaggctgttcaaaatgtttgcccagcttctgggaggaatctggagctgatgactcaagaaatgtccttcctcctaagaaattatcctcccatctgagattagcagcatctaatctcagttttctccactgctgaccagcatcagcaacacaggtaagcagagacaagcaagtccacctaaatagctgaacaccagtcatgtacgcatatctgtattacctgcaaacttctggtacgcaagtttttattttggttcggttccaaacactttttcttagtattctttactggaggattgggctacatttaagcatccccgccaggcgtggtggctcacgcctgtaatcgcagtactttggga

SEQ ID NO: 130713 - DNA, 234 bp, Homo sapiens
tggcccggggattagtccctttgatcaatccgttccgggatcccggataacccccaaaagggagagcggcgtggcagggagggaaagaagtccggatgggccctctcagaacacaatgtccaatagctgagcggcccagggaccgccagaaacaccaagcgcgggttggagtctgaacccgaggcgcctgcgtccctcccgcagggacccccacgctccaccgggtggggccca

SEQ ID NO: 130714 - DNA, 754 bp, Homo sapiens
ttggggcaaatttttcaaatacaaacatcagtgaatataggcaaggccttttcttttttattattctattttaagttctagggtacatgtgcacaacgtgcaggtttgttacataggtcgacatgtgccggcaacgccttttcaataatgtcttacaaggagaaacgtggctcctctaggtgagcagccctcagtgcgcatctccctgaagtccacattgatccggcagagctgtggggttcacatctcacactgaggcatttagggcctaaaccccactttactcttttgtacaatgaatgggaaatcagtgatctaaatgagtttaaatcttattagggattcagactgcccttcagactctgtctctattcctcccagagctgggttcaacatgaattcaaatagaaatatgagacaatgaattatggtagtgacaaagaccttccttcgaattccggatttttctagcagcccctttctttctgcttcccacctgccttcaactctttctcctaaaaaagttcagttggggtgaagtttggtgacttagaacatcattattttaacgtgatcccaaagcagttttcattatatgcaaagctgcatatttattcacattttaaaaaatgttctaaattggtttcttatgtccaaaagaaggggagctagttataagaaaagagaactgagtaacataagaaagtgctaatcatttcaaattaaagcgggaaacatgcaaagcagaaagaat

SEQ ID NO: 130715 - DNA, 256 bp, Homo sapiens
ggtgagacagagatgaagagacagacagacatattggagagaaacagagacagagaggaagggggcagagagacagagacagagaaacagacagagacacatcggacagacacacaaagaaggcaaagggagggagagacagagagacagagacacatcaaagagacatgcagagacaaagaggagaaagggatggtgagatagacatgaagagacagagacagtgggagagactgagacatcagagagacagagg

SEQ ID NO: 130716 - DNA, 642 bp, Homo sapiens
caactgaaagttgttttctgaagtaaattatctaagaaaagggaggtcagagccctggagtcagaaagaaacctatgtaaaacttagttaagctgaaagaaacgttaagaccttttgggtcatatgttcttttcttttcttttcttttcctcttttcttttcctttctttcccttcccctcccctcccctcccctctcctcttctcttctttgcttttctttttctttctattatagaggcgagcgtcttgctatattccccaggctgtcccgggttcaagcaatcctcccaccttagcctcccagtgtgctggaattacaggtgtgagccaccacacccagccacattctcttgatgataacttatcactgtagcttccaactgctgctcctgaacttccccagttgttttactttccctgcaggctgttgttgctcattttggttttcttctctcagaacaggaaggaagcctcctgtttactgttctccagagcagcaatcacacacaatgctgggctatgtaagcctcatgggagacttgcagataaaggcagggaattacagcatacagtagacagtaacttacatttgtaagttggaagtctgtgcttttgaagttacacactcatgtcacactaa

SEQ ID NO: 130717 - DNA, 350 bp, Homo sapiens
ttatttctctccctgaaacccacctttttgtaaattttttacctttcaagttttactaataaaatgcaacttacaataaaaaactgaagtcaaaaaaagtgaagaaatcttttcaagatgataaacccccagagagtggcagtgctgattagaaaactgatgtgtttgactcgtgtcaagtcaggccacgatcccttgattctcccaccccatcctgctcacttaagtgctcaacgaccaccctcttcggagacactatacctcagttactgctccagatgcattttagtttgcaagttcttgcaccatctcactggagtaagttttttttagtttttttggtacactat

SEQ ID NO: 130718 - DNA, 386 bp, Homo sapiens
tcagaggaaggagggtgccatagaggctgaggcccccctcaaagatctgagagagcagactaggctcctcagctcacttcaagctgccagtcaaggccctctagagagtaaccagaatccacctccctatccttacctgcaacagggcctgtcccttcaacttaaccttccctcaagctgcagaggccacagggccacgacattccacccacattgttactgctgaaaaaagccctcacttccttcacaaaagtgctgtcctccaactaaacagcaacccctgtctccacccacaaggctgaggacatgatgtcacctcaacccaatcacaaaatcatgttcctatgactcctagaggaagaaggtagtgaaaagattaaggtgga

SEQ ID NO: 130719 - DNA, 155 bp, Homo sapiens
ccaaataagtacctatcagttccagtactaagtagtttagtctaaatagcttagtaagtatttatatccaaacaacttagtaaccacttgaaaaaaaaatacacataaatcgaaagtagtgctggctgccgtggctcacgcctataatcctagca

SEQ ID NO: 130720 - DNA, 115 bp, Homo sapiens
tgtgataccaacaggcatcattcggtttcctctcaagagaataaaaaggactgggcaacaggaaaaactcaactacaggaaatcacagaagaaatgaaacatgccccccgagtgg

SEQ ID NO: 130721 - DNA, 454 bp, Homo sapiens
ttattttaagaatttcatcaattttctgctttcatagaaaactgaatggaacagtagaaaagccctattatattcattttcataattattaaacaattaagagaagtcattggtattttcttttacagttgaggaaaccatggttcagacaggtaaaatctcacaaaatcacatagcttgaacttactgaattttgtatttcaaagactaccagttacctctcgctttaatgaaaacaatgatgagatgacatgaaagtccagggactttcactgtatcagtaagatgtcatgcttccatattgatttcctgtgtaaaatatgcaatttcaaaaggctttcaattcttattagtggaaactcctctttaaaaatcctactaattagtcataaattctctgtctaggtcaatatccagtaacaaacttgcacatgtaccccctgaatttataagt

SEQ ID NO: 130722 - DNA, 434 bp, Homo sapiens
catgcacttgtagccctagctactcaggagggtgaggagggaggattgcttgatcccaggaattctgagctgtagtgagctatgccgattggattcctgcactaaatttggcatcaatatggtgacctcccgggcacgggggatcaccaggttgcctgaggaggggtgaaccagcccaggtcgggaatggagcgggtcaaaactcccatgatgatcagtagtgagatcatgcctgtgaatagccattacacttcagcctgggcaacatagcaagaatcaatctcgctctctctctttttttttttttttaaagagccaaccttaggaagaaatgcctttttttttttctttttaaaggacatttcttctaaggttggcttgttttagggatagccaaacctacaggttgttctaattgatatactcatctcacc

SEQ ID NO: 130723 - DNA, 755 bp, Homo sapiens
ggcacacgcctgtaatcccagctactcgggagacagaggcaaagttatcacttgaatttgagaggcggaggttgcaatgagctgagatcaagccactgctctccagcctgggtgacagagagagactctgtcttgaaataaattaattaattaattaaaacaaaagagataaataaatacagacatacataaaatgaatttgcactcctaccagaaatatatgagtgcctttctcccttcatccatgccagtattatagttgggcattgtgcctattcaaatgatatgattatttatctagaaacctccaaagaatctatcttttaaaaattatgtaagtcagtttcctttaatctggtaataaccagttagaaatataatgaaaggggaaatatccccttcccaatagccacagaaaacatcagtttcttggaaataatctgaacctgcaatatgtgagaattacatgaagaaaccaaattttactgagagaaagaaaatttgaataaataggcagtctgtgttccttaaagggaaggcttaatattgtgagaacattttaagcatattaattccatctaatttaatttataatttaaaacaactcttttcagaatcacaatgtgatttttttgaaaattggaaaatgtattctgaatattctgaatattacctggaaggataaacaagtgaggctagctaactttgtaaatggaaaagtaaagaaaaaattatcggcattagggttaataaaa

SEQ ID NO: 130724 - DNA, 224 bp, Homo sapiens
ggggtgatctcaagcttctatcctatacctgccccatgagaatattacaggtggggaaactgaggcacagaaggctttggtgacgtgctcaaagttagcagcaagtgcacgtctggggaagcctgtgcctgtcaccaccatcctaaggtagacacaaccttagcaaaccaaagacaggggccctgtccttccctgccctccttggtgcagctccggtaccgaga

SEQ ID NO: 130725 - DNA, 444 bp, Homo sapiens
attgaaatccctgtaatctctatgtgtcaaagatgggagcaggtggaggtaagtggatcatgggggcagtttcccctatgctgttctcaccataaggagtgagttctcacaaaatctgatggttttataagtatctgtcatttcccctgcttgcactctctccgtcttgccaccatgtgaaggaagtgcctgcttctcctttgccttccaccatgatgttaagtttcctgaagcctccccaccaaagcagaactgtgagtacacttcttttctttattaattaccccatctcaggcactcagatatttcctcatagcagggtgagaatggactcatacatacatacatacatatgtatatgtatatgtatatacacacacgtggagacagagggaattcaagtttatactctaacaagtgtgtatgtgtgtattcagtgaggta

SEQ ID NO: 130726 - DNA, 751 bp, Homo sapiens
  misc_feature (631)..(631): n is a, c, g, or t
tacagaggttaagtattttcgggttaggcttgctcaacaggtaagtgtaatgcaaatattccaaaatcggaaacttctggtcccatgcatttcagataatagatagtcagtctgaattaaactaacttcttggttgggaatttgcctggtcagataatgtgaattctagagtccaaacctaggggaagactgtcttgtgcctaagaactgtcaggaaagtattttctcttctttacccacacctggctaatttttgtattttttagtggagacagggtttcaccatgtcttgtgcctaagaactgtcaggaaagtcttttctcttctttacccagagcaagactgatataggaaaaagtttccttacagttctcccttaaaagatggaagaagaggccagacgcagtggctcaagcctgtaatcccagcgctttgggaggccaagccgggcagatcacttttttatctataaattgaagataatattttctttgcctcataggaaaactgcacatgtaagagaaaatgaaatgtcataaaccgagtgtacctgtgtaactggcacttaaattaaaacaaaaacagaacattatcagtatcccaggaggtttttacattctccatgtgtgtntcgaggattcactatattgtaggtggactggcaggaatcacactgtacctagcacttgtaggctagcggaggatttatccaggttgaaatagcgtgaccgaagggatcgttttatcaggg

SEQ ID NO: 130727 - DNA, 444 bp, Homo sapiens
ttccatcagcacccctctgccttcctgccttccaggctccgcaccctgatgtcgcttctcctcctccctctgcagccagtgccaccgctgctctctcacagcttgctttccttgcactctcatgccacccgccgactgtgcaccaccacccatgcccgggctcctgctgcagcctcttctgtctgttctctgcaccttggacctcccttctggcctccactctactcactgctatccaagtcactgtccttaaaaccaagcccaccgaaatcctcctaagcccgaagcttcccaaggttcccatttctacaggatagagcttgggattcaagatgctctgaacctccccctcttcccttcattgttgaccattcatgcctccagcctgaaggtgctaagcagtggcccaatgccaggagctgagccaagctgagctccagcaca

SEQ ID NO: 130728 - DNA, 312 bp, Homo sapiens
taaccttgcctactgcagttttcatcatttcatttcacggcaacttcaactttccaattgttcagtcccaaaatttcagagtgatccttgactactctctctcacttcatctttaatacacacccagaatctagccatgtcctaccacctctactgctactatcctggtccaaaccaccaaaccactatcctggtccaaaccatgcctgaatgccctcctaaatagccttcttgcttctggccaaagtctattatcaagaatacagagagaccattcaaaatgtaaataagattatgccatgcttctgctca

SEQ ID NO: 130729 - DNA, 618 bp, Homo sapiens
cttcctgatgaggtgtcttacattcttgaaaccaggaggaggtagttaggtggtggagggtattctggtggagagaattgcatgtacaaatatctgaagcaagagagtgatgtgtgctctggatatggttcaggatagcgggaagccgtgtgtgtgtgcacatgtgcatgtgcatatgtgtgtgtatctttgaatatacatttactgagaccctcccctgcaccaaacaccattgagaaagatgatatttttgctgctgtgaacaagacagtctgctaggagccccctttgtgaacaatgatgtgggctctcatgcagctgtgctgaaccagctgtgttggggcctggggaccaggagggccagacagatcgtattctttggagccatatttatttgggttccagtgtgtgacctagagacagatgttgaactcttctgagactcctctgtaaaagcagaatgtctttcttacacagcacttcagtgcagtgcttggaacatggaaggtgctcagtatgtcctggttgctggacccattcatagcattatcaatgccatcgatcactttggcattgtgtttttctaggaaaatgtgttgtgaattccagccttgcacc

SEQ ID NO: 130730 - DNA, 563 bp, Homo sapiens
aagagtccaaacagtgcccagagtccaaacagtgcccagagtccaaacagtgcccagagtccaaacagtgccccagaaatcatgtttctaactagtatgctacactgcctgtcatgtatgttaatacatgtaatactttatgaatcatttaaggtgacttttagtcatccacacagaaatgtcacatgtagaattaggtgtaagtaatgaggttgctggagttgtatgggttggaggtaaatttgggagtcataagcatgtggatggcactataaggtatgaatatcgaagtggatgagatcactcaggaagagtgtaactagagaagtccaaggactgaatgctggcatgctctaacgttttagaggcccacgaggtgagaatgtagcatgaaatctaaaaaggaatgggctcagaggtaggaggaaaatcaggatagtgtggtttctaggaagccaagagaaagttgcaagaatgactgttgaatgctgctcagaggtgaagaaaaaggagtgagcattcgacacaacatgctacatgcgttgggcatactaacacacagt

SEQ ID NO: 130731 - DNA, 474 bp, Homo sapiens
gcctaggtgcccaaatactggtatttcaacaggacggcttttatttttaataaaataatttttatagagatggggtctcactgtgttgtccgggttgttctcaaactcccgggctccaacaatcctcccacctcagtctcccaaagtgctgggattacaggtgtaacagctttttataggagttctgcctcctacagcttcatactggaaaatacgagcaaaaaatgttgagcacatctatgatgagtaagggagatgagttgcactgtatggagaacctgatcccaggcctggccccacctttttttaactgtgaggcctgaggactatcccaggccatccaggcctctggtgtcacgtctagatagtgaggaagaacccccttccatggtctctaaggtggttcctagatctattattccaagcactagctctcctatgagctgtactgttgaggggcagaggggtcaaaag

SEQ ID NO: 130732 - DNA, 332 bp, Homo sapiens
tacagtacattattaagtcatttaatcctcacaagtattgccaccatttggtagacaaggcacctgaggctaagagataatttgtccaagatgtcacagcaaaaatgtagcagagttcagaacttaaaccaatgtgctataatgggtatattttattttcagaaaatacaaaactagatttccttaaaatgtagtctgagctataacagattctattttatgttacacgtgtgtagaagagcatttatagaggccacattactaaaatggggaacttcatagcattctgttttgtaaccagcatcatacttaatcttctgagttgaaagaat

SEQ ID NO: 130733 - DNA, 1026 bp, Homo sapiens
  misc_feature (1004)..(1004): n is a, c, g, or t
ggccccgccgccagcgcttccatccccgccccggcgggtccaagccggtgccgggcgcccaggggttgccgcgctgggcgggagggcagcgcctgagagggcggtggaggtggcggggttcctgcgcgcggcccgccatggaggtggaggaggcgttccaggcggtgggggagatgggcatctaccagatgtacttgtgcttcctgctggccgtgctgctgcagctctacgtggccacggaggccatcctcattgcactggttggggccacgccatcctaccactgggacctggcagagctcctgccaaatcagagccacggtaaccagtcagctggtgaagaccaggcctttggggactggctcctgacagccaacggcagtgagatccataagcacgtgcatttcagcagcagcttcacctccatcgcctcggagtggtttttaattgccaacagatcctacaaagtcagtgcagcaagctcttttttcttcagtggtgtatttgttggagttatctcttttggtcagctttcagatcgcttcggaaggaaacaaagtctatctcacaggttttgctcttgacatcttatttgcaattgcaaatggattttccccctcatatgagttctttgcagtaactcgcttcctggtgggcatgatgaatggagggatgtcgctggtggcctttgtcttgcttaatgaatgtgtgggcaccgcctactgggcacttgcaggatcgattggcggcctcttctttgcagttggcattgcccaatatgccctgttaggatacttcatccgctcctggaggaccctagccattctggttaacctgcagggaacggtggtctttctcttatctttattcattcctgaatcacctcgttggttatactcccagggtcgactgagtgaggctgaagaggcgctgtacctcattgccaagaggaaccgcaaactcaagtgcacgttctcactaacacacccagccaacaggagctncagggagactggaagtttcctg

SEQ ID NO: 130734 - DNA, 417 bp, Homo sapiens
agtttgtattttttgtctatcttccctttatttccactaattttctggcctctatgatactttcattctctgatgttcaacttagtgtagatttttttttcttttctggtgtgcctcttatagttgccagcatagggctgacatctcaccaggaagaaattggctctgtaacttggggttggaaatggtgctgcagatggtgctttctccagtgacagttctcttttccctgaattaggatcgattggcggcctcttctttgcagttggcattgcccaatatgccctgttaggatacttcatccgctcctggaggaccctagccattctggttaacctgcagggaacggtggtctttctcttatctttgtaagtagtttttcctcttagagttttaatttaaaaagccaaagcaatg

SEQ ID NO: 130735 - DNA, 493 bp, Homo sapiens
aaaaaatgtgtattctatttggacattacagtggattgacagcatagaaattatttattaaacccatcctactggacctgaaggtgaaccccatcgtaacagggtgcctggtagagtcattcttaactagccatcgatttgtaaaaaattgcaaaagtgggtttttttttttttttttttttgaaatggagccctgctttgtcgccagactggagtgcagtggcatgatctcggctcactacaacctccgcctcccaggttcaagcaattctcctgcctcagtctcccgggtagctgggactacaggcgcccaccaccacgcccggctaatttttgtactattagtagagacagggtttcaccatgttggccagaatggtcttgatctcttgacctcgggatctgcccgccttggcctcccaaagtgctgggattacagtaaaaatttcttatatcaaatgaccgttcttgaattgttaccttggattaacag

SEQ ID NO: 130736 - DNA, 102 bp, Homo sapiens
ctatgtgttccattgtggcaattgtgattcacaagggcatagctgagccaccacagctttcagctgtaatcctcctggcatctatccctgctgttagaggga

SEQ ID NO: 130737 - DNA, 451 bp, Homo sapiens
gtagccagccctttctgggcagaagtatctttttaaacatttcctcaggggattctgatgtgaagccagggctgggaatcactaagttaagccaagagtcggagggaacattcgatgagatggctgagatgcaaaggtagagagtttgcgatcatggagcaagaatttggagagcagcatcggaggcaggagggagagggggatggcagattgagtcaggaggaagatgggagagggtatgatgggagaggatggatgggtatggaattcccactctaggtttccacttggttccttggagaaggataagtgctttggcataagagaagtctgcttcagcctgaaaggaagacccagtggtgggtggggtgtggagctggagatcctttgccttgaggtcttctggggagtgcatgtgtacaaaggtgggctggggcgacggataggagag

SEQ ID NO: 130738 - DNA, 303 bp, Homo sapiens
gatactcgcttccaaaacaaataaggccacgtggagctgtgcactggaatgggattctggatgcaattttatttgattgggtacaagaaccaatccagttaaaggggtcatgaaccaactccaggcaccaggctcctactcagaggctgcctcagacccccttctggcccaggcaccaacccctcacccacccaactccatctcccgacattcttcaaccacattcccatctcgctccacaatattctccctccaggtccccctgactctatttctcctctattcccaaccctgacctctcta

SEQ ID NO: 130739 - DNA, 442 bp, Homo sapiens
catcatgggaaaaccctgcccacatgattcagtttacctcccaccaggtccctcccatgacatgttgggattatgggagccacaattcaagatgagatttgggtggggacacagccaaaccatatcagtctgtaataaataactcaaatttctttaatcctatattttccaaactttcttagtcaccaaatgtctcttttcacatacatcttttaacatcttgcagggcacactgggaactgctaaggtcagagaggagtgttcttgagcagaggaatgacattatgaaagcagtgttttagtcaaagtaatgtatataggatgattggagacagaagagattggaaacgtaagatcctgtttggaagctattggaatattttgggataaagaagatgtcacagatggataataatagcaaatattcattcgtcaattcagc

SEQ ID NO: 130740 - DNA, 289 bp, Homo sapiens
tgccgggattacaggcatgagccaccatgtccagcctctgtgtattgaatttcttaggatattttcactcatgtgacagttttcttctcctcctgtcccaaaccagttgcctgaaggatgcagtttccttcattagaccccaggggattccgcctcactgtttcttcccaaaagtctccagtgcagcgtccctggacttcctatgtgcaccactgcttggcagttcactgtattggagttaactgaactgacagttcagtgtgccatgccttaagcccctggtgacctc

SEQ ID NO: 130741 - DNA, 234 bp, Homo sapiens
gctgcctgatagtatgataaggtcaacagaagaaaaagaatagtggaagctgagacctgggattctacttctggctctatgtctaacttactgtgcaactctgggtcaatcagtttacctctgtagggcttgagtgtcccttaatatatacctgtaagtgttagaggaactgagaagttccatttcagaaaaactcccttggatttaacaatatgatggagaaaatagtatgaa

SEQ ID NO: 130742 - DNA, 554 bp, Homo sapiens
gggttgggggcccctaccctagtccacatttaatgtaatcatttaaacttttgacattcagattagggaaaaaataaatcttactttaattgaacagtttttctcatgctcattgattgtcatacttctgaattgcctattcatctccttagcctatttttctaaaggattccttatattcttaacgagttacagaagccctctattatccagttcatcctttgtaatatatgttacaagtacttttatttggttacttgtctttttgctctgttatgaaagttttaattgatactatttgaaatctgtccactttttctttgaggtttctgagttttgtgtaggaagactttatggatggtgtgagataggaataaaaacattttttcctcaataacgagttgtgcctgtctcatttattttccctattataaacttaaagatgttagtgtttcttttactgtggtttgctttcaaggcgtctcaaatattttgatatagaatactggatttttgaactaaacctccctgcgccattttctttttatcttccc

SEQ ID NO: 130743 - DNA, 238 bp, Homo sapiens
tcatgattcaagctaccacagattctgcatgaattagagaagggtcactttagcccgagggtgctgttcatgagccaaaaagctctcacagaagccagaagctgtctctgaaaatcttgtccagagctttccttactataatagccatttttgaaaggtctgtgtcctaaaggggttgcatcactcttattgagtgactcttttagtttttcacaaaaactattgcttttggagtatt

SEQ ID NO: 130744 - DNA, 774 bp, Homo sapiens
ggttgaatctgcagatgcaaaaccagtggatacggaggcctggctgtatggtattacacaggaagagtttactgagtgagaaatgaggtcaaggatattctaggtggtcttagaaaagcagtcagcaaagggttttgagaaaagaagaaaatgtttcttgagaagattaagagtaacatattaaacgctgcagtgtatttaaggctttggcattctttccaactcatagattgtcctcagcagtagataagattacttaccttaacctatatcatttctattcaagtctgtagaacttttttcatcttcttttcttctttttttttgcatgagtatcaattaaggaaaaacaacaacaaccatgtttacaatttattaggttccctgcagatatacgtggtatctgatcagaatagggaatacttttaaagcaagaagctaacaattttttttcacacctgcaatccttgatacatagaaggaaatctgattgcgaagacctctgttcatacagaataaccttaaagatataggctagtcttatttcatacctaagtgatatacaagtgtgtcaataatcattgatagtgaaattttccatcaacacagggtgcctatgagaataagatgatacaattccagagtattttgacagtagaaacttgtatgttaaaaatgaggagctatgtgataggtctaattatatctaaggcaacaaacagtccttttggcaattccttgaatttaggaatgaaaatactggttacgtatctt

SEQ ID NO: 130745 - DNA, 428 bp, Homo sapiens
ggggtcttttcccaatttttatctcctttgttgttcttgatccccttttcctcttcttttctgtctttcctttacatattcaccttttaactcatgtttccctttttcatttcttctttatcttcctttcccttatgttctctgtctaccttttccctgttaaatgccagaatagaagattgggttttccagttgcatactcagcaaatgagcagaaacagcacacatgtccccgtttaatttgtaaaggaacttaagtctttctgaagactatcaattaatgtgtctgtagccataaacatacctatgaaccatgttttacatttatgtaacactgctcaagaagtttatgcacttattagtctttgcatagcttcaaggagcagataatattgagtattagaaataaattttatttctgctgaaat

SEQ ID NO: 130746 - DNA, 216 bp, Homo sapiens
tacggctcactccacgaatctcaggggcaggagaccaaagataaagatgaaagagccctattaaaccactgcaggccaggcacagatggtgcccaccatgcaatcccagcactttggaaggccgaggcaggagtacgagacatgttgttgtaactggaaggtgctagtcggatgtcgtgggtgggggccagggatgctcctaaacaccttaaaatg

SEQ ID NO: 130747 - DNA, 117 bp, Homo sapiens
ttatgatatgacacaggaaacatcacaaactattgaaaaaagtgaatattattacataaaatatgttggattaattggccatctatatacaaatctagatgtctatctcataccata

SEQ ID NO: 130748 - DNA, 372 bp, Homo sapiens
agtatttggaggtggggcctaatgggaggtatttaggtcataagggttccactctcagaatggatcaatgacaaaataaaaagagctcgacctctcaggctcaaacagtcctcttgcctcagcctcctgagtagctgggaccacaggcacacaccacaacacccagctaatattttaaatgttttgtagagacgaggtctcactatgtttcccaggctggtctcgaactcctgagctcaagtaatcttcccgcctcggcctcccaaaggctgggattacaggtgtgaaccattgcacctgtcctgggtttagtttttttttttctagatttttcagtgagagatactttcttcctgggttacatattacggg

SEQ ID NO: 130749 - DNA, 610 bp, Homo sapiens
agaatacctaactatgcaacactttgattactttcagctgacctcttttgtttacaccagttttatgggcccctgagtgtggtgttagtggtggttacaatattgacctgctagctacatgaagctgctcaacagctacccagtcttcatgtccttttgtgaactatttctagaaagaaatggattcccagctctcagttgtaatctaactgcagagtaatgttggataatacatcagcctcaagaaattttccagattaaattgtctgagtgagaagtataaaagtgtatctactggaaatgcaagctaattatgtcacattcttggcttttcagttttaagttacatgttaaatgtgtatttgaagaaagagcttctagttaaagactgtgaaaaaaaagacattttgtctccatttcattcactcagaaattgttaaagaaataaattcagtcaaaagctgtgtctatgtgggagggggtaaaaaagtggggaagagatgaagttcctcttcactttcaatgaaagaggaaatggctgtgttcccatatcctgaatttgtcataaacctgccaaatatatggaatgtggcctggaatgagagagacc

SEQ ID NO: 130750 - DNA, 402 bp, Homo sapiens
acttcagtttactgaaatgaaaagagaaaatactggtacttgttttatgttacattacataaaatggtatggataaaacaccaaccttagggccttgcatgtaaagtaagcacttagtaactaatccttccctctccctagcctctttgagttaaaaatccaaggttctattctcaactttgctagaatcttaatattttcatctgctaaatggaggcaacagggtcggtctgctttataaaaagctgttgtgaatttggagtaagaaacatacatagcctatgttagagctagatgtatgctgcttgttggctgggaggtctctttcaatctaatttcaagttctaaaatctttacaatcgcttctctgctgttccatggtcaatgacagtctttgggtat

SEQ ID NO: 130751 - DNA, 148 bp, Homo sapiens
ggtgttgtgagattgttttaggtagtagcttttctagtcaggccaggtctaggaggagtaggggtaggttttggcttgtaagaaggcctagataagggactgtgcggtgtatgatactagggtaaaatccgagtatattagagaagta

SEQ ID NO: 130752 - DNA, 151 bp, Homo sapiens
tacagggtaatatagttttcaaagttatatgtgctatttttttaaacacacaatgatgctgtaactatgcaatagtagaaattttatattaaaggttgtggaatcccagcactttgggaggccaaggtgggaggattacttaagttcagga

SEQ ID NO: 130753 - DNA, 690 bp, Homo sapiens
cgttcacctctgagaggcagtgcagcactctttctttgatccccaggagcactctggcatattggggaagcccacaggtgctggcggaaggtggcctgcactccagtgtctgtcatttactggccaaaacccctgagcacttttctttaacatctgtgatcatgtttcctcatctgtaaagtaggggcaattgctgtgaggattaaatgagctgatacaaagcacttcatatggtacctggcaatagtgaatgttggcccatgattcccccaaattagcatgcttagctttgcttagtaagtgtatttataaatgatttgtagaaatattttaaaggaatcttattctagcttatatccatgtaaaatgtaatttaagaaagaaatgaaattcaaagaatcatttttgtaatgtaggatttcaaaaaataaaaacaaaaaaggacccttccttcacccgtcacttaattttgatgcacagttgaacttcagtcagctctgatccagttacccatatgggaatatttaggattgtctagtcacgcctgggtaatagaatgtcaagccctgattttacaagctaatatgtcaaattcattttttcctgtttacatgtagctgtctgattcatttgtccccgaggcacgtgatacttggctccactccaattttagaccctaacaaaaattaa

SEQ ID NO: 130754 - DNA, 572 bp, Homo sapiens
atagaatgtttgtaactcagatccttatgaggatcataaattaatatcaaacaaaatttttatcctaaatatttttaaactaagttgatattaagacatcagcttaaatctctgttccaaaaccatctatattgttttaaatatgctatctgtaaaggatatcgtttgctcattgttataggaggaagtggagtagatgacttctcagatctcttagatttaatctactatgagtttgagtctcaaaccttttgtgtgacagtaaaaatgttttcattctgctctctccatatatccatgagctgaatcgcatgcttggaatccaacacagtgcctgagtcttagcaagtactcaataaatgttaattgagttaaattgatttgttcaatgcaacaaaaatgtatgtagcgctgtctgcattaatatttctctagcctccaacatgcatctgcccaaatactcaaaggatctaagttcaaacagagatcccagtatatccagcaccactaacagatggagcctccgtaattaccatgtccacctgtctgcagtgggctgttctgggaaggaa

SEQ ID NO: 130755 - DNA, 488 bp, Homo sapiens
acacacaagccagtggcaaacctctgcccaagtattaaaggataaactgggcaatcagatttgaatctcaaaactctggactaggaaatcagaagaatgaactactgtaagtcaatgatatgaacgagtccaagagacaaagtagagggggaaagctaatcagtagaaaacaggcagatgaagatgcctggagagaagcagagctgccaacggagaacagacgcgagagctgtccgaggtcctgataccctgaggttctgattccagtcaacctgcagactcacatctatcctgaaatgcaacccaactccaattccacagagtcacaatgtacctaaattatttggacagacacagaagtcataataatataatttaacctactgataggccctgtgacaaaaaggcctaggcaaatggtaatttttaaaagcccagtctgcctgagactgaagcccagctctgtcatttattacctctgtggccct

SEQ ID NO: 130756 - DNA, 771 bp, Homo sapiens
tgtcacctgtttgtctctgtaaaaaatggaatccctccttcattattatctttgcctttattctgctttttttttcccctagtgcttatcactctctgaaactatgttatttgtttgcttatttctttgctgtagcccacaccagatcaggaactcctcaaaagcaagaccttaaaactatcttatttggctaccatatccataacttataaaacagtactcagcatacaatagacaccaggtaaatagttgttggatctgttgaattatcaccatgaaagctaaaatcctctaggataatggtgggagtcagggtgagagtgaggtgtcaatgtcacctgatgagttgaagaaaagataattttactatttgagagaaaggactgaaatatgatatgctaaggagttgttgctgaatttaaatttttttagggaatctatattaaaatatgctgtatatttgatattagacctagaggtcagtgtaacccattcacagggtttgcaagtatcatttgtgtcatcctcagttttgcaaataaaatgttgcacttttaaaagataaatgtaagtagcttaagcagaagtagttaggtatattttttcactttttctttttggtccagatctggcatggttcctagacatgtgaaattagtgatgtggaaaaatgtaaatatatagctaatgcaataagcttcacaaaaatattttgttctatacagtgttcagcattttaaccagctccatggatttcagtaggaagtctca

SEQ ID NO: 130757 - DNA, 198 bp, Homo sapiens
gacactggcccccagcctcctcctatgtcttcctaggcacctctgcctccactgagccctgactctgggggaggcaggcaggcccaggagagtatatatgtcagttagggtttgtcgtttacacgtggagatcattaacgagacttatttttaaattgtaattgcaaaatgtaaatgctccccaaaccgatgtgtaat

SEQ ID NO: 130758 - DNA, 421 bp, Homo sapiens
aatgttttgttcccaccacaatcactgagtctcagaactggaaggaattatctaattttctacccaatttcctacgcatgaaaggaatgctggggaggattctgagaaaagtgtggcttcttaataaaaagaggtgcagagaagagatacctcctcttctctgtacatacctcattgtgcctgtataaaatgcctaggacctggacagtcatcctgggaccttcccatatccagtatccatttctgaaagagctctccagttccatgagcttcagaccccataaaactcaggtcggcctcctactcatctccctgatctaagtcacaagtctatgaactcaacatcttgagtatctctcaagcctgcccacttactcttctccagtgctaccatcctggtccacactgccatcttctttca

SEQ ID NO: 130759 - DNA, 392 bp, Homo sapiens
tgataataaccctttttgaaaactatgtggccttcctaaagctaatgcaagaccaccaggttagaaggatgagaggagcctgaagtcgttaacttccccagttactcctggagataacatcactattgtagaatctaagtaagattggcctttagagatgtcttttaaagtttttgcatttctgatgacccacgactccacgtgaacccaccaactagtcccatggccgcccccagaagaggactactttccatactcccattcaattgcccaccaaactatccttgaaaaagcctagcctccgaaatttgggggagattgatttgagtaatgactccatttcccatgtggcgtggccaggcttgtgtttattcaactctttttttattgca

SEQ ID NO: 130760 - DNA, 401 bp, Homo sapiens
aggaaacacaggtggccccctttctgcaggactcggagctgggcggaggtgagcctggagcctccacaggcagccaggagggagagcctgcttggcagcaaagccagtccagcagaaaactgagctgggacttggcagaggcagcttccagacaacatctaagttctggatttgtgcctaatgcagagatctgccctggaatttttcattacgcaaaccaagaagtgcccttttggcctaaatcaggtggagtccagcatctgccacttgcgacagttgctgtagcacacctattgggtgtgtaacatcctcaaccttaggagcagaaatccccgccgataccagcaaagaatgaagcaagcagaggccaatgcccagacgggccagacaggaccaggaga

SEQ ID NO: 130761 - DNA, 824 bp, Homo sapiens
aatcgagctcggaccaggacagtcttacaggacagtacccgtctgcagcctggggactggggaccctgctttagatgatgtactctggctttgcattctggcattagctaagcaccctcttaaaggaaattgggtctatactctcagtccgtgttctccctaacacctggaaacattgaataccttcaatgctgggaagttaactcccaccacaactagaacagctatgggaaagacaacagttgattttgaagagtgtcaccaatttgcacatgattccatccttaaccattcttatcctatcagctctgccaaacatggagaatagttggctgcaggacagctatttttcctacttgtagatgcaactatttctcacccaccaggatgtaaaaggtccctgtaccctaagattggtcctacatacacacccaatgggaaaatgagatgaaaaatttaaagcagtaaatatttgaggaagtagatagagtaatttagaaaaagaaaatacacagggccaagcacagtggctcacatctgtaatcccagcactttgagaggccaaggtgagaggattgcttgagctcaggagtttgaggccagcctaggcaatgtagtgagaccccacctctacaaaaaattaaaaacttagttgggcttggtagtatgtacctgtagtttaagaaacttgggaggctgagctgaggcaggaggattgtttgagcccgggtggtcaaggctgcagtgggccatgattgtgccagagtactccagcctgggtgatagagtgagactctgtctcaaacaaaaaaaaaaacagagac

SEQ ID NO: 130762 - DNA, 341 bp, Homo sapiens
aaatggactaagacagatttggtccctctcttacagcaccattaatatttctatttttaagatagggaaactgaagttcagaaatgatagatgatttgctcaaggtctctcaacaaaatacttattaaatgcctgttgctgccaatcacgatgctgaatgctgtggatggagtttagatctagcgggataagcagacactcaaataattacacaggcacatgtataattatgaacaagaataactgccaggaagaaagaggttggggagtggcaagagtgtacatcagctcatcagtgccagccatgtgtcctgaccccaaagccatttgattgctaaacc

SEQ ID NO: 130763 - DNA, 272 bp, Homo sapiens
cacctaggctaaataaagtgcagtgcacaatcattagctcactgcagccttgaaatcctgggctcaagtgatcctctcacctcagcctcccaagtagctagcctcaagtgatcctcctgcctcagcctctcaaagtgctgggattacagatgtgagccaccgtgactgacctattatctgattttagccaacaatgttgtttttcttaatattctttcactgttaattaaatgtgatttaagtaatatcttttaactctcagttgttataga

SEQ ID NO: 130764 - DNA, 406 bp, Homo sapiens
cagatagggctggcacagcaaagcagagactcggccgtatcctgaaaatccacagaaatggcaaactacttctacgacaggtcatcgttcaagcagaatgcagacaggccattcacgagcccaagttgaagagaagagacgcccatccgtgaaggagcagaccatccatccgatcctccccttcccctgtccttccttcgtggattgtctccattgtccagacagtgcccccatctcccacctagatgtctttgtaacctgagctggtaagaaagggaggagggacagaaagaggggaaatatgcccttgacatatgatgtatcttctttcttttcttcttctctttgattacacgaaataaaatggtttaggctgagggtaaagaagtaataccatttctagttg

SEQ ID NO: 130765 - DNA, 332 bp, Homo sapiens
actctaattagaaaagtctaaaaccacccaaaaatgtttttagagacagcttcagaaagtctactgccaatttagtttgagtcactatgagcaaagacaccagggcaaaagaggggtgacgatgatggaaagaggaatggctggctgaagcccaatgccagggctggatagctcctaggggaagtcaggacaatctgaggagggtgtgtgagggtgtgtgtgtgtgcgtgtgtgtgtgtacatatgcacttcaattttcacaagttgtgcttgatggattgagaaagggcagaggcgtctgggcacggcggctcacgcctgtaatcccagca

SEQ ID NO: 130766 - DNA, 379 bp, Homo sapiens
cttcactgccatttaaggtaactttctgcttgtttaagaatattccagctgtgtttatggtgttccaacattcccctgccaaaacccttgacaaatgaatggcaatattttcagggatgttggcaagtacagactggatttagctattaaatcctcattggtttttgtcatatctgatcagaatacaggaatgggcttttgactattaaaacatgtacacagtgcttgggaggctgatgcaggaggaccacttgagcctgggagttcaagaccagcctgggcaaacacagcgagatgctgtctcaaaacaacaacaacaagcatgtacacagaaatgaatcagttttcacacatttcagctctgcccacacagtaccta

SEQ ID NO: 130767 - DNA, 752 bp, Homo sapiens
tatttggtatcacaatgcatactttctcagtagagacgctatttattatcattttaggcagaaaggtaattccttgtgtgggatttttctgagcattgcattagcttattatcccagtcccaacacattgaatgcctatataaccccacaatcattgtggcaaacaataatgcctacacacatttacgaataccctttggggatatggtatagtcaccaattgagggagattcactggtacagtgcatatttgagaaatccaaaattctctacttctcctctctaaacttcccccaacaaattatgggagtctgtatggggcatcttactcatgctcatgaaataatcctctcaactgccacaaggcagccactaatttccttctatccagctgattattactggtgctttttcctgctacatttctttccagatgcagactggtgcaacttacttcacagaacttacctattcccttcacattcctacagttctagtattaactgagatgagtggtatgccaaggttagtcttggggtgaggaggatggagggtagaggagggtggaaagtagaggaggaatgaagctgagagcttgcttctttcagcccagaaccggtgttcaacattcttctcccttagaatagttatttcccaagagtatctcagtacctaccagattctgaattctaggagagcatggacttctcaagaatgatacctggcttattactggtacttaaattcataca

SEQ ID NO: 130768 - DNA, 932 bp, Homo sapiens
gtagttgcttctttctcctgggaccgtgctttttgacagtttacccaccaggaggctgaaacttttgcaaaccagaacctaggtcttcaatttcagttttgatgctctgatttgttccccgaggacagctgataacctggctgctcttcctccttccaaattagcttcccaataagtgagaattcagtggcctcttgaattcagcagtctgtgtttccccagtaatggttcccaatattgctcctgcagcaatttgctataactgggtctaattctccaaattgcgaccacagccttgtgccaatataatagactttccttctcttttccattggtatgatcagaaggttaacatgtaagtcccaacacctctcacattatagaaagctgagttcacacagcaagtcttcagccctagtaacaggtacattggtggttgtgatcatttcttaattcctaccctgttgttttttttcccccaactttttgttaatctgcatgactactccactgtcaaggtttgtcacatgtaacctttccttccttttcaggagagtgctgtagagggtgcagtttgaataagttcagggttccacttgggcaagtatcagcatctgggatgtgggagctctcattatgcctcctttgtatttcaaactctggctagcgagaaacaatagcaccttgccctaaggtgtgaaattaaattcaagtaaatccatagcagtaggaaacacgcttactatttgtaatcagcaggcaccgttcgagaaaaggcaatatcaaggggagatggaggcttatgtgcactcccagtgtgctatacatctcaaaagagggctgcccaatgaatgtacaaaccttagatattgaccaggattaggaaaccatgattcttgctcacaaagcactgtgcaagtgtccccctttcc

SEQ ID NO: 130769 - DNA, 605 bp, Homo sapiens
ctgtctcacatggtaatcttatttgcctctgatgactggagcagatgaagtaatcgcttcgcagcatctgataaatacattacattaactgtgagaagcaacaagagactcaaaagccttgttcccaagtgaaattaaaatcaggttattgtcctcataaggcatttctcttccttaggcttctgagcaggagtcattggtgctgcactaagcatttctgctctctctagaactaatgaaactcttggcaatttagaataaaggtcattatttttgacaaaatggaagatgggatttggtattcaaatgatttaggtatttttatgctaaaaatattgatggtatgtggaaataaaaccacaccttttctcctttgatgggagcagtgtgtacctttatattccgttatttcagagcatgctgtgaaatttcaactttttcactccctgtgttcttccatgactaacccagttttcaggtcaggatgaggggttgccgccggcccggctgtagctgctttagggggagtattctgcatgctctgggcgcccagaacattttgttaaatgatttaaacatgagacagctgaaaccacttgacttgg

SEQ ID NO: 130770 - DNA, 238 bp, Homo sapiens
cgcctcccgacagcattaccgtgtgagctccgcccccgttagagcattactgtgtgagctccaccccctgccagagcattactgggtgagctccaccccctgccagagcattaccgtgagctccgccccctgtcagagcattactgtgagctccgccccatgttagagcattactatgtgagctccgccccctgccagagcattactgtgagctccgcccccctgtcagagcattagt

SEQ ID NO: 130771 - DNA, 215 bp, Homo sapiens
aggaaagctacatggcaaagggtaggagccactgtatacagtgggcaggcctggcaggggcaggggggtgacacagcgctgtctcagagggaatctgttcctagtccattaggccaagcagggccccagggaagagcctgtttcctgggaggaaaggcattaaccccgggtgctgttagcagcagggcagaatgtttacacctggggctccgaag

SEQ ID NO: 130772 - DNA, 438 bp, Homo sapiens
ttagaaatggctccttcctcacccacaccttcgggttcaggccaccctcgccaattgggacacaccctgtcctcaaggctgcacatcgtcctggcacctgctcccaggacccgctgccctcctgatcccacagggcagcgcttcaagggcagatcggacgtctcttcaatctgtgcctcgtccgtgaacaaggacgtggagccaggggcacaagtcaaagggttactccaggcaaagctgctgcatgaggaacggaacatcataaatgcagccccagtcacagttactgatagcaaggcttacgatcaaaatgaatttcttacatgagcagcaggtgaagagatgataggtctttcgcagaagcctcatgctggaaacagcccaaatgtccgtccacggcagaatggaaaaagtcgactaaagtccagccatacagtg

SEQ ID NO: 130773 - DNA, 234 bp, Homo sapiens
ggctcaggggttaaagggaagatgactggtcactggtggggctgaggtttgaatctggcttgctggctccccgaataagaggattctttccactcctccaagctccccgacaagggactcacctttcccaaggtctaaggatgtcctaaggggctcacaggtcccactggtctccttggaggctggaccttgagtcaccccggattgagcctcatatccctcagtattttgcca

SEQ ID NO: 130774 - DNA, 362 bp, Homo sapiens
gcctcccaagtagctgggattacaggcacatgccaccatgcccaactaattttttttgtatttttagtagagatggggtttgaccatgttggccaggatggtctagatcttttgaccttgtgatccaaccaccttggcctcccaaagtgctgagattacaggcgtgagccactgcgcctggccggctcctccttcttattccttctgtctttttttctcctactggagcacctcaattgactgatcttcatgtttgctgactccttcttctcctagtcaggtctgctcttaagcccctctggttaattttttttttttttttttttttttgggaaacggcatatgggggacccggagtcgag

SEQ ID NO: 130775 - DNA, 216 bp, Homo sapiens
gtgatccacccgccttggcctcccaaagtgctgagattacaggcgtgagccaccgtgcccggccataacatatgctctgtgaccttgctactcaaatatggcccagggaccagtatcatcagcattatctcctaggagcttattagtgcagaatctgaggccccactttagacctgatgagtcaggacagcagcaccgcagggtcaccggagctcg

SEQ ID NO: 130776 - DNA, 1080 bp, Homo sapiens
  misc_feature (230)..(230): n is a, c, g, or t
  misc_feature (273)..(273): n is a, c, g, or t
  misc_feature (283)..(283): n is a, c, g, or t
  misc_feature (305)..(305): n is a, c, g, or t
  misc_feature (314)..(314): n is a, c, g, or t
  misc_feature (318)..(318): n is a, c, g, or t
  misc_feature (321)..(321): n is a, c, g, or t
  misc_feature (325)..(325): n is a, c, g, or t
  misc_feature (328)..(329): n is a, c, g, or t
  misc_feature (352)..(352): n is a, c, g, or t
  misc_feature (377)..(377): n is a, c, g, or t
  misc_feature (381)..(381): n is a, c, g, or t
  misc_feature (388)..(388): n is a, c, g, or t
  misc_feature (395)..(395): n is a, c, g, or t
  misc_feature (407)..(407): n is a, c, g, or t
  misc_feature (424)..(424): n is a, c, g, or t
  misc_feature (450)..(450): n is a, c, g, or t
  misc_feature (453)..(453): n is a, c, g, or t
  misc_feature (477)..(478): n is a, c, g, or t
ggtggcaagctcttcgtacaggacgaaaaaggagcattcaactttgaccaggaaacagtgatcaacccagagacgggcgagcagattcagagctggtatcggagcggggagacctgggatagcaagttcagcaccatcgcctccagctacgaagagtgccgggctgagagcgtgggtctctacctctgtctccacccgcaagtgctggagatctttggctttgagggggntgatgcggaggacgtgatctacgtgaactggctcaacatggtncgggccgggntgctcgctctggagttctacanacctgaggncttnaangggngannaggcccatatgcaggcccggttngtgatcctgagagtctgctggaggntggngagggantcgttancatcactcccancacaggctccgatgggngcccagatgcccgggtccgcctcgancgnagcaagatccggtctgtgggcaanncctgctctagagcgcttcctgcggagacttcaggtgctgaagtccacaggggatgtggccggagggcgggccctgtacgaggggtatgcaacggtcactgatgcgccccccgagtgcttcctcaccctcagggacacggtgctgctgcgtaaggaatctcggaagctcattgttcagcccaacactcgccttgaaggctcagacgtgcagcttctggaatacgaggcgtcagctgctggcctcatccgatccttctctgagcgtttcccagaggatggacccgagttggaggagatcctcacacagctggccacagccgatgcccgattctggaaggccccagtgaggccccatctggccaagcttgaggaagatgtgtggccttgcccccaattccatcagaccaaggctgcaagtggccctccattcgtgtgtgtatttaggggctggggagggggaggggcaggagcttggaccttggtactacctcagctgagggtggtgacacaaccccttccatttgtcagcactttccagcctgccaattgcttcccctctgtgatctcatttcatctgcactgccgtacgtggagtgagcaaga

SEQ ID NO: 130777 - DNA, 797 bp, Homo sapiens
agcagtggctctgtaatcccagcactttgggaggccgaggtgggcgtatcacctgaggttgggagttcaagaccagcctgatcaacatggagaaaccccatctccactaaaaatacaaaaaaaattagctgggcgtggtggcgcatccctgtaatcccagctactcaggaggctgaggcagaagaattgcttgaaatcaggaggcggaggctgcagtgaaccgagatcatgccattgcactccagcctgggcaacaagagggaaactctgtctccaaaaatatatatatatacactaataaacagagatccagaatgtaagactgggactgaaatgaatgcatcagcatgacaggcaagttcagactaacccaggagctaataaactaaatggcaggtgcaatatgttctctaatgtgacagtgttttgtaatgacaccaaactaaaaattatatctaatttcaaaataactaaagtagtatgaagtattacaagtagcagatgaaaaaaaatcagtatgatacaaggagcttcaaaagtactagttaagtactacctcatttcttaagctggaagaaaataccaagtggtttttattacttcattttatatgttatataaatgctcgcattatttcacaattttacaaaatttagcccatattgaacaagataaattacagtgcacactggggatctaaaacagataactcagaaagatgcccattaaaaataagcaacaacagaaaagctacaaaacagaaatcaagaaaaactagatctaaaattagattacat

SEQ ID NO: 130778 - DNA, 665 bp, Homo sapiens
cttcaaaaatgctgggattacaggtagaaggcactacacctgccccatcctcttattttcaatctatttgtgtttttgaatctaacatgcttctcctgtaaatgacatacagttagatcatgttttttaatctagtctgacaatttctgccttttaactgggttagttcccatttaatttgattcttgatattgccagatttatgtctgtcattttgtttttccttttctataggcctcatgtctttttgtttcactttagcttcattaatgattttctcactttttgagctactcatttttagtggtttctccaatgtttatcatatacattttaatttatccgaatcagcttcggattatgctagcttaatatccataatacatagaaatgttacttctatataactctattcccatttctccttttttggtactattattgtgcatgttatgtcttttaatgttacatgccaacaatatattatattaattattactttaccacctatcattatttcttatcccattatagctttactgtgaccaacttcttctgtactgctattgacaaatatattactcacatattacatttccatgtgctataagcacaacaatacattttatattattatgcaattgtgttttaaaaatcttttaact

SEQ ID NO: 130779 - DNA, 878 bp, Homo sapiens
tgcttttggacaggttgtgcaaggacggctctgacagccgtgtcaaaactatgaaggcggcatggcccacctgctgaagatgtcacagtggaaaggtgaagtctcagggctcagacaagattgtgaactggcgaattaacacaggagccttctttccccaagttccttgtcctatgaggttataccactgattgtttatgccatttttagttgaaggttcttttgcttgcagccccaagcattctcactgacatgaaaggtctgcaagagtcatgagcagactgtggcagtatattttgatagtctatgtggagaaaccttagtgcatgggtgtcgtcatagcggttctgcctctctaaggatattcccctttacttctgagtttacagctgtgatcaggatagtgagttcgccctcatcccagtggcattgtactatcttaacaggctgcatggagagtaatggagaaagacaccattgtccaagctgactttgaccccctggagctctcacagtatttcgagatggtttgccctgtgaagggcagacctacctgtgtttccatcaggccccaatttcctcattactttgctcagcttccaagatgagatcattattaattaatacacttatagttattaacatatggtgacattaattaactacagtctactaaatgccccctgtgtgtctggtctgatgctacatgttgtgctgcattttctcattgatcctcccaacaacccaagaagatgagttttgctatgcatattttacaagaaagaacccaaggttcagatcattaatgcgcccaaaggcccacattctgattggaaatcagcagaggtaggatatcacctctgcaattctccctggtt

SEQ ID NO: 130780 - DNA, 448 bp, Homo sapiens
cccggtgcttactgtctaagacattttgggaaaatccctagagcctggatcttcaatcctggtaagccagagagcctggagacacacccaaattatgtccctcttagttcagggaacatgtccattttcgtcagcattaaaattttggcaccaaatgtgctaactgcaattccaccatacaatgcataactggaaatagaggcaacatctcatatcctgaacaattcatgtgagaatctaggagacacaccgcttatttttgccttttcccactgaaacaatggctagtattaacaatgttatgctatccttggtttcactccccacttttaaatctctcggatgtttacttcttgagacagggcgtcactgccgtcacccacgcttttctacggtgtaatttttgttgttcgcttttgtcaaatttagaaattttcatttcatctct

SEQ ID NO: 130781 - DNA, 291 bp, Homo sapiens
gtgctggacgggctcggggaacagatggaatgcatgtaggtgggaaagctattatttaaacagaggagggctactgtgtgttggaagggggtggatttttgagggtagctgggtacttaacattttggggctagactaatatatttactagtggacacaggaagaagcagacgccaaggcatatggtcaggaagggagttaacaggccaccaacaaagaggaagaatgcggcagctgaaatcaactgagggtagatgaaaagaggataaaatggcaccgacagatccaaag

SEQ ID NO: 130782 - DNA, 223 bp, Homo sapiens
caaccctgtgtggagcttggccattaggatagtgcagtgtagacaaagctgcatttttctcaagagctagattcatactcatttcagcacttgagaatatgtgcatttgatgttccataattcctaccttccacagtgtaagagacaggggaaaccaaagtgttttcctattcacacagcacttaccactcagctcagcgcttctgacaccagatgctggggg

SEQ ID NO: 130783 - DNA, 178 bp, Homo sapiens
tttgaggcaatccaataagcaaagagcagtcggactaactgtccttgtaccagctgactgtctccctgccccgatcaagctctagggaccagacactgtgttaggcactgggcatgaagatcgtaacacaaaatcgactccttccaagagctcaggcttgagcagaacacacatctcc

SEQ ID NO: 130784 - DNA, 772 bp, Homo sapiens
tgattccccctctcatatcttctaccctccaggccaatctatatgtgtcctctgcagaatggaaagatttaaaaacagctactccatcttgctgtacaaccttagccaaggcatgtaacctctgtctctgttcccttgcccatgtgaaattgttgtaaggataatgataaagaagaggaagtcaacagtggctaacatttatcccttgctcacaatgaaccagacaccaagctatgtgactttacctgaatggtctcaatcagtcttcacacaagcctgcaagatgtgacttgctccttcttgccttccgccatgattgtgaggcctccccagccatgtggaactgtcagtcaattaaacctctttcctttataatcacccagtctcaggcatcttaataacctctaagttgcacccaggagagttggtgcagaaaaggaattctggccaacctaatttgtatttgaaaataccccataggccaacggaacaagattcagatgaatttcacaggcagctgagggctacacaaggaaaataatgatgtgaactcatacttatcagctatctgataccctgagccagaccccggtgtattcctcacaacaccccaaaagttctggagatgagaagtccaaaatgagtcttaagaggataaaatcaaagtattgacagggctagttccttctgaaggttccatggcagaatccattccttgcctcttccagattctagaagctgcaggcatttctgagcttggactgcatcattc

SEQ ID NO: 130785 - DNA, 383 bp, Homo sapiens
gactcagcagggaggtcaaagaaggcttcagaccaaggtttaagataaagagacccagagcacccctgggacccctcccctattcttccatgatggtcgcctgattagaaactctagactctgggtggccgggtgcggtggctcacgcctgtaatcccagcactttgggaggccgagacgggtggatcagctgaagttgggagttcgagaccagcctgaccaacacggagaaaccctgtctctactaaaaatacaaaaactagcatggtggtgcatgcctgtaatcccagctactcaggagactgaggcaagagaattgcttgaacctgggaggcggaggttgtggtgagccgagattgtgccattgcactccagcctgggca

SEQ ID NO: 130786 - DNA, 173 bp, Homo sapiens
tattaaaaaaaaaaaaaagaatgattcagtgtagttgtagtgctagatatattatatggaattatcagcagtttaccagttggttctttattagtactcctgatgtcttaaacaaaaatgaataattgtttatcttttctcaaagtgtctcatctgttcagtaacaatcacag

SEQ ID NO: 130787 - DNA, 226 bp, Homo sapiens
tacgttcatgcctccgaatacataacatccaaatccagcaggaagaacaggctacctgatatataaaacaatactcataaagttactatagtacatataaaaatagcaaaatatttcccatgaagttatcataatgataaaaatggcaacagcatgcactatgtgcaaagcaatgtcgtaacaatttacatgtattaacccacttaatcctcaaaactaccctgtg

SEQ ID NO: 130788 - DNA, 710 bp, Homo sapiens
tatctatgttgtataattagtaattgggaagcagatgtttgtctttcttccactccgtattgccgtaaggccatattctattgagacacttctgccttgctgaagcccagaacagcagagttaatcagcttcttcaggaaagagaaggaagtaattcctctggctagaaattccacgtgtacaacactgaatatttaccaaatgacataattcccctctaaaaaaacaaaaacaaacgagaaagatctcaaacaaaaaatgctagctaatagttttcattaaattaaactgttttctctatcagcaatttaaaaaaatactgaggccttttagatgtaaccttcttttttaaggccctggagatatgaagatgagtaagacactcttcctatcttcaagtaagtcacagtccattgaaaaaaacaaatgtgtatatagctataatattaattaacgtaataaacagaggcactcctatgtgattatgtagtgtcaattcagagatgttttgtatcaaaaaagtgaaattaaatatgggaaagaaaaagtaaagatttacaggctgggcatagattggccacacctggcccagtcatcttaaatatggctaaatgtttaaatcagtgtttttctatctggggtgattttgacctccaagtgacattttgcaatatatggagacattttttgttatcactgcttggagggga

SEQ ID NO: 130789 - DNA, 256 bp, Homo sapiens
tgaatcttaacattttatcaaatgaaagaaaccagacataaaagagtacatattgtatgatttaacttacatgaattaaagaacagactaatttcatccatggtgagagaagtcaagatagtagttacctctggggaagggctggcatgaaatggaaaggggcccaggaaaactttctgagggggatggacgtattttctgtcttgaactggttgatgattccccaagtaaaattcattcagctagacatctaggg

SEQ ID NO: 130790 - DNA, 212 bp, Homo sapiens
ctcaccagaatccagagacaagtaaattagtacctgatctttaggtgtcagcctcctggaacatagaacagggtagaaataggtagcgttgtgtatctgccaggaccactggaaataccagtacacctacgatatcatcaaatgttttaaataatgacaatgaacttgttcatttatgtagttggtaaaaattctggcaaaatgtctcaata

SEQ ID NO: 130791 - DNA, 693 bp, Homo sapiens
cactaaaagttggcttaagaaatatgcaattatatgtcatgtaaatgattatagaattagatatcataggtataaatcagtaattttaatatttcagaaaaatagagcattccatttacctaaataatataaaagagtaaaacttaaatatgattttgtatttcagcttaatgattctacattctgggaaaaagacttaactccaaaaaatgagatagtggggcatttaatattcctcataaatcttaaattgttttgcctaatttttttttaaaatagttactagtatatgtatttttatttttttaaaaggaggatatctggtgttagcactattgtcttccaaaatcagtgtcttagatgattctttcattcatctatccatctatccatccatgaaacatttattcattaccttctggttactagagtctgggaatacaaagatgaataggatccagaaaaacgtttttgtgggggaatccaatgtgtaaatataattgcatcatcatttgatgtttcactgtagcatagttctgaggttaggtgtataatcttaaacttcagttttctcatctgcataatggtcataataagaatacctttcataggactgttgagagggtaaatgagtttttgcatgtgtttcacttatatatagaatgttgtgattattccataaatgttatgatg

SEQ ID NO: 130792 - DNA, 801 bp, Homo sapiens
gaaaaaggatttttaaacaacaaagtttgctgaggccaactttgtgtatggttctacactgggctggaaagatgacatggaagctgtgcttgtaccgcatcctgggctgtcattctctctgagctggtgcaagttggacatcagagaacataaacagatatcactcatctagcactcaggacaggccttttggctccacctttgtggtggatgctggaaggcagtggggaaaggacattaaggtgagttttccctgattccaagccctgggcccacttcattgactggcatgagaaatgcacgctacttcctttgtgcttagcttcctcttccttcaggtttgctctagaaatggcagcaggaattcagaaggcctgctttctaatctccagcatgccggtagcttgctttgtaactctgggcacacggctctgtgcctcatttctcatttttcttactataaatgagatgggttggcttagatagaggaatttttaaaaggaacttctgacacctgttaggactttcagctatcatcttctgactgtgaaagattaaggtatgcatgagggggtgttacctaggctggcataggctctctgagtcaccatatggtgccacctccctcacagagtccttgttttcatcagtgttcagctttcaaaaatggctaaatcatttttaactgttccttaaagatactgggctgggggtatagggtgaaggttctgtaagacttgcatttggctgggcacggtggctcacgcctgtaatcccagcactttgggaggccaagaaggg

SEQ ID NO: 130793 - DNA, 219 bp, Homo sapiens
gaaaatattttggcatttctcatagtatgatgttgaacccacagttggaacaaataaatacatgtgaactgatacttattctactcataggatgagaaataactctaagaaggtaagtcacagcaaatttttgtggaacatggctaaggtgttcatatgtttgatttagactgagcatttcttcaacaaacgcagcttttttttttttttttttttttt

SEQ ID NO: 130794 - DNA, 686 bp, Homo sapiens
gtagatttctaggttgagggtcattgtatagaacataggcctctattctttaaaactgttcagacatgaaagacagggaaaaacatagaaatgttccaggctaaaggagactgaagagattggatagctaaatgcatcatatgttcctgaattaaatcctggaccattagaagcaagtgacaatattggcactgttggtaaaacttgagtagggtctgtggattggataatagtgttatattaagtggatttcctcatttggaggcttatgtggtgattatactggccacagttcttgttttcaggaaataccaactggagtgtttaggggtataggggcatcatatctgcagcttactctcaaattgttcagataaagataactgataaaataggcagggggagtaggagggagggggaaatgtgctaaaaaaatgttaaccattgaggaaactgggtgaaggttattaacttgaaaagcaagtattttatataaaactatggaaattgctatagagctttcatttaaactaatgaaggtctcattttttgtcataagtggtttataatacgtggggcatggttttcttttaaaatatgtgtggcataatttcctcattgtatagttaacagtggtgttttccaaaaggccagtcacactctaaaatgtcttataactatatgtt

SEQ ID NO: 130795 - DNA, 587 bp, Homo sapiens
catggtggtgcctgcctgtagtcccagctactggggaggctgaggcaggagaatcgcttgaacccaggaggtggaggttgcattgagccgagattatgccactgcactctagcttgggcaacagagtgacaagttgttctcaaaaataaataaataaataaataaaatatttatcataccactgcccccacaccaactcccttctcccaaaaccccaaagcctgcacgattcttgatacccagggcaacagccatgtaaaataagaagttcactcatatttactcttcatttgtgagtcctattacttaaagagccgtgtaatctgagcactaaaaaggtattttacctactagaatacatacaatatagtctggttcttattatcttatttttttgtttttcttttgttattctgaggcagggtctcactcatgtcaccccagctgcggtggtgcgatgatggccacaacacctgggcctattctcttattaacagaaaaaaacagtataaaacgttgtatggctgagtagaaactgtgagtaaagagtcaagtctgagaatctgctagtcaagacatacgttatt

SEQ ID NO: 130796 - DNA, 684 bp, Homo sapiens
attttgggaggccgaggcgggcggatcatctgaggtcaggagtttgagaccagcctggccaacgtggtgaaatcccgtctctactaaaaaatacaaaaattagctggacttggtggcaggcgccttaattccagctacttggaaggcagaaaaaaaaatactacaaagtctgctttccatagccctaggctgttcactctattcatgaatgaccttgcgtggcatgtgacgttctgttcctctggactgtaagtatttgtgactaataaatgattgtcaatatcgtaagtccagtttcagttattgtatgtctggtcatcccattaccctaaagtgggaatcgctccctcatcagtgggtgaataggaggtgattaaaacagaccctcccctgccactcccacccaccatgtgcttggccctacaccagtatattgctactcaatgtcttcggacattctgatatgtcactgctgaccttgtgcttagaaatatgtcttcttgtatctgtgctctgagggtaagacatggcattcagaaaatagcataaatcatctggttccatatgctcaaatatattttaactgtgacaatctatttgactatctatagaaaagataactaccttagttctaagacaatagtaggttaaaattttaagatttaaaaaattttcgtggtgaga

SEQ ID NO: 130797 - DNA, 508 bp, Homo sapiens
gcctagctttttatattgcctgtgcacacacagttcccccttggattcaaagtgctctgtgtatgaaaaaggaagaacggtatgcacttgaaatattatcttattaaattgttttagttcttaactctcatacccatggggttgataggaaggaagcagcgttattcaattataaagttactctcttcttaaacaaatgctttaaattataccaaggcaattttttcattggtggcatttaagtggaagttatatacagccgtctcctggggcattatactcttgtcttctacccttaatttgacctgaagaaatttcccacagccgagttagctagcaggtgaaggaagcagaaacatgccaatgtgcccattaatcagaactctagacttagagaacacatatatcaatgttttctaaaagctcttcctaatagggcctggaaaaaggcagaagcattttttcctctacctaagaattatcttccttaaatatgcttattttggaa

SEQ ID NO: 130798 - DNA, 212 bp, Homo sapiens
cttagacgtaattatttaggttataatttatctatttaaatcactcttagatgatgcagctatatcattttcctgataatgatgtcttcgccattccaacagagaaaatgtttgaatccagctcatttaaaaatagtatgaggctggacgtgttggctcacgtctgtaatcccagcactttgggaggccgaggagggcagatcacgaggtca

SEQ ID NO: 130799 - DNA, 733 bp, Homo sapiens
taccaatccttctcagattctttcaaaaaggtaaatgaggagggaatacttccaaactcttttttgcaaggccagcatcatcctcatatcaaaggcaggcaaggccattacaaataataataataataaattacaggccaatatcctttatgaacatagatgtaaaaatccccagtataatgctagcaaacccaattcaacaacacattaaaggatcatccaccatgatcaagtaggatttatccctgggacgcaaggatgattcagcatacccaaatcgacaaatgtgatacatcattaacagaatgaaggccaaaaaccatataattatctcattagatgcaaagaaagtgtttgacaaaattgacaagtttattgctgggttatttttcagttctaaatagcaataataataatagctaactcctactgtgcactaacttcatgccaggtgtgttttaagcacttcacaggtattaactcagtactactcagatagagttccgttaattttattttcttttttaattatcagccaaatcgcttattgatttggtttcatttctgctatttttttctttgtctgtccattgactctaagccataaatttttatgcaattttaatctgattatcatttcctcttaagttttttgaggattggtttcattttgctagaagaaccttgtgagaccttcttcctccattccccttcaaagactcttgttagtttc

SEQ ID NO: 130800 - DNA, 377 bp, Homo sapiens
tccttccatctatacaattattttggatagttacatgtgacgatgacagaagaaaatgacactgcataataagacaaagagtaaaaataagtagcttaagcgttggaaactgtgaaaggcacataaggaatatttctctgtggggatgacttgaaaatgatgaatcgactgcagtgaggcaaaatggaatgaggaaaccagccagaagatgtgctgtctttcgtcctgtgtgcacctttctccactgcacgtgtgctttggaatactgactggcaaagactgtatgaatcaggaggcccccttgccctgtgacttcctgttgagtctagccaatgaggatactgataggaaatcagagtgaagcagcagagtgaggt

SEQ ID NO: 130801 - DNA, 354 bp, Homo sapiens
tggaaaggcctcagcacaacgaacagaaaatggagtgaacgcccgtgactgccctgcgcaatcctgcggagtcattgcttcatggccagagcttatttaccgccctcgggttagcccggtttggtcagacgatcagtcaggcaacctgtattgacagtggcctctgctgctacgatgacagctgtgcgcgagcgcccccagattatctgtgtgtagggcggaacagggtgcccgaggagtgtccacccaaatgggacaatttaatatagttgaggtgttcgccttatattctatcaaattaagttactggtcaatttcaggctttaagtggcattaaggatagttccaaaatta

SEQ ID NO: 130802 - DNA, 357 bp, Homo sapiens
cccatatcaggactgaggctggaagtcatcctctgtcagttcccaccctgcatcttggcacttttcctcctcaatctctcatcacttctgtcctttccatgctctaccacgcccttggctgggtccccctttggccattccacctccactccctactatcagggccatctttctcaaatgcagacctgaccaggtcactctcttgcttcaaatcccttagagatggctgccagccgagaggcagaagagagcatgggcttgggaggtggccctgtctcccaatggtcagctaccacttactggcagtgtcatcgggggcaatgctgggatcatgatgtgctttgcagggtagctggc

SEQ ID NO: 130803 - DNA, 246 bp, Homo sapiens
tgtcggaaagaccacagctcacccactgatctctgcaactgcagaaaagatctcacggctgcaaggattgcacaagaggaaaataagtaggaaggaaggagtgggaggaaatagtgaagggagtagaaggaaggataaagcagtgtatttcaaccctgtgcatcacaacacacagaggacaatgtaatattgtctaggacatttgagtcagtggacaaggctctgtgtctgctccaaatgctgaat

SEQ ID NO: 130804 - DNA, 183 bp, Homo sapiens
gtagtcttatctgggaagctactgaaaaatgacagtattagaatcagaaaggcaaatcaagacagactgtaggagactcagtcgattaatagttcattgtgttttacatatcatgtaatgtattggtagcattataaataataatggtcctgatcatgattagaataacagtattgggataag

SEQ ID NO: 130805 - DNA, 413 bp, Homo sapiens
gaataaatgctggttccaacatctccttcaagcttcataaatgaggcaaccttacactctcaaagaacaaagaaaaagcaatctgacagcttttgaaggccaaaaaacccttcaggcaacgttattaaattgacccacagcactgaagttttaaagccaagaaatgacttaggttttagaaattaacacttgtataaaaccttcagaataccatggggaaaataatcctttatttcagaaataaactttgaagtttgaaaacaaagcagaaaacctgtttctgaaaacagaaaggactatttgaaacactgagcacagttcttccacagctctttgaaactcttcaatagttccactctgacttctggagatggccaagtaagatataccccagaatgccagcaaaagaaaaa

SEQ ID NO: 130806 - DNA, 654 bp, Homo sapiens
ggaatagttcttttctatgtggttatactacatactcagtacacaagttcatatgtttcattttgcttttaatttttaggaatttttcttaataattatataaaacaatccaaaaagtcaaatctattaatagtattaaggcttgttcagaaaagtctatattctattcctgaatcctctaccttatttccttctccttagaggctaaccatttttgttttggttcaatttggggtttggtttatcctatttttaaaaacagtgttgtatatgaatatttttaattgaggcataatttatataattgtaaataaatatagtaatattacttgaaactttccatggtgatagaaatcagaaagtagttgcctaagtttgactagaaagaggctaagagattttagccctaagactaaaggctaaggggtaatagaaattcttacccctaacctcctgtcaccttctagcatattgtgcttaaagaaatttgtggtacagtaagggttctgttttaggaaaaagaaaaaacagcactgggatcacaaggaaatagataatttttggagaggagtaagtggggatggagcataaaattttaaagcacaatatttttagactacaaatttgaaaataattttatgttttaagatatag

SEQ ID NO: 130807 - DNA, 369 bp, Homo sapiens
caggtccctcccgtgcaggcagacctctctggagaaaatccttgaaacgtcactaagaatacacacaaagatgcattctgcaagaagctttacagtagggtccctcagggagggtgctgttgcaggcaaacttgattccagattcaccctgctctttttgatttgtgttttcttcccttcttaaaaaagttataggttgggcgcagtggcccacgcctgtaaccccagcactttgggaggccaaggcaggaggatcatttgagcccaggagtttgagaccagcctggccaatatggtgaaactccgtctctactgaaaatacaaaattagccgggtagggtggacaatatagcgagaccctctctctat

SEQ ID NO: 130808 - DNA, 763 bp, Homo sapiens
caaggatggggagaagtcgtttcctaaatgttatgcttgtgggacctgttttcaaatatatgttactgaccaaattatttttaactactcctcaccatttttatcactaccagcttctagcttatgctaacactacagtttcagtctctccgtcggcattttttttttacccttgaaatacctccatcagttaggcagtcttaccctctttcacatggtaccaatttttaatcatgctcctgaaacagatttttttctgtgacacttttattgtattttacagtaacatatatatgcaaaggtttaaaaagttcaacaacaaactggtttttatgaacagatggttttgggggtgcttgtttcatttcttttgtgtttaaaattttttaaattaacaaataattgtacgtattcatagggtgcacagtgatgttttaatatgtataatgtatagtgatcaaatcagggtagttagcatatccatcatctcaaacatttatcatttctttgtcttggaaacctccaatatcctccttctagctatttcaaactgtaagatatattaactgtagtcatcctttggtgggatagaacacttgaatgcatttgtcttatttagctgtaattttgggtcctttaacagtttttaaatgaatattgtccttatatgactctttctacaaacaatatatttagaaatctgttatattaggaagaaagatatataaaaattaggcatgcttagcctaaacctatttacttg

SEQ ID NO: 130809 - DNA, 264 bp, Homo sapiens
ctcattttaaaaactttttgtataaacagtcttgctgttgcccgggctggtcttgaattcctggccttgagttatccttccacctcggcctcccaaagtgctgggattacaggtgtgagccactgcgcccggcctaacccagtaacttttatctgaaatgcaaggttccccctctcccagcagtggagctcacgggtcctttgcatgaaaggcgtctcagtgcgttggtcgggtgcccgtggtctggcttcctgtctggcaccc

SEQ ID NO: 130810 - DNA, 358 bp, Homo sapiens
aagtatataatttatctcttttcacgtggctctttgccagagctaccactgttataattttcttaggtatacttctagagctattctataaaaatacaaggacatatgtgcatacttatatgtacattttaaatataaattgtagcatattattatagtgtatgttgtcctgcaactttttttcacttaaaaattgatcctgggggccaggtgtggtggcacatgcctgtaatgccaatacttagggaagccgaggcaggtggatcacttgagctcaggagttcaataccagcctgggcaacatgatgaaaacccaaaccccaaaatcccatctctacaaaaaaatacaaaaactagc

SEQ ID NO: 130811 - DNA, 965 bp, Homo sapiens
cttgcatcctaagctgcagccatgatgaaacatttctggccacagcaggcttttgcacatgctgtttctaatgcctcaaacaaatcctcccacccacccggctcctcttaaaacctaattcatccacttctcaccacatggtctcatagtttcccttcactatccttttattgcttttatgtttcattttgtgactctctgattaaagttactttcacctgttagactgtaagttccataagtgcaaggactatttttgttttattgaccattataccatccagactgtcttctactacagtgcacagaaaaccagcaggcactcaaagtatgtgttaaatgaataaataaaaatgccaatgctggtaggtgagtggggatggggatcactgattgaataaggaccagaagaatgtgagaaaggaaaatgaccaaaagcacaactggagaggtctgccatagaaaggaaaagcagttccttctctgatacctgaaaacagctgcaggagggtaaaattacagaaatatagagaaagtagggatgaaaatgtgaggggattcatattatatggcctctcttcaagaaagcagaagaccaagtcaacttggagtaagaaatcagcagcttgagtgagaaacgtggacattcttttctgacctgctgctgtagagaatggggtagagtcagtagggaaaaacaaaaaagatgaccaagaccacgggcctcgctgaggaaagtaatcacaaatctcatgaagagacagtgtcaatacaatactataatttttacaaaagctatggttaaataccagagtagaagtgagaaaaatgggcaacttgttgtgcccccaccaatcctgggcactagtgaaagaaatggacaactaaatgtccccccaccaggcctggggattggtgagacaagtgaaacactccaagtgctaatgatgcatctggcatcatat

SEQ ID NO: 130812 - DNA, 475 bp, Homo sapiens
tctcaaactcctggactcaagtgatctgcccaccttggcatcccaaagcgctgggattacaggtgtgagccagcgtgcctggcccccttcttcaataccattggaaagacatctgcttgagctttcagagctgtccatcccagagcttgggtccaaattaattacatcacattgaaataaaaaacttcctggaggctgggtgcagtcgtcacgcctgtaatcccagcactttgggaggccgaggcgggtggatcacgaggtcaggagatcaagaccatcctggctaacacggtgaaaccccgtctctagtaaaaatacaaaaaattagccgggcatggtggcgggtgcctgtggtcccagctattcgggaggctgaggcaggagaatgccgtgaacccgggaggcagaacttgcagtgagcagagattcgtgccactgcactccggcctgggggacaaagcgagactccgtctca

SEQ ID NO: 130813 - DNA, 666 bp, Homo sapiens
cacagaggctcacgcctgtaatcccagcactttaggaggctgagacaggaggattatttgaggtcaggagttcaagaccagcctgggcaacacagtgaaaacccatctctactaaaatcacaaaaatcagccggacgtggtggcgcacacctgtaatcctggctactcagtaggctgaggcaggagaaccagctgaacccaggaggtagaggttgcagtgagctgagattgtgccactgcactccagcctggggaacagagcgagattctgtctcaaaaataaaaataaaaataaatttaaaaaagagtgaggaatgagctagaagagacatcatggcaggaagatgggggacagattccttcggtcctaagggactagggtgctgggttgaatgaacatttttccagaggttctacagtaaatataaagaaattagagctatacccaaataaatatattatttgccaaggatatacttcttgacttttccaaaagttgccaagaataatccattagaaaatcagtaattttatgacctttatgtctgaactcttcttttctgaaagctggcataacacagaagagaaacaggaaggggcccacagcccagtccagccattccttgtctttgaatagaaaaaccaagctaatgcacaaagagtctc

SEQ ID NO: 130814 - DNA, 812 bp, Homo sapiens
tgataaaagaattttatagttttagctcttatagttagcagttctattttgagttaattttagatgtggcgtatgttaggagtccatctttattcttttgcatgtggatatccagttgccccattaccatttgttgaaaaggctattctttttaacaaattaatagtctcagttgttgtttttttacccttgttgaaaatcaattgaccataaatatgtgggtttattttgggattctcaattctaatatgttgatctatgtctatcatcatgccagtaccgaatctaattttaggatacttatttttcagtcatgttgcttattattcccaattgtcctaagtaagaatagaaattcaggtagtaggatgcctttaatttcactgtttgcttcctgaaggaacatgtggccagcttatattaatatcttgctgactcctgtgacacaatgggaagtcaggcttacaaagacagagcgtattcatttctttttctccgttcaaaccatttttctctcactcagtccctacctcttcactccgattttcatcaaatcttggttagaggatctgctgactcagtctactatttactgcattatatttactaactcataataagtcatagaattgtgtagatttttgccatgtaggaaggagaagattaagtctgggctgttgctttcctctttggaaattgagctaattcatcatcttacagctcacaaatagatcctctgttgacctggtacctggttctttgtataacactggagctgatccttttcttggcacagatcctacattctcaga

SEQ ID NO: 130815 - DNA, 293 bp, Homo sapiens
aggcctgctactacctggagtggctgttaggtcctaatacctcttgggaggcagggtgggtgaagtaggactgtctttgatttgccttgggggtctcgctctgtggagacccaggcccatccttctgtcctcctgaatttgtggcctgggctctgccctcctcggtctgagttccccttaccaaggtggcttctctgtccactagcccctctgcgcctcttcaggtggatgttaagtccagttggtgagaggtttcccaagatgtggcatgcagaagctcacagagtggcccc

SEQ ID NO: 130816 - DNA, 451 bp, Homo sapiens
gcattttccacaagtgatgagacaatctccacagcataggtagattcctccgacttcatctcagccttggatgttgtcatttgagctctttcttggaaaacaaccatcagagaagcctgtggctgtgatacacccctttactatctccctattaattccctgattggtaattgtaaaaacccattaatcttactgtgccacttcctgcctggcttctcacagcatggtgctgaggaatggagattctagaaggtgttaggccatgaggtgtaaaatgagaagaacccatacaaagaacgtttctccaagaaagcttcaattcaacctccatgttaccaaattatcatttgtattttccaaccagagttccaggtcccagtagcatctgccctgaggagctcaggaaaccccttcaacagtgctgcccctctttaccgcttctttacatctc

SEQ ID NO: 130817 - DNA, 743 bp, Homo sapiens
cataatattaagacaatcttgttttgtaaaaaatcagtcaagaactttggaaaatatggcaaatgatcttaggccctgctggctgtagaataaacttccaacatgtctttcacatattttaccaatatctctcaataaaatgttctgctctttcacctgccaatttcacttgagatgtttgtcttaaggaaatctctctgtgtggatcacataccttatagagagaagaggcttactggggcattctttgtaacagtaagatgtttgaaacgatgccagcgtcccacagtaggggtgcggctgtgtagacgaggggattgcagttctgtagataattatgcagcatcctgagggatggcttcaaagagcatgttataaaatgggagatccctgttacaaacgtcagattctacagggcagaaatgcaactgtagtcatgtaacagctgaacaaaacctatgtagaaacaaattgggataaaattagaccaagagatatcctggctgtgttttacataacgtatctgtggctaatttccctctttatttagtattgtgagttcctaaaattttttttgtgacgatgactttaaaagaatcagtgcctgggccgggtgcagtggctcatgcctgtaatcccagcactttgggaggctgaggttggtggatcacaaggtcaggagatcgagaccattcctggctaacatggtgtaaccccgtctctactaaaaatacaaaaaaaaa

SEQ ID NO: 130818 - DNA, 328 bp, Homo sapiens
ggttaattggtcctttccatgaagtcatcgttgggaagcactcttcctttcaaggcagtgagcagcaccgttctgtttctatagtttcccctgtagctagctggcttggaattgagagcaacagtcctctgaaccctgtctcatgctgagctgtttggtacctcactttgagaattctcagcccaagggtgttttcttccttagagaccaaattctccacttattcattcaagaaatatttatggagtacctactatatgctaggtcccaaacatgaaatgcctcttgtttgtttttttgttttgttttgttttgttttgtttttttc

SEQ ID NO: 130819 - DNA, 344 bp, Homo sapiens
tagttaccactgtcatttcttcagctatggatatgtggctgatgttggagagacggacctcagtgtgttttatattgtctggtgttaagatgataaattactttgtgattacaagcaaattttctatttgacaaagcccttggtggagtccaaatgatttttctgtaccatattgttctcttacacatacgtatgttaggaaaataggcacactttcaaagagaatgttctcttacacatacgtatgttaggaaaatagacacattttcaaagagaatgttctcttacatatgttaggaaaataggcacactttcaaagagaggtataggggctttttactgcc

SEQ ID NO: 130820 - DNA, 320 bp, Homo sapiens
agctgggggggggctaattttttttgtatttttaagagacggggttttgccatgttggcgaggctggcctcgaactcctgacctcaagtgatctgcccacctcagcctccccaagtgctgggattacaggtgtgagccaccatgcccagcctataattgtttctatcttatgtctctttatgcggtattgtggatgacttccttatatccatcttataataaattaggcctttttattgaggattatagaaacttatctataataaattttgaatgttttactccagaaactattttttaattttcattttttgacttgg

SEQ ID NO: 130821 - DNA, 444 bp, Homo sapiens
catgtatgtgtgtctgtgtgcatgtgtgtggtgtgtgtgttctgcctgtgcatggtttgtggatgtgtgtacatgttgagacgtgtgtgcacatgaatgtatgtgtgttggtgcatccgtgtgcatttgtgtgcatgtgcacatgtaggtgcctgtgttacatacatgtgcaaatgccctctgcccacggcagtctggggttttcctacctcctttcctaactgctctgtctcagtcacctgcccccctcactcactctcccatggcaagcttccccagccccctgcagcttgagtgattgtttcaaggctaacaatgcctggatccctctctccagaccagacctcactcctgagccccgacccacatgtccagtgccccccggtcactcccgtgacagcaccctcatgctgggtgagaatcttctggaaggtgtgggcctcc

SEQ ID NO: 130822 - DNA, 498 bp, Homo sapiens
cttgtagcccctctttagaaaatagcatggatgctttctgatcacaagcttcctgctcaattgagttctccacaggaaggaaatattggagccactgaagcagtcgatagctcaagatggagagagagactggcaggaagcaacaagaaagaaaatgcgttggaaactgagaatggtgagcccaggagacaaaagaagagggcagtgcaagaaaaggagatgaaaggggccttagccaccaaattcagttctggtcctacattttaagggcatctatattctaggcactgtgctgggttctggacatataaaaataatatgggctgggcgcggtggctcacacctgtaatcccagcactttggaaggccgaagtggaaggattgcttgagcccaggagtttgagaccagcctgggcaacatagtaggactccatttctacagaaaaattaaagaaaattagcccggcatggtggcacgtgtctgtagtcctagctact

SEQ ID NO: 130823 - DNA, 463 bp, Homo sapiens
gcagcacctgcttgtgtttgggtcgaggagactttagttggcaggccacatcaagaggctggaatgtcaacttgcactgggccagtgggtcatcaccttgcctgcctgttgggacccccggcatcaccactgcagctttcatggatgcccaactctcgcctcatgattctgattcagggcgtgtgggctggagacgaggtttctataaccctcaggtgactgacgcccagccaggtttcactgagtgagacctacagtgagccctgcatgacatccaagtggcgtccccacctccacatctccttacacacttgatgcactaccgtcatccaggaaccacccacatcctccttagcacatgtcgtgaacttcagaagcaacctgtgatctctccagccccatgttgtgggagtgaaggggcctaataagggccatctcaaagagacagcagacaaagtcttcg

SEQ ID NO: 130824 - DNA, 420 bp, Homo sapiens
tatgttaaagaaactaagtcattagtcttgtagtgactctaaagaaactaagtctaagtcttgtagagttcccctcagtctgaatactggtgactgtatcccagtgttattggatacactggtggaagaaatacttaataagtgtgtatatttccatcaggagatacctaatatctggatgtctctcctttttctttttgttgagtagccattgatggtcattgcctaggtctgctaattcatgacagtcttcggtaaatgggactattagctagtggctcttgccaatatattaagtattctaggatatacaacatttagacacaggttacacactttctttttatattgtctgcaactatttccattggtattctagtttattttactgcaactgccttttaatgggtcttcctgcac

SEQ ID NO: 130825 - DNA, 815 bp, Homo sapiens
aaacagctgtgggccagaggaatggaggggctgtgggtgaacacgaggacagccgagattcgactctgcccacagaccagcaaagccaaggacagagaggtcttcagggaatacatggctatggtggtttgaagactcccattagagagtggatattaattgccctccttttgaatatggtctggacttagtgatttgattgtaacaaatagaatacagcagatgtgatgctatgtgacttccaaacctaggtcataaaaggagatgaagttttcacctggctctcccttgggacactcacccttggaacccagctgccatattgtgaggaagctcaagccacagggaaggccatgtgtaggtgtttgggctgatggtgccagctgaggacctggtctactgccagtacaacttatatcaagcatgtgagttggcgagcttttgaaagaactccagccacagtcactgaccacgctgcctgagagacctagagagaaaacctagctgagccaaatcaggccccggaaccaatgtacagcatgaaagaaatgctccagtttatataacttatattttggatgcaacaatcaagtattcaacctcaaggaatgggaagatgggatacagaaattggtaggtggagaaattttatttgtggtcaatgaaaagacactttttgagtgattgaatctgaatttctcaagttgtaaacagatggaatatgtggatctattagttacagtgtacggtatattaaaggtgggataacttggggaaaagcatgtttaaaaaagaaaatggggggcaaattaagg

SEQ ID NO: 130826 - DNA, 429 bp, Homo sapiens
gatcctcaactggcagcctgcaaggaaatggggatctcaattctacaactgcaaggaactgaattctgccaacaatccacatgagcaaggaaacatatcttatcctggagcctccagaaaggaatgtaaccttgccaacaccttaattttagttcagtaacatccgtattatacttctaacctgcagaactatgaggtaataaaattctcttgcttaagccactaactttgtagtactattatggaagcaatagaacattaatacaacatatattccctctcttcttgtcaatgtcagtttatattattctatacaatagcagaatgcagtatagaagagaggaaaagagtgtggtctgtgcatttagacagagctgagtttgaatcttgcttctgttatatcttagctgaatgactttgagaaaatac

SEQ ID NO: 130827 - DNA, 613 bp, Homo sapiens
agttttcatccctcattacctctgtcctaggcaattgggatagcctcctaactagtcactgcctacctatactctctccctgctccaaagcatcttaaacactgatgtttgattataactcataacttccccccaccccgccttttttttcttttttaaaaaaattatactttaagttctgggatacatgtgtagaatgtacaggtttgttacataggtatacatgtgccatggtggtttgctacacccgtcaactagtcacctacataaggtatttgtcctaatgctctccctctcctagccccccattccctgacaggacccggtgtgtgatgttcccctccctgtgtccatgtgttctcattgttcaactcccacttatgagtgagaacatgtggggtttggttttccgttcccatgttagtttgctgagagtgatggtttccagcttcatccatgtccctgcaaaggacatgaactcatccttttttatggctgtgtagtattccataatgtgtatgtgccacattttctttatccagtctgtcattgatgggcatttgggttggttccaagtctttgctattgtgaatggtgctgcaataaacatatg

SEQ ID NO: 130828 - DNA, 180 bp, Homo sapiens
agattgagcagaagccaacagtcatgtggtacacagatcttcagggctttccacttctctccgcgagtcctaataacctaatctggaaaatacttccaaaggtactgcacaccccatttcccctcagtaaaccacagcccaagggtaaacgtggctcaggcaagggcatgcgtggtggag

SEQ ID NO: 130829 - DNA, 206 bp, Homo sapiens
gtaagagcctttattgtggtttctgtaggaagaaataggacagacaggagaagcaggcttgggattgactagcagaataatttcagtgggcttgtagagagtggagagactgttccaagttgtcggatactttgtcctgaggggattgggggaggaagcagcggcttgatgtgagtcagttcagttcaataaaggaggtagttggg

SEQ ID NO: 130830 - DNA, 408 bp, Homo sapiens
tgatcgcccaaatccatatataattacaaatgtgttgaaaacagtgataagaaagtaatgtctgtaatgaggggtatgacttagtctgcagcattctggaaggatccccgaggaaacagcatttcctctgagctctggaaagtggagtaggtataaatcaggcaccaggggagaggaagagctttcctagcagcatgtgcaaaggctccatggcaggaaggagcctggaaaatgtgagtaactaaaaggaataagatgcaactaaacagaggaagtgagaggtggtgttttagaaatggtctcagggaggtgggcaggaagtggaccatgaagaggctagaggccatggcagggagctggctctgtatacttaaaaaaacatgggtccaggcatggtggctcacacct

SEQ ID NO: 130831 - DNA, 467 bp, Homo sapiens
aagttacagaagacaagtttattttatcttgtatttaatatgataattgcaactaagcatttgaaacaacgggcagcaaaaggcccagtggcacacagggcagcacatccagtgcaggctctttaataaccagcttacatgccactctgctcacactggggcaatccggcttcctgagagccttccactacttttggccgggtatggtggctcacgcctgtaatctgagcactttgggaggccaaggcggataaatcacctgaggtcaggagtttgagaccagcctgaccaacatggtaaatccccaactttactaaaaatacaaaaaaaaattagcctggtatgatggcgtgcgcctctggtcccagctactcaggaggctgaggtaggagaatcgcttgaaccagggaggcagagattgtagcgagcagagactgggccactccacttcagcctgggtgacagag

SEQ ID NO: 130832 - DNA, 288 bp, Homo sapiens
acgttgtgcacatgcaccctaaaacttaaagcatgataaaaaataaaaaataaaataaaaacattggctgttgactccaaatatcctgcttcatcatctctccactccagaaacttttcacatgcttacaaagggtgttcatttctcctctaagtatttgcactccagccccacctgcaagaaggtggaagtagggcctctgcctgggatggtaactctcaaatacaaggcaagacctttctctcctccaatatccccaggactgaaggactgtgcaagtctgcatat

SEQ ID NO: 130833 - DNA, 326 bp, Homo sapiens
tcaggcatgatcagggttcactgctgtctcagcctcctgggctcaagcctctcgaatagctgggactacaggcacaagccacgatgcctagctgattctttaatttttatgtttttgtagagatgggcctcattatgttgccctgggttgtcttgagctcctggacttaagcgatcctcccaccttggtctcccaaagtgttgggattacaggtgtgaaccactgcacctggctgagatccttttaattatctacatatgccaggcattgtgctactaactgaacatgtctaaggagaactggatttgtttgtaatactttttttt

SEQ ID NO: 130834 - DNA, 655 bp, Homo sapiens
gtagaactgaaagaacttaagactacagttaattctaagcctttttgaagattatatagtcttctagtagaagtctgtgcatcagaatgttttaagaaagggttttaagaatgtataaaaaccaaaataattgattttcatacttctatattgttttttatcagtgactcttttttctttcaaatgaaatcttatatgaaattttcatatataatatagaaaaaagtggatctagtctgtcaaagagaatagtgaagctcagagatgtgccagcctggcctttttctcagctcaagtggcagaatacagtttgtaaacaattgcactagctcttaaattcgaagaggcagtcaaactaataaataaattggagagttatttctttggtagaggattaagggaaataaccacagacagaagaagcaaatatgagaatctatgtgaaatggatgatattctagaaaaaaaattatcaaaactgacccctaaagagagaatatctaaacagagtaaagaagaggtacagaaagttactgaagaagtttccaccccacctgcacaaataacaatagtaccaggccccagtggattaatggggaaattctgttaaacctttaaggaatggtaactctaatactaagtgttccgaacatat

SEQ ID NO: 130835 - DNA, 113 bp, Homo sapiens
ggcacagcctgagtgttagcattgcagatggatactgacttgcccaaagtcacatagtgagtcagtgcttggggcagggcaggaagtaggtctcctaactcctagcccaggac

SEQ ID NO: 130836 - DNA, 407 bp, Homo sapiens
cttggggaattgccacactttcttccacaatggttgaactaatttacactcccacctgcagtgtaaaagcgttcctatttctccacatccttgccaacatctgttgtttcctgatgctatattttcattgaaaatacttttcagttcaaaatattttctcatttctttgtgaatttgtagatacataatattgagttctaacttcatcccactgtcttcagaggacatattttcaatgatttcaagctctttaaatgtattaaaactgtcttatggtccagcatatagtgtatcttgaacatcctcagtatgctcagaaagaatgtgtgtattctacagttgctaggtgcagtgatctacaaacatcaattaggtcaaagtggttgataatggtattgttcatatca

SEQ ID NO: 130837 - DNA, 225 bp, Homo sapiens
aaaaaacaattttattggttttttttcagactgtattatatagctcttcagctttattacaatcatgcaaaagccaaaggttaatatttgaaaatattctccaagcaaggatttagtaaatactttgactgtatttctgctttttgctagaaagtctatttcattgctaaaatgcatctattatatcaaataaatgcatacagctatctcctatgtagatacatc

SEQ ID NO: 130838 - DNA, 351 bp, Homo sapiens
ctgagcccagatagtgccactgtactccagcctgggcaacagagtgagtgagactccgtctcaaaaaaaaaaaaaaaaaaaaaaaagacaaaaaacaaaccagtatttacccatataaacactagaagtaaattgcatgacttttaagctaggcaccatatcttcgtttgagttatttggtttctttgtggatgtgtgggcacctatgcgcgtgtgcatctgtgtgagtcattagggtaaatgctagttatgtaaagaatgtatggagtctttagaattcaaatagaattggttccattcaaagtaattgatttctagtagttgaaaattagtgctggttgactcttgtta

SEQ ID NO: 130839 - DNA, 196 bp, Homo sapiens
aggagagagaaaaaaatcaccaaaggtatattttcttagtagaaccaagtatccagcacaaagaaccaagacccccatcaaggccaagcacatggaacccctaacacagtgaacaaagagagcttgaaaagctgccaacgagaaaaagcagatcgtgcacacaaggtcacagtggctcacgcctgtaatcgcagca

SEQ ID NO: 130840 - DNA, 167 bp, Homo sapiens
agctcattatctgtctgtacctccaccaccccaccccaaataacttatccttttctcagtaaaagaataagttactttcctcagcagagataaacatatgctgaattttccagggcaatccttatcgtgtataatttcattctttcctaaaaaggtagttttgctgg

SEQ ID NO: 130841 - DNA, 2292 bp, Homo sapiens
taaatcagctcggtaccggcatgtgctgtaggccagcggaggcccatcgctgtcttctgtgctgaacgagctgcccagtgctgccacccttcggtaccgagaccctggggtgctgccttggggggcgctggaggaggaggaggaggatggaggaaggagcagaaaggccttcacagaagtcacccagacagagctgcaggaccctcacccttcccgggaactgccctggcccatgcaggccagacgggcacacaggcaaagaaatgccagcagggaccaggtggtctatggctctggaactaagacggaccgatgggcgcggctacttcggaggtccaaggagaaaacaaaggaaggcttgcgaagcctgcagccctgggcgtggacactgaagaggatcgggggccagtttggcgccggcacggagtcctacttctccctgctgcgcttcctgctccttcttaacgcgctggcctacagcacatggcctgcgtgacgctgctgcccacctggttgggaggcgctcccccaggccctcccggccccgacatctcctcgccctgcggctcctataacccccactcccagggcctggtcacctttgccacccagctcttcaacttgctctcgggtgagggttacctggaatggtcccctctcttctatggcttctacccgccccgcccacgcctggcggtcacctacctgtgctgggcctttgccgttggcctcatctgcctcctgctcatcctgcatcgctcggtgtctgggctgaagcagacactgctggcggagtccgaggctctgaccagctacagccaccgggtgttctcggcctgggacttcggtctctgcggggacgtccacgtgcggctgcgccagcgcatcatcttgtacgaattaaaggtggagctggaggagacagtggtgcggcgccaggctgcggtgcggacgctgggccagcaagccagggtttggttggtgcgggtgctgctcaacctgctggtggtcgcgctcctgggggcagccttctatggcgtctactgggctacggggtgcaccgtggagctgcaggagatgccccttgtccaggagttgccactgctgaagcttggggtgaattaccttccgtccatcttcatcgctggggtcaattttgtgctgccgcccgtgttcaagctcattgctccactggagggctacactcggagtcgccagatcgtttttatcctgctcaggaccgtgtttcttcgcctcgcctccctggtggtcctgctcttctctctctggaatcagatcacttgtgggggcgactccgaggctgaggactgcaaaacctgtggctacaattacaaacaacttccgtgctgggagactgtcctgggccaggaaatgtacaaacttctgctctttgatctgctgactgtcttggcagtcgcgctgctcatccagtttcctagaaagctcctctgtggcctctgtcctggggcgctgggtcgtctggcggggacccaggagttccaggtgcccgacgaggtgctggggctcatctacgcgcagacggtggtctgggtggggagttttttctgccctttactgcccctgcttaacacggtcaagttcctgctgcttttctacctgaagaagcttaccctcttctccacctgctccccggctgcccgcaccttccgggcctccgcggcgaatttctttttccccttggtccttctcctgggtctggccatctccagcgttcccctgctttacagcatcttcctgatcccgccttctaagctttgtggtccattccgggggcagtcgtccatctgggcccagatccctgagtctatttccagcctccctgagaccacccagaatttcctcttcttcctggggacccaggcttttgctgtgccccttctgctgatctccagcatcctgatggcgtacactgtggctctggctaactcctacggacgcctcatctctgagctcaaacgtcagagacagacggaggcgcagaataaagtcttcctggcacggcgcgctgtggcgctgacctccaccaaaccggctctttgacccccgcagcccacgtcccgctttcagaccccaggcccattgtaagcctaggtcacaacatctgtaaactaggagaactggagaagactccacgcccttccagctttggtatctggagatttccagggcccctcgccgccacgtccctgactctcgggtgatcttccttgtatcaataaatacagccgaggttgctgagcgcgctttgaa

SEQ ID NO: 130842 - DNA, 2357 bp, Homo sapiens
taaatcagctcggtaccggcatgtgctgtaggccagcggaggcccatcgctgtcttctgtgctgaacgagctgcccagtgctgccacccttcggtaccgagaccctggggtgctgccttggggggcgctggaggaggaggaggaggatggaggaaggagcagaaaggccttcacagaagtcacccagacagagctgcaggaccctcacccttcccgggaactgccctggcccatgcaggccagacgggcacacaggcaaagaaatgccagcagggaccaggtggtctatggctctggaactaagacggaccgatgggcgcggctacttcggaggtccaaggagaaaacaaaggaaggcttgcgaagcctgcagccctgggcgtggacactgaagaggatcgggggccagtttggcgccggcacggagtcctacttctccctgctgcgcttcctgctccttcttaacgcgctggcctacagcacatggcctgcgtgacgctgctgcccacctggttgggaggcgctcccccaggccctcccggccccgacatctcctcgccctgcggctcctataacccccactcccagggcctggtcacctttgccacccagctcttcaacttgctctcgggtgagggttacctggaatggtcccctctcttctatggcttctacccgccccgcccacgcctggcggtcacctacctgtgctgggcctttgccgttggcctcatctgcctcctgctcatcctgcatcgctcggtgtctgggctgaagcagacactgctggcggagtccgaggctctgaccagctacagccaccgggtgttctcggcctgggacttcggtctctgcggggacgtccacgtgcggctgcgccagcgcatcatcttgtacgaattaaaggtggagctggaggagacagtggtgcggcgccaggctgcggtgcggacgctgggccagcaagccagggtttggttggtgcgggtgctgctcaacctgctggtggtcgcgctcctgggggcagccttctatggcgtctactgggctacggggtgcaccgtggagctgcaggagatgccccttgtccaggagttgccactgctgaagcttggggtgaattaccttccgtccatcttcatcgctggggtcaattttgtgctgccgcccgtgttcaagctcattgctccactggagggctacactcggagtcgccagatcgtttttatcctgctcaggaccgtgtttcttcgcctcgcctccctggtggtcctgctcttctctctctggaatcagatcacttgtgggggcgactccgaggctgaggactgcaaaacctgtggctacaattacaaacaacttccgtgctgggagactgtcctgggccaggaaatgtacaaacttctgctctttgatctgctgactgtcttggcagtcgcgctgctcatccagtttcctagaaagctcctctgtggcctctgtcctggggcgctgggtcgtctggcggggacccaggagttccaggtgcccgacgaggtgctggggctcatctacgcgcagacggtggtctgggtggggagttttttctgccctttactgcccctgcttaacacggtcaagttcctgctgcttttctacctgaagaagcttaccctcttctccacctgctccccggctgcccgcaccttccgggcctccgcggcgaatttctttttccccttggtccttctcctgggtctggccatctccagcgttcccctgctttacagcatcttcctgatcccgccttctaagctttgtggtccattccgggggcagtcgtccatctgggcccagatccctgagtctatttccagcctccctgagaccacccagaatttcctcttcttcctggggacccaggcttttgctgtgccccttctgctgatctccaggagccagacgtttggatataatggaagagcgtgtcaggagtggcttccgttcctgtctccttcagcatcctgatggcgtacactgtggctctggctaactcctacggacgcctcatctctgagctcaaacgtcagagacagacggaggcgcagaataaagtcttcctggcacggcgcgctgtggcgctgacctccaccaaaccggctctttgacccccgcagcccacgtcccgctttcagaccccaggcccattgtaagcctaggtcacaacatctgtaaactaggagaactggagaagactccacgcccttccagctttggtatctggagatttccagggcccctcgccgccacgtccctgactctcgggtgatcttccttgtatcaataaatacagccgaggttgctgagcgcgctttgaa

SEQ ID NO: 130843 - DNA, 2351 bp, Homo sapiens
agagacagcccagcctgggccatggaagaaaacccgaccttggaatcagaagcctggggctcctctagggggtggctggccccccgggaggccagaggaggcccatcgctgtcttctgtgctgaacgagctgcccagtgctgccacccttcggtaccgagaccctggggtgctgccttggggggcgctggaggaggaggaggaggatggaggaaggagcagaaaggccttcacagaagtcacccagacagagctgcaggaccctcacccttcccgggaactgccctggcccatgcaggccagacgggcacacaggcaaagaaatgccagcagggaccaggtggtctatggctctggaactaagacggaccgatgggcgcggctacttcggaggtccaaggagaaaacaaaggaaggcttgcgaagcctgcagccctgggcgtggacactgaagaggatcgggggccagtttggcgccggcacggagtcctacttctccctgctgcgcttcctgctccttcttaacgcgctggcctacagcacatggcctgcgtgacgctgctgcccacctggttgggaggcgctcccccaggccctcccggccccgacatctcctcgccctgcggctcctataacccccactcccagggcctggtcacctttgccacccagctcttcaacttgctctcgggtgagggttacctggaatggtcccctctcttctatggcttctacccgccccgcccacgcctggcggtcacctacctgtgctgggcctttgccgttggcctcatctgcctcctgctcatcctgcatcgctcggtgtctgggctgaagcagacactgctggcggagtccgaggctctgaccagctacagccaccgggtgttctcggcctgggacttcggtctctgcggggacgtccacgtgcggctgcgccagcgcatcatcttgtacgaattaaaggtggagctggaggagacagtggtgcggcgccaggctgcggtgcggacgctgggccagcaagccagggtttggttggtgcgggtgctgctcaacctgctggtggtcgcgctcctgggggcagccttctatggcgtctactgggctacggggtgcaccgtggagctgcaggagatgccccttgtccaggagttgccactgctgaagcttggggtgaattaccttccgtccatcttcatcgctggggtcaattttgtgctgccgcccgtgttcaagctcattgctccactggagggctacactcggagtcgccagatcgtttttatcctgctcaggaccgtgtttcttcgcctcgcctccctggtggtcctgctcttctctctctggaatcagatcacttgtgggggcgactccgaggctgaggactgcaaaacctgtggctacaattacaaacaacttccgtgctgggagactgtcctgggccaggaaatgtacaaacttctgctctttgatctgctgactgtcttggcagtcgcgctgctcatccagtttcctagaaagctcctctgtggcctctgtcctggggcgctgggtcgtctggcggggacccaggagttccaggtgcccgacgaggtgctggggctcatctacgcgcagacggtggtctgggtggggagttttttctgccctttactgcccctgcttaacacggtcaagttcctgctgcttttctacctgaagaagcttaccctcttctccacctgctccccggctgcccgcaccttccgggcctccgcggcgaatttctttttccccttggtccttctcctgggtctggccatctccagcgttcccctgctttacagcatcttcctgatcccgccttctaagctttgtggtccattccgggggcagtcgtccatctgggcccagatccctgagtctatttccagcctccctgagaccacccagaatttcctcttcttcctggggacccaggcttttgctgtgccccttctgctgatctccagcatcctgatggcgtacactgtggctctggctaactcctacggacgcctcatctctgagctcaaacgtcagagacagacggaggcgcagaataaagtcttcctggcacggcgcgctgtggcgctgacctccaccaaaccggctctttgacccccgcagcccacgtcccgctttcagaccccaggcccattgtaagcctaggtcacaacatctgtaaactaggagaactggagaagactccacgcccttccagctttggtatctggagatttccagggcccctcgccgccacgtccctgactctcgggtgatcttccttgtatcaataaatacagccgaggttgctgagcgcgctttgaa

SEQ ID NO: 130844 - DNA, 1572 bp, Homo sapiens
ggagacggctgcatcagttcacgttaaggaggatctctggagagccagacctggggaaccgggaggcccgcgccttgggaaatggagtccaagcgggcatctctcctgccttcaggtggagctggaggagacagtggtgcggcgccaggctgcggtgcggacgctgggccagcaagccagggtttggttggtgcgggtgctgctcaacctgctggtggtcgcgctcctgggggcagccttctatggcgtctactgggctacggggtgcaccgtggagctgcaggagatgccccttgtccaggagttgccactgctgaagcttggggtgaattaccttccgtccatcttcatcgctggggtcaattttgtgctgccgcccgtgttcaagctcattgctccactggagggctacactcggagtcgccagatcgtttttatcctgctcaggttccagcctcacggggatggctgggaatgatgaagggtgggggcggtcagagggatgttggcgctgacaggaccgtgtttcttcgcctcgcctccctggtggtcctgctcttctctctctggaatcagatcacttgtgggggcgactccgaggctgaggactgcaaaacctgtggctacaattacaaacaacttccgtgctgggagactgtcctgggccaggaaatgtacaaacttctgctctttgatctgctgactgtcttggcagtcgcgctgctcatccagtttcctagaaagctcctctgtggcctctgtcctggggcgctgggtcgtctggcggggacccaggagttccaggtgcccgacgaggtgctggggctcatctacgcgcagacggtggtctgggtggggagttttttctgccctttactgcccctgcttaacacggtcaagttcctgctgcttttctacctgaagaagcttaccctcttctccacctgctccccggctgcccgcaccttccgggcctccgcggcgaatttctttttccccttggtccttctcctgggtctggccatctccagcgttcccctgctttacagcatcttcctgatcccgccttctaagctttgtggtccattccgggggcagtcgtccatctgggcccagatccctgagtctatttccagcctccctgagaccacccagaatttcctcttcttcctggggacccaggcttttgctgtgccccttctgctgatctccagcatcctgatggcgtacactgtggctctggctaactcctacggacgcctcatctctgagctcaaacgtcagagacagacggaggcgcagaataaagtcttcctggcacggcgcgctgtggcgctgacctccaccaaaccggctctttgacccccgcagcccacgtcccgctttcagaccccaggcccattgtaagcctaggtcacaacatctgtaaactaggagaactggagaagactccacgcccttccagctttggtatctggagatttccagggcccctcgccgccacgtccctgactctcgggtgatcttccttgtatcaataaatacagccgaggttgctgagcgcgctttgaa

SEQ ID NO: 130845 - DNA, 360 bp, Homo sapiens
atgtcactaaatagacagagtgtggatggatcatgttgaacctgtaggaagccaggcagatccaactgctaggagaaatcctcaaaagaatataataaaaagttttaaattggtaaagtgaattagtagagcttaagagggaaagagaaatggggtgtgggggagtagacagaaaaagaaaaggaaaaagagacattcagatgtctgtttactacacttggatataggacttaaggacagtatctcgggttttaatgctcatgaagggacaggcggtaaagtgtagctcagagtgttaagctggaactaaaactgatgcaaagtatcaattcgtttgaagagacacagtattactaggtg

SEQ ID NO: 130846 - DNA, 575 bp, Homo sapiens
tactaagtatttaaaaagaagtactcagttgttaatcaaaataatatgatttggaaaaatgtaaattaaacctcagagtcctagagtcaaactggttttgaatttcctgttctttactagacatgtgatcttaggtgagttagttcaccactttgtgctttagtttccttatcaagtaaagttgtgataataatattccatatatgatagggttatgctaaagattgaatgaggcaatatatataaaatgcataatacagtgcataataataatgcacacagtggcaagttcctgtagttccagctacttgggtggctgagacaggaggattgcttgagcccgggagttcgaggctgtagtgtgccgtgattgtacccgtaactagccactgcattccagcctgggcatcataggaagaccttgtttctctttttttaaaagcataatacattacctaccatatactaagctctcagtaagttaaaaattaaaacaaaaagttatgaatatttacctgtaaccaactttgtaagtgaaggtattaatacattggagtttatctcttgaattttaa

SEQ ID NO: 130847 - DNA, 549 bp, Homo sapiens
ctgtccagaagtgtcacttactgtgtgctcagtcctgtcttaaggagaatcagggatactgaaaggtgtaagggcagttccttccctcggaatcgacagactggtggggaagacagataaactgctgtaaggtgatgccacaatccagcatcaactcttggtcagaacaaagtgaggagcccagagtaggtgctcaataagccaccaagtgggtctgtaaatcatcctgggctccagatctcagttacttgcttccgaggacccttcagggtctgaccccaaagacgagagatggctcattaaaaccagaggtgctctgctgagaaagtgcatgcccgtcctggggagcataacaagattctttaatgctaaaaatagccccggtaaacaggctttgatgactccccacagccaggatatgcgcgggctgaggttttggagcactttttccggagcaacgctcatttccttcaggcagcaccgcccatgtggggtgggacttcctgggcagcaggggctgtgcattgggagagagcaggcagagtggca

SEQ ID NO: 130848 - DNA, 270 bp, Homo sapiens
gagtgactgaatgcttttttccctgtttgatatttccttttttaaatgtataaatttgaaatttgatgaaagctgcatcaggacccactgtcagatcttaggataaagctaatgtgtcacaaaagcttttacttccacataagcatgtttcaggaggacccatggtgaacctaaatcagtataaaaaggaagccatgttattttgggggtgctgttgtctcattacgagagacagtgatacgaactgttacaccaaacaaataacaatta

SEQ ID NO: 130849 - DNA, 341 bp, Homo sapiens
ccaaatctgatttcttaattggtatactgtactgtgtatgtgacaaaagtcatatattcaatgattattgcatagtcaaaacaagtagcaggtttgccatcatgaaacgctgtaaagcaattctttctcctgggagaggtggacatgatttttataccattttacagataaggaagctgagttttgataggcttagggaatatggacaatgtcagcaggccagcagagagccgagaacttcagatctaaatctcctactatgtccaccatgcagagctggatgttaatgaagggcagaagttttctaaatccaaatccactcctaatacccgacacttaag

SEQ ID NO: 130850 - DNA, 377 bp, Homo sapiens
tcacgcagggttttcagagaggggcaggatggccctgtgtggtgtgtggacgccccacattgcactgtgaaagcacagatggaaagggtggtttctgctgtcttcaccttcctttgtgtgctccccttttcctgactatcacaaaggactgatctcaagtggttcccaagaccatggagcaggacattctcttcctaggaagtgggaattatttacctaaatccacatgtagggaacacagttgctaaggactggggctggataacagacagacttggatttgaatcccagctccacctcttattggctgtgtaacctcagattacagacttaaccaccccatgctctacttcctcattataaaatagacaaaaggg

SEQ ID NO: 130851 - DNA, 163 bp, Homo sapiens
tgctgggattacagacatgagccactgtgcccagccttatatacagctattattattaatgtatactgtgtattcatttcaattcttaatctctccacttggatgttgatgaaatacatacctcacattcaacatttctttctttttttttttctttttgaga

SEQ ID NO: 130852 - DNA, 557 bp, Homo sapiens
atgcttttggaaagctaattttatacacttgaattaagtcacagctgacagactgtttttgatttgacttgagcatttagcatatattatctattagatttcaattgtttatgtagctgtagttcataatctatttattaaacaaaaatctgcggcacacactgtgtaccactcttatggctctttgaacctagttttcattttgctttttccatatagcctagaagttttgttgtgattgtttatctaatgctgtgacattaataatgttattattataaataaataatgtcagtaatgtatgaggccttttgtaagttgtttaaagtgttactttgtattattttgagattttataaaggattatattttaggtaaaagtccgaaagcagctattaaaaagaatataaatgggtgtggtggctcctgcctgtaatcccagtacattgttgagaggcggaggtgttcagataacttgaggccaggagtttgtgaccagcctacccaacatggtgaaatgccgtcactaataaaaatgcaaaaattagccaggcatg

SEQ ID NO: 130853 - DNA, 216 bp, Homo sapiens
tccctggctaccatactcctcatctgctgacgtcaccactgagatcagggagctggtcacaagaccataaaaggccgcttctggaatgtgaagagaggaaaggagaggcaggacagggtgctgcttggactactggcaattctgagacaccgttggcaggtgtaccagctcccgcagctctgacagccctgtgggctgggcactgtgttaccatga

SEQ ID NO: 130854 - DNA, 525 bp, Homo sapiens
ggagagaggcctgcccatctctcatgcaggccactggaaatcaactctgggtcaaaaccgacaagatttttatcttttaatgcttattgtaagaggccgggatgtttgaaagagggcagcgtcttaagttgcagactattcaccaaagtccttttctattcaggaatgactaatgactttctttgttccccttttccaaaccaaacagcagcagtattaccttgactccaaagtacagtgattgcaatggacagtcttgagattaagggtctttttagtgctttgctcggaatctggagcaaggaaatgtctagggatgtttgttgaatgaacccacctgccagcagtccagagagctgtcccaaaggcccctgagatgtctattgtctgctttggtagggagccaacctgctagaagactcaagggcatttgccttagagagaaaaaaaaatggcacatttagttccgggcttgggtgctgaagtcactgtgtttttggctcctgaagctccactttctttttt

SEQ ID NO: 130855 - DNA, 178 bp, Homo sapiens
ctgagctacttgtttagttttgggcatgtgatcttcttctgctgtatattttggaaaacctcatgggagtttctggcagagatgttcctctctgcctgaagccacagctccttgcatttcagcttttgaatgcaatagttaagtcctaatgcctgaagctcttgcggacggactgtag

SEQ ID NO: 130856 - DNA, 564 bp, Homo sapiens
gattttttttaagttagttgattatttacttaatttcttaagaaaaaaaatgactgccaatctttttgtgccattatggtttgatacaggcaatggtgtcaatcaggattaatggcattcttggtctagttctgttttatcatcataaattttgaactaagttttttcagttgagaaagtcacataaacataatttgaaattatatacattataaagtagacctctttcccagcccttcttcccagagatactgttaccagttttttggtgttattccagaaatacagtgtccgtataaaatcatttatatataaatgattatatatattttatacacatatgtattacacatacattcctcctctgttttcaggatattctgagtggaattatgttgttactttgtttatagtagatttatttactactaattttaattcctttaaattctttatgctactggagttttttgtccttcttagataaattatttacataattattatcatttttttttactttcttctttctttcttttttttttttctttttgagacagggtc

SEQ ID NO: 130857 - DNA, 706 bp, Homo sapiens
tgtgcagtttctgtttcgtcagaactaaacaagtgttcaaagcaactctgaggttcctccctttcagaaggaaacatttttttaagggaatttaagaggtgaaaaagtatctatataaaactcagcagtaagccagtaatactttaatatacaaatttatctcacgaattcttataaaaaattcatagaaaattataaaatcataaatgtaggaactgctagttaatgctcactgaaagaacgttttggcatttattcctactggaatatatgatctccagtaggattcttcacaaacagagaattaagactacattatgaatatttagtggttttgaaagttaaacagctggcaagctttggggagcattaggaataatatacattacaggatgggagggaggaacataccaactcaatactcaagggaagagaactgtgaaagaatggaatgggtaggttgaacaatttcagacttttagatgtatattacacatgtaagctccatgaggccaactgtttttattttgttagccattgtatcaccttacagccattagtcctataataatttaatttgggtttgttggtatagaaactgtatttgcacaataatgataaagccactcaggctcatctagtcatttcctggatttatgtgtgtaggagtacataaaaataagggcactgattcgttttgtacttg

SEQ ID NO: 130858 - DNA, 256 bp, Homo sapiens
gactgtgtctcaaacaaacaaacaaataaaccaaagaaatagctgttcaagagctgagaccttttaacttttgctccagtatcaagcaagacatacaggtctaactcacttttccccacataaaatattctaatcatctctagaaaaattctctttcaaaatgagctaccaaataataatacagtaaaaaagacagggcttggctaggcccggtggctcatgcctgtaatcccagcactttgggaggccaaggcag

SEQ ID NO: 130859 - DNA, 276 bp, Homo sapiens
ctcagcccacctcctgtaggggagcacgggtcccgtctttcttgtccaatttctcagccggggcactgagacgtctttgttccctcaccctaagcctggtctgaagtctgcctcctgcaatgcaagctctgttttgccttcttagccttcttcctgagatgctccttccattcaatttccatttgcccaaagctgactccacactttcattcccagaggcctcatttctcctgtactgccactgcgaagatcggacttaacaaagggggtcccggg

SEQ ID NO: 130860 - DNA, 297 bp, Homo sapiens
aactgggattacaggcatgagccaccgtgcctggccctggtctccattctttatctttccctatatttaggccctttcaccatgtaacactggtctgacctgccctgtgactatggcctcagccttgtgatttgctgcagccaattgaatataagcaaacatgacacacggaaaacttgaacagtgtttacttgaataggctggcttgctctttcccgtctgcagtcaccgcaagaataggctgggctgggctgctgaagaaggagacacatggaatagaatggagttgcccagtca

SEQ ID NO: 130861 - DNA, 404 bp, Homo sapiens
ctattaagcttgagagatccagtgaaatccaaataagagaaactgtgtcctacacagttttctgttaaccattttcttggtatttaaattatttatcaaattttaacttcaataaaaaattattctggagaacacatacctctagagtaagtaaagtatacactttcaatttttagacatgaggttttgaggtgtttgactgtatctaatttcctaaaggctctattttttaacctacaaaaattataaaaagatatataaaagatatgaaatgtaaaaataaggaagatatgaagattaaaataacctataatcccaccactcagaggtaactgttatacaatttttgatgtattattctatgcagatataaattttaataaaatttgaattatatacagttt

SEQ ID NO: 130862 - DNA, 2712 bp, Homo sapiens
acggaaatgaaaggagcacttccgggttcggcaataacctggagccggcggcgtaggttggctctttagggcttcaccccgaagctccaccttcgctcccgtctttctggaaacaccgctttgatctcggcggtgcgggacaggtacctcccggctgctgcgggtgccctggatccagtcggctgcaccaggcgagcgagacccttccctggtggaggctcagagttccggcagggtgcatccggcctgtgtgtggcgcgaggcagggaagccggtacccgggtcctggccccagcgctgacgttttctctcccctttcttctctcttcgcggttgcggcgtcgcagacgctagtgtgagcccccatggcagatacgaccccgaacggcccccaaggggcgggcgctgtgcaattcatgatgaccaataaactggacacggcaatgtggctttctcgcttgttcacagtttactgctctgctctgtttgttctgcctcttcttgggttgcatgaagcagcaagcttttaccaacgtgctttgctggcaaatgctcttaccagtgctctgaggctgcatcaaagattaccacacttccagttaagcagagcattcctggcccaggctttgttagaggacagctgccactacctgttgtattcactcatctttgtaaattcctatccagttacaatgagtatcttcccagtcttgttattctctttgcttcatgctgccacatatacgaaaaaggtccttgacgcaaggggctcaaatagtttacctctgctgagatctgtcttggacaaattaagtgctaatcaacaaaatattctgaaattcattgcttgcaatgaaatattcctgatgcctgcgacagtttttatgctttttagtggtcaaggaagtttgctccaaccttttatatactatagatttcttacccttcgatattcgtctcgaagaaacccatattgtcggaccttatttaatgaactgaggattgttgttgaacacataataatgaaacctgcttgcccactgtttgtgagaagactttgtctccagagcattgcctttataagcagattggcaccaacagttccatagtttaacatctagttaagctacaaatatagtataagcattattagcagctggtacttctgctaggggttgtaaattccaggtgttacactgacctcaatccaatttacataatttacataaatgcatctcggtggaaaaataatcattttcttggcatgttaaatcaagcttaaaaagttttgagaaaattttactgtgctgtgttgctaatggttaaagaagtctgtatctagtgataaatataccagtttttttaaaaagatgctgttgtgcctatatcatgaagtacattaatttctcatgtaaaaaaaatagctctaaaatttgtttcaacctaattggtaacctgagtttatatctggcatgaattcattatggtgatacacatatgtgaattcagtacattttgagacagtattctaccattcagtaattttggttaatgattttaacacttctcagtgtatttaatttcaaattgtttttttaattggttttatgctgctttgttaggacagatgtgttttgaatgtaccattataagaagaattctatgtatcttaaactatgatcttctaaaattttatttccgtaagtacttctgtggccttgagtattttttaaaaggctcaactgtaagcctcttagccagttggataaatatttggggtcacctagccattgaaagcagaaagcagtagtgacacagctttcccttcaaagagccattgagaaacatttctcaaacaggaaatccttcttttactaatgtggacatatagattattcgtattatagtttgtagaactacctagttcagaatcttgactgccagttttcttggtttcttaggcttgaattttcatagacaattgcaacagtttagatgccttttgaaaggaatgtaatgaagattcagcatctgactatatgtgtgtctatcctgaaataataatggagagtatactgtagattacatgtttacccatcaaatctgacttaaaaggttaaatggaaggttttataggtaaggtaattgattgggaatggggtagggggaggagttgtgggggaataatgtgcatttcagtctcaacgcatagataaatttaggggaattggatgtattattcaactttgatttgggttgtaaaatgtgttaaatcctgttcattgaactcccatcaactcttataaaattcatgctgatcttcattaccgttgcatgattggaaatgtttaaaacattgtacagttttagtatagagaaatgtaatggtttttgtgaccagtttctgtctgcatgtaatttggatttctcaaatacattcattagtaatttatcagtaacattagttttatttttgttcatctccttatctataaaaaggggatattcttaggataaatacatgaaaaattatacttgatagcttaactataatcagctatttttgtatttttgtaatatttgtccactaagctggagaagcagcctcatacagttgattttgtgtatgtggctagtcttattgtcactatgtaagtaatccaatggttttagaaactaaactttctagagcaataaaatgactataatgtt

SEQ ID NO: 130863 - DNA, 2508 bp, Homo sapiens
acggaaatgaaaggagcacttccgggttcggcaataacctggagccggcggcgtaggttggctctttagggcttcaccccgaagctccaccttcgctcccgtctttctggaaacaccgctttgatctcggcggtgcgggacagacgctagtgtgagcccccatggcagatacgaccccgaacggcccccaaggggcgggcgctgtgcaattcatgatgaccaataaactggacacggcaatgtggctttctcgcttgttcacagtttactgctctgctctgtttgttctgcctcttcttgggttgcatgaagcagcaagcttttaccaacgtgctttgctggcaaatgctcttaccagtgctctgaggctgcatcaaagattaccacacttccagttaagcagagcattcctggcccaggctttgttagaggacagctgccactacctgttgtattcactcatctttgtaaattcctatccagttacaatgagtatcttcccagtcttgttattctctttgcttcatgctgccacatatacgaaaaaggtccttgacgcaaggggctcaaatagtttacctctgctgagatctgtcttggacaaattaagtgctaatcaacaaaatattctgaaattcattgcttgcaatgaaatattcctgatgcctgcgacagtttttatgctttttagtggtcaaggaagtttgctccaaccttttatatactatagatttcttacccttcgatattcgtctcgaagaaacccatattgtcggaccttatttaatgaactgaggattgttgttgaacacataataatgaaacctgcttgcccactgtttgtgagaagactttgtctccagagcattgcctttataagcagattggcaccaacagttccatagtttaacatctagttaagctacaaatatagtataagcattattagcagctggtacttctgctaggggttgtaaattccaggtgttacactgacctcaatccaatttacataatttacataaatgcatctcggtggaaaaataatcattttcttggcatgttaaatcaagcttaaaaagttttgagaaaattttactgtgctgtgttgctaatggttaaagaagtctgtatctagtgataaatataccagtttttttaaaaagatgctgttgtgcctatatcatgaagtacattaatttctcatgtaaaaaaaatagctctaaaatttgtttcaacctaattggtaacctgagtttatatctggcatgaattcattatggtgatacacatatgtgaattcagtacattttgagacagtattctaccattcagtaattttggttaatgattttaacacttctcagtgtatttaatttcaaattgtttttttaattggttttatgctgctttgttaggacagatgtgttttgaatgtaccattataagaagaattctatgtatcttaaactatgatcttctaaaattttatttccgtaagtacttctgtggccttgagtattttttaaaaggctcaactgtaagcctcttagccagttggataaatatttggggtcacctagccattgaaagcagaaagcagtagtgacacagctttcccttcaaagagccattgagaaacatttctcaaacaggaaatccttcttttactaatgtggacatatagattattcgtattatagtttgtagaactacctagttcagaatcttgactgccagttttcttggtttcttaggcttgaattttcatagacaattgcaacagtttagatgccttttgaaaggaatgtaatgaagattcagcatctgactatatgtgtgtctatcctgaaataataatggagagtatactgtagattacatgtttacccatcaaatctgacttaaaaggttaaatggaaggttttataggtaaggtaattgattgggaatggggtagggggaggagttgtgggggaataatgtgcatttcagtctcaacgcatagataaatttaggggaattggatgtattattcaactttgatttgggttgtaaaatgtgttaaatcctgttcattgaactcccatcaactcttataaaattcatgctgatcttcattaccgttgcatgattggaaatgtttaaaacattgtacagttttagtatagagaaatgtaatggtttttgtgaccagtttctgtctgcatgtaatttggatttctcaaatacattcattagtaatttatcagtaacattagttttatttttgttcatctccttatctataaaaaggggatattcttaggataaatacatgaaaaattatacttgatagcttaactataatcagctatttttgtatttttgtaatatttgtccactaagctggagaagcagcctcatacagttgattttgtgtatgtggctagtcttattgtcactatgtaagtaatccaatggttttagaaactaaactttctagagcaataaaatgactataatgtt

SEQ ID NO: 130864 - DNA, 2632 bp, Homo sapiens
acggaaatgaaaggagcacttccgggttcggcaataacctggagccggcggcgtaggttggctctttagggcttcaccccgaagctccaccttcgctcccgtctttctggaaacaccgctttgatctcggcggtgcgggacaggtacctcccggctgctgcgggtgccctggatccagtcggctgcaccaggcgagcgagacccttccctggtggaggctcagagttccggcagggtgcatccggcctgtgtgtggcgcgaggcagggaagccggtacccgggtcctggccccagcgctgacgttttctctcccctttcttctctcttcgcggttgcggcgtcgcagacgctagtgtgagcccccatggcagatacgaccccgaacggcccccaaggggcgggcgctgtgcaattcatgatgaccaataaactggacacggcaatgtggctttctcgcttgttcacagtttactgctctgctctgtttgttctgcctcttcttggtgtccagatgtcttgctttaaaaaagagaggtcctcagctctttccatcttaaccccagtgaactagatacaaatggaatttaaccaagaaacaacttatttaagcagtgagtatcttcccagtcttgttattctctttgcttcatgctgccacatatacgaaaaaggtccttgacgcaaggggctcaaatagtttacctctgctgagatctgtcttggacaaattaagtgctaatcaacaaaatattctgaaattcattgcttgcaatgaaatattcctgatgcctgcgacagtttttatgctttttagtggtcaaggaagtttgctccaaccttttatatactatagatttcttacccttcgatattcgtctcgaagaaacccatattgtcggaccttatttaatgaactgaggattgttgttgaacacataataatgaaacctgcttgcccactgtttgtgagaagactttgtctccagagcattgcctttataagcagattggcaccaacagttccatagtttaacatctagttaagctacaaatatagtataagcattattagcagctggtacttctgctaggggttgtaaattccaggtgttacactgacctcaatccaatttacataatttacataaatgcatctcggtggaaaaataatcattttcttggcatgttaaatcaagcttaaaaagttttgagaaaattttactgtgctgtgttgctaatggttaaagaagtctgtatctagtgataaatataccagtttttttaaaaagatgctgttgtgcctatatcatgaagtacattaatttctcatgtaaaaaaaatagctctaaaatttgtttcaacctaattggtaacctgagtttatatctggcatgaattcattatggtgatacacatatgtgaattcagtacattttgagacagtattctaccattcagtaattttggttaatgattttaacacttctcagtgtatttaatttcaaattgtttttttaattggttttatgctgctttgttaggacagatgtgttttgaatgtaccattataagaagaattctatgtatcttaaactatgatcttctaaaattttatttccgtaagtacttctgtggccttgagtattttttaaaaggctcaactgtaagcctcttagccagttggataaatatttggggtcacctagccattgaaagcagaaagcagtagtgacacagctttcccttcaaagagccattgagaaacatttctcaaacaggaaatccttcttttactaatgtggacatatagattattcgtattatagtttgtagaactacctagttcagaatcttgactgccagttttcttggtttcttaggcttgaattttcatagacaattgcaacagtttagatgccttttgaaaggaatgtaatgaagattcagcatctgactatatgtgtgtctatcctgaaataataatggagagtatactgtagattacatgtttacccatcaaatctgacttaaaaggttaaatggaaggttttataggtaaggtaattgattgggaatggggtagggggaggagttgtgggggaataatgtgcatttcagtctcaacgcatagataaatttaggggaattggatgtattattcaactttgatttgggttgtaaaatgtgttaaatcctgttcattgaactcccatcaactcttataaaattcatgctgatcttcattaccgttgcatgattggaaatgtttaaaacattgtacagttttagtatagagaaatgtaatggtttttgtgaccagtttctgtctgcatgtaatttggatttctcaaatacattcattagtaatttatcagtaacattagttttatttttgttcatctccttatctataaaaaggggatattcttaggataaatacatgaaaaattatacttgatagcttaactataatcagctatttttgtatttttgtaatatttgtccactaagctggagaagcagcctcatacagttgattttgtgtatgtggctagtcttattgtcactatgtaagtaatccaatggttttagaaactaaactttctagagcaataaaatgactataatgtt

SEQ ID NO: 130865 - DNA, 1370 bp, Homo sapiens
acggaaatgaaaggagcacttccgggttcggcaataacctggagccggcggcgtaggttggctctttagggcttcaccccgaagctccaccttcgctcccgtctttctggaaacaccgctttgatctcggcggtgcgggacaggtacctcccggctgctgcgggtgccctggatccagtcggctgcaccaggcgagcgagacccttccctggtggaggctcagagttccggcagggtgcatccggcctgtgtgtggcgcgaggcagggaagccggtacccgggtcctggccccagcgctgacgttttctctcccctttcttctctcttcgcggttgcggcgtcgcagacgctagtgtgagcccccatggcagatacgaccccgaacggcccccaaggggcgggcgctgtgcaattcatgatgaccaataaactggacacggcaatgtggctttctcgcttgttcacagtttactgctctgctctgtttgttctgcctcttcttgggttgcatgaagcagcaagcttttaccaacgtgctttgctggcaaatgctcttaccagtgctctgaggctgcatcaaagattaccacacttccagttaagcagagcattcctggcccaggctttgttagaggacagctgccactacctgttgtattcactcatctttgtaaattcctatccagttacaatgagtatcttcccagtcttgttattctctttgcttcatgctgccacatatacgaaaaaggtccttgacgcaaggggctcaaatagtttacctctgctgagatctgtcttggacaaattaagtgctaatcaacaaaatattctgaaattcattgcttgcaatgaaatattcctgatgcctgcgacagtttttatgctttttagtggtcaaggaagtttgctccaaccttttatatactatagatttcttacccttcgatattcgtctcgaagaaacccatattgtcggaccttatttaatgaactgaggattgttgttgaacacataataatgaaacctgcttgcccactgtttgtgagaagactttgtctccagagcattgcctttataagcagattggcaccaacagttccatagtttaacatctagttaagctacaaatatagtataagcattattagcagctggtacttctgctaggggttgtaaattccaggtgttacactgacctcaatccaatttacataatttacataaatgcatctcggtggaaaaataatcattttcttggcatgttaaatcaagcttaaaaagttttgagaaaattttactgtgctgtgttgctaatggttaaagaagtctgtatctagtgataaatataccagtttttttaaaaag

SEQ ID NO: 130866 - DNA, 1111 bp, Homo sapiens
acggaaatgaaaggagcacttccgggttcggcaataacctggagccggcggcgtaggttggctctttagggcttcaccccgaagctccaccttcgctcccgtctttctggaaacaccgctttgatctcggcggtgcgggacaggtacctcccggctgctgcgggtgccctggatccagtcggctgcaccaggcgagcgagacccttccctggtggaggctcagagttccggcagggtgcatccggcctgtgtgtggcgcgaggcagggaagccggtacccgggtcctggccccagcgctgacgttttctctcccctttcttctctcttcgcggttgcggcgtcgcagacgctagtgtgagcccccatggcagatacgaccccgaacggcccccaaggggcgggcgctgtgcaattcatgatgaccaataaactggacacggcaatgtggctttctcgcttgttcacagtttactgctctgctctgtttgttctgcctcttcttgggttgcatgaagcagcaagcttttaccaacgtgctttgctggcaaatgctcttaccagtgctctgaggctgcatcaaagattaccacacttccagttaagcagagcattcctggcccaggctttgttagaggacagctgccactacctgttgtattcactcatctttgtaaattcctatccagttacaatgagtatcttcccagtcttgttattctctttgcttcatgctgccacatatacgaaaaaggtccttgacgcaaggggctcaaatagtttacctctgctgagatctgtcttggacaaattaagtgctaatcaacaaaatattctgaaattcattgcttgcaatgaaatattcctgatgcctgcgacagtttttatgctttttagtggtcaaggaagtttgctccaaccttttatatactatagatttcttacccttcgatattcgtctcgaagaaacccatattgtcgtttgtggtgccccaaaacagttacaatagtaacaccaaagagatcaccgtaacagaacagatcacagatcaccataatagattaataatgtgagcacatgctgttggaaagtggcactgatagtcttgctgt

SEQ ID NO: 130867 - DNA, 907 bp, Homo sapiens
attacattcctttcaaaaggcatctaaactgcttgaattttcatagacaattgcaacagtttagatgccttttgaaaggaatgtaatgaagattcagcatctgactatatgtgtgtctatcctgaaataataatggagagtatactgtagattacatgtttacccatcaaatctgacttaaaaggttaaatggaaggttttataggtaaggtaattgattgggaatggggtagggggaggagttgtgggggaataatgtgcatttcagtctcaacgcatagataaatttaggggaattggatgtattattcaactttgatttgggttgtaaaatgtgttaaatcctgttcattgaactcccatcaactcttataaaattcatgctgatcttcattaccgttgcatgattggaaatgtttaaaacattgtacagttttagtatagagaaatgtaatggtttttgtgaccagtttctgtctgcatgtaatttggatttctcaaatacattcattagtaatttatcagtaacattagttttatttttgttcatctccttatctataaaaaggggatattcttaggataaatacatgaaaaattatacttgatagcttaactataatcagctatttttgtatttttgtaatatttgtccactaagctggagaagcagcctcatacagttgattttgtgtatgtggctagtcttattgtcactatgtaagtaatccaatggttttagaaactaaactttctagagcaataaaatgactataatgttaagtaaacataatgttgatttctaattatgttttaaaaaatgaagtcttgaattatatcaagaaattttggcagctgaagtcatgtttattttgaagctgttagttttttcctataatttaaaaag

SEQ ID NO: 130868 - DNA, 961 bp, Homo sapiens
acggaaatgaaaggagcacttccgggttcggcaataacctggagccggcggcgtaggttggctctttagggcttcaccccgaagctccaccttcgctcccgtctttctggaaacaccgctttgatctcggcggtgcgggacaggtacctcccggctgctgcgggtgccctggatccagtcggctgcaccaggcgagcgagacccttccctggtggaggctcagagttccggcagggtgcatccggcctgtgtgtggcgcgaggcagggaagccggtacccgggtcctggccccagcgctgacgttttctctcccctttcttctctcttcgcggttgcggcgtcgcagacgctagtgtgagcccccatggcagatacgaccccgaacggcccccaaggggcgggcgctgtgcaattcatgatgaccaataaactggacacggcaatgtggctttctcgcttgttcacagtttactgctctgctctgtttgttctgcctcttcttggtgagtatcttcccagtcttgttattctctttgcttcatgctgccacatatacgaaaaaggtccttgacgtaagtaaaactgctctttgtctgacttctgaattacagatcattgacatgaatttgagttctaagacattttggtatttgtcacaaaaagtccctctataccttacaaacttgttatgaattatttagtgatttgaaagttttaagtttaaaagtgtttattgttgaagtttcacaaactagaacattttatagataaaggattgcacttaaaatcaccccccagtctccaggggaatttttcaagtttgaaatagatcagtttttttgaaacctgtgtctctaaagtttgttgagttgtcagatctcttgttctgtcagtgtttaattctggcatacctgataagttgagtgtactgaatgaatctcttgtacactaattttcaga

SEQ ID NO: 130869 - DNA, 439 bp, Homo sapiens
cggctaggtaagcgaggctgggtggcccgaagctccaccttcgctcccgtctttctggaaacaccgctttgatctcggcggtgcgggacaggtacctcccggctgctgcgggtgccctggatccagtcggctgcaccaggcgagcgagacccttccctggtggaggctcagagttccggcagggtgcatccggcctgtgtgtggcgcgaggcagggaagccggtacccgggtcctggccccagcgctgacgttttctctcccctttcttctctcttcgcggttgcggcgtcgcagacgctagtgtgagccccctgaccccttctttcaaacagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaac

SEQ ID NO: 130870 - DNA, 750 bp, Homo sapiens
atgatacaatttagaagaaaaggctaaaaaacctaataaaacacatttggcatcttaatatatttcttccaatttaaaaaaatacaattgtaataatatgtgtagttttatattctgcttttttcagagttgctatgtaattttcataaccaagattctaggtagttgcatattaaatccattaaataaccataatataagttgttcaattctacttccttacagttcacattaggttgttgccacattttgtttgtagttatttcagtgaatgtcttaattcagatagtttttcttagggaagaattccagacctggtatttcataaacatatatataattcttgggatattgtaattgtgttttttaaccaagaacaataattagtataggctgtttagatttactgatgagccagtgtaatttttttggtggaggggagtgtttgtttctttttatatatataaaataagtcacttttcatttgcatattttatgaagctttacaacttgatttcatcaattagtaattacggaattatttaacattttctgatttatttagtattttaaaaaatttcaaaagtaatacagataagaatacatttataaaaaaattaaacaacattttactctttaccaatcatgtacattcttttatatccttttttaaggataacttggatttagacatgatagatttcactatgaccatttgatgaatgaagatacacatattctccagttgaa

SEQ ID NO: 130871 - DNA, 2838 bp, Homo sapiens
acggaaatgaaaggagcacttccgggttcggcaataacctggagccggcggcgtaggttggctctttagggcttcaccccgaagctccaccttcgctcccgtctttctggaaacaccgctttgatctcggcggtgcgggacaggtacctcccggctgctgcgggtgccctggatccagtcggctgcaccaggcgagcgagacccttccctggtggaggctcagagttccggcagggtgcatccggcctgtgtgtggcgcgaggcagggaagccggtacccgggtcctggccccagcgctgacgttttctctcccctttcttctctcttcgcggttgcggcgtcgcagacgctagtgtgagcccccatggcagatacgaccccgaacggcccccaaggggcgggcgctgtgcaattcatgatgaccaataaactggacacggcaatgtggctttctcgcttgttcacagtttactgctctgctctgtttgttctgcctcttcttgggttgcatgaagcagcaagcttttaccaacgtgctttgctggcaaatgctcttaccagtgctctgaggctgcatcaaagattaccacacttccagttaagcagagcattcctggcccaggctttgttagaggacagctgccactacctgttgtattcactcatctttgtaaattcctatccagttacaatgagtatcttcccagtcttgttattctctttgcttcatgctgccacatatacgaaaaaggtccttgacgcaaggggctcaaatagtttacctctgctgagatctgtcttggacaaattaagtgctaatcaacaaaatattctgaaattcattgcttgcaatgaaatattcctgatgcctgcgacagtttttatgctttttagtggtcaaggaagtttgctccaaccttttatatactatagatttcttacccttcgatattcgtctcgaagaaacccatattgtcggaccttatttaatgaactgaggattgttgttgaacacataataatgaaacctgcttgcccactgtttgtgagaagactttgtctccagagcattgcctttataagcagattggcaccaacagttccatagtttaacatctagttaagctacaaatatagtataagcattattagcagctggtacttctgctaggggttgtaaattccaggtgttacactgacctcaatccaatttacataatttacataaatgcatctcggtggaaaaataatcattttcttggcatgttaaatcaagcttaaaaagttttgagaaaattttactgtgctgtgttgctaatggttaaagaagtctgtatctagtgataaatataccagtttttttaaaaagatgctgttgtgcctatatcatgaagtacattaatttctcatgtaaaaaaaatagctctaaaatttgtttcaacctaattggtaacctgagtttatatctggcatgaattcattatggtgatacacatatgtgaattcagtacattttgagacagtattctaccattcagtaattttggttaatgattttaacacttctcagtgtatttaatttcaaattgtttttttaattggttttatgctgctttgttaggacagatgtgttttgaatgtaccattataagaagaattctatgtatcttaaactatgatcttctaaaattttatttccgtaagtacttctgtggccttgagtattttttaaaaggctcaactgtaagcctcttagccagttggataaatatttggggtcacctagccattgaaagcagaaagcagtagtgacacagctttcccttcaaagagccattgagaaacatttctcaaacaggaaatccttcttttactaatgtggacatatagattattcgtattatagtttgtagaactacctagttcagaatcttgactgccagttttcttggtttcttaggcttgaattttcatagacaattgcaacagtttagatgccttttgaaaggaatgtaatgaagattcagcatctgactatatgtgtgtctatcctgaaataataatggagagtatactgtagattacatgtttacccatcaaatctgacttaaaaggttaaatggaaggttttataggtaaggtaattgattgggaatggggtagggggaggagttgtgggggaataatgtgcatttcagtctcaacgcatagataaatttaggggaattggatgtattattcaactttgatttgggttgtaaaatgtgttaaatcctgttcattgaactcccatcaactcttataaaattcatgctgatcttcattaccgttgcatgattggaaatgtttaaaacattgtacagttttagtatagagaaatgtaatggtttttgtgaccagtttctgtctgcatgtaatttggatttctcaaatacattcattagtaatttatcagtaacattagttttatttttgttcatctccttatctataaaaaggggatattcttaggataaatacatgaaaaattatacttgatagcttaactataatcagctatttttgtatttttgtaatatttgtccactaagctggagaagcagcctcatacagttgattttgtgtatgtggctagtcttattgtcactatgtaagtaatccaatggttttagaaactaaactttctagagcaataaaatgactataatgttaagtaaacataatgttgatttctaattatgttttaaaaaatgaagtcttgaattatatcaagaaattttggcagctgaagtcatgtttattttgaagctgttagttttttcctataatttaaaaag

SEQ ID NO: 130872 - DNA, 2660 bp, Homo sapiens
cggctaggtaagcgaggctgggtggcccgaagctccaccttcgctcccgtctttctggaaacaccgctttgatctcggcggtgcgggacaggtacctcccggctgctgcgggtgccctggatccagtcggctgcaccaggcgagcgagacccttccctggtggaggctcagagttccggcagggtgcatccggcctgtgtgtggcgcgaggcagggaagccggtacccgggtcctggccccagcgctgacgttttctctcccctttcttctctcttcgcggttgcggcgtcgcagacgctagtgtgagcccccatggcagatacgaccccgaacggcccccaaggggcgggcgctgtgcaattcatgatgaccaataaactggacacggcaatgtggctttctcgcttgttcacagtttactgctctgctctgtttgttctgcctcttcttgggttgcatgaagcagcaagcttttaccaacgtgctttgctggcaaatgctcttaccagtgctctgaggctgcatcaaagattaccacacttccagttaagcagagcattcctggcccaggctttgttagaggacagctgccactacctgttgtattcactcatctttgtaaattcctatccagttacaatgagtatcttcccagtcttgttattctctttgcttcatgctgccacatatacgaaaaaggtccttgacgcaaggggctcaaatagtttacctctgctgagatctgtcttggacaaattaagtgctaatcaacaaaatattctgaaattcattgcttgcaatgaaatattcctgatgcctgcgacagtttttatgctttttagtggtcaaggaagtttgctccaaccttttatatactatagatttcttacccttcgatattcgtctcgaagaaacccatattgtcggaccttatttaatgaactgaggattgttgttgaacacataataatgaaacctgcttgcccactgtttgtgagaagactttgtctccagagcattgcctttataagcagattggcaccaacagttccatagtttaacatctagttaagctacaaatatagtataagcattattagcagctggtacttctgctaggggttgtaaattccaggtgttacactgacctcaatccaatttacataatttacataaatgcatctcggtggaaaaataatcattttcttggcatgttaaatcaagcttaaaaagttttgagaaaattttactgtgctgtgttgctaatggttaaagaagtctgtatctagtgataaatataccagtttttttaaaaagatgctgttgtgcctatatcatgaagtacattaatttctcatgtaaaaaaaatagctctaaaatttgtttcaacctaattggtaacctgagtttatatctggcatgaattcattatggtgatacacatatgtgaattcagtacattttgagacagtattctaccattcagtaattttggttaatgattttaacacttctcagtgtatttaatttcaaattgtttttttaattggttttatgctgctttgttaggacagatgtgttttgaatgtaccattataagaagaattctatgtatcttaaactatgatcttctaaaattttatttccgtaagtacttctgtggccttgagtattttttaaaaggctcaactgtaagcctcttagccagttggataaatatttggggtcacctagccattgaaagcagaaagcagtagtgacacagctttcccttcaaagagccattgagaaacatttctcaaacaggaaatccttcttttactaatgtggacatatagattattcgtattatagtttgtagaactacctagttcagaatcttgactgccagttttcttggtttcttaggcttgaattttcatagacaattgcaacagtttagatgccttttgaaaggaatgtaatgaagattcagcatctgactatatgtgtgtctatcctgaaataataatggagagtatactgtagattacatgtttacccatcaaatctgacttaaaaggttaaatggaaggttttataggtaaggtaattgattgggaatggggtagggggaggagttgtgggggaataatgtgcatttcagtctcaacgcatagataaatttaggggaattggatgtattattcaactttgatttgggttgtaaaatgtgttaaatcctgttcattgaactcccatcaactcttataaaattcatgctgatcttcattaccgttgcatgattggaaatgtttaaaacattgtacagttttagtatagagaaatgtaatggtttttgtgaccagtttctgtctgcatgtaatttggatttctcaaatacattcattagtaatttatcagtaacattagttttatttttgttcatctccttatctataaaaaggggatattcttaggataaatacatgaaaaattatacttgatagcttaactataatcagctatttttgtatttttgtaatatttgtccactaagctggagaagcagcctcatacagttgattttgtgtatgtggctagtcttattgtcactatgtaagtaatccaatggttttagaaactaaactttctagagcaataaaatgactataatgtt

SEQ ID NO: 130873 - DNA, 1924 bp, Homo sapiens
aagagtggtatcaacgcagagggcccattacggccggaaaatattctgaaattcattgcttgcaatgaaatattcctgatgcctgcgacagtttttatgctttttagtggtcaaggaagtttgctccaaccttttatatactatagatttcttacccttcgatattcgtctcgaagaaacccatattgtcggaccttatttaatgaactgaggattgttgttgaacacataataatgaaacctgcttgcccactgtttgtgagaagactttgtctccagagcattgcctttataagcagattggcaccaacagttccatagtttaacatctagttaagctacaaatatagtataagcattattagcagctggtacttctgctaggggttgtaaattccaggtgttacactgacctcaatccaatttacataatttacataaatgcatctcggtggaaaaataatcattttcttggcatgttaaatcaagcttaaaaagttttgagaaaattttactgtgctgtgttgctaatggttaaagaagtctgtatctagtgataaatataccagtttttttaaaaagatgctgttgtgcctatatcatgaagtacattaatttctcatgtaaaaaaaatagctctaaaatttgtttcaacctaattggtaacctgagtttatatctggcatgaattcattatggtgatacacatatgtgaattcagtacattttgagacagtattctaccattcagtaattttggttaatgattttaacacttctcagtgtatttaatttcaaattgtttttttaattggttttatgctgctttgttaggacagatgtgttttgaatgtaccattataagaagaattctatgtatcttaaactatgatcttctaaaattttatttccgtaagtacttctgtggccttgagtattttttaaaaggctcaactgtaagcctcttagccagttggataaatatttggggtcacctagccattgaaagcagaaagcagtagtgacacagctttcccttcaaagagccattgagaaacatttctcaaacaggaaatccttcttttactaatgtggacatatagattattcgtattatagtttgtagaactacctagttcagaatcttgactgccagttttcttggtttcttaggcttgaattttcatagacaattgcaacagtttagatgccttttgaaaggaatgtaatgaagattcagcatctgactatatgtgtgtctatcctgaaataataatggagagtatactgtagattacatgtttacccatcaaatctgacttaaaaggttaaatggaaggttttataggtaaggtaattgattgggaatggggtagggggaggagttgtgggggaataatgtgcatttcagtctcaacgcatagataaatttaggggaattggatgtattattcaactttgatttgggttgtaaaatgtgttaaatcctgttcattgaactcccatcaactcttataaaattcatgctgatcttcattaccgttgcatgattggaaatgtttaaaacattgtacagttttagtatagagaaatgtaatggtttttgtgaccagtttctgtctgcatgtaatttggatttctcaaatacattcattagtaatttatcagtaacattagttttatttttgttcatctccttatctataaaaaggggatattcttaggataaatacatgaaaaattatacttgatagcttaactataatcagctatttttgtatttttgtaatatttgtccactaagctggagaagcagcctcatacagttgattttgtgtatgtggctagtcttattgtcactatgtaagtaatccaatggttttagaaactaaactttctagagcaataaaatgactataatgtt

SEQ ID NO: 130874 - DNA, 1414 bp, Homo sapiens
acggaaatgaaaggagcacttccgggttcggcaataacctggagccggcggcgtaggttggctctttagggcttcaccccgaagctccaccttcgctcccgtctttctggaaacaccgctttgatctcggcggtgcgggacaggtacctcccggctgctgcgggtgccctggatccagtcggctgcaccaggcgagcgagacccttccctggtggaggctcagagttccggcagggtgcatccggcctgtgtgtggcgcgaggcagggaagccggtacccgggtcctggccccagcgctgacgttttctctcccctttcttctctcttcgcggttgcggcgtcgcagacgctagtgtgagcccccatggcagatacgaccccgaacggcccccaaggggcgggcgctgtgcaattcatgatgaccaataaactggacacggcaatgtggctttctcgcttgttcacagtttactgctctgctctgtttgttctgcctcttcttgggttgcatgaagcagcaagcttttaccaacgtgctttgctggcaaatgctcttaccagtgctctgaggctgcatcaaagattaccacacttccagttaagcagagcattcctggcccaggctttgttagaggacagctgccactacctgttgtattcactcatctttgtaaattcctatccagttacaatgagtatcttcccagtcttgttattctctttgcttcatgctgccacatatacgaaaaaggtccttgacgcaaggggctcaaatagtttacctctgctgagatctgtcttggacaaattaagtgctaatcaacaaaatattctgaaattcattgcttgcaatgaaatattcctgatgcctgcgacagtttttatgctttttagtggtcaaggaagtttgctccaaccttttatatactatagatttcttacccttcgatattcgtctcgaagaaacccatattgtcggaccttatttaatgaactgaggattgttgttgaacacataataatgaaacctgcttgcccactgtttgtgagaagactttgtctccagagcattgcctttataagcagattggcaccaacagttccatagtttaacatctagttaagctacaaatatagtataagcattattagcagctggtacttctgctaggggttgtaaattccaggtgttacactgacctcaatccaatttacataatttacataaatgcatctcggtggaaaaataatcattttcttggcatgttaaatcaagcttaaaaagttttgagaaaattttactgtgctgtgttgctaatggttaaagaagtctgtatctagtgataaatataccagtttttttaaaaagaaaaaaaaaaaaaaaaaaaaaaaaaaaaaaaaaaaaaaaaaaac

SEQ ID NO: 130875 - DNA, 455 bp, Homo sapiens
ttatgcccttttctccctgggttatttatgctttgatttcactcctactgaatcagtaatcgccacttcatcttaacttcggcctgaattgtccaggggagcatgcctagcccccagcccaggtttccgtgatttgcaaataagcgtggcctccatgaccacttcctagctgagatcacaccagtgcagtgaggtggctcacagctgtgattaggaatccttttttgcaaaatgtgaaccatcactcctcatgtgttggtttccacaaatcacatattgttaaagtgggaaggagcgggtgagaggggatagaacccattcagaaaatgtttacaccaacccaagacttttcaacaggtagcttagcctggaacattgagtccaaatttgtagaaattaaaaaccatgggaatgggggaaagaggcgagagaaggcatccaaaatggtaatgtac

SEQ ID NO: 130876 - DNA, 460 bp, Homo sapiens
agtagcaccagagtagcttagtagtggtctaaatgcccagtagtccatagtagagctgtgaaggcaataccatcaagtggccagttgctgcttggccagtgaaagagaaaataggcttcaattttagaataagagaggtggacagaaagattttttgggatcagaattttattcacaggttgactacatcccagaaatctggaaacctataggcttgccatagccaattgcagggaagtgagatatatgcaggctatataacttctagaaattgaaggcaggaaaagtgaaagtgagaggtggtaatatgaagcaaggttggccaccagccactcttaagacagagaaagagtgtaggaacctacttattggacacacaattccatgtgagataagaactcagtagtttaggaattgaaataatgcaaaatcccagtcaatagaaactggagtaacaaag

SEQ ID NO: 130877 - DNA, 291 bp, Homo sapiens
ttctcattcgcttgattccgttctctctctccacacacacgcgctctcattcgcttgattccgttctctctctccacacacactcgtgttctcattcgcctgattccgttctctctccacacacactcgtgttctcattcgcttgattccgttctctctctccacacacatgcgctctcatttgcttgattccgttctctctccacacacactcacgcgctctcattcgcttgactctgttctctctctccacacacactcacgctctcattcgcttgattccgttctctc

SEQ ID NO: 130878 - DNA, 281 bp, Homo sapiens
gtttggtgtttaggagggctgagggtctgtatacctacccactgacataaaggctgagaggaaaaaaaaaaagaaattaaaagcagttttacaaggcactcactcaacagcacaggggcctggtgtggatgggatgtgggactaggaaacacttcacagggtgcagacaggatgattaactcacttcctgtgacaaccataaaaggaggaacgtttgctccaaaatatattaactattaaatgctatctggggaaatgtctagacataaagcaccatattt

SEQ ID NO: 130879 - DNA, 292 bp, Homo sapiens
gtggagggaagggcttgggacctgtgtcaggagagctgggtccatctccctctctgtctcaaactatgcttatgatctttagcagtgaaaataatctctctaaggtggggacaggaccccagtccctgctgtgcttaataaattatgaggatcaaaataaattatcagtgaatgtgtatgggaagactaagaaattgttaaagttctcgaatacattacattttcatccacagaaaagtgtaggctagggatgataggggaatagttagtaatgacagggatagttgaactt

SEQ ID NO: 130880 - DNA, 133 bp, Homo sapiens
tttaagcgatccaactgccttgacctcccaaagtactgggattacatgcatcagccaccatgcccggcttaaattcttccatgacttttcccctccaggctttagtgtctcttgtaatctgctggaaatctac

SEQ ID NO: 130881 - DNA, 155 bp, Homo sapiens
ctagtgcctgctatgtgctaaagtctcatggtatgtgttttacatactttatcttatttacttcatacaacaatttgtaaatattattcatcccattttataaaagaggaaactaagattcagagagtttaggtaattttcccaagtcacagagt

SEQ ID NO: 130882 - DNA, 574 bp, Homo sapiens
acagagggctaaattactaacatagacccttatatatacatacatacatataaaaattgagaagaaaaagttccatgttccaacggaaaaatgggaaaaggctattaacagtttagaggaaagagaaatttactgctctgaacatatggaaagatgttaacctcactcacagtaagagaaatgcatttttaaactgcaccaagataccatgccccatgtacagaatggcagaaatgcaaaagttaaacagcatagctattctgatggtgcagtgagcaaaaccagccctcttcaaccctagtggttagaatgcagcatggtactaccccagtggggatggcgtttgtcaggatctagcaaaaccgcctctgcattttctttcttcaactaagcacctcatatatatgaatctatcccaaagataatgagcaaaatcaagatgtggcatgtgctcaagggcatttagtgcagcactagttgtaataggaagcaacaagaaacaacccaagtaatcatcataggggactgagtgaataatatggtccattaatagagtgaagtactacatagctat

SEQ ID NO: 130883 - DNA, 504 bp, Homo sapiens
agagaattcctgaaccaggtaaaatttccaagtttagggcacacggttatgtgcctgtagtcccagctgcttgggaggccagaagattgcttgagcccaggaggctgaggccagcttgggcaagaagcaagagaccctatctcaaaaaacattccctgtttgcctagggtcagtgtccaagccaagttgctacagggtgaagcccttatagtggatctgaatggcaagctgaagacagatgtcctgtgggtgttcttcactggcagggtgtaggagtggtgaggactgaggagtctgggaagaaagatcccattgtaaggacttgcagcccatagatattcgcctcccctgccacccactttttctgctctagcctcttgggctagcagagtatgacactaaccatgaggattgagcttcatacttatccaacaagtacagatgctcctcaacttaccatggtgctacatctctatatgcccattgtacgctggaaatattgaa

SEQ ID NO: 130884 - DNA, 879 bp, Homo sapiens
ggtcgaggcaggaggatcacttgaggcccaggagtttgagactagcttgggcaacatagcaagaccccatctgtaagaaaaagaggaaaagaaaaaaattaactggatgtggtggtacatgcctatagtctcagctactgtggaagttgaggcaagaggatcacttgagctcaggagttcaaggtgcatagtgaactgtgatcacaccactgcactccagcctgggcagcagagtgagaccctgtctccaaaaataaataagtaaataaaataataaatgaaataaaaaattagaaattaaaagttctggaagctcaaaagtctgaaattaatttcactaggctcagatcaaggtatcttgccagggctgtgttccctctggaggctctaggagagaatgtgtttccttgccttttccattatatagagctgtatttcttgcctgcctttattcatattctctttcttcatcttcaaagcagtatggcattttgttttagttatcacattgccttcttcttctgtagtaaaatctccctctgcctccctcttataaggtcacttaagattatatttagggcttagctggctaatccataatattctccccatttttttatttttttgatccttaatttgatcacatgtgcaaagtacctcttgccatataaactagcattacagattccagagattaggacttggatatcttcgggggctgttatttagtttaccatagtctcttactgctacttttctttctgcagttcttcgtggttctccctttttctgaagactagctttctctgctttggcatacaggtgccaagcatatattaccaacaatgatggccttgggtcctgggttcacaagagaat

SEQ ID NO: 130885 - DNA, 365 bp, Homo sapiens
cgcctgtaatcccagctactcaggaggctgaggcaggagaattgcttgaatctgggaggcggaggtagcagtgaggctagatggcaccacttcactccagcctgggcaacagagcgagattccatctccaaaaaagaaagcatcaaggaataaccaaatgaagcaaaattttatttttctttggaaaacatttgaggtgattggccagttgtaaaattgagtgtatatcaagatcagtttaattcatctgaattttgcttaaggtgatttcattttttgctgtctaatagctttattcaagtagaattacacgccataaaatttactcattttatttttttatttttattaagttaggttgtgtt

SEQ ID NO: 130886 - DNA, 827 bp, Homo sapiens
cattgaaagagaatgtacatctatgttatatttgaagctacatagaaataaactttttacattttcagaatattttcatagttgtattccgaaagtcatacatttaggcaggctaaagtttacaaattaagttgaaccttttccgcatctagacttaattttgtgatattacaagtgaatgagcacatgaagttctaacagatttttgcatctgaactataattaataagatttaactgattatacactaaaacttgacaaagtagtttttcttttattttccattttttaatatgttccgcctcagggttatatatttactactcctgtgcttttacaaaagcaacttcaaattcttaggcacaggattctgaaaattagatgaactaaccaggtacagttactttaattttcagattttagggatattagagtgcatttatttgtatttctatttgtaatatttaaaatggaccaatttgtgtgtgcattagtttccaatggggctgtaacatattaccacaagtttagtggcttaaaatcacacaagtttattattctaaagttatggaggtcgctgggtgcagtggctcacacctgtgatcccagcaccttgggaggccaaggcgggcagatcacgaggtcaggagatcaagaccatcttggccaacatggtgaaaccctgtctctactaaaaatacaaaaaattagccgggcatggtggcacgcgcctgtagtcccagctacttgggaggctgaggcaggagaattgcttgaaccttggaggcggaggttgcaatgagccgagatcgcgccactgcactcca

SEQ ID NO: 130887 - DNA, 126 bp, Homo sapiens
agtaaatcattttaataggttaaatttgattatgagaagtgacccttttcaaatgtcacttactaaagaagttttctttcactttccctcccttcttttcttgccatagtagaataaactcacagt

SEQ ID NO: 130888 - DNA, 122 bp, Homo sapiens
tttgtttggttccaagagcatgagaaaaactttaagaagtacagacgcttccacacaaaacaaaccaagatggacccagaattgccactgccctgcctgtacaacatgagcaccacccactg

SEQ ID NO: 130889 - DNA, 504 bp, Homo sapiens
atcttttaaaaatagagactagggttttgctgcgttgcccaggctggtcttgaacacctgaactcaagtgatcagcctgcctcagcctcacaaagtgttgggattacaggcatgagccacgatgcctggccttagtcatcctttaaatctcagcaaagcatcacttccctcaggaagccttacctgacttttctgatcagatttgattctgctgttagaagctggtgatagcatggtgcaccttcccttggtatcacttactgtagttgcagttgtacctttatctgtgtgattattttgttagaaatgcttgttccccagtgccacagagaaatagcactcaaatataaatttatttcagcaaggcaatttttaccttctgcagaaagggtgctccttgcagatggaacaatggcgagcgcacactgaacaaagggggtaaaaatatttatatcctacacatctggaccctactgctgtgtcctgattccattggctggaact

SEQ ID NO: 130890 - DNA, 660 bp, Homo sapiens
ctcagttatttcctcatctgttgacttatatgttttggtagacaatcccatgtacagctctttcatttttgatatttcttttgcatataagttgtacatattcattggagacaaattagaaataggtattagcaatgtaacatatgaaatacagagaagaacccaccatctaaatataattactgttgatattttgaatgttttgctttaagtctttttactgtaatatatgcctatgtattttttcttaactaatattcacaccttgttttataacctgattttttttcagtgttagattgtttaggcttgcaggaggtggggagtgtgactttttgtctactttattcattccatttttaaaagaacatagaataatatttggcatggactttggacttatttatctagaaatctcaaatataataagcatgtgtattttagtacaaattcatacttaaagcatagttgaatagcagttttagatttcagcaggccttgagaggtgattttttaaaaattctaaaaagttcacatctgcttcacattcattgtttaaaatgaaaacagagaagctcacacatgcttgataaagctgtagaatacgtaatgattaagtttttatgtgcttttagatgatagctaagtcctgtaaggcta

SEQ ID NO: 130891 - DNA, 151 bp, Homo sapiens
aattcatctcctctgagcacaaaccacctcacccttgcatctaattctgtgaactacaaattcctggctccagccttgcctggcttcacaggctgcatgcccccaacttcagtctccctggcaacgtcaccaaccactcccagcccagcct

SEQ ID NO: 130892 - DNA, 135 bp, Homo sapiens
agccataaatgtatatcatagatattgtgacactgctttttatcagtttggttcatattgtgctattatatatgccctaatgctcatgtttattttagaaactgtgacccaatgtcctttgttcctcttctaatt

SEQ ID NO: 130893 - DNA, 326 bp, Homo sapiens
attttaagccagggatcataaaacccacctttcaggatgactgtgaacagaaccagattcagctggtatgctggtatgcctggcacgacacggcatggcaggcagcattcactctgatcggttggtgcctgcgctgagtatgtagaatttcacccctggttgtgaggctttaaatgagtaaatgcttataaagcattcagcgcattttctgcctcgtaataagaaggtcacaaatgatagctgcttctgctaccactattaatgctatcattattcttattatctggaggcagattgtggaggacttttggaggccaaacagagac

SEQ ID NO: 130894 - DNA, 362 bp, Homo sapiens
cctttagccaagaaggggctagaaattgctctaaggaggacattctgggagagctacagcctccatgagtaaattagactgagaggtggcaatgtttgcatgttcatttcccagatgtgagatgaataatttaacctgaaaggtgaaatgctcaggaaaagcaataatttaacctgaaaggtgaaatgctcaggaaaagcagatggtccagagatgccatacttctcatgcaacattgcttccattgcttgaaattggtgtctgattttttcatagaaaaaatgttatgaatattactttggaaaattgtagtgaagtcatggtcacacttgtgtgtgtggtccagttctttggggttctct

SEQ ID NO: 130895 - DNA, 442 bp, Homo sapiens
gctgtgtgctcccaagtgtacatacatgatgcacatgctaataaacttctgtttgtttttctcctgttaatctgtctttggaaagattaagctggaaaacctgaaatgagtagagaaaaagactttttgcctttcctatagggaaattataaaatatcttgagacataagaaaacaaaaatacaacatgccaaaacttacgagatgcagcaaaagcagtgctatgaggaaaatttatagctataaatgcctacattaaaaagaaagaaaaaggccaggcatggttgcttatgtctgtaatcccagcactttagaaggccaaggtgggagaattgcttgaggccagtagttcaagaccagcctgggaaacatagggagaccctgtctctacaaataataacaaaattaggtaggtgtggtggcatgcacctgtggtcccagct

SEQ ID NO: 130896 - DNA, 648 bp, Homo sapiens
gggactctttatttccctcttaccttcccacttacgccatttgtctggctgacctattcagctactctggcatgggaggagttttcaccccactcctgaggttgaagaataagaggcctggcggtgctttcctaagagggctttgctgccttcctcctccaccccaatgaagaagggctgtcaggccagtatctcctgggtacaagtcctgtatccccagcagactttccttggctagaatgatatttgggcatctgggtctcttggtttcagacaagagaccagaggaaggggctggatttgagttactgagttcactacctgctggggcaggagttctctcctttccatcctgtgaggcttttccctggaccttttttcttgtgaattcagtgggcaggtagtatcctcctgctggcctggggaatttgaggttggtggggacagagactcaggagccctgcctctatgttctaagggcagcaaggcccaggaaagttgactatgtctttcaaaccatctcacatatagaggctgaggctgggtgggcctttgctgaaagagtcctccatggccaatttatgagtcaggcatggcgggagtgagctggagagggtcccaaactagggaagagacagggttctctgt

SEQ ID NO: 130897 - DNA, 623 bp, Homo sapiens
cctttcaagatagtaatgtatttcttttaacccatccaacaattaccgaattcccattttacagatgagtacgacttacataagttaagattggacaattagtgcactatcaaacacatagttactggtagagctagaatttgaattcctgtttttaaaaattatgtatggttccttttgcacgatgacactgttttggacagtatagaatactgcagtctcattgagaaatacagcagtatctagaaatatactagggatatgtgaattggctcagcttgcatttttattgtaggaggcaattgtttgtggataagtttgatacctttgaagcttctttttaagcttgctggggcaagtctagaaagtcttcactctaaggtggatattttcaaactttatggttttagaaccttaacactctttaaaattactggggactccatagtttttgtttatgaggattttaactatggactgttcagcattttagaaattaaaactaggaacattttataacacaagactacagaagcacaacctgtacaatatcaatgtaatattatgatacaacatgtagcctctataaacaccactgtataattgtgaatgaattaaagtga

SEQ ID NO: 130898 - DNA, 440 bp, Homo sapiens
aagtttctttttctctggggtgactgtgtacatttcagggagatttctatgttacacagcctagtttttctccacaatgatggaaaactaagaaatatatcactaattcttagactacacaattaacaactcttgttgcttaattgagagacatggacaccgagattcctgatccagccccagctgcagcctctttcatttgtggctgtcaattacaggactaccaagaataatccaccaatctcctggcataccaggaaaattcctggtctagattcagacaagtggtttatagttccagctctactttgagttaatcctgtttaaatttcagttctcatattctatgattcatttgtggaacatatactgagtcattttgaaaagttttaggccaaggctaactttcttacatgcaacaaaaagttgctggaaaaata

SEQ ID NO: 130899 - DNA, 794 bp, Homo sapiens
gagatacttcctggacaactgctataaaaacaacaacaaatacttttattaattcggggagcctggtcaccaactggatgctcagaggggagatggaaccctgagcagcccatgtacatggaagatctttattgcagagatcttcaaaccagctagtgtgcatttactcctgcctctccatgcctgaaggaaggaatgaagaggtctctgctgtccatctgagccagtgactgggtgaatatgcctgcccaattctagcatgcagtattaggaagcccactgttgctgtgcacctaagcccaggttttccagtatcagctcttttagtaataaagttggcattgtagtttctagctaaaaaaaaaaaaaaaaaaaaaaaaaaaacaaaaaaaaaaaaacaaaaacaaaaaaaaaaaaaaaaaaaaaaaaaagaagaccacagagcagcgagacagagagacaagaggagaaggagcaaggaagagacggacgcaagagagagagagaaggagacacacacgcgcgggaggagcaatgcacggggcgagacggggcccacgccagggagacagaggagaacacagacacgcacggggggagtgggggagagggaacgcggggggggggggacggggagagaggcggagaggagggggcggggggagagaggggaggaggagggaggggggcggagaggagcgaagagaggaagaggagaggggaggggggcgagagagggcgggaggaggcgggggagggcggggaggggaaccggaggcgggcgagaggggagg

SEQ ID NO: 130900 - DNA, 1030 bp, Homo sapiens
tgatctagaggatcccgtatatgctgtctcaaaattgtataagtttaagaacctcacaatcaaaattcactcttcttgaatggaggaaaataatatagtggagaccagggaagttgggtatttcagatgagttttgaggcagttaataacatctagaagagtttaattgatttctcctttgaaagggaaaatggtggaataggaggttgctgacatatattttttgaataataaaccttgtattactagttaacttttgtatgcataaatttgacaaaacttaaaactatgtatttatttatttattcatttatttatttgaggggagatggaaccctgagcagcccatgtacatggaagatctttattgcagagatcttcaaaccagctagtgtgcatttactcctgcctctccatgcctgaaggaaggaatgaagaggtctctgctgtccatctgagccagtgactgggtgaatatgcctgcccaattctagcatgcagtattaggaagcccactgttgctgtgcacctaagcccaggttttccagtatcagctcttttagtaataaagttggcattgtagtttctagctaaaaaaaaaaaaaaaaaaaaaaaaaaaacaaaaaaaaaaaaacaaaaacaaaaaaaaaaaaaaaaaaaaaaaaaagaagaccacagagcagcgagacagagagacaagaggagaaggagcaaggaagagacggacgcaagagagagagagaaggagacacacacgcgcgggaggagcaatgcacggggcgagacggggcccacgccagggagacagaggagaacacagacacgcacggggggagtgggggagagggaacgcggggggggggggacggggagagaggcggagaggagggggcggggggagagaggggaggaggagggaggggggcggagaggagcgaagagaggaagaggagaggggaggggggcgagagagggcgggaggaggcgggggagggcggggaggggaaccggaggcgggcgagaggggagg

SEQ ID NO: 130901 - DNA, 219 bp, Homo sapiens
ctttatgtggtctctggagttttgaacataaagggaggtttgggagcacaaagaagagtctgaactgtttgctcatggtatagaccatttgctgaggacaacgcagaacattcagcggaagcctacgacaccactttgaccagctgtgccaaatactggggggtgaagagcaagtgtcatttttcttttttttttttttttgagacggagtctcgctct

SEQ ID NO: 130902 - DNA, 237 bp, Homo sapiens
agaaaactggctcacagtgaccactaactccacatggagtaaaacaaactagaaggctttactggagtcagttttcatcccaggtcaatttatattccatcaaaccacataaaaattgccagatcaatctgaccacagccaggaggagatgttcctgcttggagacaggcacatgtgctacttgtactcgctgctgtgctggaggcacaaatatggtcaaatatgtttgaatagtgg

SEQ ID NO: 130903 - DNA, 138 bp, Homo sapiens
tgcagggatgacaggtgtgagccaccgcggctggcccacggtcaaatcttaaagcatggtttcccagccacagcaccgtggccatttgagctggaccagtttctggagcagggccgtcctgggcactgcagggtgctg

SEQ ID NO: 130904 - DNA, 844 bp, Homo sapiens
aaagggttgaatgttctcctgactctgggtgatgtgactataaacttctttggctcttagcctcatgatgatgctgtccactctgcttttttaatctgtcatgacctctcaggcttagtgccagataatccacaaatccagccatgttttcatcttttccatagcttcgtcatgcacagcggatgttactttagcacttacttgagtgaactcatgttcagattggcaaatttcctcttcctttttctgcatgtgtcgttttgttgactcattaacactgaactcacagccaacagtggtataacttctgcctgaacgaagctcatctaacgcaagcattttctccataaggcgcatcacagccttcttgtacttaggagcactagaaagcacttaattgctatacttggaggccaatttatagagaaaaatcatcaacaaaaagcacaaaaatgtcaaaaacacagcactaaaaggaccgaggaaaggacacttgtgtacagtatgagagccaaaacaagaaggcagggtggcttcttgttggacatcagctagaaacgtatgtatcaggtagctcattttttcaccactctgtgcatgtcgatggatggccccaagaacactgcaagtgttgattttggggttacaaataaagcttagtaagtaggcaaattcacaaatacggaagctgtgaataatgaggactgactgtatttgccaagagccacatggagaggcttatttgttagtgcgctgaaccatgtggctctgatgtagatggcaaagggaagaagctagggagtgtgtcactgtgtgtgtgtgtgttggcgggagatgctgccca

SEQ ID NO: 130905 - DNA, 178 bp, Homo sapiens
tttgaacataacaatccaattccttcaacaaccatcatagaaaaatcagttaaaagcaatatgtctaattaaaataatgattttatttaatttggtcaataacaaaatgtcactctttataaatgcaatttgttctgacaaacgtcagagatagtctttgagtagtttcctacagatg

SEQ ID NO: 130906 - DNA, 470 bp, Homo sapiens
agatggagaaagtccatctcgtactaaaaacacaaaatgagcggggttgtggtggctcatgtctgtaatcccagcactttgggaggctaaggcgggcagatcacaaggtcaggagatcaagaccatcctggctgacacggtgaaaccccctctctactaaaaatacaaaaaattagccaggcgtggtggcacgtgtctgtagtcccagctacttgggaggctgaggcaggagaatcgcttgaacccgggaggcagaggttgcagtgagacaagatcatgccactgcactccagcctgggcgacagagcaagactctgtctcacttcttccaagtgagcacacaatcatttctacctacaaatgttataactaaaaattaattatcaggaactccttctcaatataacgatttaaacaaatgtaaggtgtactaatttatttgcttaacattgtttattaaatacctgtac

SEQ ID NO: 130907 - DNA, 333 bp, Homo sapiens
ggagaagaccaagcatggcacctgggaaaattctctctagaaaatggtggaagaagatccagcaaaccagaggggaagagtgctcagagtggcaggagaaccaaggcagagcagtgtcccagaggtcaccggtgtgatgctgcagagacatcaaggaagacactgtcaggaagcatggaggggacttgccctcaattccattcctccatttcccacttcccgctatcctcgttttgtagttctctcgagtgtctttggctgtcatggtaactaccagtaccacacccctctatgaaggccacactgattcattctttattgactcaggtgtgg

SEQ ID NO: 130908 - DNA, 579 bp, Homo sapiens
gtggttcagttagcttccctgttcactgactctggctagacattttgcaagtgcatgtcaagtgtgaccccaggatagcaagagggagatgggctaggggtatctctcatatatgtatatttatttatttagagacagggtctccctctgttgcccaggctgccaggctggagtgcagtggcgtgattcatgctcactgcaacctccacctcccaggctcttgaccctcgtgcctcaacctcccgagtagtcaggattacaagtgcatgccaccatgcctggctaattttgggtttgttttttttggtagagacagggtttcaccatattgcccaggctggtttcgaaatcctgggctaaagcaatctcccctcccaaagtgctgagattacaggtgtgagccactgcatccagccactgtatcttatatatttctttttttttttcctacgaggaaacaccaattttaatttaaagaaaaaaaaaaatcagaaattgtctgtaaggataacagagcaaaacaagtcctgaaaaagagctctgcatcttggtggtcatatttattgaagagctttagaa

SEQ ID NO: 130909 - DNA, 232 bp, Homo sapiens
ccatgagccacagagggcaggggcagagggacaggcagaggtgtccacactatgctctcctttgaaagtggcagtttgtgtgttttatgataaaagattctgtgtaaggtttgacttggaacactagagtatgaaagccacagcattagccagatccagaggaaaggacaggatgtcccttttccaccacctcactctgctggtgagctgctgtcttcttcagaggacacca

SEQ ID NO: 130910 - DNA, 437 bp, Homo sapiens
tctcctgcctcagcctcctgagtagctgggactataggcgtacgccaccacacccagctaatttttgtattttcagtagagacagggtttccccatgttgaccaggctggttttgaactcctgacctcaggtgatccacctgccttggcctcccaaattgctaggattacaggcatgagccaccatgcctggcctaaagaaaattttttaaaaacaagtagttttaatatagcttttcacatgaatgatgtttgaggtcttggctagggaccctagatagtggaccctgacatgaaggcaatccatttaaaagtaagaatttggcaagaataaaaaattacttgctaaggaataaaggaggcaaaattttatgtaaattcttaaacgatgtagaatcttaaactatgtagaatcacagaattttaaattatttctag

SEQ ID NO: 130911 - DNA, 500 bp, Homo sapiens
gttggctgcctctagaggatccactctccctactgtatcctatgtttgttgagaaacttatttaacttctctggccctccgtttccttcactgagcagtggagtgattgataacctccacctgtggttgctgaaggtcttgcacaagatgatatagttaaagtagctagcagtgcccacgtacggcggatgcctcacaacggtttgcagccatctctctatctgtgtctttgtctctctctcacactggttttggcttactgttagcagctagccgagataagtgtgtttatggtctttgcatgtattgtttctgtagcatactggaggattacaagaggttggggagtgagggggcggtgaggagtagacaaaggcagccaactcttccaagtttagcttagaaggaaggagcggtaaaccctagttgaatgttggactgaagcaggtttgtttttgttttgtttaaaggatagggaagatctgtgcgtgtttccagga

SEQ ID NO: 130912 - DNA, 582 bp, Homo sapiens
gttcaattctaactctgcaactagtaagcactgtgaccttgctataccctccatatagccatatttttacaagatttgggggtgtcaggaattaaatatggctatatgttttatatacctatatatttctctctccagtatatagaataagacataatgccacttaaaagattgagaaacttaaatgtttatctgaggtgaaactgctaaggataggagctacctttactaaacaagtcttcttacttctaccccagtgctttttccattattagtcttatggctttcagcagaatcaccttgggttcttgttaaaaatgtagattcaggccgggtgcagtggctcacgcctgtaatcccagcagcctgtaatcccagctactcgggaggctgaggcaggagaattgcttgaacctgggaggcggaggttgcggtgagccaagatcacgccattgcactccagcctgggcaacaagagtgaaactctgtctcaggaaaaaaaaaaaaaaaaagtagattctgaggctgagtgcaggggctcacgcctgtaaccccagcactttgggaggctgaggtgggagg

SEQ ID NO: 130913 - DNA, 310 bp, Homo sapiens
aagctaaagaaaaagcaaagaaaattcaccccgccacacagagaaatgtgtatatttaattattcccaatgtgtttttgctctgcttctctttgtgttatgagaaacaggaagaattttgtctaggtaggaattaagtcagtttcatttcctgactgcaaatgatgtccgagagatttggcagaaacacagtccaggaatttttgtctcccgttgtctttcaacttagataacatagccctggttagaaggggaggtgtgggaagcaggaaggcaggtcacatatcaatgttgcggacctactttgctgg

SEQ ID NO: 130914 - DNA, 945 bp, Homo sapiens
ggaaaataaaactgcaggctgaagacttaagtcttagtaactaataatactcatcgtaaggagataggagaaattgaactattaaaggaaacaaggaacagctggaaatcaaagaagataatctgtgaactgaaaataactttccagagatgtttttcatttttctaaaaattgactggatgacgaagctttttaaaatacgttaaatttggtcatgtctgtaatactcttttttagaactggtggaaaaatataactaacatttaaatatttccttgctatttgctgtacaaagcaagaaaatcatctcaaaatttttatcaagaaggaagtctttgttgttactctgtatgctacgttaaacagctctggatctgacacgtcaatttatatatcaaaaatatcttctatttgcttctttttaatatactcccagatttgtcagagatcacagaagcacatttcctctaattcagctctaggagcaatgagtgtagtacgggtgacagcaggtcattcgtttcaggagaggattcgaaagagaggaaaaatctcctggaatttcaaagaaatttcttttgtataatagcttctgtaaaaagatcttctctgtcatctagcacagtgtctacagatttggggccaatggtgtttgtattagtgttttcttcaggaagactacctggttttggagaaactaacttgctagtgattaggtcttttctgttttctagctccccaaagtcagtgaggaggctctctccctgctgctgtgatcactgggccatgcatgcttagtcttgtgaacttgtcatgtgagaacacatgccatgtcccttccccactggtttatgcccctgtggccctgaagtcttctttaaaaagagaaacagcctgacagtccagtagaaaaaggagcaaagcagatttcaagagaagaaattg

SEQ ID NO: 130915 - DNA, 687 bp, Homo sapiens
gacttacactgcctggcatatctagacactgtagatattagcatagggattaacagtgtaggctttggagtcaagttacttggtttgaatcgtggctccgttgcacactggctttgtgatcacaggcaagttattcaacctctctgtgccttactttcctcatgtttaaagtagtcataatcatacttgcatcatggtgttattcagaagatcaactgagagatgtatgtaaagtatttagcataggacttagaacctagttaatgctcaattaatatgttatttttggccaggtgtggtggcttacgcctataatcccagcactttgggagactgaggtgggcggatcccttgaggctaggagttggagaccagcctggccaacatgacgaaaccccgcctctaccaaaaatacaaaaattagccagccatggtggtgcacacttgtagtcccagctactcgggaggctgaggcaggagaatcgcttgaactcgggaggcagaggttgcagtgagccgagattgtgccactgtactccagcctgggcaacagagtgagactctgtttaaaaaaaaaaaaagatatatatatatattaacatgcttcttattgaggtataatttacatactgttatggactgaattgtgttccctccaaaatacatatgttgaagtcctaaacccca

SEQ ID NO: 130916 - DNA, 433 bp, Homo sapiens
ttcacaagcatctcaaaacaaaaactgacctcggcatctcctcctgttcaccttgtggctacttccttaccccttcctcagggaatgacacctttgctatcagctacccaagtcagaaaccagagtcaacctaaaatccctccattgccaaccactgcagccacattgcaagtccttgggatcagataataacacaatctagaatccaccttctctcccctctactgcctcccctctactccacctcctcctgcctctactggggctccagtactaacatctttcaacccagacctctacaactgcctccaaattcatctctctgcctctagcatcctgtggcataaagccaacgtttctcaaattagagtccaagatatgtttctttaaattttgaactttaattttaatgatgttttaaaatatattttac

SEQ ID NO: 130917 - DNA, 513 bp, Homo sapiens
caattctgatggccaacaatttcaagacatcacttagaagaataatgtagagatggccagagtcccagagttggccaaagactggacaagtggctaacatccttttctacctatctgcctgtctcatcagggctctcattccagacaacctccaaggggctgctgaatgtaaatttctaaagcacagctctgaaatgttggattaaagatgtttctcagtgacccccaaaacatgagtttcacagcatgtaacccttcatagtctggccaaaggcaccttttgagcctcctatgcgggattctccttctgtgccacttgttgagcctaaacaccattttttcacttcactgtacactgtacatatactggttcctcttactgagatggcttttccctcatgtacctgataggtgcttagttttcctctgagatcccctcaagtgtcaccttctcttgacaccttcctgcagtgcttgtgcaggatgcagcaaatagagtataaggatgtgggc

SEQ ID NO: 130918 - DNA, 274 bp, Homo sapiens
attatccatcacatactatatttctagatgatgccatgctttctgtctctccttccagctttcatatctgctgccccatgtgccaaaaactcactcacactccctccttctcttggcccagcaaactcttactcttcaagtttaaaaacacttcctcggctgggcgcggtggctcctgcctgtaatcccagcactctgggaggctgaggcgggcggatcacgaggtcaggagtttgagaccagcctgaccaacatggtgaaaccctgtctctac

SEQ ID NO: 130919 - DNA, 397 bp, Homo sapiens
catcggaccttccagattcccaaaaaattaagtttaatacggacaggtattggttgtaacatgaaaacattttaagagtataaacagaggatgtgatacctttctggtcttgaagaaattactgaaaacgagctcattcaatacttagttgattaccaaactcttatctccatctcagtataaaaactataaattcaggccgggcacggtggctcacgcctgtaatctcagcactttgcggggacgaggcgggcggatcacgaggccaggagatcaagactatcctggctaacaccgtgaaaccccgtctctactaaaaatacaaaaaattagccgggcgtggtggcgggcgcctgtagtcccagctgttcgggaggctgaagcaggagaatggtgt

SEQ ID NO: 130920 - DNA, 210 bp, Homo sapiens
agataaattccacagggcttctgtggtgtctctggaaaattgaggcattttaaggcaaacaagggccccccacctgcctctccagcctccgcaaatgatattgcaattcatatattctgtgttcttgccctattgagcaatgccctgcaccatttaacatgccataatttctttgattatccttatattctatttcctttccctggaatg

SEQ ID NO: 130921 - DNA, 785 bp, Homo sapiens
gcctgttgcaagaaaatctctattaatacctgtaaattggatggggaaatagtcaagcaagttctttaccttcatcaagaaaagctagtttctggtgacctttctttatgaggttttaatcaccccagagttttatccctctcagagtcagtggtcggctcttgtatcccatgagtaaatgcaaatgtttcctccatttgaaagcaaaaccagtaagaccccttacttataaagtgagttaaaacaaaaagaaagaatataaaaactaaaggaaggtagtaagtaaagcatttagctttctgaaacaattcaaatggggataggaagttggttttaaatggcttaaaggggattagggttttaaagttggataaagagtttggtgcttaggtttaggcatggcattgcttttaaaagattacttccatatttgacaatgattctaactggagattataaagtaaatagtcaattttaagacaccacgggaaacaagagggtttcttttttgttgttgtttgtttatacaaaatggtagcctagagttaacaggctgaatcctgaagccctcatttcataatactacagaggatctatcaccagagagaatctagcagaggttgtttaatgcacttaattgagattatctgagcttttggtttaaattactttggaaaaagtcttaggtgcaaacagcgtccttgaaaggtaaacatacttacctctaagaaaaaaaggttcaatttaagttctttaaaattcttcatacaggttagtagcaccaa

SEQ ID NO: 130922 - DNA, 418 bp, Homo sapiens
tcagcaccctcagccatcaactccagagaagtccatgaaggtcccaaatctagaaccaatgaagaaacattaaggcacaagatctgattcataacaccatacagagctaaaagcatgggagaaaacagctgccatgagcacaaggagcagaggaaggttcatgggacacaaggaggcacagaatagaggcccttgaggggagagagttccctccactgagggaagggaagccagtgaggacagcagacatgccggggcctcagcctgggctccacacaccatctcagagcccagggcatccctgtccttcattaacagcaaaccatggtaagaacagagttttccagaactctgttccagtactgggtgctgatatgaggggctctgtctgacagatgtacgttcaaacaccaacact

SEQ ID NO: 130923 - DNA, 206 bp, Homo sapiens
ttacttatacttgatgtggctgactaaaattatgatataccagataaaccagattctgaatcccagtccaaccacttctaactatatgacattagacaagtaactcaacctagctgaggcttgatgacctaatttgtaaagtgggaaaaacaatcaaaacctatatctgatggctattagaatgtttaaatgagataatatataat

SEQ ID NO: 130924 - DNA, 226 bp, Homo sapiens
gcgttttgaagattgaaggtggcaagctgtgtgctcccagggtgagttcccagggagagcaggggcccttgctatgggtcagggtgtcggatggcatcctggagatgcgggtggaggtaacatatgtgtcctagaaacaggaaaccctgacagctgcagcccctagactgagcccagcctaaaggagaagactgtcctccctggaagagcccatgctgtccaggcc

SEQ ID NO: 130925 - DNA, 445 bp, Homo sapiens
ttgctttttttttctcaggcacatcaaaggagtccgctttttcctccttcattgtgaatggcagcaaaagaagaggaaatctggaaatataataatttggtttgcctgaacactgaaatggaacttgagaattccttgggctgtcagataatttttgttaaagattttttttaaaaggagtagttaatcttctaataaatgcactaatcatcagagaaaacaaggctcaagataaaaatatttgcccttgatgagttccctccattagaatttataacacagttgaagaggcttacatgtgttattttgattttaatagaaagtctaattccaaacataatttcaatcagcatatgtgaatgtctcttcctatctttatctataaaaatgattagaatatacagcaacacatagaacattccacacccatgttcagctctgtttt

SEQ ID NO: 130926 - DNA, 305 bp, Homo sapiens
gggaatatccccagaagactggcctagggattaactgtcatggtcaatagaaagcacacatcttagaaggatcctcactcagcacatgttgagtgtttaatgaaggttgcgcgttgtcactgttatttaagtattctagaatgaccatgagggagaggaagcttgtgggacagaggctgaaaggaggggttggggagaaggctgaggatggagtaagacagtattagttcctttcttcctcctctctgtgtccttgagaactgaatgccatggtggtgtccagaggccaggacaggagacagggg

SEQ ID NO: 130927 - DNA, 422 bp, Homo sapiens
gaaaagagggaggtggactgaagggaagaaatatggaagggggaaactacagattcagggacttagtttattacaatggacctttttgggatcttataaagcatatatatttatcaggtaattatagaaatttgaacactgatgaacatctgattagttattgttggtttttaaatatatgatattgtattatggttacatttaaaagagtccttatttatcatttgtttgtttgtttgttgagacatagtcttgcactgttgcccaggctagagtgcagtggcacaatctcggctcactgcaacctccgccctccaggttcaagcaattctcatgtctcagcctcctgagtagctgggactgtgggggtgcgccaacatgcctggctaatttttgtatttttaggagagtcgaggtttcac

SEQ ID NO: 130928 - DNA, 777 bp, Homo sapiens
gggctcggtggctgacgtctgtgatcccaccattttaggaggccgagatgggagtgtacctgggcgtcaggagtttgagatctgcgtgagcaaaatagcgagaccccatctctaccaagacaacaattaaattaaattaaaacattagtccagcatgatagcgcttacactttaggagacactcttttttttaaatatattaaaaaaaaaaaccagtacagtaacaacagcctgttatcccatcttcccatcacacaaagagctctactgctagctaataagataatttggtgagcagataaatgcacattttttcccacaaaatgtatgcagtatatggcattttacaacttcgcgttgttttaatcaatttcccttatttaaaaagtttacaaaagtgattttaatgtctttattatttcttctcctgaattctgcctgctacagtgttaaccaattccctaggaatttattaatcaaccagattttttaaataattcatcttttccctgcggattaagtaccacctttaacattatacatactcggaactattaccaaaattctattctgtctataatttaatcaaggtggtttgccaaagggaatctatgttcacggttaaaagcttagaaaattcacattaggaaaaattttaaaagcagtaatttatatctgcttaatattccatcataagaattttctaggtccactttcacagtatttctagtacttagcaataatgtgctaattttcttttcctaatttaaaggagaa

SEQ ID NO: 130929 - DNA, 707 bp, Homo sapiens
agccgcctcagcctcccaaagtgctaggattacaggcatgagccactgcgcccagccagtccacacaactttttaaaaaaatttcctgacagcagtaacttcatggtccatacagcttaagaagtgtttatgctttaacaactttgtagctgtttgaaaaaataatacacaaacattgaaagagagcatgtctttatttcattctaactatacttactaatggaatatgtgcctgttggaattgcacaacttctcaaaatttggtatcagaatggacacctacacactcatttcctgttacgtattggttttcttatggtatttgcttttgtcatagcaactatttaaacccagctttgtgaaaatatgatgttatctatcaaaaggattgtagggggaactaatgttgaagcagtgtacaattttgagttagtagtgcacacattctccaacagatattgctgtttttcttcaaagagttaaaataaccctcgttgtgaccctctgagttcaccacagccacccacagtgcctgagagcacagtttaggaactgtggctttagagacttttgaaaaactatgaaatctcttatatgtttctatgttaatgtctacaagttttcttcatatattcagattcatgcaaagtatgatttccagcaaattataaatattggcatttaaaataaaactgttacttcgttta

SEQ ID NO: 130930 - DNA, 315 bp, Homo sapiens
caagaccgtgcctcaaaaaataaaaataataaaataaaaccaaggaggtatgaagaggtagggagacgtgactgttaaccaatattgcaggaaagggttaacattcaaacagtctagaaaatcactttggttcaagttttatctttgacagttctgcttaacgtagcaatattgtggctggaaagatttggagttagaaaaccttgtacgcttttttcaaacaaaggtgacctattcataaataggagcattaacagctgacaacgttgcacataaaagattcctggccggcacggtagctcatgcctgtgagca

SEQ ID NO: 130931 - DNA, 3543 bp, Homo sapiens
  misc_feature (1596)..(1596): n is a, c, g, or t
  misc_feature (1830)..(1830): n is a, c, g, or t
acgcgggagattcgattggaaggctgccggcgtgctactgagttcggccggtccgagtcactgtgcgtcgcctgggcgcgttcctggtcttctcccccaggtcttgctctgtcacccaggctggagtgccatggcatcatcatagctcactatggccttgatcctcctgccttagcctcccaagcagctggtattacagaccacggtgtgaacacatgaacagaagacgaaaatttcttctagcctcagtacttgctctccagaattcaagttttatatatccatcatgtcagaagtgcttctctaggataatcctggtctccaaaaggtctaattgtccaaaatgtggctctactggtgaatctggaaatgccaattacagatacaaactttccttaaaagttgcagaatcaaacaaattgtttgttattactgtatttggaagttgcttagatacattttttggtcttactgccactggtttgcacaggtacattcaggatcctaataaaattccagaaacactggacaatgatacaactcagaatctattaactaaagcagttgaaacttgctttgttggacaaagctttatttttggagtgacgaattttgaaaaccaacctggacaaggttcagatgccagtaacttcttacagcaatgctctgaccacaaaagaaaagccgaaagcactagtggcttgccagattgttctaccagacccaggtattgcaggctttactgtcattgactacttccatcaacttttgcagacttttaatttcaggaaacttcagtgtgactctcaggcacctaacaatcacttacttgctttagatcactcaaatagtgatctcagcagcatatatacttctgacagcacttctgattttttcaagtcctgcagcaaggatactttttcaaaattctggcagccatcacttgaattcacttgcattgtttcacaactaacagataatgatgatttttcagcttcagaacaaagtaaggcctttggtactcttcagcagaacagaaagtccatctccattgcagaggccactggttccagtagctgccatgatcccattcaggattcatggagccttgtttcatatatggataaaaagagtacagcagaaaagttgggtaaagaacttggcttacaagctaaggagctgagtgcagttcacagcagtcatcatgaaattggagttaatgactctaatttattctctttggaaatgcgagagccccttgagtcaagtaatacaaaatccttccacagtgcagtggaaattaaaaataggtcccagcatgagctaccatgttttcagcatcatggtatagataccccaactagccttcagaagagatctgcatgttgtccaccttcgttactcagacttgaagagacagccagcagttcccaggatggtgaccctcaaatttgggatgatctgccattctctgaaagcctgaacaagtttctggcagttcttgaaagtgagattgctgtaacccaggcagatgtcagtagtaggaaacatcatgtagataatgacattgataaatttcatgcagaccacagcagnttatctgtgactccccagagaactactggagccctgcatacaccacctatagctttaagatcatcacaagtaatagtcaaagcaaactgtagcaaagatgacttccttttcaactgtaaaggaaatctaagtcctagtgttgaaaaggagtcacaaccagataacaaagtagaggctgtctctgtaaatcataatggaagagatatgtcagaatattttttaccgaatccttanctgtcagctctgtcttcatcttcaaaagatttagaaacaatagttactcttaagaagactatcagaatctcaccacacagggagagtgaccattctagtctaaataacaaatatttgaatggatgtggagaaatatcagtttcagaaatgaatgaaaagttgacaactctgtgttataggaagtataatgatgtctctgatctttgcaaattagaaaataaacaatattgtaggtggtccaagaaccaagatgacagttttacaatttgcaggaaacttacatatcctttagaaactctttgcaatagtccaaatagaagtacaaatacattgaaagaaatgccttggggacatatcaataacaacgtaacacagagctattctattggttatgaaggtagctatgatgcctctgctgatctctttgatgatattgctaaagaaatggacattgcaactgagattaccaaaaaatcacaggatattttgttaaaatggggaacatctttggcagaaagtcacccttcagagtctgatttttcactgagatcactttctgaagacttcatccagccttcacaaaaattatccttgcaaagcctatctgactctaggcattcaagaacatgctctccaacacctcattttcaatcagattcagaatataattttgaaaatagtcaagactttgttccatgttcacagtcaactccaatttcagggttccaccaaacaagaattcatgggataaacagagctttcaaaaaacctgtattttattcagatcttgatggtaactatgaaaaaataaggattttccctgaaaatgacaaacagcaagccagcccaagctgtccaaaaaatataaaaacacctagccagaaaatcagaagccctattgtatctggtgtttcacaaccagacgttttcaatcactacccttttgctgagtgccatgaaactgatagtgatgaatgggtccctcctaccacacaaaaaatatttccttcagatatgcttggattccaaggcataggtctagggaaatgccttgctgcctatcatttccctgatcaacaagagttaccaagaaagaaactgaaacatattagacaaggaaccaataaaggtttaattaagaagaaattaaagaatatgcttgcagcagttgttacgaaaaagaaaactcataaatataactgtaaaagttcaggctggatttccaaatgtccagacattcaagtcttagcagcacctcagctgcaccctattcttggacctgattcttgttcagaagtcaaatgttgccttccattttcagaaaaaggcccaccttcagtgtgtgaaactcgaagtgcttggtcacctgaattgttttcataaaaagtcacctgaacccaattcctgaacttttaaatctgtttggaaatgtttgccttcaggggtacggaaagcattctttacattttgaacacttggagagaagcaaattgaaaacaggactctgctgggagctactgtgccttttaaaatataaagccattgttttccccagggttttatctagaatactatgattaggtagttgagcactttatcttatactgtttattgtactttaataatattgttaagattgtttttgaaagtattaatgtttgttaaaatcacatatacatccagaaataaagactttgcaaaccaaaaaaaaat

SEQ ID NO: 130932 - DNA, 3022 bp, Homo sapiens
  misc_feature (1596)..(1596): n is a, c, g, or t
  misc_feature (1830)..(1830): n is a, c, g, or t
acgcgggagattcgattggaaggctgccggcgtgctactgagttcggccggtccgagtcactgtgcgtcgcctgggcgcgttcctggtcttctcccccaggtcttgctctgtcacccaggctggagtgccatggcatcatcatagctcactatggccttgatcctcctgccttagcctcccaagcagctggtattacagaccacggtgtgaacacatgaacagaagacgaaaatttcttctagcctcagtacttgctctccagaattcaagttttatatatccatcatgtcagaagtgcttctctaggataatcctggtctccaaaaggtctaattgtccaaaatgtggctctactggtgaatctggaaatgccaattacagatacaaactttccttaaaagttgcagaatcaaacaaattgtttgttattactgtatttggaagttgcttagatacattttttggtcttactgccactggtttgcacaggtacattcaggatcctaataaaattccagaaacactggacaatgatacaactcagaatctattaactaaagcagttgaaacttgctttgttggacaaagctttatttttggagtgacgaattttgaaaaccaacctggacaaggttcagatgccagtaacttcttacagcaatgctctgaccacaaaagaaaagccgaaagcactagtggcttgccagattgttctaccagacccaggtattgcaggctttactgtcattgactacttccatcaacttttgcagacttttaatttcaggaaacttcagtgtgactctcaggcacctaacaatcacttacttgctttagatcactcaaatagtgatctcagcagcatatatacttctgacagcacttctgattttttcaagtcctgcagcaaggatactttttcaaaattctggcagccatcacttgaattcacttgcattgtttcacaactaacagataatgatgatttttcagcttcagaacaaagtaaggcctttggtactcttcagcagaacagaaagtccatctccattgcagaggccactggttccagtagctgccatgatcccattcaggattcatggagccttgtttcatatatggataaaaagagtacagcagaaaagttgggtaaagaacttggcttacaagctaaggagctgagtgcagttcacagcagtcatcatgaaattggagttaatgactctaatttattctctttggaaatgcgagagccccttgagtcaagtaatacaaaatccttccacagtgcagtggaaattaaaaataggtcccagcatgagctaccatgttttcagcatcatggtatagataccccaactagccttcagaagagatctgcatgttgtccaccttcgttactcagacttgaagagacagccagcagttcccaggatggtgaccctcaaatttgggatgatctgccattctctgaaagcctgaacaagtttctggcagttcttgaaagtgagattgctgtaacccaggcagatgtcagtagtaggaaacatcatgtagataatgacattgataaatttcatgcagaccacagcagnttatctgtgactccccagagaactactggagccctgcatacaccacctatagctttaagatcatcacaagtaatagtcaaagcaaactgtagcaaagatgacttccttttcaactgtaaaggaaatctaagtcctagtgttgaaaaggagtcacaaccagataacaaagtagaggctgtctctgtaaatcataatggaagagatatgtcagaatattttttaccgaatccttanctgtcagctctgtcttcatcttcaaaagatttagaaacaatagttactcttaagaagactatcagaatctcaccacacagggagagtgaccattctagtctaaataacaaatatttgaatggatgtggagaaatatcagtttcagaaatgaatgaaaagttgacaactctgtgttataggaagtataatgatgtctctgatctttgcaaattagaaaataaacaatattgtaggtggtccaagaaccaagatgacagttttacaatttgcaggaaacttacatatcctttagaaactctttgcaatagtccaaatagaagtacaaatacattgaaagaaatgccttggggacatatcaataacaacgtaacacagagctattctattggttatgaaggtagctatgatgcctctgctgatctctttgatgatattgctaaagaaatggacattgcaactgagattaccaaaaaatcacaggatattttgttaaaatggggaacatctttggcagaaagtcacccttcagagtctgatttttcactgagatcactttctgaagacttcatccagccttcacaaaaattatccttgcaaagcctatctgactctaggcattcaagaacatgctctccaacacctcattttcaatccgaaaaagaaaactcataaatataactgtaaaagttcaggctggatttccaaatgtccagacattcaagtcttagcagcacctcagctgcaccctattcttggacctgattcttgttcagaagtcaaatgttgccttccattttcagaaaaaggcccaccttcagtgtgtgaaactcgaagtgcttggtcacctgaattgttttcataaaaagtcacctgaacccaattcctgaacttttaaatctgtttggaaatgtttgccttcaggggtacggaaagcattctttacattttgaacacttggagagaagcaaattgaaaacaggactctgctgggagctactgtgccttttaaaatataaagccattgttttccccagggttttatctagaatactatgattaggtagttgagcactttatcttatactgtttattgtactttaataatattgttaagattgtttttgaaagtattaatgtttgttaaaatcacatatacatccagaaataaagactttgcaaaccaaaaaaaaat

SEQ ID NO: 130933 - DNA, 780 bp, Homo sapiens
  misc_feature (672)..(672): n is a, c, g, or t
  misc_feature (688)..(688): n is a, c, g, or t
  misc_feature (697)..(697): n is a, c, g, or t
  misc_feature (719)..(719): n is a, c, g, or t
  misc_feature (758)..(758): n is a, c, g, or t
acgcgggagattcgattggaaggctgccggcgtgctactgagttcggccggtccgagtcactgtgcgtcgcctgggcgcgttcctggtcttctcccccaggtcttgctctgtcacccaggctggagtgccatggcatcatcatagctcactatggccttgatcctcctgccttagcctcccaagcagctggtattacagaccacggtgtgaacacatgaacagaagacgaaaatttcttctagcctcagtacttgctctccagaattcaagttttatatatccatcatgtcagaagtgcttctctaggataatcctggtctccaaaagttgctctttatttgcttctgaatcttgctgaggatactcgtaccgaactgaaaatgaggaacaagaacatagttcacatgttggtgaaagcccttgatcgggacaattttgagctgctaattttagttgtgtcattcttgaagaaactcagcatttttatggagaataaaaatgatatggtggaaatggatattgttgaaaaactggtgagaatgataccttgttgagcatgaagacctgctgaatatcaccctccgacttttactaaacctatcctttgacacaggactgaaggaataagatggtacaagttggactgcttcccaagctcactgcactcctanggcaatgacaactacnaacaaatancaatgtgtgttcttttaccacntaagcatgggatgaacgctttaaatcaatgtttggcatncactgactgtttaccccagtta

SEQ ID NO: 130934 - DNA, 396 bp, Homo sapiens
cctgagccagacacctcagtaggtgccagcagccctccatggatgaggagggagctgttgcaccttgatatgtatttttgtcatctggatctgggctctacagtatggtggccactggctacatgtggctgttaagcacttgaaatggaactagtccaaactgcgatgggttgtaaatatgcagtgcacactgaatttcaaagacttggtatgataaaaagattgtaaaatctcaatatttttaaattggttatatgatgaaatattttggatataccaagttaaatagaagaaattatttcattaatttctcttgtttctctacttattttaaagtgactgccagaaaacttaaaattgggtatgtgtagaccttggtctagatgctataccctg

SEQ ID NO: 130935 - DNA, 831 bp, Homo sapiens
ctattattttgtctgctggcttttctcatttctatagaagcagcttgtgcaatgtaaattctctagcattaaatacttttacaatcaaagtcttagtgcaacagaaattcctttggcatcaacctatgtctacttatttccagcacaacttgatagtacatcagaatgtgaactgaatattggaatgatatttgatatgtgtatcacgccttcattaatttattgctttacatatttcatgagaacctatgtgtccagcacagtggcattgtaggcactggacatacacagttctagatggagtttctgccttgggaggtgatatgaggaaaatagtcattgagactaaaaatatttactgagattcatacttgtcatgcattgagctaggttcagagaatacagtggtgaacagacaggttccctatcttgatgatgcttgcagacattgttcattcaagctgctataacaaaataccataaactgggtagcttgtaaacaaaaaacatttatttcttatagttctggaagccgttaagtccaagatcagggtgctggcagatttagtgtctggagaaggcttgctttctaatagatgacaacttctttgtcctcccctggtgcaaggggccaaccagctctctgatgcctctttgataagggaattaatctcttataaggctcttccttcatgacctaatcacctcctaaccccacctcttaacactattgcattgaggactaggtacaacatgtttgggggaaacacaaacattcagaccatagcagatatgtagactaatactatttcagcatattgcaactattag

SEQ ID NO: 130936 - DNA, 447 bp, Homo sapiens
gccagtgattaaaactacagtgatcataaaaatgcagggatgtaagccacagggaatgttgaaagcagtgattcctcagcctcaactagatgctcacgaactttacgttcacatgtgaaacagacgcatcaagatgaagaccacgtggaacactgaaaatatatcccagaagactgtgtctaaaaaatgaagggtaattatcaatgtcatcattagctcactgggggtaaggtccccctgtaatatgtccgtctgtcgttcaacttttgcacattcatttaacaatgcccagcaaacactgagggctgtttcaggtaaacacagctgataaactgctcctgccctcaagcggccagcattctttagaaggcattttcagggattattattataatcaacgaaagaggctacaaatattgacaatggtccataatttagaattagatt

SEQ ID NO: 130937 - DNA, 669 bp, Homo sapiens
gtccataattcatccctaccaagtcctatccaattcatggtgctcatgggttcccactcctgagtgccacaaaagactaccctcttggggctcaatgaaggcttgaaaataacactgctccaagagtatctgcctttctgaatctcagccccagcttgagatgagcattgggcagttccaagttactgccctgaggactctaacctggggaaagtccatgttagccaggccctcaaggttctgggccagccatttaccccaaatcctgacaccttctgagactggagaagtctggctgatggtctgcagcctgtctgcattgaccctactagtccagaagtgatatcgggccatacacataggactcctcatcaaagtgggatttgggattggaacagagctctgggcttttagtctgccttggctctgaatcacttgaacttaaactgatcattctttccctttactccttcagaggttttctaagagttctgagagggaaagtaaaatgctcttcactttaaattgtaaaatcatgcacttaggaaggccgaggtgggaggatcacttgaactcaggatttcgagaccagcctgggcaacatggcgaaaccccatctctacaaaaaatagcccagtgtggtggcacacgcctgtagtcccagctact

SEQ ID NO: 130938 - DNA, 697 bp, Homo sapiens
tagctgagactacaggggcatgccaccacgcccagctaatttttgtatttttagtagagatggggtttcaccatgttggccaggatggtctcgatctcttgacctcgtgatctgcccacttcagccacccaaagtgctgggattacaggcgtgagccaccgcacccagtttaaaattcatttttctatatacacagaaaaccaaggatcatcagccatggcattaatcagaagcttggaaagaaaaggctaagatggaaagaataactgtcacagggagaatctagggaatagagaagcatctaattattttttttaaaatgtattctcagaatttgaaaaatattgcatccataaagtaagaacaggaaactataataaaggaacatcagaaaacaagttaggctcttagaaactaaaaatattactgcaggaaattttaaaaattcaatataagcattggaagtagaagtccaggtagtctgtcccaggacatagaccaggaagataaaaagagaatatagggaaggagaagataagatataggggactaggtcaagatgtgactagtggaagttctaaaaagaagggagtctttggattgaaggggctcactaagtgccaggaaagttgaatagagaaaaaaattcaaacaccacacatagcacatcatggaaaaatttcagaacaccagagat

SEQ ID NO: 130939 - DNA, 510 bp, Homo sapiens
caagctctgcctcccaggttcacgccattctcctgcctcagcctcttgagtagctgggaccacaggtgcccgccaccacaccctgctaattttttgtatttttagtagagacagggtttcagcgtgttagccatgatggtctcaatctcctgacctcgtgatccgcccgcctcggcctcccaaagtgctgggattacaggcgtgagcgaccgtgcccggcctcttttgaagtattttcagaagatgatctcgagtggtccattctcctttgcttcacttctcttgtgaaattctgctcccccctgcacacaggaaattgttactgctgccccgcccgcagcacagaggtggtactgagcggtcacactttgcactggaatgtcagacttctcagtcaaggggctgggaggcaggcagcggaaggtcctgctgatgagtagcaccctacagtgctctttctttctatgcaattcctgtctgatcaagggtccttcagacaaaggattccat

SEQ ID NO: 130940 - DNA, 282 bp, Homo sapiens
atccacctgcctcggcctcccaaagtgctgggattacaggcgtgagccaccgagcccagcctatttttaaattttaatccatttatttatttatttattgaccaggttatgagtctgtataactttttgtatttttgatagagacggggttttgccaggttgccaaggctggtctcaaactcctgggctcaagcaatctacctgccttggcctcgcaaagagttggagtaacaggcatgagccactgcacctggccaagcagtatctttctaactgatagcc

SEQ ID NO: 130941 - DNA, 234 bp, Homo sapiens
gaagtcttccctgaccattccctgatcccacaacagccaatccagtgggctcaatgaatgcttgttaaatgaatgctgtggaaacaccaggatgagcatagattccctgtaatccagactgaacctatatttcagtcttttctcccaataaagacttagatacttgtgggccgtggccacattgactgaaataccacgaacccctgggttcctcacctaggatgcgggagtcaa

SEQ ID NO: 130942 - DNA, 315 bp, Homo sapiens
tatattggctgatagatacttaatacttaaactaagtattcacatggatatattttagcacccgtctaaattgtaaacaacatgaaggaaataactgtatttttataaatctttgaaccttttcaccatctaacacgctgccttgtagaaagcagaaatatgtattgattggttgattcataaaaggattacattatatgaaaacagagtaggcaaacttttgaggctgaatttgatatccacatccgagaaaatgccaaatataaataactcgtaaaatcatgtatttgggatagttcctaatttcaaagagtt

SEQ ID NO: 130943 - DNA, 165 bp, Homo sapiens
aatccattatatatggaatatcttggcctggggatagtgaatgaatattaggccggaggtcagccggctggcaagacagtgcaggtttgtgaaatatttgttagggccagtggcagcactcgcttgtgccgggatttaaaaggtaaacaaagcagctgaggaaaa

SEQ ID NO: 130944 - DNA, 349 bp, Homo sapiens
aagtaacagggattacaggtgcatgctaccacatctggctgatttttgtatttttagtagagatggggtttcaccatgttagctaggctagtcttgaactcctgacctcaagcgatctgcccacctcggcctcccaaagtgctgggattacaggtgtgagccaccgtgcctggccctttttgctgttcttaaacacaccaggatgctcccaccatggggcctttgccctggttgtttccttgggctggaatattcttctccagaagtcagcatggctcactgtcttcccaggtcacctctcagtggggccttcttgccaccttgtttaaaactgcacccaccatcccac

SEQ ID NO: 130945 - DNA, 178 bp, Homo sapiens
gttcaactcacctggcagccactcccagagcccctggaactctggcccaaggctctctgactccttcccagatcttctcggcttagcagctgaagactgacactgcccgatggcctcagaagccccctagaccatcacggatgccgagcttcgggtaactctcacagtggaaggtaag

SEQ ID NO: 130946 - DNA, 358 bp, Homo sapiens
  misc_feature (23)..(23): n is a, c, g, or t
tctacaggatctagtgacttctntctctggtaccttattgaacccctgacgtggtgatgacgacttttattttctgccaccttcaccgggcatccttttcatgcaaactgttgtgtgctggagcagctgtgctcatgtcttcccaatgccgtgtgcggtgacacaagctgtggtgagggtattcaggccacagaaacctgcaaatgctgaaaatcagaaattcaggctgttgagccattcacctgcacaccactgagtgcagagcagcccacctggcccagggctggcgtcccagaggaggagtggaggagggtccgtggcacccgtcagtggcacctatcccagaggaggagtgaag

SEQ ID NO: 130947 - DNA, 1698 bp, Homo sapiens
agacccccaaaagaggctgcagattcttagtggacagctctcatatcccctccagggaaaatgatgaaaaatgtcttcagaaaaatagctttatgaaggcaagaggactttttgcacctgcaagacatgtctgaaagctcctcaggtcaaaacacaagtagtcaagagatttgtccatctaattcatcatactactctgatccaagtgagacccacactgggtcagctccatcaaggagaagaacattccacccacgtttggattctggaatatcatccttgcttccatcagattcttgtaagtacctcacttggcacaaggtagacatgacgttcaaggaagtcaactgcgttgcccaagagtaagagaaggaatctctgaagaagagcaacttttcagacaggtagagtgtgccttgctcccaaggaaaagagttcttgaaaaaaacaaatgggaaacatggctacaagaaaactgggaagactgcaagaatttgaacatttcatttcagggtttgggggatccttaccaagttgaaaattttaacagaattcttagaagactaattcgagttgaaaccctctggttagtggataattcactggtggacttaagtgccataagattgccaaggcaaaaacatgctaactgacaagaaaatcatgggttttatacaaggataacaagtgctgggttgcttagctatgaggaaggctaggctcactgcataccagaagatgtacagcgttggagaattcagggatttttatcaacaatcaaactatatttgtggaaattttgtgcataagtgccaaagatggctgacatcggaccacattctatttaactcaactgaatgacaccaagctctcatcctaaaacttatagttacatccacccttctgaaatatttaattattctccaatacactggaggtaataggtataaaaagaatgagcatgtgcaacttagtatctcatatctaattttgtgtcccaagttcattcttcccctgaatgtcccatgtctaccaggtgcaggattatctggatgggtcagttcaaaacaatttcagggaataaattgtgtaggggactcaattttctgagacagaaacataatgtgaataactcctttgttagaaaataatttcagtgacagaaagcctttcagttcataaagaaaacttacatatcaacaagcctagctcctcactagtcccagtgaatgcttacatcaatcagctctacaatatccagtaaaggactttccaattcgcctttgaataaactgaggtattggaaacatctaaaaaatggtttttaattcttcctaatcttcagggagttcttccttatattgagctgatatctgccctctgtaactttcaactaattattcaaatctctcaagtgattataattaattccatcttataaggaatttttctcagcttccagcctcttgaaaatactctgatattttctctaatattcaagtggaaatgtaaatgggtaacgtaagagtctgtggggttaggagggtggaggaaaggtaagggaaagctaatgagaaataaccaaagcaagaaaaagaattttattttcttcaagttctttgtacatccaaagtggaagattcctaaaataaattccccataccacattttaaaaattaggttagcaagcttactttt

SEQ ID NO: 130948 - DNA, 1852 bp, Homo sapiens
agacccccaaaagaggctgcagattcttagtggacagctctcatatcccctccagggaaaatgatgaaaaatgtcttcagaaaaatagctttatgaaggcaagaggactttttgcacctgcaagacatgtctgaaagctcctcaggtcaaaacacaagtagtcaagagatttgtccatctaattcatcatactactctgatccaagtgagacccacactgggtcagctccatcaaggagaagaacattccacccacgtttggattctggaatatcatccttgcttccatcagattcttgtaagtacctcacttggcacaaggtagacatgacgttcaaggaagtcaactgcgttgcccaagagtaagagaaggaatctctgaagaagagcaacttttcagacaggtagagtgtgccttgctcccaaggaaaagagttcttgaaaaaaacaaatgggaaacatggctacaagaaaactgggaagactgcaagaatttgaacatttcatttcagggtttgggggatccttaccaagttgaaaattttaacagaattcttagaagactaattcgagttgaaaccctctggttagtggataattcactggtggacttaagtgccataagattgccaagggattgctagagaaccccttttacagggagctgctatttgcttcagcaggcagaatgcgtaggtggagtgagctttggtggcaatgagaggggccaacagaggtcctcaggagtgaattagatgaaggaaattgagcatccacaaaaaggaaaggcaaaaacatgctaactgacaagaaaatcatgggttttatacaaggataacaagtgctgggttgcttagctatgaggaaggctaggctcactgcataccagaagatgtacagcgttggagaattcagggatttttatcaacaatcaaactatatttgtggaaattttgtgcataagtgccaaagatggctgacatcggaccacattctatttaactcaactgaatgacaccaagctctcatcctaaaacttatagttacatccacccttctgaaatatttaattattctccaatacactggaggtaataggtataaaaagaatgagcatgtgcaacttagtatctcatatctaattttgtgtcccaagttcattcttcccctgaatgtcccatgtctaccaggtgcaggattatctggatgggtcagttcaaaacaatttcagggaataaattgtgtaggggactcaattttctgagacagaaacataatgtgaataactcctttgttagaaaataatttcagtgacagaaagcctttcagttcataaagaaaacttacatatcaacaagcctagctcctcactagtcccagtgaatgcttacatcaatcagctctacaatatccagtaaaggactttccaattcgcctttgaataaactgaggtattggaaacatctaaaaaatggtttttaattcttcctaatcttcagggagttcttccttatattgagctgatatctgccctctgtaactttcaactaattattcaaatctctcaagtgattataattaattccatcttataaggaatttttctcagcttccagcctcttgaaaatactctgatattttctctaatattcaagtggaaatgtaaatgggtaacgtaagagtctgtggggttaggagggtggaggaaaggtaagggaaagctaatgagaaataaccaaagcaagaaaaagaattttattttcttcaagttctttgtacatccaaagtggaagattcctaaaataaattccccataccacattttaaaaattaggttagcaagcttactttt

SEQ ID NO: 130949 - DNA, 1436 bp, Homo sapiens
agacccccaaaagaggctgcagattcttagtggacagctctcatatcccctccagggaaaatgatgaaaaatgtcttcagaaaaatagctttatgaaggcaagaggactttttgcacctgcaagacatgtctgaaagctcctcaggtcaaaacacaagtagtcaagagatttgtccatctaattcatcatactactctgatccaagtgagacccacactgggtcagctccatcaaggagaagaacattccacccacgtttggattctggaatatcatccttgcttccatcagattcttgtaagtacctcacttggcacaaggtagacatgacgttcaaggaagtcaactgcgttgcccaagagtaagagaaggcaaaaacatgctaactgacaagaaaatcatgggttttatacaaggataacaagtgctgggttgcttagctatgaggaaggctaggctcactgcataccagaagatgtacagcgttggagaattcagggatttttatcaacaatcaaactatatttgtggaaattttgtgcataagtgccaaagatggctgacatcggaccacattctatttaactcaactgaatgacaccaagctctcatcctaaaacttatagttacatccacccttctgaaatatttaattattctccaatacactggaggtaataggtataaaaagaatgagcatgtgcaacttagtatctcatatctaattttgtgtcccaagttcattcttcccctgaatgtcccatgtctaccaggtgcaggattatctggatgggtcagttcaaaacaatttcagggaataaattgtgtaggggactcaattttctgagacagaaacataatgtgaataactcctttgttagaaaataatttcagtgacagaaagcctttcagttcataaagaaaacttacatatcaacaagcctagctcctcactagtcccagtgaatgcttacatcaatcagctctacaatatccagtaaaggactttccaattcgcctttgaataaactgaggtattggaaacatctaaaaaatggtttttaattcttcctaatcttcagggagttcttccttatattgagctgatatctgccctctgtaactttcaactaattattcaaatctctcaagtgattataattaattccatcttataaggaatttttctcagcttccagcctcttgaaaatactctgatattttctctaatattcaagtggaaatgtaaatgggtaacgtaagagtctgtggggttaggagggtggaggaaaggtaagggaaagctaatgagaaataaccaaagcaagaaaaagaattttattttcttcaagttctttgtacatccaaagtggaagattcctaaaataaattccccataccacattttaaaaattaggttagcaagcttactttt

SEQ ID NO: 130950 - DNA, 928 bp, Homo sapiens
agacccccaaaagaggctgcagattcttagtggacagctctcatatcccctccagggaaaatgatgaaaaatgtcttcagaaaaatagctttatgaaggcaagaggactttttgcacctgcaagacatgtctgaaagctcctcaggtcaaaacacaagtagtcaagagatttgtccatctaattcatcatactactctgatccaagtgagacccacactgggtcagctccatcaaggagaagaacattccacccacgtttggattctggaatatcatccttgcttccatcagattcttgtaagtacctcacttggcacaaggtagacatgacgttcaaggaagtcaactgcgttgcccaagagtaagagaaggaatctctgaagaagagcaacttttcagacaggtagagtgtgccttgctcccaaggaaaagagttcttgaaaaaaacaaatgggaaacatggctacaagaaaactgggaagactgcaagaatttgaacatttcatttcagggtttgggggatccttaccaagttgaaaattttaacagaattcttagaagactaattcgagttgaaaccctctgggattgctagagaaccccttttacagggagctgctatttgcttcagcaggcagaatgcgtaggtggagtgagctttggtggcaatgagaggggccaacagaggtcctcaggagtgaattagatgaaggaaattgagcatccacaaaaaggaaagagtattctcctgtttgccaaacttaaaaatgctggatggaatcttgaagctaccagaagattgcttatcaccagaaaccaatattttttcaaaaatatgccttgtatcctaatgcagtctgtatagaaagaaagcaatcatcattgttgctaaaagctaataaacacaggacatgcatgattaaatat

SEQ ID NO: 130951 - DNA, 655 bp, Homo sapiens
agacccccaaaagaggctgcagattcttagtggacagctctcatatcccctccagggaaaatgatgaaaaatgtcttcagaaaaatagctttatgaaggcaagaggactttttgcacctgcaagacatgtctgaaagctcctcaggtcaaaacacaagtagtcaagagatttgtccatctaattcatcatactactctgatccaagtgagacccacactgggtcagctccatcaaggagaagaacattccacccacgtttggattctggaatatcatccttgcttccatcagattcttgtaagtacctcacttggcacaaggtagacatgacgttcaaggaagtcaactgcgttgcccaagagtaagagaaggaatctctgaagaagagcaacttttcagacaggtagagtgtgccttgctcccaaggaaaagagttcttgaaaaaaacaaatgggaaacatggctacaagaaaactgggaagactgcaagaaattgatggcaaaatatggaaataaaaaaattaagttgacttttaggaatgcagtttacaagagcaatgcgaccactgagagtggtagcaatgtattttacaccaaagttgcctgatattaaaagtgaaaataaaatattcagtatctttgaagcacaccaaa

SEQ ID NO: 130952 - DNA, 378 bp, Homo sapiens
tgattttcaactattagaaaatgaaaaatgtggtgaagtcctggatcttttcctgtcttcaacctttcccccaaccaggttaggaagacaggagtgggttaaatcattttattactgctcatactatgtgggtcaaatcatgcttccccaagttgtgatatctagtgggagtttcaaacaactggccaatagcaagtgaagataccagtcctgccccctaaacatacttccaaaatctcaacttgtggttcttatctaggaatctctgaagaagagcaacttttcagacaggtagagtgtgccttgctcccaaggaaaagagttcttgaaaaaaacaaatgggaaacatggctacaagaaaactgggaagactgcaag

SEQ ID NO: 130953 - DNA, 217 bp, Homo sapiens
ttggccaatgtatcctaggttaggatactgctggtattttgtttccaagatgcatgctactgatttttttcccataagaatttttagcatgaaatttatttcagtgcattacagttttattttcaaaggaaacttaacctagaaatcaaggcaaatcccaaaagttattaactaatcttttcagttctaatatcatttataggaaaacaggaaaaga

SEQ ID NO: 130954 - DNA, 531 bp, Homo sapiens
ttccacgagccattgcatttttcctaaatggggcaaacaagaatttcaccttcccacgaaatgatttgtaccttttttcagcactcttgtttttcatccttcctttaccttctattgctctttattttaccaagctaggaaaaggagacagctaaacatattttagcggcctctgaaacattataggtaaaataaataagctgcacatgggaatcagagacaagggaagatgatgaggtatttacttagtggtatagactttaatatacaccaaggaacaggaagtttggagtgggggtggtggggatgagtgagacgttgaaaagaagagagaaaggaattgaatggagtctactgaatttaccgcaggcactgagataatctgcaaggtaaaagtgttgtttttaatgcagtagaattttttctggtctactgtcaccatatttgtcttgttgctaagcttggccatacacaggctaggccttcctgctcacttgccctcaccccctgtggaagttctcaataggttgc

SEQ ID NO: 130955 - DNA, 940 bp, Homo sapiens
agaggaatgttgatgcaaggttgaatattgattcaggaaggttgatatttgtattacgctgaacattttatcaccatttctcaagtaaatttcccaaaggtgaaagtgtctttttcacgtagataaaatcctattgcatgattatagtaataaagcaggcatccttcctaggaaccagtttccacatggtaaaagtgctgtgttacctgttttactgtaaattttctgtgggagaaattctctctccctggcctatttagttgtgactttctctaacaaccgtatcagattgtgtgctgcttttactaatacctctctttctggacttctaacaccccagccttgcctcagatctaaattctctccctactaggaggaataaaatgtaccaagtgtataaaaatagctgcaaatactcatggagcattgtgcgccagatgtggtgtcagctctgtccatgtatcagcccctttactcctcgctgtagcctgctgtgaggaagtggcagggggaacgggggggccggggggacagacaagagggtcaaaatcatagaaatgcattcagacttgagcatcctgaatccagactcatgttcaccaccgcaccgtgctgccacccattttccatttctgcccaaataggtcttgtttgttcttgttccttactactgtttgtgctgccgagagtctgtgcatctactcggttcctttggcagggaagtgccagcatttcactccttaattacaaaatgccatcccagtcagttgatatgtcccttgttggccgttacagtgaactgtgatcatccagattttggcagcttataggttcttagttgatataaaaaagaatgccaaagcatgggtaaaaatacatgacataactatgtaaacaagtagaagaacttagggttcttctaagtagggtcagagccaag

SEQ ID NO: 130956 - DNA, 867 bp, Homo sapiens
tggcggtgcggggcgctggcgacgggacagggtttttgctgcccggggcctagtctacctcggcacgcttttctctgaaggagacacgcacttgcacgacgtgggcctctgtgcagctctactttgtccttaactcctctgactcaacgttatcgcagtttgactctggagccactcaggtttttcctaagctcaactctagccagctaggttcctggtgctttgggggctggagtgcagtggtatgatcgtggctcactgcagcctcaactacccagactcaagcgatcctcctgcctcagcccgccaagtagctgggactgctggtgcacgccatgacgcccaggtaattttgtatttttctatagagcctcccaaagtgctgggattacagcatcctacctaggaagtctttttcttgtccaggtgtggtggctcatgcctgtaagcccagcactttggaaggctgaggtgggcagatcacttgaggccaggtatttgagacagctgggcaaaatggtgaaacctcatctctactaaaaatgcaaaaacaatagctgggtgtgggggcgtgccatggtgatccggctgtccggggggctgaggcagcgagagtcgcggggaccggggaggaggaaggtgcggggagcgggaccatcagggacccaagctggtgatggggagaccgaacaagcaagacgaaaattgtacacaaggcagagattcgcaggtataatagaagtaagacaacatagtaggaaaaacaggaaccaggcaacaatgaaggacccagaagtggaggagaaagagggcagacggacaaaaggagcgaaaaagaacgcggaaaaagacacaacaactcacagg

SEQ ID NO: 130957 - DNA, 431 bp, Homo sapiens
catgaaagtggtatgttcttcaactcacaacccattggccagaaccagtaacatgacttcacctaactgcaaactagctggagaattgtgggagagctcatggatattcagtgataaatgtctttgttataaaagggtggtcatagccaggcacatggctcacgcctgtaatcccagcactttgggaggccgaggctggggatcacctgaggtcaggagttcgagaccagcctggccaacatggtgaaaccgtgtctctactaaaaatacaaaaattagccaggcgtggtggtgcgcacctgtaatcccagctacttgaaaggctgcggcaggagaattgcttgaacccaggaggcagaggttgcagtgagccgagatcacaccattgcactccagcctgggcaacagagtgagactctgtctccaaaaaa

SEQ ID NO: 130958 - DNA, 237 bp, Homo sapiens
gcaccactggattccactgtaacagtagtctttcatgttctataaactctctaagaacctgtatatctgaagtaaaagttttcatgctaaacacactatttgctaaattattattaaaatatctctgaacctaccttgtcaactacattcatcaaaatggctgttcatgaggccgaagcaaatggatcactgaaggtttggagtttgagaccagcctggtcaacaaactaaaaatac

SEQ ID NO: 130959 - DNA, 248 bp, Homo sapiens
tgaaggaacttaaacattatacagtaagacacaggcctgttttattacccacattccctattctattctcttagagtaacataatgaccgttctaagtttggtggtagtcttttagcttgttttctttgcatttacagtgatatctatgttcctatgatattgtaatcagtgtttacatttgttaagcacttaagtgtgtgccatgtgctattttaagcactttatactcattaactaattagttttc

SEQ ID NO: 130960 - DNA, 201 bp, Homo sapiens
gaaatatagttcggcaccatgtggcaactctttcttttacccatagatttgcttggcatcttatcaaaagtaaattaaacatatatgtgtgtatgtctagttcggtaatctctattctatgctattggtctatttttctttccttagccaatactagtgtctcctgatagtgtatatttatattaaaacttgaggttctgt

SEQ ID NO: 130961 - DNA, 144 bp, Homo sapiens
cccgtgcatctagaggatcccggtgctatggagttccaccaacaatgtgggagcctaaagccttacactttggcctacactagatgttatcatttctttcatttctgccaatctatgtaaaagaaatgatagatccatattttg

SEQ ID NO: 130962 - DNA, 291 bp, Homo sapiens
tgctgggatgacaggcgtgagccaccacgcctggcccatccatcctttcttatatccacccgttgaatctcctttgcacatctctgtcttgggcttaggaagatgaataaaattgagcctctgttcagatgtgatcataaaaccacagttcagtctggttgtgttctagcagaagctcgaagaggaggaggctgatgctgcctgagtgatgagggcgtctgaactagaccctaaagagggaggccctcgggagggaaagaaggaaggagggatgtcccaggaaaaaggaca

SEQ ID NO: 130963 - DNA, 481 bp, Homo sapiens
tcagtgagaccaagaacccaccaactgcggacacaccagcatttaagaaagacaaattacttgactctttccatggcggaaaaaaaaaaagacagtttaaacctcattgtaattacaacagatacttttaaaaattctctctgggccggacgcagtggctcacgcctgtaatcccagcactttgggaggccgaggcgggcagatcacctgaggtcaggagttcgagaccaacctggccaacatggtgaaaccccatctttactaaaactacaaaaattaaccaggtgtggtggtttgcacctataaatcccagctactcgggaggctgatgcatgagaattgcttgaaccctggaggcagaggttgcagcgagccaagatcataccactgcactccagcctgggcaacagagtgagactacctacaaaaaaaaaaagaaaaattctctctgatacaatagcaaactgttaccgtcttcaga

SEQ ID NO: 130964 - DNA, 357 bp, Homo sapiens
ctgctccgcccctctctggtggggggtggggatgggtgactgtgcctcgaagtcacttgagggagttcagcggggtagagctgacatcagcgatcctgggaaacagcctccaactccatcctgaatggaaaggagctggcaggaatcagaggaggaggcccctcctcacccctgcattggagttccaggctccccctgcagagaacacgctatgagctgtcaccagaggagtggctccttggagggatggggtcctgctgcagccaggggcctggggaagtccctcgcacaggctgtgactgccttgtggagcaggggcctccattgatctttacagccctgttccagagttgaaga

SEQ ID NO: 130965 - DNA, 435 bp, Homo sapiens
catacttgtgcctgggctgctgagattaatgcaggctggcaagggaggggagctgtcaatgtgttgtgcagatacatacacatccttgtgttgggcaggtggtgcacaagagcaaatataacttcttcatgttgctccagctgccaagttgtatatgtaagagatcctgggagagtattagtcccagttcagcttgtattctctttgaggctctcctgtgctaaagcctgtcctctgcagtttgtatgtagaagacactctgatacctgtgagataaatggatgactgggcagtcaagttcagttattgaagtagccccaggctttgttagagaaaccctcagaaaaggagccatagaggtttaatgcaatacattaaaccaaggcatgatgtgctccagcactggtaagaatccccagctggagtcaggagctt

SEQ ID NO: 130966 - DNA, 352 bp, Homo sapiens
atcaggccatttcttccaaaagaaaccaatgctctaggtaccccctacaaaaataagttttgaaaaatcatgtatcccgtcttgcacatttttaagttgacatgtagtattttttacttaagttttaaatccttcaaaggtgtgatttctgccattttgtaaatatttacatttttaaataaaactgctgcaacaatttaaaatacatcaaatgaattctgatcaccatggtgatttaacacccaccctcatctattttaaaaacacctgacccagctctccttcttcttcttttttttttttttttttttgagacagggtctcactctgtcatccaggctagggtgcagtg

SEQ ID NO: 130967 - DNA, 328 bp, Homo sapiens
caagtatacaaagctggaaggaattaattctgccttgcatgtgtgtgtctgagggggtgtatcagggactggaccattcgaattgaatattgccgaattcacacaacttggcaaagagaaagggtattccagggagagagaactgcatgtacaagagcaaggaggtagaaaataccaggaacggtcaccagagcatgccagggtgagtgcaatactgtgcaggtggtacagaagatggggcagagagactggccagaccctgccttctctgccaggctggcctgctcctgtcagccacaggagccagctcagacatttaagcagaagg

SEQ ID NO: 130968 - DNA, 249 bp, Homo sapiens
atataatctatcctggagagtgatccttgtgtactagagaaaaattgttttatcttcctgatgaattgatccctttgtcaatataatgtccttccttttctcttagagcagtttctgccttactatctattttgtctgatattagtatagccaccccagctatcttttggtttctatttgtttggaatatctttttccatcctttcactttcaacctatttgtatctttggtttgtttcttcatttgtt

SEQ ID NO: 130969 - DNA, 204 bp, Homo sapiens
gtacaaaggagcatctggagcccacttgaagccctgatgttccacactgagaatgacataacaacccagagagaaggcacagagaagggaaccagatttgccagagggagggaggaagccatggatgggactggtcttaggatcaatttcttgcctgatagacaaaagctgatcaagtttttgattgaaacgtataaaagcatg

SEQ ID NO: 130970 - DNA, 114 bp, Homo sapiens
agggcctagggacccagtgctgggccaagtgcctatggcagagtgcttgggagctgtctggtttggtcctcagagtcctgttgctaataagcgtggagggggaggacggagcaa

SEQ ID NO: 130971 - DNA, 220 bp, Homo sapiens
caacgctggggcgagggcagggggactcgccctcctggcatgtgattgattatctggtatttatgccattgaggacttgtcagcggtctggggtcaaagggtcatctcatgtgtcttgccgccagcccacctccttttgtacagtgtggaccgggcgagctgtgcacaaaacagctttttcttttccttgggaaaggggggatggggaggggggagtgtc

SEQ ID NO: 130972 - DNA, 547 bp, Homo sapiens
cgatcagagcataccctgtgctttaaattggatcatctcttagtatgtaaaagttttttgtaatagaaacaagcagggcagtatttgacctgttgacagtgtccttggactttacaatttgtgaagcagcgtattttgcttgagttgtacgattgtcgtttttttccccccactttgacaactgttacagaacctgtcaccagatacaggcaagggaggttgggcttcccatctctgcacggcttccctgtgattcacaagcaagcaatcagaagtgcacaaaagtttagaacgcgattttcattctcttctttccttagaaaaactcgctttgttagccttttccagaaaggaaggcactcaattgttgtaatactcaaatcataaaaagaagcctagtctagtctattcagcaaggtgttctgaaagagggaattttttaagttcaattatgcgaagatcttgaaggtgggactcaaaggagagggctatcctgggaagaaggctttggaagatgagaggcgtgaaggggtatggctcctgatcc

SEQ ID NO: 130973 - DNA, 707 bp, Homo sapiens
gaggagagttgttagctgaagaggacatgggtttgctcaagatccctgcattctccactatggctctctgattctcctctctgagcttgtggcagacacggcagatacctcaagcatggctgggcagcagatgctggctgagaggaagtggctgagcccaacttgtccctcctcagaccccagaattgccaagaccagagtcctccataaagacctcacaaacaggcaatcactgcatgcttttccacaattaaatatgtgcacatcttaaggaaaggacctaacatccttcagcagtatctctttccagggcagggagtgactgcgtcagcagcctcaagtacctggaaactgtccacatcaggcaaagtggtgggagagacacagatgtttccaccagcatttaaaagaaaggaaagaaaattattgacaagaagcctccatggtggatcaggcttcaacgttttgatggacctggcctctcttggaagcaaatccctggatggagcccatgtctctttgggcccccaaaggcagcctgaccttgacacggagtgcaaagcagactcagctgcttgtgtttaatggggattcgcatagttggtttttggttttgtttttgttttgttttgttttttgtttttttttgagatggagtcttgctgtgttgcctaggctggaatgcagtagcgtgatctctgctcact

SEQ ID NO: 130974 - DNA, 331 bp, Homo sapiens
gcgtgccaccacgcctggctagtttttgtatttttagtagagtcagggttttaccatgttggtcagtctgatcttgaactcgtgaccttgtgatccacctgcctctgcttcccaaagtgctgggattacaggcgtgagccatgatgcctggccaccctcctggatcttggtagtaaaataacttgagtatactacctaaattactttgaattagtttttttaagattttttttaaatttttaatttttttttgttttgagacagagtctctctctgtcacccatgctagagtaagtacagtggcatgatcatagctcactgtagccttgac

SEQ ID NO: 130975 - DNA, 250 bp, Homo sapiens
ctggggacccagtcctcctggcagaatccaggagcaggcaggtgtggctgccccacggggaggcagaggccgcccttgtccacctgcacttttggtgcctttggcattgcgtggtggggcctcctgccactccgtcaccatgcaccacctgtggccgttggagtttgaattaattaagatgaaatattcctggccaggggtggtggcttccgcctgtaatcccagcactttgagaagccgaggtgggcgg

SEQ ID NO: 130976 - DNA, 150 bp, Homo sapiens
gagagtagcagaaggaagttatttagctttagttaacgattctcccaagcaatgtgggatgggccaggtggtttacactatggaagagccagaggggagttctgacaataaaggaagacaatggggaacggggatcccatgggaaaaatg

SEQ ID NO: 130977 - DNA, 648 bp, Homo sapiens
atcattgcatggggttgtgagagagcgatgtgtttggagtgacaccagggaccctgttggaggtgttcaggcagtggcaatgctgaccatgggaagcaagtttgtggagaaggacttgaggccccaggtggcagtgtcccagtgtggttactcatgttctgggcttagcagacttggcagagaggaatctgtccagagtctcctgcatttccagtcagaggagtaaagggaccaaggcaagccaacccagttcagtgtagacctcagctgcttgtgtgagaaacacactcacccatccaaacccaaagaatggactaaaagacacgaagaacagcgaaagtgagactttcagtaacagtcttgcaagatcaggggactggtgtaggcaggcatatctagggtagtcacaacaggtaatttatctccttgcttgcaagtccctcctccaagatactcattggtccagtactatgaggttacagtcttcccagatgtcgtctaagtttcattatcccccttataacgttaaaccccggtccccttccctgcttaagttttgatttccaataatgaaacattcttccctttcatggcctgacccctcctctacattctgtgtacctattgtgaccttctagatgcatgagc

SEQ ID NO: 130978 - DNA, 496 bp, Homo sapiens
ctatgacatgaggatgatcctgaataacacactttaatcttctcaatcaagccttccatttatcaaggagggatatttggtaaaaacagacccctagatgatatccctgtaagtacagataaactgagaataactcaaagaatccctgacagatgccttaagagaactttctgggatgcagttgtttttttgttttttttttaaatccacacaactgtttatcttttgaaagaaaagaggccaggcccagtggctcatgcctgtaatcccagcactttgggaggccaaggcaggccgatcacctgaggtcaggagttcaagaccagcctggccaacatgccaaaaccctgtctctactaaaaatacaaaattagccaggcatggtggcgggtgctggcaatcccagctacttgggaggctgaggcaggagaatcacttgaacccgggaggcggaggttgcagtgagccgagattgcaccactgcacttcagcctgg

SEQ ID NO: 130979 - DNA, 154 bp, Homo sapiens
attatttaaatatactaaccaagtctaaattctcactttcacactctcatggtttccagtagccatttccattgtctgatgactttgtatctgtattacttctctaaattgttacagttactttgggtagctataacaaaataccacagacaag

SEQ ID NO: 130980 - DNA, 247 bp, Homo sapiens
ggcatgagccatcacacctggccctatatttttctgcttagctttccgcattgagagttttatgggcaaaagttcctactaccgttttttgtgctaaataaatgtggtaagactaaagagatgctatcatttggtgaaaaatggagaaatgaaaataactgtgcttttaggttcataaaaaatgttgacttctagattttagccagcaccttcccttttctctgaattccatatagatgttcattac

SEQ ID NO: 130981 - DNA, 185 bp, Homo sapiens
catatttgagggattgacacttctggtggtggagctgcagaggggtggggagtctcaaacgccagcctaggaggttgggactttgtcctggggtgctggggagctgtgggagggctgggagcaggggttggacaaattcagctctgggagcaagaagaccccttgggggccgtgtgagagacaca

SEQ ID NO: 130982 - DNA, 723 bp, Homo sapiens
ggaggtcgaggctgcaggactctgtctcaaaacaacaacaacaacaacaacaacaacaacaacaaacacacacacacacacacacacacaacagaagaaaagaaaatgtattgactcttagaactgagggtctggggtctgccttcaggactggctatatccgggtgctcacacaatgccatcagaagtctctctgcatcttgactctgctttcctctgcattggcttcattttcaggcagattcttcccagttggcagaccccctctgatgaactgaggctagcagagatctcatatcatttaatacccagattcaaattcccctcgagtgcatttccctttttcttctgcacagaggctcctggagtgcctgcactggccacctggctggctgctgtgttccagacttgcctccatgatgtcccaggctccttcctcagaggacaactcccgccacctccccgccaccttctctctccagtcccagagggaagagaaagtcccttgctctcagtcttccttacccatctacagaaacataatagctgcaaacataatagctgccaccccaaatggcaacagttttacaagccttactgacccttaacatttctatcctgggccagaatttctgcttttttattttttttttaatttttaatttaatttaattttttttggacacagagtattgctctgttgcccaggctggagtgcagtgg

SEQ ID NO: 130983 - DNA, 224 bp, Homo sapiens
atggcaagagggcctgacccagagagagattagggaaggctgcccagagaaagtggtattgaaggagggcttggagggatggttttgataggcaatgatgagtgttaggatttttaggcaaggaaacagcacaacattaggtggaaaatgactgggcctgttcaggaaacacctgcagtttggcataaccctgaggaatagtgggacataaatctgaagaaatc

SEQ ID NO: 130984 - DNA, 527 bp, Homo sapiens
gaatttaaagaacaacaacaaaagaaataactgtggatgcattatctaggttaagaaatagaacatacccgtattttgaaacttaactttttcagtactggttaggtgactcaactggtatttttcttcattcatcacatctgtgtttcttttctttctggccaaatgcaatgtaacataaatttcaactcagtgaacaaaagtcatttgttatagaagtaatatatagctgtgaaacactagtattgcactgtttcataaccataaaaattctggttacacatatgtaggataattctggttttatatatatgtatgtgagtatatacatttgatatttactttactccctagcagagctggtatgttgcttgattttggttgtgcttctgcttagaattttaaaaattagaaagaagggcaataaagcatcataattccatgcactgatttaatgttattggattcatttatacctaaagaaaatccttagactacatgataaaggtttactggtggaaaaaaaa

SEQ ID NO: 130985 - DNA, 272 bp, Homo sapiens
aggggaaattttaggagattacaatgctgaataaaggtagggcaggaattctttgtgccatggactctggcaatctggcaaggtctatgggcctcttcttttaacagtgtttctttaaaatgcataatgtaaaacacataggattacagagaaatccaattatatttacatagagttatcaaaactaaaagaactttgtgatatagtaatatatgtgctttagtaacaaggtctaactataggtaataactactgtaggtctggcacagtgg

SEQ ID NO: 130986 - DNA, 317 bp, Homo sapiens
tcaagtcggtacccttatttccttctttattgattagtaaaacttttaaaatgcaaaacaaatttataaaaaggtttccttactgaagaaggaaatcaacttttaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggag

SEQ ID NO: 130987 - DNA, 719 bp, Homo sapiens
atcctaagccaagagaacaaagctggaggcatcatgctacctgacttcaaactatgctacaaggctacagtaaccaaaacagcatggtactggtaccaaaacagagatatagaccaatggaacagaacagagcctcagaaataatgctgcatatctaccactatcttatttttgacaaacctgacaaaaacaagaaatggggagaggattccctatttaataaatggtgctgggaaaactggctagccatatgtagaaagctgaaactggatcccttccttacaccttatacaaaaattaattcaaggtggattaaagacttaaatgttagacctaaaaccataaaagccctagaagaaaatctaggcaataccatttaggacataggcatgtgcaaggacttcatgtctaaaacaccaaaagcaatggcaacaaaagccaaaattgacaaatgagatctaattaaactaaagagcttctgcacagcaaaagaaactaccatcaaagtgaacaggcaacctacggaatgggagaaaattttaatgtatatcttttctttaaaaatatcagaatatttaacatattttataattattcagtataaaactgattttagtgtgattttatatacttatgctttcatacataaattatgtaagaaccttacaaattagcattcctccaaattcttgtggttaaataaaaacaacatggcactt

SEQ ID NO: 130988 - DNA, 389 bp, Homo sapiens
ctggagatcaaaacccatcctttgcaatgaataaacccgggctcttagcaacacggggaaagaagggcttgcaacactgctgtgaccaggtaattctgtgcacataccaaggtaagaaacatcacaagggggtgacaaagtatttccttgatggtcaaaattctggaggttgagtgtgagtgtgcatgcgtgagtatggtgtgagtgggtcctctctgcaaattctgtaatcatttcatatggcttagaggtaagagagggcaaaacaaaaggaaaggagtgaaagagacctccagaaggtgagggggaatagttagaatcctccctgggaaaagaagggtgaaaaacctcaagcacgtgaggttgtttgtttgtttgtttgtttgtta

SEQ ID NO: 130989 - DNA, 402 bp, Homo sapiens
caaggtgctaggagtagaaagcaatagacagattcacaatgttataaatggtggtgatatgaaatgtgaccctgataatggttatgtggtgctttggaaatttacctctcttacagactttgtccttttgtatgtgaaggtgacactgaacagtgtgtctgaacagaatgatgtgtaatctgtagttctttatatcttatcagctgcagatcctggttttgtggagcctgaagcttgcacaacatgggggccgtgttttaatgagaacaatagtacaaaattaaaaatgcaaaactaggtacaggcattggaaggggccagtatttagtgaggatcagcttcattacgcttcatggtagatctgtctctgctgattacatatgtgaaaactgagaatgggta

SEQ ID NO: 130990 - DNA, 343 bp, Homo sapiens
tgctgggattacaggcatgagccaccgtgcccagctacagctgcttttaagacgagtgattcagaacagacttttgaagcaacaaaatttgatcacttctcatcttaaaagagagctgactcatttgtccttacgggtaaatccatcacttggtgataggagaatggtgataggagaatattctgaatattcagtctagactcacttgctccttatttgcctccaggcctctccttgccaggctttctccttactggatgttatttaccaagggtttccactcattaggggtggtgatgcttgttttaaaggtcttctagaaccttctagatagaacacctcc

SEQ ID NO: 130991 - DNA, 193 bp, Homo sapiens
cagatctataaatttcatttattttgaggttcattcacattcagtaacaatctgatcattcaccaaagttccaaaacacatactttataaattagctatcatagtttttagaaatccaaatatatttcaaattattttttaatagcagcaactagagaaaggattttttaccatctagcttactgtagcgctg

SEQ ID NO: 130992 - DNA, 615 bp, Homo sapiens
gaagtgtgtagtgagtttcctattattacttccaggttggagatgagattggtcttcataagaattaactgacaatgtttacgaattcacacagctaacatacaatagagtcagaacttgaactctggtttactggctccaactccagtattctttccactactctgcgaaaagtatattatttttaagttggcattagctttttcaaattaccacgtgttattttattatttttcaaagtcaagtccttttaaagaggaccaaatatcttataaaatcttttaaatatatatatacttagcatacacaaaaatagaataatggttaaatatgttttagtgtgaagcaattgcgagtcactattgatctctgattgtgttgaacttttggtgatgacttcagtattttgtaatcagccatttacagttcatttatttcaggaattttaaggtcaagctgagctacctatatggaatgaaccagcccagttctctgaaattggtcttcctttatgtgcctagaaatatttctctattagtctgacttctgttggtaggcatggcactttacacattagctaggaagaaataaaatctaatttgtctggacagaatg

SEQ ID NO: 130993 - DNA, 324 bp, Homo sapiens
agcctgtcctgtcactgtgcatcccgtccagatggacaggtagtagattcccgctggctgggtgatatccgtgtccttcatctgtcagcctctggagccgccgaggctgggtgccaggcactgccgcctgggacacatgtgacctccgtgctgcaggaccacagtgcaggtgcgctttcacagggccgctcctagggaggaggttgtggacatcagacattccatgattggattccatggctttgagaatctcacttggggccttagctcgagacccatttaaataccacatcgcagagaccagaaggcaagaccatgggactc

SEQ ID NO: 130994 - DNA, 194 bp, Homo sapiens
ggcaggaggactggtcagggaggagttagggcaggaggactggtcagggaggagttagggcaggaggacaggtcagggaggagttagggcaggaggacgggtcagggaggagttagggcaggaggacgggtcagggaggagttagggcaggaggactggtcagggaggagttagggcaggaggactggtcaggg

SEQ ID NO: 130995 - DNA, 789 bp, Homo sapiens
aatgttgttcctggtctgaaatttggaaataaccatttaacaatttggaataattggtaaatcgtcagtctctttacttaattcctaggatttgtaaatatctttagtctcttcccttctactgcattattaaataataataaaattaacatggacatttattaagttttgagttagacactggttttggggtttttttgtttggttggttgcattttttttttttgaaataggatctcactgtgttggccaggctggtctcgaactcctcacctcaagtgatccacccgcttcagcctcccaaagtgctggcattataggtgtaagccactgtacctggcctgcatataacttttgacttcccaaaaacttaactaaatagccttctgttgaccagaagccttattgataaccttaatggtcagttacacacattttgtatgttttttgttttctttccagacagggtcttgctgtgttactcaggctggagtacagtggcactatcatagtgcattgtagccttgacttcctgggctcaactgatccttcctcctctgcctcccgagtagctgggacacaggcgcatgccactataccgggctaatttttctatttttttttttgtagagacagggtttcgctatgttccccaggctggtctcgaacttctgacctcaagcaacttgtcctccttggcctcccaaagtgctggtattacatgtgtgagccgccacgccccatctactgtattcttacaataaagtaagctagagaaaagaaaatgtt

SEQ ID NO: 130996 - DNA, 399 bp, Homo sapiens
aatgttgttcctggtctgaaatttggaaataaccatttaacaatttggaataattggtaaatcgtcagtctctttacttaattcctaggatttgtaaatatctttagtctcttcccttctactgcattattaaataataataaaattaacatggacatttattaagttttgagttagacactggttttggggtttttttgtttggttggttgcattttttttttttgaaataggatctcactgtgttgcccaggctagtcttgaactcctgagctcaagtgatcctccctcctcagcctcccaagtagctgggactacaggtgcacactatcatgcctggcttgtatgaggcatcattttaagtgctttggacggatcaactcattccgtataaccctg

SEQ ID NO: 130997 - DNA, 812 bp, Homo sapiens
attcaaagagagttacagtccttgttcttataatcaattacttgtgctcatttaatcttaaagtccacttaaaatacagtataatatatatgtatgaattttttattttctgtcctttctgtctcatgctctgatattattgtgaaatatatctgtagagatttcctgtgacttgacctttttatttaaaggtcataatctgttcataatctgttcataatcataagtcataatgtgtttgagacatcataatggtttctacggaaacatttgttgcctctcaaagaagcaagaacactctaaattttcaagaaaatagaataatttggtggtagtgctagggagaaagcatctgaccaagagaaaacaaaaatatatgagtttgtatcaggaagaacaatttaaaatttttctaatttgaaaaaataaaagtcttactttaagtgctgctttataaaaaaaaaattctatagtgctagttatcttttttagttttaaatatttacaattttctcttttatctttttactattttctttagtaaaatgttctccttacctcattgtgtaatttttaaaaatatggttctgaaagatgcttcttacattattggtaaggaatatcatttagattatgcctaatagttcacacatacagagaaggtagtttcacaaacacaaaaaaatggaactttagatcattattaatagtacaagctctccatttttacacttctgcagtgagctacaaaatttctatgagacccctcaaaatacatcaatgattgcagactacagatattaaattgtgat

SEQ ID NO: 130998 - DNA, 613 bp, Homo sapiens
gtgggagcgaagatggaagctgtaatggttgggttgggggaggtctgctgattcccactggaatgaaaagtaggtggtagcaagacttaaaccaggaatgcgggtcacatggttcttttttgtttgtttgtttgtttgtttatggagtcctagatacagtgaagataaacaggcctcagcatctctgtatgtcacgctagggtcccaactggctggtatcaagtctgtgtcccagctgaggacttctctggttctctgtcactggagaaacttcatcctactgagaagtagccccagaaattcacctgggaaggcaattccaaaatgattggaaataacacagtgaagtccttagtgagaaaatgtatctcatccctggagatacttggaattgaatatagagaagatgaagtcagtcagacctgcattattaacatatttgtgataagagaatttgttcattttttaggaatttgtaatgtttaagtgaatttgacataccagagttgctaacagattagatttgtgatgctaatttaaaatatatagttgatttagacttgtgattttaaattaaaatcgtaataggtttataaacaatattagaacactt

SEQ ID NO: 130999 - DNA, 377 bp, Homo sapiens
gatctagaggatcccaacacgcattcaagacctgaatgaagacaaaggttagctatgtaaacatctgagagaaaagaatttcagaaagggaaagggttagtacaaaggccctaaggtaggatcatagctaaggtgttagagtaaaagcagagagaggtcccagaatgagcaaggaagagagtaacagagcatgagggcagggtggctatgagggtttagttcatggagggtacggttggttattttaagatttttagattttaccctgagttaaatgggcagctgatggaaagatttgaatagattagttacatgaaaatgattatttcatctgctgtgttgagaagagattttaagagagcaaagaaggcggggag

SEQ ID NO: 131000 - DNA, 346 bp, Homo sapiens
cccctctcctctgggctgttgttcaagcctccaggctctttgccgaactgctgagacttgagggaacaaaggcttttatgacaagttttattagtgatgcctcctgtgctaactctctgagatgggtcaatgctattaaccctgttttacagagaggggaagagccccagagaggtcaaatgcttccctcaaggtcatgcagcatgtgtggggcagaggtaattagccccagcctgtctgttgggccaagggacaaggagggtgtgcgatgcaggggtctggggaggccactcttaatgatcctggaacttggacttcaggaaaccagagatgggcatgggggcag

SEQ ID NO: 131001 - DNA, 366 bp, Homo sapiens
aggcgtgagccaccgcacccggctatttacttcttcttttatgaagctccctcctccaaaacacccccatcacctgttccttccagctctctgaccactccttggattctctgtgaattcccttttctctctttgaagcctgccttcctggtactgtactcttgcacactctctttcctcttgcaagaagccagcacgtggtacagatcttgccaatgacccttctctcactagctgagtggcatgaagaagcagaaaatggttaagagcattggtttggagtcacagaccttcattgattcccagctctgccacctatagctatttgacttgcacaagtcactaacctttcagagactcagcttc

SEQ ID NO: 131002 - DNA, 397 bp, Homo sapiens
aaataattacaattaaaccatcagattattcacctatgtttgtatatcaaagtattttagggcaaaataacatctacacaaaccaaggagaggctacaattaatgctctctggatgccagtctaaccccttgcggggagcgggggggaagatgacacttgtgctttgataatccactgtttaaggaaccacattgagagagtagtcattctgtaacccagattcccttctctcaatgacctttcaacagacctcaacagacagcagctctcagtgaggaaagggaattggaggtggcaggaaaagttgaaaggaagacaatagaggtgttttgctttttagctcagtactccattctgtggcagaaaagccaaactcaaattagcagcacctccctc

SEQ ID NO: 131003 - DNA, 694 bp, Homo sapiens
attgatattcttatggtttatgttatagtattcatggaaatttagcaatggaaaaggaaatgaaaaacttattaatgatgttgttaaattttcaattgtgatgacagtaaggaaaagacataattgagagctacctccaattgtttatatcaaatgtggtaattaagaggattttggtgacctatttatggctgaattaaggcaaaatagcttttatatccgattctttcctcttcccttctcttgttctgtgtgcttactatcataataattgagtatacattaattttctttaagtatttatattttaaataaggttttgatgtcagtagagacttttttttttccttgaaggtaagtaccctttaaaccactaatttgtcactagagtctatagtcgcttccatatataataggtagcacagcttctcaggtcatgtcctgctttgctgctctgctgaccaataatacaccttggagatactggttctggttatatgaatagaacaattaaattgttcttcattagatggatctttgattactaatcttactcagaaaggctcaactggacttggattattctaattgccaatactgtttttgcacaaatgtctgcaaatcattgaacagtaatactgacccctttttcttccaataaagttattgcagtaatcacatcattgcagagaat

SEQ ID NO: 131004 - DNA, 563 bp, Homo sapiens
catagagaaaatttccacaaactaggaaatgtagagagttattctatagaatactcaaaagaggaaagtatgtgatttttggaaacaggaaaatcttcaaacttctttcttcacttccctttgtgtttagctgaccctccaatgtgatcattgcctttggagtttgggagaggtacgggaagtggcctgatccctgcttccatacttcactcctccatccatccttccctccctcttcccctccagctaaatggacaattctagccaacattgagtcactcaataagtctcaacagtgggtgtgtttgctgagattgtccagcagttgagcagtttggtctcacctccctcgctagttgagaccaaaaagagacaaataactttttcatggtctttgaaacataatgcttatttcgtggtcaatggctttaaaaaaatctgtttcttgttttcttcaacaaactcactagttttcccttaaatgatattgtaaaaattaaagtaatcttgaaaatgttttgacaaaagtaaaattaaagggacatcttttcttaaaaaaaaaa

SEQ ID NO: 131005 - DNA, 481 bp, Homo sapiens
acagggaattgtcaggtttcaaggagctgaactctgtgaggtaagttttacgtatctactcattgtaaataaaagtaatgttttaaaagatgttttgccttgacgcagaacataagcaagttccctgactcaaaatattctacgctccactacttcaattgttcagttttcgtaactccccagatccttcaacaggcatccaggtctgcccaggatgcagcccagagatttctggtttgccctgtttagaaatccaaaaagtctggctttttacctttagatagttccaaaacaggaaaataaccctatttcttaagtgttagtaatatgagaggtaataaaattgattagatgttaaaatacacaaagtatgagatggttaaatcagacacacaagaattggagattttaacctgtatcagatcttcctgtacaccaagggatagacataactaactttgagacacaatgaagcgtgaag

SEQ ID NO: 131006 - DNA, 221 bp, Homo sapiens
tgtggagctgcacacatatggttccagctacctgggaggctgaggtgggaagatcgcttgcacccgggcagttgaggctgcagtgagccatgatcatgccactgcactctagcctaggccacagagggagactccatatcaagaaaaacaaaaacaaaaacacttatttctgcagaaaagcctgcatacaaatatgtataagcagctttatataaaatcac

SEQ ID NO: 131007 - DNA, 457 bp, Homo sapiens
aggtcccacctttaacattccctattacaattccacatgagtgttggtagggacacagaatcaaatcatattattctggctcttgctccccaaatcttgtatccttgtcacactgcaaaatacaatgatgacttctctactgtcccccaatgacttatctcattccagcatttactaaaatgtacaaggacttacagaccccatacaagtcaaaaacccagcaggccagtcattgaatcctacagctccaaatcatcttttctgaatctacatctcacatctggagcacaggtgtgtgatgcctgggctcccaaggcattgggcagctctgcacctgtggctgtgcagggtctatcccccacagctgccctcatgggctgggctggtgttgagtgcctgtagcttttcacactcagtgtgccagctgttggtgggtatatgaatctggggtctggag

SEQ ID NO: 131008 - DNA, 416 bp, Homo sapiens
cttcccactcccatcaccttcctgactcaggaatggcactgttgtaagtgacatataaccttttatgagagggaggaggaagaggatgaaaagagagatgaggcagatgatgttaggtactttatagatattatcccactgaagcctgtcatctctttcccatagctgcctccacttaaaagataagactactgatactctgagaagatgaacaagtaacttcctgatgatcacaaagatgaagctagtgttgaaagtcagatgtgattccaaatcaagtgctctttttactacagcacattccactcccacccccaacttaccctattgggctgaggggtatcttgctgaggtttgggcatgactgtgggcatgacttgagtgtgtgtgtgtgtgtgtgtgcgtgagagagggaa

SEQ ID NO: 131009 - DNA, 414 bp, Homo sapiens
ctttttaatgtaaccatactactataataacctttaaaaaattaaaattgtttaaaaatcatctaatatacaagtggttttcaaatttaaattactcccaatgggctcataaataactttttacagttggtttgcatgaaacaggatctaaacaagatctatacttatgttcaattaatatgtttcattcaagtcttttttattttttccaagacagagtcttgctctgtcgcccacactggagtgtggtggcatgatctcactgcaacctccgcctcctgggttcaagcaattctcctgcctcagcctcccgagtagattcaaagaaactggctagaatcgcatagggtgggggaggatttgtggaggaaaagtaggcatataatagctgaaaaagcatcgtagttgatcctc

SEQ ID NO: 131010 - DNA, 327 bp, Homo sapiens
ggcggacgtctcatgctctagattccaaatccatctgtatgcgtctatctcctggtaccttcctagcatcaattctgtatttgtaggagtcaatcaggagacacaaaccactcaacagtttaaactaattcaacaaccacctaaatgcccatcaaaactggtaacatttctttttttggagacagagtctcacttcttcacccaggctggagtgcaatggcacaatctcagctcactgcaacctccgccttctgggttcaagtgattctcctgcctcagcctcccaagtagctgggataacaggcacatgccgccacgcctgcgctt

SEQ ID NO: 131011 - DNA, 726 bp, Homo sapiens
tgtaaagatattaattttttgtatcttccttgtaagcttgacatcattctctttcaaaacacaaaggtactgtcatgtatttgcacatccctcatgtcttctgtcattatttactcttctgaaattatttcttctcttggaggagtactttctctgtgtaattttcaaatgttgtttgtgtatatttctgtgtgtggcaaaacttttgaagtcttctattccaaagagtatatatatttcaacctcactttcaagtgatgaaatatctatatataaaactgtaagccacaagttatttttcttttacactttagaagggttcatccttatcttcttgcatcgagggtttcttatgcccatctaatttttgttccttgtttcgggaagtcttttgaatgtttgcactttctttacttaaaatatactatgatacatctaagtgtaggtttttaattctaaatgttatgtgtgttagtggtgagataggtacaaatgcaatagaggaaactaggaaaaattctcaatccatttggggtgtgtgtgtgtgtgcgtgcgcatgtgtgtgtgtatgtgtgagtgtgtgtgaaacaccttcctccaaatcttaatcttacaggtctttttacctcatcaaaaaaactcagtaggtcaaaaactctgtgttgaattggtacctcttgaaagagcctgatgccccactaacatctgtggtccatcttgaatggg

SEQ ID NO: 131012 - DNA, 493 bp, Homo sapiens
gttggtcatattaacaggtggctaagggcacctcaggtggaggggaaaaagcacaggccatgagacagccgggcagatgaagggccctgcaaatatgtgtggggtcttccagggggaaattggaggtgctgggacatgatcagctgaacagcttggactgagggttccagggaaccagagagggccctgagcagggaagaggcagtgtcagctctggatgcaggaaaatttttcagggcttgtgctgcgagggccacagcatggaggcgagaggctgcagaccgggatgttgggtgggaaatggagcaatcgtcaagaccgaaaagggcctggccatgcagatagaggggaggagacagggaatggagggaggaggaagggcatgatggcagacatttttggggaagtgaagtttacaggaacccctgactcatgcatggggtggttgaaaacaggaggcaactggaataagtcctgggtcctgactgggata

SEQ ID NO: 131013 - DNA, 410 bp, Homo sapiens
atagtttaaatgatgaggttgatttctgattgacaatggcttaagattagtaatatcttaaaatagtctaacccatctcttcaactaaaaaatatacatatcaaagaaaactaataaaaattatgtaaaataatgaatggcttttctgtttatcaaaatttactaaagtatggcaaaggaatcattaggagttgaacaaaaaaagaatctcacatgttaatacacttaaaatctgtttttttcaaacaaatactctgctgtctgattatcatctcatgatataattggtgcaaagtgcaaaaagttctctgaataaagatttttaagttctgctaatagacattatagctcatgtgtgtgtgagtgtgtgatgtggaggctcaaattttaatgtaatatatgactcatgt

SEQ ID NO: 131014 - DNA, 617 bp, Homo sapiens
ccagccatcctttgctgtcagtgtgtggatcagaatgagtaggggagcaaacttacctgaatactgttgttgagattttcagccagccatcctttgctgtcagtgtagggaacagagtgagtaggggagcaaacttacctgaatactgttgttgagattttcagccagccatcctttgctgtcagtgtgtggatcagagtgagtaggggagcaaacttacctgaatactgttgttgagattttcagccagccatcctttgctgtcagtgtgtggatcagagtgagtaggggagcaaacttacctgcatactgttgttgagattttcagccagccatcctttgctgtcagtgtgtggatcagagtgagtaggggagcaaacttacctgaatactgttgttgagattttcagccagccatcctttgctgtcagtgtgtggatcagagtgagtaggggagcaaacttacctgaatactgttgttgagattttcagccagccatcctttgctgtcagtgtgtggatcagagtgagtaggggagcaaacttacctgaatactgttgttgagattttcagccagccatcctttgctgtcagtgtggggatcagagtgagtagg

SEQ ID NO: 131015 - DNA, 433 bp, Homo sapiens
actcagtttttgcaatgcaaaagcagccataaatgacatgtaaatgaatgagcgtgatcagtgttccagaacaactctacttacaacatcaagcatggggctgcgcttggtcccctggccataggatatcaacccctggcctaaggtattgtgcagactaaatgagatgagattcattcctgtaatcccagcgctttgggaggctgagatgggcagatcacttgagctcaggagttgggagaccagcctgggcaacatggcaaaaccccatctctacaaatagtacaaaaaaagtcactgggtgtggtggagtgaacctgtaatttcagctactcgggaggctgaagtgagaggattgcttgagcccgggaggttgaggctgcagtgagccaagatcatgccactgcaatccagcctggaagacagagcgaga

SEQ ID NO: 131016 - DNA, 149 bp, Homo sapiens
tatgaggactgaactgactgacttgtacataggacgtatcagaataaataacttagggcaagagtaaaggtagcttttttacagtaacttcaagcttatctccatgtagtaccttttttttttttttgagacagggtctctgtcatcca

SEQ ID NO: 131017 - DNA, 720 bp, Homo sapiens
tgcagtggctcacacctgttatcacactttgggaggccgaggcgggtggattgcctgaagtcaggagtttgagaccatcctgaccaacatggtgaaaccccgcctctactaaaaatacaaaaaaattagctgggcgtggtggcatgtgtctgtaataacagctactcgggagactgaggtaggggaactgcttgaaccagggaggtggagggtgcagtgagccgagatcatgcctctgtactgcagcctgcgcaacagtgagactccatctcacaaaaaaaaagaaagaaagaaaagaaaagcctcatgaataagcagtacacagagaattgtgtataaatgtaaacactcaaaacagctattataattttccaagtttattaagcttcctgacttcttagtcactcatttaataaatattttagagtgcctactttatgcccataaaacagaaaatgggaggaaggaaagaagtaagcaggtaactgaggcagtcaggcagtcagtcagtcagtcactcacagattcctaacatagctagaattggtcatttcaaatacactttccctctttccaactgagaaatttccaactgaggattccctccctctttccaactgaattccaagacctacttaattcttgctctccactttccatgttcctgctcctactgttatcaaaatgcatctaaaaacatggatcaaattctttttatgt

SEQ ID NO: 131018 - DNA, 289 bp, Homo sapiens
gggaaacagtcagagaagccagcaatttgctcaaagttttgggctctacttttctctgtttggttggaactggggcttaggggatcctggaacttagtagaagctcaataagtacttgatgagtggacaaatggatgagtactatattttcaggtacacaccaggccttttttccctccactcacagcccacagcccttctgataggccgggttcctgcacttgatatatgctacatcccattaagagagttccttcccctccctaggctttggattctccacatgaga

SEQ ID NO: 131019 - DNA, 345 bp, Homo sapiens
attgtgccaaataattgacaccattctccttttaccattagtagcaattcgagatggggcaaagacactgcaactaaactgctgaatgtaacaaccagattactccaaactgatccattgtactattttgcggggagggcttagacttttctctttaaaagtgaattttaacgaaatagccttgcagatgggcttatctataagttctacaggttggttaaaatttgtggtgggcctttagttagccgtttacattttatttgtttttttttataggctgtgaagctcaggaaaagggtaggcaggtaaaatttgtttttaatgagttgatactttttagaaacc

SEQ ID NO: 131020 - DNA, 264 bp, Homo sapiens
agaacaatttggttaatgtccacctctaggaggaacaataaacatcggcaggatttgtgtttctttagtcttctattcccaaaattaacaatttgtttaagttagaggttggacttggactaaagatccatagtaaatggaaattaactccactgtctccctacatgtttaaatactgcgagttttatatgtcatcttagaaattcactcatcaaatatttttccctctagccaaagcagaagcccttaaataaacaagccatg

SEQ ID NO: 131021 - DNA, 588 bp, Homo sapiens
aaaaaaaaaaagaaaaaaaagaggaagaaacctgactttctaagtttgcacagttactgagtagtggctgaggcatggcttgggtccagggcctcttcctgtggttcccaagtgcttttgagtacaggaactgggctgcctcttcaccagggaaggattagtgtttattaatgtttattaaacatcttctgtgcttatgaagctgctgggcttggtgctttgcatacttttatttcattgcattctcatagccaccctctgaggtgatgttacttatttctgatttaatgatgaggaagccagagatcaaagaggtcatcaagctcgcaagagacagagccgtggacccaaacccaggtttctgattctgcagcagctataaattctgatcacagagatctaatgacctctaggagtcttccactcctaggaggtatgtagaatggaccactcactaggtagttggatccactaccagcaatgtgaattctcacactgagtcaaaatgtgtctctacctactgatcccagaacagtcccctgctgccgaattgaatgaatctcatctctcttccctgagtcagccctg

SEQ ID NO: 131022 - DNA, 471 bp, Homo sapiens
cgtgctaagattacaagcataagccacggcgcccaggctttgtctctctttttaagccccatccacccacagatacaatgatcccagctagtcagaatggatgtttccagttttttcccttagatcaaaatcatgacatcttgatttcaaagatcatcaaggagagagtgttcccaagtcatccctagcataccagctccaagaccagggactataatgtttaacatgacctgagcaaggcggggtgtctctctttcctggcctttggactgagagggacaaataaaaagtcaaattagcctcaggaccaaaagcaagacatccagtgtgactcagatttgtaagaaaggcaggggctccttagaccagccttcagggtcagttcataatcccttctgaaacagcacagcctttctgaaaacaaacagcttagggaggccctgtgtggcggctcacacctataatcccagc

SEQ ID NO: 131023 - DNA, 768 bp, Homo sapiens
gaaattcagtaacttcaccaaaatatgtcttaaaggtgaagacatcactataagactataggacagaatgtactttcagtctaaagatacaaggttctctttattttagaatatatgtgtggtggtggaggtgattaaaaaactaaggagttggccgggcatggtggctcacatctgtaatcccagcactttgggaggctgaggtgggtggatcacctgaggtcgggagtttgagaccagcctgaccaacatggagaaactccgtctctattaaaaatacataattagctgggcatggtggtgcatgcataatcccagctactcaggaggctgaggcaggagaatcgcttgaacctgagaggtggaggttgtggtgagccaagattgcaccattgcactccagcctgggcaacaggagtgaaaccctgtctcaaaaaaaaaagaaaaaaagaaagaaactaaggaatttccggccaggtgcagtggctcacacctgtaatcccagcactttgggaggccaaggtgtatggatcacctgaggtcaggagttcgagaccagcctggccaacatggttaaaccccgtctctactaaaaatacaaaaattagctgggtatggtgatgggcacctgtaatcccagctactcgggagcctgagggtggagaatcgcttgaacccagaagacggaggttgcagtgagctcagatcatgccactgcactccagcctgggcgacagagcgagactccatctcaaaaaaaaaaaaaca

SEQ ID NO: 131024 - DNA, 432 bp, Homo sapiens
ggctccaacctctcattccaactccctttcccatggtaaactccaccaaccttccattctagcagcatcatgccactccacattcagatgctgtgtgttctcactgtgccttttttttttcttgtgacaggatctcactctgttgctgaggctggagtgcagtgttatgatcatagcatgctacagcctcaaactcctgggctcaagtgagtctcccacctcagccttccgaatagctaagactacaagcatgcgccaccatgctcagctaatttcttttattagtatttttagagacagtgtcctgttctgtcacacaagctggagtgcaacagaatgattatggcttactgcagcctcaaactcctgggctcaagcagtcctcctgcctcagcctcctaagtagctgggactacaggtgcacaccatcac

SEQ ID NO: 131025 - DNA, 814 bp, Homo sapiens
gcatccaaaaaaatttttttaatttgttttagacacaactttcaactaatcttcccaattgcctgcgtcactccttgataataacttgagctctgagggagtaacatttacactttgaatgtgtgtctgggcagccattcataaccttcagataattattgtgcttcatccctctttatttgagatcacaaaccttgccagatctcctgacttgtgcacttagatgttctgtatgttatgcttttattttaaagctaagatcccttgggatctttggagaaaccatagtgtcccaagaaggggttgaaaatctctgcattgcagtttcccttagtcattttatctagtccatttgggtccttgagaagattaaatttatgatcctgttatctgtgtaggtctctccaaaagttgagctcagacttttatacaattactttgtagtgccggattttctgatgcatttattgactttattgctaatcttcccaatgcatttctaaatgatagtctttggctgctgaaccattcctcttattgctcctgctttctgctttccccctctctagggattgaaacccagggtgagtgacattgttgcacccagcatctatctacaaggatactgatgatttttaaatccttcataaatttgaatgttgaactttactgttggctgtggaggaataatctaccttcaaatctcagggaaacatccaaaagagaaaaggggaaagcgtaggagaatttactttagcgctgctcatatatttattttgaaggctggcagaatctaaaaatggggctgtaaatt

SEQ ID NO: 131026 - DNA, 358 bp, Homo sapiens
ggagtagacaggaagtgatggggcacctgtgttacacgtgctcagggtatggatgtccttgagcctgtagccttttccatttgttcaatccacacacaaatgttgaatctgtccttagccagagttggtgccagagggaaactgaagcccatgaggccagtccctgcccctcagagctcgtcttccagctgaaaaataggcctatcccacagactgctccatgcaaagctgtgtctaatttttgtgcggaggaaggaaggctctaggaggtcagggcaggagggaccacaaggagccactggcattttagctgacccttgaaggatgggaggggttcacttggtggacttggagtcag

SEQ ID NO: 131027 - DNA, 214 bp, Homo sapiens
aagttttcaaattttaatatgggtttttaaacgtattataaacttctgtggggcttttaaaaacctgtacctaggccaagcacggtggctcatgcctgtaatcctggcactttgggaggccgaggcaggtggatcacgaggtcaggagatcaagaccatcctggctaacacggtgaaaccccgtctctactaaaagtaccaaaaattagccagg

SEQ ID NO: 131028 - DNA, 341 bp, Homo sapiens
gggctcaagtatggctcaggccatagcttctgaaggtacaggcagcaaatcttggcagtgtccatgtggtgttaagtctgcagatgcagagaatgcaggaactgtggaggcacggcttcctctctagatttcaaaagacatcacaaagagcctggggctccaggcagaaacttttcagaagggcagagccacacagcagttcctactacagcaacacctggtggagccatggggaaaaagccatcccccaaatcccagaactgctgagctaccagggcacaccaccagcctgcaagagctgcaggcacccgattccaacccaagagctatgtgggctgcac

SEQ ID NO: 131029 - DNA, 294 bp, Homo sapiens
tccaagaaaggagaaacatatttgctctgcaccccacagtctcttgagctttgctgttaaccgcaaatggtaaattagttctattgcaggagaaccaaattctactcactttctaaatgcacgtaattgccaagcataggagattaataccctagaaactaacctcagagacagtttgtttaaaaacaaacaacctaactaaaaacccaaagccgttgagttccagaaacaaccactctgaagccagcagaaatttctgcatttaacccacctgcaccccggccctcccccagt

SEQ ID NO: 131030 - DNA, 322 bp, Homo sapiens
aaaactgtgcactggttgatgaaggcaggatgaggcggacaaacaaggatggcactagctgaggggcctcagaacatgcgtcagggtctgaagctgctgtgaaggtgcttggagctaaagtagcattattgcaataattggggaggtgttcagagaggaccctcactttgttgaagggaggctcttaaaatacttcctgttatttcactttcccaccctatggagggcaagtatttgattccagcttgaatcgtagttgttgttaacaataaaaatgatacagacacacacagaaataagctgttcccttttcctttcctct

SEQ ID NO: 131031 - DNA, 709 bp, Homo sapiens
gttctgagtttggttttcaacacatttaaatggaatttatatttaggtttcagtagttattagtgtgagggatactcttgaaatttgtgccaggtacttttctggctcaaactattatggatcaggcgtagggtagctgaagttctagattattactgtgaaatcaagtgctgtttttgttaatgttcatttgtctggtataagtttgctctggggctaagctagatctatggaaagacttaacccttttccagaaagcttccaacttagggaaaaaaatttttttttttctaattctgactgttccacttctgaaaaaaacagatccacagatcagacttgtaaatgatctgttttcttaagatatcttctaacagaatgggtctccagggaactgagtgacaacacacatttagctgggagtggcagttcatctccctaaacgtaatttaacatcacatttatctacacactacagttttggaggcatacttggagattgaacttatacttctcttggcttattttattttattttatttatttttgagatggagtctcgctctgtcgcctaggctggagtgcagtggtgcgatctctgcatactgcaagctccacctcctgggttcacaccattctcctgcctcagcctcccgagtagctgggactacagttgcccaccaccacgcccggctaattttttgtatgt

SEQ ID NO: 131032 - DNA, 391 bp, Homo sapiens
cgagaggatccccgtccagtagtctgtgcccactgaccacacaatagatccctctagatatcagataggtatctcaaaattaacttgtctaggactaaaaccctgattttcattccactgaacatgagacaaaacaaaacaaagcaaaacaacttcttcccatctttcccacttcattaaatggcagcataatttttgtaactgcttatccaaaaaaaatctagggggtttccttgtctgtttctcacaccacatatccatctatcagcaagtcataataaaatctaaatcataattttaaataatgaacacgaatgatgtagttttgtagagtaggattgaatgctcacataattcacctgcttttttagaacatgggcatactgagaag

SEQ ID NO: 131033 - DNA, 347 bp, Homo sapiens
gcttagtgctcctgaagttgcagaggtttacaagctctcaagaatatttgtactccatcttcgtacagggagggccgacccacgtgaccgtctcactcaactgagaaaaactctgagttggagggacagagtagtcatttaatttgttattttggaaatgaggtgtcatccttgttggaggctttgggagctggcagcttgcaagccagagaagggaggggctggggattgatgggagccttgttctcagcttgcttggtttaggttggcggacgaagagtgaagagtgctccctgctcagaaggtgaattctgataaagcaggggaatgtcttgtaagagggcgcg

SEQ ID NO: 131034 - DNA, 623 bp, Homo sapiens
gtctccatttccaaaaacgctccagaatctctagatatatttaaatcttccccaacacacttggtccaacatgttgcttctgttttcattgtctgtcaccatgcctagggcacagcaaacaagagtagtggattgataacaagtgttagttgatgaacatgaaaaaaacgacataggccgggcccagtggctcatgcctgttatctcagcactttgggaggctgaggtgggcggatcacgtgatatcaggagtttgagaccagcctgaccaacatggggaaaccccatctctactgaaaatacaaaaaaaaaaaaaaaaaaaaaaaaaacactgtgttggccccggccctgggccctgtaggaaaaagttttctaaaaccattctggtgggggggcgcggcgcccgcacgatgggttagcgttgacaaaggggccatagcgcgtgctccccataaggaaactccgggctccatggccaaatcgcggctgtggttctcctccccattaaaaagaccgccggggggaccccggcgccgtttgtgaacaaactcccgaacggggggttccgacgcgcacagcggggatcttcccacagaggctcaggcgagccgaaataaattacg

SEQ ID NO: 131035 - DNA, 415 bp, Homo sapiens
caaaacctgcatacattgctggtgtgagaatataaaatggtgcagccacttcggaaaacagtctggcactgttcaaatggttaaacacagatttatcgtatgaatcagcaattccactcccaagtatatacttaagaaaaaggaaagcatatatccagaccatgagcagtggctcatgcctgtaattccaacactttgggaggccaaggcaggaagattgcttgaggccaggagttcaagaccagcctgaacaacgtagctgggatttcaggtgcacaccaccatgtccggctaattttttgtattttttgtagagactgggcttcaccatatctcagttctttaactcctgagctcaagcaatcttctcgtctcagcctctcaaagtgctaggactataggcgtgagacactgc

SEQ ID NO: 131036 - DNA, 375 bp, Homo sapiens
ggcgttcaaaatcagcctgggtaacatagcaagaccccatttttacataaatttttttaaaaaaaattatctagttgggggggtgcatccctgaagtcccacctacttgggaggctgaagtggaaggattgcttgaaaccaggatttcaaggttgcaatgagctatgctgctatgattgggccactgcactccattctaggtgacaaagtgagatcctgtcttttaaaaaaaaggggtgaggggccaaaaaaattgaatagacatttctccaaagaagatatacaaatggccaaaaagcacatgaaaaaatgctcaacatcaccagtcactagggaaatgcaaatcaaaaccgcaatgagatacaacttcacacc

SEQ ID NO: 131037 - DNA, 251 bp, Homo sapiens
aagaatttaataaatgtgtgaatggtaaacggggagcaatcaggaaatcattcagaattaatcaacataatttttgtatttaaatttaagtaaccaggccaggtgcggtggctcacgcctgtaatcccagcactttgggaggccgaggcgggcggatcgccagaggtcagaagtgcgagaccaccctggccaacatggtgaaacattgtctctattaaaaataacaaaaattagccggctgtagtggcggg

SEQ ID NO: 131038 - DNA, 545 bp, Homo sapiens
ctctgccttgtgtcatgtgtctgctgtcatcttaggctggcatcctaagtatgactgccagcaataatctgggctgcatgcttcttcctttgcattcaggagtaggagagtgattgcttttcacactaaactaacaaaattcttcaactttactctgattcttccaacctgaacctgtcattgtgtccagggtaagctcaggtgccagtcaggttttgctcacttctgaagcaaccactgtgataaaatgaaggaaattggattccttgacttacgctactcaaactacatggctgatacgcaatggggaaagggtagttccttaaagaaagattcttaggtagtaggcagagtggggatagttcttgggtaagcaactgatgaatgtcctgtgcagatgacatggattctgttaccaactcttacttccaggcttgttgagggaagtggaacaattcagggcttcagagacaagcccatctgcattctggcctcatttatgtcacatactagtgcataacctttacaactcttataaacatcaa

SEQ ID NO: 131039 - DNA, 394 bp, Homo sapiens
agctgggactacaggtgtgtgccactaagctcagctaatttttgtatttttagtagagacgaggtttctccatgttggtcaggctggtctcaaactccaggcctcaggtgatccgcccaacttggcctcccaaagtgctgggattacaggcgtaagccaccgcacccggcctgaacattttctttagagtaggatccgatgctgttcttgcaaagacatgaaataatgaaacagaccgcgtttgcggttacttcgaacggtgcacagctgtgagaggactcggcggatgagcagtcgttgagaaaatggtttccttcactcgctcactaccttttaatcagaaattttggtctctgtcccgatagtaaaacccgtttgcgtggggttggcagta

SEQ ID NO: 131040 - DNA, 484 bp, Homo sapiens
ctcctgcctcagcctcctgagcagctgggattacagttgcctgacactgcactggctaatttctgtatttttagtagagacgggttttcaccatgtggccagtctggtcttgaactcctgacctcgtgatccacccaccttggcctcccaaagtgctgggattacaggcgtgagccaccatgcccagcctattaatttcttaaggctgccataacaaattgccaccaacttgagcctcacagttatggaggctcaaggtctgatatcaaggtgtcaacagggccatgctccctctaagaatccttccttggggcttccaaggttctagaggctctaggaatgttttgatgcaccttggcttatgggtacattgctgtcatctctgcctccttcattacttggccttcttctgtgtctgattgcacatggccttcctataaggacaccattcattggatttagggaccactctaatccagtatgc

SEQ ID NO: 131041 - DNA, 494 bp, Homo sapiens
ctctggatcaagtgtctactgcccacggctggccaggcaggtgcacgacagccttcctcagccctccctcctggctctgcttcagccagccctgcccacagggccagaggcccactgcttttgcttctgggggactctgaacagccagctcccggccctctttcagcccacctcagggaccctggtacacaacaggaagtcatggaggggacatgcaggtggggtgcaggggcaggatttgtccaaaccaccaacattttagtttcttttttttcttttaagacagagtgtcactctgttgcctaggctggggtgcagtggcacgatcttgtctcactgaaacctctgcctcctgggttcaagcagttctcctgcctcagcctcctgagtagctgggaccacaggcgtgtgccaccatgcccagctaatttttgcatttttagtagagatggggtttcactatattggccaggctggtcttgaactcctgacct

SEQ ID NO: 131042 - DNA, 668 bp, Homo sapiens
atcctgggaattatgtgcttaatcctgtttcctggatccaatggctgtcctcttttttagtattatatctgtggcgcatcctccagtagattgctgagaaagcttgcataggagatttttttttggaaaagctttttcagatattaaaatgtcttcattatgttctcatatttgtgacaggtttgcttggtttaaagttgtagattgaattgttacttgggattttgaaggcattatcccattgtcttctagcttctaatgatgctgatgagaagtttgataccattcttatttccagtggtttgtatgtgacctattttttaaaatctctggaaggttttaggatcctctctttatccctggtttggaattttggaattttacatttatattttaaaatttatttgctaagcactgagtatgcccattaaaactcctttagttctggggatattttttgaattagtcctcctctgggttcttctgttcactttttctaaaattctcttagatactggatttccaagattattctgtgtttttaaatttttttaatctcctgttgtttatctccttgcatctttactttacatttggtctctttctttaactttattatctagacctttaataggctccccctatacagatttaaaagttttctaaga

SEQ ID NO: 131043 - DNA, 166 bp, Homo sapiens
acttctcttttttctttctccgaatttatttgctatcatgaagctcagcagatacgtgatataaagtaaacattaattctacttcagagtttctccaggttgtaattggtagctgaagaaatactgcagacattttaagttaaatgtaacttgaatttatctgggc

SEQ ID NO: 131044 - DNA, 428 bp, Homo sapiens
agtgaagctctgccttccaagtcagaatacatctgacaaagtgcccaagccactgaaatattactacacctacttattctggcctctgggtgaatacttattaatttattctaagagcttaaattaatcaaaatggcttgaaagcactaagtacttccaaagcgcttgaaatgataaatgcaactcaatagatagccttcgtcctggtatcttacaaaaagtaaataggatttagcaaggttttctccctttagttaattagttgggagtttattctggcttaccagaggcatagttgagagcacaagctgtcactgacttaggaactttacaaaatgctgcaaaacagcaatgattgtgaaccaactttctgcctgctgtctatttattccttacactgaagattgcttggtttatccttttactga

SEQ ID NO: 131045 - DNA, 433 bp, Homo sapiens
tccagactgggtgacagactaagagagtctgtctcaaaaaaaaaacaaaaaacaagcaaacaaaaacctcccaagagttaacattaactgagcatacattaaatggtaagtgtcacacactgttctatgtatgcatagctcagtttttaacttaggaagtaaattctaataatattccttatttttttctgatggggtaattgagggcagctactctcagtaacattgaacccgatagcacatagtgaagactcattatctttatcaatgatgtgtcagttggaggtaaaaattaggtccttttcaatatccagtggtgactgtgctcctaggaagatcagccaaggatacacagtccgaaaagtttatagcttaggtaggtaggattaagtgcagtgcctctctagtacacacctggatgtgactcttgtgt

SEQ ID NO: 131046 - DNA, 531 bp, Homo sapiens
gctggggactggtcggactgctgaaggaatgtaaaccggcataaccttcagagatgtgagttggatacatcatgtccaatctttaactgacccctttgagcaggcacaaaacctcacttctgtgaatttatttctgtgaacttataatcaaggaataattcagggaatgtattggggtctttcattcatcaagtatgtattgtacacagacacaaaccctgtgtcacagactgggtttttagcaaagaacacggagctagctttgtggaatttggaaaggccttgacaaagaagaggtgtttaagtaactgaagagggccagtggggcaggactttcccaagacaggaccaaggttctggtgaggaaggcaggggttgtgtcatacacagcctcctaggccatcttcaaggattgcaagtgcagccttggagtgtcatgattgtaagggcatttgtcaaagggtttggtctaggtctaggtcccattgagggaagctgcaagtccggaagctgacaggaccctcagaaggt

SEQ ID NO: 131047 - DNA, 564 bp, Homo sapiens
ggtcacacaggagatgggaggagagaaagcagctaccgtgggttaggtgagagaagaaaatatgttcaattactccgatgttggtagaagtatttgactggataagagaaaagcaaaagcaatgaaaactttttggggatttacacagtaacccaggattgaaatatacaaatcagggaagtgaaaataaagacacaataaatccaacaggaagaatttaaagatggctgcatagtatcagtgctgaaggcataatcaacactataaaggcacacgggccaggtgcagtggctcatgcctgtaatcctagcactttgggaggctgaaacgggaggactgcttgagctcagaagttcgagaccagcctggataacaaagggagacccttgtctctacaaaaaattctggaaattaggtgggtgtggtggcacgcttctgtggtcccagctacttgggaggctgaggcaagaggatcacttgagcccaggaaatggaggctgcagtgagccgtgatggcgccactgtgctccagcctgggccacagagcaagaccctgtcaaaaaa

SEQ ID NO: 131048 - DNA, 595 bp, Homo sapiens
aaacagagacatctcatccagtctgacgcttctgcatctgcccaatgcaggggagctaaatgagaacctggaaaggtgaatacactttacccaagaaaggcaataaatctgtgcaaagagaatggaagtatgaaaagcacaacagaaaaatgaagctttctgaaattagttttttagaccagacgttggaaaactttttcaattaagggtcagagagttaagtattttaagcattgtggtccacatctctgtcactactccactctgcctttgtagcacaaatgtagccagagaccataattaaatgaatgagttcatttaatattccactgaaaagctaaaatttgaatttcattaaactttcatgtataatgaaatattattactcttttgatttttgttcccaaccacttaaaaatgtaaaacctgggcagatcacctgaggtcaggagttcaagaccagcctgaccaacatggcaaaaccctgactctactaaaaatgcaaaaattagccaggtgtggtggcacacacctgtaatcccagctactcaggaggctgaggcaggagaattgcttgaacccgggagacggaggt

SEQ ID NO: 131049 - DNA, 310 bp, Homo sapiens
taatacttcgttgtatcagcagctggatatgcacccgttaccaggaagcaacctacgtaagaagccctagagagtgctttgagttctgagagtaagagcttcctttgcagatgggtggggctaggatgattagaattaagattgtttttgtgttaatgctgccttaatgcacaggacccacacgggatccacactggatatacactggatatacgggatccacggaagcagtgatgattgctggttttgttcatagatatatcctgagtgcctagcctggtgcatagtaggtcaatagtaaagacttttc

SEQ ID NO: 131050 - DNA, 186 bp, Homo sapiens
ttcctttccaaaatagtttcagtttgggtcagccacaagagaaatttgcatgttctttgtaaggtagaagtgaagagctgtatttctgctcagaaggttggtatatggtcaggcactgttgcagctcacacaccctgtcactgacttggctgtatcaccatgttggcgtttggcttccagctcctc

SEQ ID NO: 131051 - DNA, 312 bp, Homo sapiens
ctcctgaatgtctctctagttttgtgctcagccccacctccttgtgctctatgatcaaatcacattgcactccttccagttcctccaatcttccatgctctgcctagccaccagaagcttgcagataattttccttctgcctaggatactcctgtcacactcttttgcctgattaactcctatcattgttctgatttccatttcaatgtcacctcctcagagaagtcttcctgactctgctggcttcacttaatgccttgctgtcaccttccatgcttccccatcgttaattgcatgacactttacccttca

SEQ ID NO: 131052 - DNA, 311 bp, Homo sapiens
aaggaaaaacacgtaatatgtaacaacaacaacaacaacaacaacaaaatcaaacaaacaaaaaccaaaccaaaagattgctgccacatttgactgacaccagatgacaggactgcatctccggtacaccattctaacccgaggctcagttgtatgagattatgtgagattgtcagccaccaggccccatccatttccacctagttaagcaattacaggaatgttgcaagtgcagccagggatagctttgaaacctggcttttttttccccactaacattaagatttcactttggttacatattacgaagg

SEQ ID NO: 131053 - DNA, 309 bp, Homo sapiens
caatagcaactgaaatgtttacgtttttggtgattatatcaacatcaaagaaatgcaaatcaaaaccacaaaagattgctgccacatttgactgacaccagatgacaggactgcatctccggtacaccattctaacccgaggctcagttgtatgagattatgtgagattgtcagccaccaggccccatccatttccacctagttaagcaattacaggaatgttgcaagtgcagccagggatagctttgaaacctggcttttttttccccactaacattaagatttcactttggttacatattacgaagg

SEQ ID NO: 131054 - DNA, 715 bp, Homo sapiens
atcacccgccatagctaattgggttccttctcctccaccatccctcaggtgatgtctgatcaccctcgcctgccttcaacaagaatcctgttaggtcattttagccagaatcttctgtttctcctgatggctcctcttagtaattttccatccactgactctatattcccatctttgggtctaagtttccacttgccaatcgtgtattcaaagttaagcctagttctatactcagatctcttttcccctattgcaataatcttgaataaaatttgtttttaccactttaagtattgtccatctctggttttccctgacacaaccatgtgacttcttacattgtttactgtttgcttatcttaactcattcttcaaagctaagatgctgattcaaacacttatttctacttgcgtgagaaatataaaagtctgaggtctagtgtggtactaattcactataattgaaagaagtgcttgacctataaatgaagcttatgcttaccttagaattgaaacatatggctgggcgtggtggctcacacttataatcccagcactttgggaagccaaagcaggcagatcacttgagcccagaagttcaaaaccagcctgggcaatatggtgaaacatcatctctaccaaaaaagtcagaataattagccaggcatggtggtgtgagcctgtagtccccagctacctgggaggcgaaggttgc

SEQ ID NO: 131055 - DNA, 776 bp, Homo sapiens
ggtttttatatctcaggatggactatttatttatttgaaacatggtgtctgtctgtctatctatcatccaggctggggtgccgtgttgtgatcacagctcacgccgcagtcttaacctgttgggcttaagtgatcctcccaccacagcctcccaagtagctggcattacaggcatttgccaccatgcctggctgattttttttactttttgtggagacagggttttgccatgttgcccaggctggtctcaaactcctaggctcaagtgatccatgcgccttagccgcccagagtgctgggattacaggcatgagccgctgcgcccagcccagatggactatttgtattaaacgtttcctggcaacttgcaatagcttaagccggtaatcccagcgttttggacggctgaagcaggaggattgcttgagcccaggagtttgagaccgatctgggcaacatagtgagaccctgtttctacagaatatttaaaaaatgaggccagacacggtggctcacgcctgtaatcctagcactttaggaggccaaggcgggtggattgcctgagctcaggaattcaagatcagcctgggcaacacggtgaaaccctgtctctactaaaatacaaaaaattagtagggcacagcggtgtgcacctgtaatcccagctgcttgggaagccgagacaggagaatcacttgaacccgggaggcggaggttgctgtgagccaagatcgtgccactgcactccagcctgggtggcagggtgagactccatc

SEQ ID NO: 131056 - DNA, 392 bp, Homo sapiens
actatgttgatgggtgctgctaaataactgagaagaaatcactagaatctgtgtgccaaagaagacaaaataaaaattaaaaaggctgagccaggcgtggtggcacatgcccgtgtagtgccagcgacttggaaggctgaggcaggaggatcccttgaatccaggagttcatggctgtagtgcactacgatcccatctgcgaattcccaccatattctacctgggaaactgggatactaggacctggtgtctttaaaaaaaagaaaaaagtctaccagcccaagtaaaatcaatattatttattgaaactgtgctaaggactgtacatgattatctcgtggaatgtgaacaccaaacccataagggaggtccagttattatcctgattttac

SEQ ID NO: 131057 - DNA, 532 bp, Homo sapiens
agagacagcccagcctgggccatggaagaaaacccgaccttggaatcagaagcctggggctcctctagggggtggctggccccccgggaggccagaggaggcccatcgctgtcttctgtgctgaacgagctgcccagtgctgccacccttcggtaccgagaccctggggtgctgccttggggggcgctggaggaggaggaggaggatggaggaaggagcagaaaggccttcacagaagtcacccagacagagctgcaggaccctcacccttcccgggaactgccctggcccatgcaggccagacgggcacacaggcaaagaaatgccagcagggaccaggtggtctatggctctggaactaagacggaccgatgggcgcggctacttcggaggtccaaggagaaaacaaaggaaggcttgcgaagcctgcagccctgggcgtggacactgaagaggatcgggggccagtttggcgccgtgcacggagtcctacttctccctgcctgcgcttcctgctaccttcttaacgtgc

SEQ ID NO: 131058 - DNA, 342 bp, Homo sapiens
gtatatgctgtctcaaaaaaaaaagaaaaaaggacccataaggcttttagaagaaaatacaagagaaaacccttgttagccagacagtggccccgctaggcagactccttcagactcagtagatcccaccacagatgtcaggaagaaagagaagcaggagctccttctgtctactagtggcaaagcagcatttttatcccccaggcttctgggaaaggaaccttaaatgccttctgaaagcaggtctcaacctctcccaacggctaggcctccctttacagctcttaattgacaaggaagaagagaatgggcagcctggagtccaagatcctgctcccaagc

SEQ ID NO: 131059 - DNA, 1013 bp, Homo sapiens
ggaggatagcctgaacccagaagttcgaggctgctgtgaactgtgatcataccactgcatgccagcctggatgacagagaccctgtctcataaaaaaagaaaaatggtttacagtgtagttgtttgaatctggatccaaatcagctccatacattataattggtggatagggctcgtgaggccttttctagctacaggtcccccctctgcctcttgtccttagcagtctctttgtagaagaaccagtcatttgtcctggagggtgtcccccatctggattttgctgttggtgtcctttctgcgttcccccgtgtctcctgtatttctgtaaattggtagttagacctcaggccctgctcagagtctgttgctgttttgcttgtttgactgttgtgttttgctggagcatttcaccagtgaggaggcacgtgtggacgtccatctctttttgtgatgttagtagctgttgatgttcgcctagcctgctgctttattgaggttggataatgccttttaaggtaaaagaatcttgcccccaaaaatcacagctctggcattgtaagtgagagcactgacactttggccaaccctggatagtcttcagtgttagaaaatgaaaacgtgtcattgtcagcgtatttatcgtgtggataaagcttggtgaagaaagtactgtcgccgccattcttactgcagggaattggataaatggaagaagcctggttgtaagtatcagtgtactcagtaatgacagattcctccttacttagcactggggagtggaaaggtgacctggcttcattcttaaacctcttcgttggctggatcatgacattctgtcagtgtcgggagactgccagcgcacggtgcacgcctcttaccggcttcccacttcctcgggcagcagagctttaagcacaccactgtccccgagggccctgacctggagggttgggctgagctggggctgcctgcagggggtgacctggtgccctgcagcctccaccagcgca

SEQ ID NO: 131060 - DNA, 751 bp, Homo sapiens
ctaatttttgtattttttgtattttttgtcagagataggattttgccatgttgtccaggtcggtctctaactcttaggctcagggaatccacccactttggcctcccaaagtgctggaattacaggcatgagccactgcgctcagctcagaccacttctcacaccagattctgttatttatacctgagaaaacgtatgggtggtagcatgggatgagaaaaaaggaaaattctaggacaatcgttggtaaaaatcaccttaggatgaaaaatttgaggcacatttttttaaaatgacagaaaaagataatcatctcattggttgaaaaggagcagcatgatctctggaagcatcaatatccctcgtcgtgatgtgttgaaagctctttcactgttttggattcctagtttgaatagttgtatgcgaaatttgattcctatctggtgtatgttttgggtgcgtacaagggaaacatttggtgttattacctgttgacattgcaggacgaagggatgctttggttgtgaagatgtatctggatatatgttcatgtaataatgacatctatatcagagtcttattaatttaatctaatgaaacacacacaaaaaaaaaaaaaatatttggggggttggccagaaatttaaacatgtgtggggggggccgagtataaggaatgcagtgtccaaaactggctagtggtggttcacaaaagcggggggggggttgaaccaggtgggttggtaaaggc

SEQ ID NO: 131061 - DNA, 724 bp, Homo sapiens
aggctggggagagtatttagcccctctgaagcatgtttctgcttagagcagggtgcgtatctgaaaaagtggaaatctgtaggaaggaaaaagggggaatggatattttataggcaataaacagtgtctattattggaaatatgttttaactgagggaatctgaaaatatttttaaagaaggaaagatttaaggtggtgcttggaggatgggtaagtttcagtagattaacatagggattctagacagagggtcaccctttacagggtttgaaactatgagggtatatggattttggaaaaatggcacatacgtaagaatgactggagaataagtagggtagagaatactaggggacaggaatggaaaatttccttggctttgcataccaagatgaggaatttcagtaatgtaccttttaaataagaagagcagtattaaatgatctaaattcccccagccctttgtaattgaattggaaaaggtttacttgaagacaaacatatttaggattactgctataaattaaaggccaatgagtgtaaaatcttgagtttaggtattatgtgtaaaacataaagatgaaatattgtaatagaatgcatagtatttgattctttataaattagatggaggaactgcagatgtcttttttttcaagtctaagtatgttggaagatcacaagttttgtttggttgtgctgagcctgaaaccgtgtgaaatg

SEQ ID NO: 131062 - DNA, 388 bp, Homo sapiens
ttagccccacttcatctctgcagcaaacgttccaatgtaagccttaacaattgcttcgctctattcaaagaaatgtattagaaacataaaatatgatctcgcccaagaacacttggacctgaggatggccccaaactcccttggctcctctacaaaatcagggcacttttcagggaggacagcgtcccacgatggccacttatttatgtggtctgtcctttgcaacagtctccgcaacagccttccattgaattctgtctcattggacacctttctggggactggggacagggcaggcctgggcccgcaggttctcagcttgcagctgacagggcacggacaatgtgccaggcaggagcggaggcccttgccaactgcattcctctcc

SEQ ID NO: 131063 - DNA, 268 bp, Homo sapiens
  misc_feature (22)..(22): n is a, c, g, or t
  misc_feature (33)..(33): n is a, c, g, or t
  misc_feature (77)..(77): n is a, c, g, or t
gtctctgcaggatccccggcgnagctcctggantcaactattcccctgctcagcctcccgagtagcttgaattatangcatcgccactacacctgactaattttgtgtatttatagtagagacgagttttcactcatgttgtccgggctgatcacttcggcccaggagtttgacaccagcctggacaatacggggagactctgtctctactacaaattttacaatattagccaggcgcggtggcatgtgtctagtcccagctacttgg

SEQ ID NO: 131064 - DNA, 678 bp, Homo sapiens
gggagtgaccgttttggagtggtctgagcgctacagattggtccccaggtgggcctgtttgcaagcaagctgtggccccgaccagagtccctaatgctcatccatgtatattcagtgggtatagcccctctttagccagggttcttactttttcatccaagaaaaatgaaatttgttcctaaaggccagtgtcctcatcagccctcgcccaacgtcccgcctcatcgttacattttccattgtctttgctgtgaacccaaccctgactcctgaggtcagcctgcaggagcggcccctgacttcatgcttgcactcagtccattagggcagacagctgtaaacggaagcgagtgctcactgtctctctggagcattatgtggatgaaggaagccaagaaattgggtttaaaaatctggagtccgttattagaagcctgaggtctcttgagtgatctgagcattacaaatcttcagcccaggatacagccatttacgtttaataggaggttgatggatgtgggtaattttcaaatctaatatgaaatctatttttaaaggaatttgatgtcatcgaaattaaactgggggaaaaaagatcaaggcagaatcctactgaagaaaagattcttggccaggatttgttcttgctcctcatctgggcacaatttctcctcatgg

SEQ ID NO: 131065 - DNA, 132 bp, Homo sapiens
tttgagaccatagtgagaccccgtctctactaaaaaattactttaaattaactggacatgatggcatgttcctgtggtcccagctacctgagagaccgaggcaggaggatcgtttgagcccaggagttggag

SEQ ID NO: 131066 - DNA, 298 bp, Homo sapiens
gaaattcccaatgcctgttaagttgttggacccaagtaattatgtgattaaaaaaaaatttaaactccataatagtcctatcttttaaaatttctttgaaaatagaagtgagtgtcttgtttcatttttgtccactggtaatttgggaaagagaaattgttgacttggctaaggtcacaataaaggcaagcccaactcctttaccttatatttatttatttatttttttgagacagagtttcattcttgttgcctaggctggagtgcaatgcgtgatctcagctcactgcaacctcct

SEQ ID NO: 131067 - DNA, 334 bp, Homo sapiens
ctcaaatgagtccctaactctcttcacccccacggctgctgcttcatccaggactttgtcacctttcagacacattcatatcatcgccctctagctgatctctgtgcacgtagcccctttaatccattcttcttattggcaacaggagcatctttgtaaagcacagctctgacctgatcatgtagttccaaaaatactacagatcccagggctccaaacaatatttccacaagtgtagcggataagatgctttggaggaacatacaaatgaatacatttcatttgaatagttgtggtatttttagagctatctttaaaaaataaatctaataaa

SEQ ID NO: 131068 - DNA, 254 bp, Homo sapiens
ttttaagcttctgaagagaagacaagacgtgacgaatctggtgtgactgtcacattgacaatatccttaggcaaaaatacccatactatctaaatagaaaggaataacaaaccaggccagtgtggtggcatacacgtataatcccagctactcgggaggctgaggtgggaggattgcttgagtccgggaggtagaggttgcagtgagccaagattgtggcactggactccagcctgggtgacagagcgagaccc

SEQ ID NO: 131069 - DNA, 321 bp, Homo sapiens
tgctctaaggatcccggtgttatcgatgccacatctctgcctattttgtagagactgaaagggcaagaatggaagtaagaagattattcagaagtgtgttgtaggcagagatgtggctagtttgcattagagtgatggtggagataggcagatccaaatacatttcataagtaaaattaatggattaaatgcgggagatgagggaaagggaaatcaagggtggtgccttagataacccaagcaacagaatgggtgatattagagaaggcagagaacaggttaaggggagaaggaaagtggatggctagttttgataataat

SEQ ID NO: 131070 - DNA, 427 bp, Homo sapiens
  misc_feature (410)..(410): n is a, c, g, or t
tgctctaaggatcccggtgttatcgatgccacatctctgcctattttgtagagactgaaagggcaagaatggaagtaagaagattattcagaagtgtgttgtaggcagagatgtggctagtttgcattagagtgatggtggagataggcagatccaaatacatttcataagtaaaattaatggattaaatgcgggagatgagggaaagggagaatgctgcgtttgtgaacaccgtatcgaactcagtgctgccctgtcacagtagaaagcaaagccatgtggctgaactcagctgacagctgcccacagagggagcatttaaaccagccctagccagaggggaattgctggtcccagcagtctgaacttgagttccggcaggcctcaccactgtaggctaaagggctctngggtactaaatacactt

SEQ ID NO: 131071 - DNA, 153 bp, Homo sapiens
cacactggtgacacctagggcctagctgtaggaaacatgtctggctggctgccccgcctcctcacgccagtgcttttcccagcctgagcatctccatctctcagtgatatgctgtccaggcttggaacattctgctcctttggccactccagg

SEQ ID NO: 131072 - DNA, 354 bp, Homo sapiens
ggcactagctttctttctgtctgatttttgtttttagagggagttatagttaaaataggttgatcaaagggcctaatcttcactcagctactttttaaagtacttggttgagatcatgtcatatgagtataattcttctatgactttgagtgtgtatagcaaacctattatatatgtgaacatgagaaataggatctttatatatggagaatgtgcttcaagtgaagaagagaaatgcatgaaaagtacctatgggccaggcgcagtggctcccgcctgtaatcccagcactttgggaggccaatgcgggcggctcacttgaggtcaggagttggagaccagcctggccaacac

SEQ ID NO: 131073 - DNA, 477 bp, Homo sapiens
cggggagtttgtgcctcgaggcgacacgtgattcaggaacctgtgtagttgagagacatgaggaaggtcccaagacccagccccggggagcctgtgttcacagggccacctgtagagggtgccggaggatgggagctggcacagggcagctggagggaatcggcatagaggctgggctgcttccactcccagcagttgacaaggccgaaggagggggtttggcccctacagtcaggcctgggtgtgctgaagtcggtggtgagatgcactgttattccccagcaaagtgtgggctccctgaaggcagggatgaggctgagtcactgctgtgttgcagagcccaggtggagcttggtacaggagggggctgcaggaacaggggtgcccgttgaaagaggacaattggggcccctggcaggtggcaggagagggtttaacagctctgagcccctctctaccagggtgcccaggtcatga

SEQ ID NO: 131074 - DNA, 410 bp, Homo sapiens
cccacccctgtgcctggagtagcttgattctcagcacttgggggatctagtatgtgtacgtggagagggatagtggggtgggggagaattgccactccgcctgctctgccctgaaccctgtctttgccgacgggcatttgactgtgctctccccaaatcccaggagaaggcctgaccttggggtgtagcagcccctaagggttttttatgttggccacacccatcttggatacaggcaagaccaaggccaggctcttgggatgtgtcccccgtgtctagcacaggcctgacgtgtagtaagtgctcagtacatatgtgtggagtccgtgaatgacagaggcaaagattggtccaggattggtctgtgagtcttcagggaatcacatgtctggggaggaggtggagaccag

SEQ ID NO: 131075 - DNA, 294 bp, Homo sapiens
aggtgagtcctctgaactctctttcccctccttgctggctggaatctgtatgcaccaccacccagcttcagccatgcttgtgatggaaggaaaaactgcgccggggagagcacccacctccagggccactcacttacactgttatgtgggagagaaaggaaagtctttttttccccaaagtattggtgcattcttttgcttcagtagctttccctaactattgcagtatattttcttctagttttcttccctatgaatatgtgtacagtcatttttcacccattaccccattag

SEQ ID NO: 131076 - DNA, 434 bp, Homo sapiens
tcaaagtgaagctgcatttttaagttataagtcttaagtctgtgaccatctgtcacctgttttggtcctctttaccatatttgcattactgctataattataataccttcacacatagctccacatgtaagatttgtgtttgtagtaaactggctaaatactgtttggatacatacttgggaatccaggtaaatgtgaaaaaggccaatttttttaaccccagaatatgttaacagaaaatacatctagcggttaaaatggagaacagtaagtcaggaatccttcagtttcataacctcaagctacagtcagtactttctagactctgtaggtaatgagacttgtttttaaaagttaagatagaccttttaaaatacaaaaaaaaaaaattttaaatgacagtaagctaggctctcatacagttgtgaggctta

SEQ ID NO: 131077 - DNA, 899 bp, Homo sapiens
gtctgatctctctttcccccacagtaagacgttgaaaaaaagtctaatagctcattgttgaataagagaacttttgggtaggatgaaattcacaaaagaaagttttgcactttttttttatgctcttgaaggttatttttatgtaaaagggagacaattcaaaatattttatgctacaaaattgacattaagttcatctagcacccagatcatggcctttaaatacaattcttcactgaaaggaacaagggcttttcagaaatgactgatttcatagaatgaaaggggcttaatgtaaaaattaaaaaaaaaaaaaaaaaaaaaaaaaaaaaactttggggccccccggcgcccctgaaaaaagcattcaagaaccacttggttgtgggcgcgcaggcggcgcccagaagggttaagtggaaacaggtggctcaaaagcgagggatcccaaaaggaaacctcggggcgacacgaaatggtgtgttgggtctctccccccaagtaaaaaacacccccgggggggacacagagggttttggtaccaaacccaagagggaggaagagaggcacaaaggggcaactacaacaagggatgacaaggagcagctcaagaataaatatccgcgacgtcgctgtgaaaaaagaaaaaagaaaaagagaggaagacggcaagtgaggaaaggaaggagaagaaaggagaaagcagataacaaaaaaaaagaaaagtgtgaagaagaaaaaaaggacaaagaaaaggaagaagagaaaaataagaaaaagagagggacaagggaatggagaagatagtgaagagaagagaaatggaaaagagagacgggaaaggaaaatagatgaaggaaggaaaaataaagagaataaagagggataaaaacaatgaa

SEQ ID NO: 131078 - DNA, 425 bp, Homo sapiens
cttggcttcccaaagtgctgggattataggtgtgagctactgcgcccagcctcttttttctaacatttattccatatagtaactgtagcttctatattttataatgcttctgatcatgttgacctgtggtgataatggaattgataataagtgatgttaattagaatatgagatgtgtaggacttgctccccaaaagaagaccctttcctttgaggagatcatccctcatctacgtagaggcttccagggaccacacgaaactgctggtctcagttctgctcttgggagaaatcacaatatgccactttgttttttcatctacgtatcaaccctccacacaagtgaacatgtctctcagttcccaccctgttagccttgtaagaagattaagttcttagacttttagcattgtgtctcaccaatt

SEQ ID NO: 131079 - DNA, 739 bp, Homo sapiens
ttctgcttattttaaatccctgcatcagaagtcagaacctaatataaaccagtataaaccaaagaagcaaacaattttcaagttcatgtgtgcagttctatccttgtgccatagatcacacttcttcatttacactgaattatcgtatcaaagattttcaggtataaatatatagattgctgtataatatactactacagttgtttggttccaaaggaatttcactccatttcctcaaacaggtctccatgtgaactgactataagcccaagaagcaaacaatttgcaagttcatgggtgcagttctgtcctgtgcattgtagggtgtttagcaacatgcttggtctttatctacaagattccagtagcattcccttacacttgtgacaaccaaaaatgtctcaatgtcaaatgtatctagaatcagggctaggaaattaccttcagtgaagaatctctaatctttttcatattttaaagatagaaacaatgaaaaactctgtccctctggatttttcctaaacttctttcaatttggtgcagagattcgttacatgactgccaaaaccagaaaatctataaaggcccctgctcccataggccaaacaaaaccttcaaggatattaccctgcgaggaatacatctgcttcctatttttctcattcgaaggtaatacacatgcaccaatatatttatgattatctttctaaattcggtaagtccgctattcctattatgg

SEQ ID NO: 131080 - DNA, 618 bp, Homo sapiens
gattaggtggatagcgtatataaaataggtaggatacaccaaacatggttattattgtagctgttgttttatttctcagtttgaaattttggggttcaactgtcatatttttattgtggcataaaaataaaaacataaataataacattaaaatatgttggctggatgtggtggcacacacctgtaatcccagcaatttgggaggccaaagagggcggtaacttgaggtcaggaattcgagaccagcctggccaacatgatgaaagcctgtctctactaaaaatacaaaaaattagccagatgtggtggtgcatgtctgtaatcccagctacttgagaggctgaggcaagagaatcgcttcaacccaggaggtggaggttgcagtgagcggagatcgcaccagtgcactctaccctgggcaacagagtgaggcttcatctcaaaaaacaagttatatttaatatgccaaaaataatatacaactgaaattagtggcgcttaatacattcacaatggtatatgagcataatcactatctagttacaagcattttagttaccccagaaggaaaacctgtacccattaagcagtcactcctcattcccctctgacccccaa

SEQ ID NO: 131081 - DNA, 422 bp, Homo sapiens
cttgagtgatccacccacctcagtctcccaaagtgcggggattacaggcatgagccacagcgcccagccccacatgtacatttaaaaggaaacagtacttgacaatatggatgggagacaaaaaagcaaaagatgtattttttaattctatagatgtcaataattctaataagaaaatgcagcagacatttcctgtgaaagtagtaactctagtagtaaaaagtaatatcaatatttgatttctcagggcctgacatacattaggaacttactgtcagtggactgaataaatgaaggggatgagtaaaacaatgaggctacatagtttctggtgtccaatttttaaaggacatatatataacaggagagaaacaaatatgcatatatacagattaatatcatcaatcttataagaacgttat

SEQ ID NO: 131082 - DNA, 224 bp, Homo sapiens
ccaacttcagacatgaattcagttgagaataatattcattttaaaatcccagaaaccaaagctagaatgtattgggtttatacaaatcccattataaagctttggtcttgacaacagtgagctactgatatagatatactacatatatatctatatcatatgtatatatataaatatatgtatatatacatatgtatatatatacatatgtgtccatgtatatg

SEQ ID NO: 131083 - DNA, 179 bp, Homo sapiens
tccagaaggggcagaagagttccaaagactcagtgcaaggcagataaagtgggaaagggctttctgggtggaaggagtagcatattcaaaggtctatgctacaagagcagtggcatgcccaagggccattccctcattcatggagacacttggcagagtccttaggcccactgcagcag

SEQ ID NO: 131084 - DNA, 357 bp, Homo sapiens
accatcacaaaagaatatttaacattaacattaggaaaatgtcacctacccaggatcatcattcctctgagaaattcagaactgcatatgtgtgtgtgtggataatggctagtggggttgaaaatgaagaagaaatggcatgtgtgagtttcacacctactacatgcagaccctttacatacagcatctcactttgtcttggcaacatctctgacttggacactgccaagcccctttgtggattctcgctcttgctttcattctttcatttgacaattactcactgggctccggccatctagcagttgctgtcaagtgctgaacaaaacaaaggttagacaaagtagaatggctggg

SEQ ID NO: 131085 - DNA, 947 bp, Homo sapiens
caaaggcccaacagcctgactgcaggaacatccttgccatatcctgccgggcagcaagctctaccgcccacacccctccatcctgtccagcaggatgggctggtcagtgggatagcctctgtgcacattttgtggcaagtaggagtgacacatcattcctgggaggccccgtggttcctgccaaacccaaccccagaattctccctgaggtggttttaccaaacccataacccagaactgctattgtggtttgggggtcagcacccaccagtgccagggcactactgggaggctgggacctgaccaaagcccatggtgtctgtggcctgaggacagggtgtcttggggccatgaggacaggccaccaatggccgttgggtcatagggcctgagccccagtgtttgtccttccctggctccttctggttcagtcccatcagggctctggatcccaagacgcagcatccaaggttccctccaggaatcctggtggctcggcttactttgtcatgtttcatctgatagcaaaaatatcagatcggctgcacagaaaaatggctcaaagtgcttaatgaccagaagaaatctgggagtagcaagaaggtaatgtggagaggggaggacctccatgactggtgtctgcagagccaggggtacagggacccagtgcagtgacctggcaccacctgcctctcagagggtgggtagcacactgtccttacctgggggacagcaggcctggtcaccggcttttctccctgtccctgcaagcatcacattgctggaagagaatctcatgccagagcttggaccatccctagcttgggggttaggggttgtctcttggtgacctaaatgaaaaaataggtccagatcagagttcgtgatgcatagcactcacccactctttgaatcatgggaggggaggcctagtcctaggtaaacct

SEQ ID NO: 131086 - DNA, 433 bp, Homo sapiens
taaattacccagtcttgggtatatttttatcagcaatgtgagaagggactaattctggtatgattaaaatattttgtgctttggtgtgtctttccatttctatcattccccacacctccataagcacattatcatttcatacgccaatctacctgtagtttactgttttgacatagttttctaagggctatttattgttgattatgttctctgagcttcgagttcccttcactctagctaaattcttcttactctttgaaatctggtttaagtgccctttattttgaaagcctttccgtatctaaccccaagatatgattcatatactccctgtatctctcatctgaatacctcctttggactcacaatgtcttttgctttcttgattataatatttatcaccatatcatgacagttgacactcttgtttagt

SEQ ID NO: 131087 - DNA, 439 bp, Homo sapiens
aagctagtacctttacttatcagaaagtgaaagctgggcatggtagcttacatctgtaatcccaacatattgtgaggctgaggtgggcagatcacttgaggccaggagcttaagaccagcctgggcaacatagcgagaccccttctctatttatttaataaaaaagcaaaagtgggagcaaggaaatgtccagtggctagaccatctgtggtagactttctgtgaacgcaatggacatagtaagaacttttaaataagaaagtcagagacacagctgggcagatcacctgagcccaggagtttgagaccagcctgagcaacatggcaaaaccccatctctacaaaaaattagctgagcatggtggtgcacacctgtagtctcagctacttgggaggctggggtggaagaatcaactgagcccaggaagctgaggtggca

SEQ ID NO: 131088 - DNA, 678 bp, Homo sapiens
ctcaggggcaaagagtcgaaggggctgaggaataaaagatgacaaattgggttcagtgtatactgcttgggtgatgtgtgcaccacaatctcactaaagagttactcatgtaacaaaataccacctgttccccaaaaacttatggaaataagaaaaaaaattcaagattatcaatattttctaatagaatcaatttgtatgacataaatttgatagattgcttaattacacaaattctagactttctggatgacgttttaatgtgccattgctttggtttgttagtatcggttttaggacttttacatctatattggtgaaatcagtcttcagactttacttttcaagctatctggataggctttggtatcagaattatacctaataaataggaggtcctctcaagattttctgtatcgggaatatttacgtcttgatgctttttacagaatttaccagtgatatagacttggatcttcttttggaagcaatttctttcaaagttttcatttatttgtgctttaaattcctctttgactcaatacaaattttctcttaaagttggtccattttagtatgactttcaagtcattatagagaagtaatacatagatttttaataatttcaaagcttttatcacgtgtcgtttcctgctttgcaacatatttttttcacaa

SEQ ID NO: 131089 - DNA, 422 bp, Homo sapiens
cccagtgttggaggaggcgcctgttgggaggcggttggttcatgggacagacatccctactttctgttctcatgatagtgagtgagttctcctgagatctggttgtttaaaagtgtgtacctctctcttctctctttcttcctcctgctcctgcgatgtaagaggtaactcctccctctttgccttccaccatgattgtaagtttcttgaggcgtccccagtcatgcctcctgtacagactgtggaactgtgagctaattaaacctcttttctttgtaaattacccagcctcaggtagttctttatagcaatgcaagaacggactaccacagggtgagaaaaacttaagtatgacttcaagatacttttcctgaacaactggaagaagggagtggccctttactgagctagggaaggctgga

SEQ ID NO: 131090 - DNA, 232 bp, Homo sapiens
aggtaaaagctagcttaaataatttagaaggaaactaaaaactatttttaaaaagtggcatagcagatttaagaatgaaataaatggaaatttctgaattgaaaaatacaaccaaaattaagaattcagtgggtggtttaatagcagatttaatagatactgttgaattaaagaaccagtgaactggaaaacgggttggaaagaaatccaatatgaactaaaaggaaagaag

SEQ ID NO: 131091 - DNA, 264 bp, Homo sapiens
caacgtaatatgtaacaaatgagaaaatcattttagtctgttttcttctggacagtttttgataattattccttctttattgagctctctgttgtcttattctaagcctatctttggcttcttatttgattttttaaaaacactgattttcttcctttaacactgatttttattttcacgtttttatttgatgagtaataatcctgtgaaataatttccaaagtgaacactgggcattccctgggtgactcaatctccaaatgg

SEQ ID NO: 131092 - DNA, 329 bp, Homo sapiens
aggataaatctagcataccctgcttctaaatagccaacctctgggggcactcagcttttcctcccccaaccccagtttccatcctttggagacacactggtggtcagccaatcagatgctggtattgaggattgagaaaagaaaattttttgtgtgttttgaaagagtctcgctctgtcgcctaggctggagtgcagtgacgtgatctcggctcactgcaacctccatcttctgggttcaagcgattctcctgcctcagcctcccctgtagttgggaccacagttttgcgccaccactcccagataacttttttttttttttttttttt

SEQ ID NO: 131093 - DNA, 329 bp, Homo sapiens
tcccagctactccggaggaccagctgtctcctctggatgaggggtatcattagactaaacaggggccagggtctgggaaagaaaaggcaaaacacatagaaggcaaaggcagctcccagcaaggttacatggagccttcctcaacagcgggaggtagagtggggaagaggtgttacaagattggggctacacggactcagccccacagcggcctcctcatcctctgtggtggcatcctcattccacttctcatctgccaccttctccaggcgggcctctagctttctcatgtactctagcaattcctgtttcccctcctgtaactgctc

SEQ ID NO: 131094 - DNA, 203 bp, Homo sapiens
tgctacgttgcccaagacggtcttgaactcctggcctcaagcagtcctcccacaaaggcctcccaaagtgttgggattacaggcatgagccaccacacccagctcacttctgttcttgacagcttgcgaagtgcattctttgtcagggaggccacactgggagagtcgccaaagcgatcttgttgctcatctagtgttcccac

SEQ ID NO: 131095 - DNA, 644 bp, Homo sapiens
ggagacagattacatctatcatcagtgaaacataatagatatacagtgactcagagtcctccgcgggccatcaaagtgtcatacacaaattttcttgaaaaatttctagtgcttacatctttgattcatttagccaatgtgtacatattaagccttgactttccttggtgtttccatctttctttgacagataggcaccacttgattttctccttttggactaatatatgacccaaaccaccatctcagtgtgtttgtaaaaatattttaaaatagttatcaacgccatctttcatgagcacatttgtcttcagtttctcaatgtttttattttgcaattggtattgtggcccaaagaagatggtcaaaagatggatgatgactaagtcaatctgatacaggggttctattattataaaatgctctcattagttaatttattcaggaaacacatgtttcttggtcatctcctatatttcaaagctattggaaaacagcagtgaaacaaacaaagccattgagccattgttatcatggagctcactttcttgtggaggcaacagatgacaaaccaataaatatcccatgtcaggtggtggtgaatgtgaaggaaaaagaaaacaggataagtagacagaaaaaga

SEQ ID NO: 131096 - DNA, 333 bp, Homo sapiens
agctgcgcctggcaggcagatcctggctgaattcagcctcccctagtcccagctccacccccaccacatcccccagaaagggccacggcaggtttctccagctccctggcaaatgcccactgccctccagccctccttccccggaagagacacctgggaggagggaaggtggcctcgcgtcaaggtaccagagccacctggctttcattgggatggcattctctgtggccccagccacagccatctgtccagcttccagcaaacaggccagcctgggcgctcacttgacactaaggaaaactcgtgctacttgaaaacgtcagagctggaatg

SEQ ID NO: 131097 - DNA, 688 bp, Homo sapiens
ttacttaatgtcatcatatcaatatttcacttcactttatctttctcatgatttttgcattattttaagtgagatgatatgcatggtatgagtctgagtgtcataacacattctacattctaagcagtgatcattgcaggagctcagccctatatattatgagctgctgaatggtgtccccaaagccacttcaggtgtgtcagaacctagaggaactgtttactcatggttacagtttattacaattgaatggatacagattaaagacagccaaggccaaaaaagcatggagccaagttcaggaaatgttcacaggtaaaccaagaagtggaagataattcaaatccctgtggttccatgctttcctatctagagaaaaaatgaaggtagaagtggaggaaaaatagtatccctatggtttaatgttttcttatctaaaaaaataaaggaaagtagattgtacatatacaaatactgatttttttcaccttttggtggtagttttccgcttatgatatattgttcagtggataatgtgtatctgcataaactggcacaagggaaaagcatggacaactttcttgactccctacgtccccactcaactcaaagcaatgtgattaagacttttgctatttcttgtataagttaagcagccataaatgaaatacaaacaaaaaaaataaaa

SEQ ID NO: 131098 - DNA, 628 bp, Homo sapiens
gcaggacgatcacctgagctcacgagtttgagatcagcctgaccaacatggagaaaccccatctctactaaaaatacaaagttagccgggcatggtggcgcatgactgtaatcccagctactagggaggctgaggcaggagaatcgcttgaacccgggaggcagaggttgtggtgagccaagatggcaccactgcactccagcctgggcaacaagaggaaaactccatctcaaaggaaaaaaaagattaacatcaaactgatacaggtggacaagacttggaaagggcacattctctctagtattctgtagacccattattaaggcctctcataagggtatgtctgtcttcatttaaaaggcctctgtggaatgagatttctcttggctccactacttctctggccctgtaaccaccttcactggaaatggtgaaatgaaagaaattctggagttgatttagttcagtctcgtctttttctgtatcagaatgccaggtactagagaggttaagtaatttgcttaaacagcaaataagcgacagacctgattggttctaggtcccatgacttccaaactggtactccttccattataccagaatttctctataacacatttgaaactca

SEQ ID NO: 131099 - DNA, 529 bp, Homo sapiens
ctcaagtgaggtcatctcacgatcaatcacattttgacatgtcttcgctggttccgcggttaattttttcaagacatgaaattggaatttggttcctaaagacactgtaaactttcagtgtcaccttacatttctgtagtagtgttaagtttctagcgtattttacagccatcgtttcatctcattctcacaatgacccttagagggagggaatgcagataagtttatccctgcattatagacaacaaccaatgaacaaaaaagtgcaagctctccaacacacacaaggtcacctcctttcctgtccctctactctttccactaaattatcagtggcagtgatggcttgattcttgatttggaaaggacattctaacatcccattcagaaagaaagagacagagaacttgacagtaattttacctaaatcagccgaatcgacttgaccagcaatctggcattggatgcagcatcaatttccccaagtggatctaagccttgggtgctcactaaaatcaccggggagtat

SEQ ID NO: 131100 - DNA, 485 bp, Homo sapiens
tgaagtatttttcaagtatttatgtttcagtatagcttaacattaccagtgtgtatcaaaagcagtattaaaaacagttgcatttgattttcttagttgatgatgggggtccccaacccccggctgcagctgtgggcaacagtccacggcagtggggccagcattaccacctgagttccatctcctatcagatcagctacagcattagattctcacaggagcgtgaaccctattgtgaactgcacatttgagggacttagactgtacgctccttatgagaatctaactaatgcctgatgaaaccacccgcctaccctctgtccgtggaaaaactgtcttccataaactggtccctggtgccaaaaaggttggggaccactggtttacacaataaaatgaaaaacaggctgagtgtgaaatcagctgtcctccagaacacctgaggcatatgctctgtctcagccactgtgaaatatcagactaat

SEQ ID NO: 131101 - DNA, 695 bp, Homo sapiens
tgcagtggctcacacctgttatcacactttgggaggccgaggcgggtggattgcctgaagtcaggagtttgagaccatcctgaccaacatggtgaaaccccgcctctactaaaaatacaaaaaaattagctgggcgtggtggcatgtgtctgtaataacagctactcgggagactgaggtaggggaactgcttgaaccagggaggtggagggtgcagtgagccgagatcatgcctctgtactgcagcctgcgcaacagtgagactccatctcacaaaaaaaaagaaagaaagaaaagaaaagcctcatgaataagcagtacacagagaattgtgtataaatgtaaacactcaaaacagctattataattttccaagtttattaagcttcctgacttcttagtcactcatttaataaatattttagagtgcctactttatgcccataaaacagaaaatgggaggaaggaaagaagtaagcaggtaactgaggcagtcaggcagtcagtcagtcagtcactcacagattcctaacatagctagaattggtcatttcaaatacactttccctctttccaactgagaaatttccaactgaggattccctccctctttccaactgaattccaagacctacttaattcttgctctccactttccatgttcctgctcctactgttatcaaaatgcatctaaa

SEQ ID NO: 131102 - DNA, 328 bp, Homo sapiens
  misc_feature (115)..(115): n is a, c, g, or t
gaggtgatctagaggatcccgtaactatctgaaaaattttagccaaaaagaaaaaaaacatatagttaaaatataggctggctgagtggctcgcacctgttaatcccagaacttngggaggctgaagcaagtggatcacttgagcccaggagttagagaccagcctgggtaacagtgagaccctgtctcaaaacaaaaatattaatttctataacaaataaattttatttagtaatatcatgtttaatacccatgttacattcattattcttctacactttggcctttaggaagaggcagtgtgtgtgttacagttaaataggaaaca

SEQ ID NO: 131103 - DNA, 754 bp, Homo sapiens
aagctcttctcaggcggggctgcctgcaggctcccgttttctgagcccacgctgcccacagctgaccccagcgcagccccgggcacgcggcactttacatgggggcagcttgggcccagactcctccgctgtgtagcagatgaggaaaatcaggccagaggacaacaggctggcgttttgttgggaactgaagaggaatctgttgaacacagcgaccagatgaccttccatttcaccggcggcagcagtttcagcgtgcagttcccaaaccccaaagctgaccctgcgccccatttgaatacggccagagcctgctggttcactttgggtagagccgtgcctcttgggcaggctcccatagtgaccacgtccccacgaatgggaaagcacgttagtgggagggacgtaggacacgtgtggaccgccaggccctctcagtccattttccggggctgctcggtgctgctgttaagacgtgagtgcatttcacttggaagaacccattgtacaaagttcaaggctaagagttctgaattctggcgtcagcttcctcaggattttcttcagttgcaagtacctttccactgaaaatatgagcatgcccgcctggctagtaggcatctgtaagagtgtcgccaggcccgcgccagctgaggcctcagactagccaggcaagagccgtctgaccagttggctggcggtggttctggtggagcacgagggagcccgggtggtgccctgagcctcgagctgc

SEQ ID NO: 131104 - DNA, 250 bp, Homo sapiens
tcaaattaatttgcgcttgtgcaggtttgttagaaactttgaagtgcttctgggtctttccatgggggttctggttaggtgtcatcacccaggccaggggattcagcgtctcccatccctttcccacctttccatgacacccaatggcatgttgactcggagggcgctcagtaactgaggaatggactgctgactgatagtgcagtttatatgttaacgggggagctatagagcctggggattggagcct

SEQ ID NO: 131105 - DNA, 371 bp, Homo sapiens
cctcaagtgatccacctgcctcggcctcccaaagtgctgggattacaggcatgagccacggccgaccagccttagtctcccgtgttttaaatcttggctcccccatttactgcttctgggacctgaggcaaacctctttgttaggtttccttgtttaaaataggaatgttcagttgttaggattaaatgagttaaaacatgtatagtggttagagaagcacacgatgaatgctattgttagcagcatttctcaaagtcagtcatacatagaatacattttggcaccctcataacacattcccatggaatagtattcttgtaggacaaccattgttatcctacctttcatcaggatttggggagatagatat

SEQ ID NO: 131106 - DNA, 688 bp, Homo sapiens
gggtttggatgaaattactggttttttcccttggaaaaaaaatctgaatatattttataatttgttagtattgtaagtaacagcctaaaaacctgagcatgtgactgtttgacactgtgcttcctatatatctgtttacagaatatttggaaaattttaaattcttccagttcttgattgctgcttgcacagaaccaatgttaaaatgttatgactaagactagagagacaatgataggtttctcggtgcacacttagtgctaggaggtcttcccatacctaccgggccagctttagagaaacccctggtttccagttgcctggttcagtactttgttagagcacatgctttaattattttcagtgttcttaggtttggttgtggtaatgaatttcttcataaagtagatctctcttttaagtgaattattaggaaatacttgtagcatgatttaagaaaaatatttcagcttcagctggaagcagaaaaatggacagaggggaagccagagagttcaggtaggttactcggagaaacagttgacacaaagcattccttattttcttattatgtatctttagaatgtaatttacacaaattgaaccatagtttacattttattctgaaccttttttctaaaaacatttcttgccatcttcctatattacaaaaataattccatctcat

SEQ ID NO: 131107 - DNA, 350 bp, Homo sapiens
cggcaatttctccttcagaacatatagcttaacgataaacttaactcacaaatatgcataaagtctctatgatctacgtgaaagcttagaacaagcatctgtctacattattttttgtaggtattcactataagcagctcaaaagcccttttataaggtaggtacacagtatgtcaactaaaactatcaagggaaaaaaagctaattatttgtctaagtatggtcctctatttgcctgtcccattccggcctctagtcccaaaagaaaactaaccccagccccttcatgtcctaccctcaagagaagagatgataactttgtgcacttagtacatgccaaacactttaag

SEQ ID NO: 131108 - DNA, 549 bp, Homo sapiens
gtactggcaattaaagcttcctccaaatggaagatatccaaattcccttttctttgagtggtttgagcaggatcgtcccaagatactggttttgcatttagactagagaacctgtaaggtaccttcagttctgagtttctgtaactgtattgaaaccactagatggacagattaaaattatctttattttgtttttttttatattacattttattttactaggattagatatggggttttgaaaaccaagggaaaattgtaagtagaagaaaatgattcttttttttttgaaaatgatttattttaagcattttttttttgttggtattttgttttgttttgttttgtttagcattatggttaagagtatgagatctggagttgtattgcctggattccaattctggctcacttacctactataagcctttgaagaagttatttagcttctcagtgttctacttccttatcagtaaaatggacatagtttgttatttatttaacctaccttatgagattatcgttgctaggattaactgaagtgataca

SEQ ID NO: 131109 - DNA, 751 bp, Homo sapiens
tcacattccgatattattatataaccacattctgacctcaagttagaatgaggtcgttagggtaagccccaatccagtatgactgatgttcttacaaaaggggaggtttggacaaaggaaaggtgatgtgaagagacacagggagaaggcagccattgacaagcccaggagagaggcctccaaagggacccaccctgcccacaccttgatcttagactttccgactccagaaccgtgagacaatagatttctgtcatttaagccatcctgtctgtggttctttatcttaacagccctagcaaacaaatacaggcagtaattctgattattacccccatttgacaggcgaggtaaccagtattcagagagatcatgaccttcacccagagtcacatgacagttaagtgcaggtggctccactaaatcccagacgggcctggctccaaggtgccggtttcctctgttctctcaatgcgccccgatgtgccacattattgaagctggagggacagcgttcctgggaaaaccatttagatttcattctccttcctttctctgacagaagctgctggtgaggaaggtaatgatcttgatcaaaccatccccagaatgcatgcctgcctttggaaggagcagactgggatgaaattctctactctgcgtcttatcaaccagaggacatgaggcaggtttcttaacctctctctaggattccgttttcttctctgagaaatgggcagattggaacgga

SEQ ID NO: 131110 - DNA, 555 bp, Homo sapiens
aattaatttaaaaaagtttgagagtaagttgcagttctttcatagtcactacagtgataaaaattgggaagttaatattgatatgatgctattatataatctacagacctcattctaaatttcaccagttatctcactaacatctttttctggcccaagagccctcatagtttttctttttcagtgttttcttgcctccatttatgcataggttatgtgcatgggttttttttgttttctccatttgaactttactctcaatttgttgagctccataaaaaatcttattggtatttttactaggattgtattaatcttgttaatttagggaaaactgatgtatttatgaggctgagttgtcctgtcaaagaacagggattatctttttatttattcagttctgtctttgtgtctttcaggagtgttttaaagttttcttcatatctaagtgttttatttcttgttaaacttattcctaaataccttctttaattcctttaatcatccttgctgctgctattgcacatggacttttcactggtgttatatcctcca

SEQ ID NO: 131111 - DNA, 424 bp, Homo sapiens
cctggtggttttaaaattattgtgctgtttttccccctcagggtggtaggggagtgattcttggacgtttattaactcaaaaagaacgcagaagttggcagaacagaactgcctggaagaaaggggctgttttccttttcactattattattttaaactttgatgggctgctgacgtcagcaaatatgcttgacgcctgtaaagcaaataagccacatcacaagcagaaagcctgtgggattttctggtgccctatttctagaaccttccctgttctgaccatttgaaggtgcttatttagtcaaccgttcaggcagctgcgaggctttattgataacaaatggcagcctatttggcccattttttttcttttatccaaatcaattatattcctaaaaggcactctctgtgagtagaagaaagg

SEQ ID NO: 131112 - DNA, 687 bp, Homo sapiens
gcaagaagatgatcagcacaaacttcagtagaatagctggtactggaagggaatcaggagaactagagaggagaagagcaataggtagatgtaatttattagtaatgttttaattctttggttgagtggtggtttcacagatgtgcattacattttaaacaaacaaaatttctagcacgctccagcagttcaagaccagcctgggtaacatggtgaaaccctgtctctacttaaatacgaagattagccaggcatgcctgtagtcccagatacttggaggggtgaggctggaggattgtttgagcccgggatgtggaggttgcagtgaactgagatcgtgccattgcactccagccaagttgacaaagtgagaccctgtctcaaataaataaataaataaataaaaataaaacaaagaaaaaaaaaaaaaattgttggggggggccgtgggccccggaaaaagtttttctaaaacctccgggtgggggggggggccccgttggtgtggcggaactgggcctaacgggtcccaagagaaacccggccggagacgagggcggggtcccccccataaaaaagcgccgggggaaacggaggcgtggaacaacccgagggtcagagccacgggtctcacggggcaaggaccgtatacccgcccgccggagaaaccacaaaacaacagagaga

SEQ ID NO: 131113 - DNA, 363 bp, Homo sapiens
gtaatcccagcagtttgggaggccaaggtgggtggatcacctgaggtcgggagttcaaaaccagcctggccagcaaggtgaaaccccctctctacgaaaaacacaaaaattagccgggcgcggtggcaggtgcctgtaatcccagctacttgggaagctgaggcaggagaattgcttgaacctgggaggttgaggttgcagtgagctgagatcgcaccattgcactccagcctggacaacacagagagaccctgtctcaaaaaaaaaataagaatcagcaagataattatccttcctgctcccacaacactactgctatcttactacacttctactcctaccttacgtcactactaccacctt

SEQ ID NO: 131114 - DNA, 332 bp, Homo sapiens
caggctggagtgcaatggtgcgatctcggctcactgcaaccttcacctcccaggctcaagcaattctcatacctcctcctgagtagctgggattaaaggcatgcaccaccatgcctggctaatttttgtagttttgtagttttgggttttttttttttctttgagacagaatcacccagcctggagtacagtggtgtgatcacagtctactgcagcctccatctctcaggctcaagtagtcctccctgctcagcctcctgagtaactgggactacatgtatacaccaccacatgtgactaatttttgtatttttgtagagacagggtttcac

SEQ ID NO: 131115 - DNA, 637 bp, Homo sapiens
gctaaattctaacctcaagaatcttactctagagctgttggtttcctcagatcagctcatctcagtgcacaatcttatggactaggatgtaaaaacacaacatgcaactctgtcactcctgccttctactgctgtcatactctgctgcttagcgcttgtcaccctctgaaatatgcacctgtttactttgttgtctgtcttgcctcctagaatgcaagcacttatgagaccatggactttgcctgcctccttcatcactatatccccagtgcctagaacagagcatggcacagttagagcgtgaaaggaagaggcgacatggagtcagaccccacattgactccttctccctcacttaccagcagcctagctggacaggtacctaaacatctccaagcctcaatctcctcataattaaaatccaaagaatgggccaggcacggtggctcaggcctgtaatcccagcactttgggaggccgaggcgggcggatcacatgaggtcaggagttcaagaccagcctgaccaacacggtgaaaccccgtctctactaaaaaaatacaaaacttagccaggcatggtggcccatgcctataatcccagctactcgggatgctgaggcagggagaattgcttga

SEQ ID NO: 131116 - DNA, 565 bp, Homo sapiens
ccacattcctgacaggaggatggaagaagaaacaaacaagatgacaaaaggaaaaggacggtgtttgctttgttgtgcaagtgcttcctacaagttaacaaacagaaattctcctttcatctcattggtcaaacttagtcacattgcattacctagctgcaagagaggctgggaaaagtgaatttatcttaagcaaccatatgcccagctaaaaattagcaagaagacattttaaggaaggcaatcagcagtctccatcacagatgtcctttcccacatctccttgtattatttggggtgttctgtgttgctgctgtggtccaatcttgttaaagcctgtgtatggatagattgatgaatgctatctctcttgttacccatatgggttaggtaaatgaggaccagttgttcctgttgcctgggtgtccctcacagtggagtaaaatacccaagaggtttagacaagtcaactgtactgctagggtatttttcaaatctaattaaaccttttttttcttttttttgctctgtcacccaggctgaagtgcagcagcacacttatagc

SEQ ID NO: 131117 - DNA, 137 bp, Homo sapiens
tcctaaatgatgacttttgataaaatttctgtattgattttttggtggtggttgttttgtttttgaggcgcagtctcactctgtctcctaggctggaatgcagtagtgcaatctcagttcagtgcaacctccgcctc

SEQ ID NO: 131118 - DNA, 252 bp, Homo sapiens
gatgtggattatttgagagaaaacatgatcccattcatcatttggtgaaagttgggaaatggggtgttgcctgggtcaaatggcacttacttacacaatgggtgactcagaatgtcatctaaggtcctagcccagccccagtgagggtggcagagctcagctaagaatgcagcaataaggttcccatttcaggccacaatgacattgaaacccagcatctttaccaaacttgaccttatttttgataaatcc

SEQ ID NO: 131119 - DNA, 475 bp, Homo sapiens
cattcatgttaagtcccttatattgataaaccatttttttatttttcatgctttttatactttattttttatttttatgccttttatctttttatgcttttttaccgtaccttttgtatgttacatatgtgtagatacacaagtacttaccattgtgttaccattgcctgcagtattcagtacagcaacatgctatacaggtttgtggcctaggagccacaagctataccatatagcctaggtgtgtagtaggctataccatctaagttcatgtaagcacactctatgatgttacaacaacaaggaaattgcctaacaatgcatttcttagaccgtatccctgtccttaactgacacatgactaagtttttgcccgtatacaatttttgtactgatttaattcatgtctgctttaatgtccaccacttggtttccatttttttctttgttcttattcttccaatatttctgtttt

SEQ ID NO: 131120 - DNA, 401 bp, Homo sapiens
gcttatgtcctcagagtggtgagggagggaagcactatgtcagagagaaggagaggatgagatcgccttgagaaaatgtcatctgggcacagatctgaccggtgtaaaggagtaagccagaaatgcaccccagttggagcaatggcaagtgaaagattctggggctggaaaatgcttccatgtctgagggctgcgagcagagcagcatggggaggaggaacaaggaggacggtaagggagaagcatgggcagaacgggtgtgctcgcaggctaccataaggactagggacttgaatgaggtggggtcactggaggagcctgagagaacccccaggctggattactttatgtcaaatactgtaaaaataattatttgggccgggcgcagtggctcacacctg

SEQ ID NO: 131121 - DNA, 176 bp, Homo sapiens
ttgtttctctatgctgttcatcttccaattaatttctactttgacttcccttccttccttccactggtcaatctaaatgcattcctggccgggcatggtggcttactcctataatcccagcactgtgggaggccaaggtggaaggattacttgaggccagaacttctcaaccagcc

SEQ ID NO: 131122 - DNA, 622 bp, Homo sapiens
gaaaagtagaagttacacatctattgccttgaggtagctttttaaaatgtttgtcttatgcatacacactgtacatagttgtaattctagaaaacataccattttatggcctttctctacccagcattcaagtataagcatttttttcattgaaaacaaatagttttcaatggttttgtaccataataattgtttccctttttaaaaaaattgtagataaaacattggtgaaaatcttactgcagatagtttgggggttatataggaaggtgatttttgttttgcttttttgattaggagtgtcaggatttctttcgtggtacatgagaaccttactataaagtggctctttaggaccgttctgaagtcagccttatgaaggtgaaatagactctgatgaaatcaccccaagtctgtggcttttgttgtaaggcagagctgctctgtgtcaatacctggtgtgtgagaacaggacgtggtagctgtcatgggaccctctagcccatcattctctagacctgcactgtccaatacaggatctactagccatgtgtggttatttaaatttaattagaattaaataaactgaaaattaatttccttattcacactggccatattt

SEQ ID NO: 131123 - DNA, 316 bp, Homo sapiens
gcactcttctacgtactggggatgtagaaaagaatgaggcaccattatggccctcagggcatttctggcctaatggagacccagatgtgtagataactcagccacacacagcatgacaggagctgcaggaagccagtatgagctccctttggtggtgctgaagaacatttcccagaagaggggccattcaaaatgggttctgatggatgagtaggagtttgccagctaggagcctgcctcctctggtgttgatgagagctgactggggtgcagtgacctcttggagcttccaatattcccagaacacttgtcctca

SEQ ID NO: 131124 - DNA, 385 bp, Homo sapiens
gtgtctccctttttaatgcaaagtgtcctcacaggtctcctctgggaactccaaaaagaatactccctttacacatgatcaagggaaaactgcctcaaggcatccatcacgttcttcctctcctgcctggagccctgacatatatcccctgtctatgcctccaagggaccactgtcactactactgctgagaatgcccatgtcctagcctatgacgatgccttctgatgctctcaaaaatccaagaatgtcacactctatcacttggagcagggcaatggagcaccaataatccacagagtgtcttatgagaacaatttcttcagctattatatgcagccctattctccacacagccatacatacgtgacttcatgcattcagtc

SEQ ID NO: 131125 - DNA, 253 bp, Homo sapiens
atattgttctggactgcattgacttttgcacccagagttatttggtttgacagactgccaaatcctgaggttcaaaagaccgtccgtcacaagtggggaaaggggccagcattcttggggttggattcccagaattctccaaatatgagtgtccataagtaagcctctcagtctaagcctccctcaggatggtggtttggttttagagatagtccctctccccaccgcaaagaatgttaggggaattctgacg

SEQ ID NO: 131126 - DNA, 688 bp, Homo sapiens
ccttgtttttgtgcaacccattagttcaggtggcgacaaaaacataactatccagaaagaaacaaagtggtgagacattttaatgagagatttaagctttagaactcaattttttttaagataaaggtggaggggttcataaagttaaggagtgtgcacactgtcaacaagatacttcctgaagcttaaaagatgtggctgtagatttaaaaggcaaatacttaagcatgacctgcagtttaaaaagggagggaggaggaaccacggactacacagtcaattcagaaatttgaattttcatccatacctccgttattcttactctactcgctcaacaacaggttctgataatgttacttctgccatttctgtttgtctttatttccagttccacaaccctgcttaggctattgtcattcgtggaacaaatatttattggacagattcccatgtgcaaggctctgttttaggtattaagagtcttgctctcttgatccttacattcttatgaaaataattttgattcttgtcagatttttaaccagctgtctttcttgttttagatgaaaactactccaatcaacttcttcaatctgttctgccacattttagccagagtaattgaaaaacaaaattcccattgctctctctttaatcattacccgccatcgttagaatgaagtttaaa

SEQ ID NO: 131127 - DNA, 256 bp, Homo sapiens
ccttgtttttgtgcaacccattagttcaggtggcgacaaaaacataactatccagaaagaaacaaagtggtgagacattttaatgagagatttaagctttagaactcaattttttttaagataaaggtggaggggttcataaagttaaggagtgtgcacactgtcaacaagatacagccacatcttttaagcttcaggaagtatcttgttggcagtgtgcacactccttaactttatgaacccctccacccagatc

SEQ ID NO: 131128 - DNA, 1035 bp, Homo sapiens
ccttgtttttgtgcaacccattagttcaggtggcgacaaaaacataactatccagaaagaaacaaagtggtgagacattttaatgagagatttaagctttagaactcaattttttttaagataaaggtggaggggttcataaagttaaggagtgtgcacactgtcaacaagatacttcctgaagcttaaaagatgtggctgtagatttaaaaggcaaatacttaagcatgacctgcagtttaaaaagggagggaggaggaaccacggactacacagtcaattcagaaatttgaattttcatccatacctccgttattcttactctactcgctcaacaacaggttctgataatgttacttctgccatttctgtttgtctttatttccagttccacaaccctgcttaggctattgtcattcgtggaacaaatatttattggacagattcccatgtgcaaggctctgttttaggtattaagagtcttgctctcttgatccttacattcttatgaaaataattttgattcttgtcagatttttaaccagctgtctttcttgttttagatgaaaactactccaatcaacttcttcaatctgttctgccacattttagccagagtaattgaaaaacaaaattcccaaagtgctggaattacaggcatgagccacacaccagcctgaaatctggtatgtattttctaacgactactttaccatgttggcttcatcttctttttttaagactacttttacatgttgcttcattcgtaaggaagaacagaagatattgaacttgatgggttaaaaggtcacttcattatctttggggtctatgacagtcttcgatttgttgtgaatgaaatattttgaagagttacttaatttctagaaaatggtctataaacacttggggaggattgagctggttttaatacaacttggggcccatggacatggaaatcaccgaaaaatgctcaggggaggtaggtacgcagcatgaacagaacaaagatggtatagaaagcaaaaatgcgta

SEQ ID NO: 131129 - DNA, 242 bp, Homo sapiens
gagtgagaatggttcaagctaggtattgttccttctcataggtttgctgcctctctccccatcctattcataggaagtgggcagaaggaaagtagggcagccctcagtctctatacctttactatgggattcacttagatgggggaacaaggtcttttttttccttgctgctgcagcacaagacaaaaggggctttaatcagctatctctgccatacaggtatgccatgaaaggcatttgac

SEQ ID NO: 131130 - DNA, 139 bp, Homo sapiens
ccggtaagatggaccttaaaaaatactcacatcaaacgttccgcatggaggaggaggagcagcaagcctcttcaggtggctttcttcctctaggtgtgcagggaccgctctgagataagacagaggtccaatcttccgg

SEQ ID NO: 131131 - DNA, 243 bp, Homo sapiens
taagatggggtctcgctcagttgcccaggctggaatgcagtggtgcaatcacagctcactgtagccttgacctcctgcgctcaagcaatcctcccacttcagcctcccaagtagctgggaccgcaggcacaagccaccatgcccacgcctggttaatttttggttggcttgtcttctctttttttccctttagtttttttttctgtgacacagattcaggagggcctgatgacatgtaccccc

SEQ ID NO: 131132 - DNA, 637 bp, Homo sapiens
gtggccaagtgctaacatgccttggttcaagggatggaaagtcacctgtaaagatggcaaatgccagtataaacaccctgcttgaagctctggattgcatcctactaccaatttgtccaactgacaagcccttgtgtctgtctctccaaaatatctacaaaattggtggtattggtactatctctgtaggccaagtggagactggtgtcagcatagaggtcaccttggctccagtcaatgttacaactaaagccaaatctgttgcaatataccatgaagctttgagtgaagtttttcctgggaacaatgggggcttcaacatcaagaacgtatctgtcaaaaatgttcatcatggcaatgttgctggtgacaggaaaaatgacccaccaatggaagcagctggcttcactgctcaggtgattatcctgaaccacccagtccaaatcagtgctggctatgctcctgtaatggattgccacatggctcacactgcctgcaagtttcctgagctgaagggaaagacggattgccattctggtaaggtgaaagatggccctaaattcttgaaatctggtaatgctcccatctttgataaaattcctggcaagcccacacgtgtgttgagagcttctgacta

SEQ ID NO: 131133 - DNA, 370 bp, Homo sapiens
aacttcccaggaacacgcacgtaatcttgccactttctgtcagccacagccatgctagcttaaaacccaggcctggcctgtatccccaagcctacaagggacctgccccagagcagccagaatatgctttgttctagggcacagccactgaagggcaggactacttgtggatgtggcagcagttcttgggatgactgatgcttctggagcgagaacttgctgttctcagaagcagagacttagaaaacatccccaagcagaaagcttcttcctttgtccgttggaaaactctgtggcaagacatttgtagctaagaattggagtgttcaccaaggacattatctctgccgtgccttaaaatcaatcaata

SEQ ID NO: 131134 - DNA, 567 bp, Homo sapiens
gcgctgatggctcctaaggtgcccgattgaactaaaagatttcccacattctccacacccataagatctttctctagggtgaactcgctgatgtagaatgagggtgcctttatgactaaaagatttcccacactctccacactcataaagtctgtccccagtgtgaatttgctgatggttcctaagatgtccttttgaactaaatgatttcccacattctccacactcataaggtcttgctccagtgtgaactcgctggtgtagaacgaggttgcccttttgactgaaagatttcccacattctccacactgataaggtctttctccactgtgaactcgctgatggtgaacaaggctgcgcttatgactgaaagatttcacacattctccacacttgaaaggtctttctccggcgtgaactcgttgatggctcctaagatgtccttctgaactaaaagatttcccacattcttcacacccataaggtttttctccagtgtgaaatcgctgatgttgaatgaggctgctcttttgactaaaggatttcccacattctccacattcata

SEQ ID NO: 131135 - DNA, 228 bp, Homo sapiens
aggtaactttacccttctgaacctctctcctcataaataaataacagtatttgcctctcaggtttgttgaacagatttagtgagaaaacatattaaacaccaaatagtagaatgattaaaaatcattcccggctgggcgtggtggctcacgcctgtaatcctagcactttggaaggccgaggtgggtggatcacgaggttaggagttcaagaccagcctggccaacat

SEQ ID NO: 131136 - DNA, 360 bp, Homo sapiens
aatgatgagacttttgggcactcctggccttgggaagttggcctgacatggtctgacttcagggccatcaaagcactgtcttgagggactgctctgaccagtcacagctgagtgacagagcttaagttggagccagcttccttgtgcaacggtgagtgagcctacaagaaagacatttcctacaggagaggcctggcctcctctggacatggaagctgccctcctatggtgagtgtgagaaggggcacccagtgtgcttcctcttggggtgcagcggtgtggccggcccaggtatgtggaagagctgctccttgttctttcacttagagaagtctttgtcggttctattagccaggggtg

SEQ ID NO: 131137 - DNA, 935 bp, Homo sapiens
cagctgacagcacagagcctcaaacagacacatggaggggctgccccaggaccaggccgccaggacgcagccaacctcaaacctcatccttccccaccagctggagccagagggaccgcctcctgcccttgaggccatgtctgaacgggcagaatccttacagcctatcctgcttgtggactagcagagccagggctatagtgaccacagtgtgagctcattgacagcggttatgggatggggagcggagggtcagaaaacctcaccccacccagctcagccgatcagccttacggagccctgccctaggccacgagcctccagaggccactcagcccagtgtggagtcaccgagtctgtgtcctgggagagggaatatgttgtcaccagcattggatgcggaggatgagggggcagctgattccttagcacgaccaatctttttctaggttttcctctcaccgcatggggccaaaacagtacagagcatgagtttggtaccccaagcctgagcagcgggtctacgctgatgccagggaggatccggaccgtgcttccgggggcccccaaccagcatggccttctcagcctggattctgtatgggttagaggcaaatgcttcatttttctgcacagtgtacacgttccttaataagcgaagtgtggggtgatttctaaaaggatttaaatggccctcatcagccacgtcctgctgagcttgctgggtaagccctttgaggtacctgatgtattgcagggagcagggaaaggaaaaaggattttttttcagaaatgcctgtaaagtgaatggagactagacaccgtccagcttcaagaaggctcaggactttcaacaaagggagcatacctgacctgagagctgtccccatcctctctggaagcataaagaacagtgagcactggctaatcccatt

SEQ ID NO: 131138 - DNA, 495 bp, Homo sapiens
taaaaattaacaccaatcctcctcagacttttccaaaaaacagaggagagataacttatttcagcttattctgtgaggccagcattaccctgtgatatggtttggccgtgtgcctacccaaatctcatcttgcattgtagctcccataattctcacgtgttatgggagggacctggtgggatgtaattgaatcactggggcgggttttcctgtgatgttctcataatagtaaataaatctcatgagatctgatggttttataaaggggagttcccctacacaggcctcttgcctactgccatgtaagacgtgactttgctcctcattcgccttttgccatgattgtgaggcctccccagccatgtggaactgtaagtcaactaaacctttttcctttataaattacccagtctaggatatgtctttattagtagcgtgatacaccctaatatcaaagccagatcaaaaaaactacaagcagctgggtgcagtggc

SEQ ID NO: 131139 - DNA, 1205 bp, Homo sapiens
aattttctcagcattacatttgatgctacagtaggcacccacacatttatgtttcttttctgtttttcaactattgttggttgttctgaggtattttcgtaaggtttcacttctgttttcccagccatgagtgatacatgagcacaactgttttgctattaatcaccagcattgggtgtgaaaatttactcaaagttttgctaaatttaactggagtagaaatgggccatgcatttgtgcgtacttccccagatgctttttagaacagtgcttgtgtaactgaccagagtgtcaggtgaggccattgttggcagaaaggtgccttcctcgggagaaggtgggttacacagcttttctttgcagatgaatggtgagagccaaacccgaagacccacaggtttcaagctggccatgtggcttcactaagtttggcctcaacttcccacagtggcacagaagcgaggtagaactcagtgttcctacccgaaccctggacattctgaaatgtccacagcccgaggaaagggatgacctgcatgtcactttccataccctccactgcacatagatctgtctcaggcattgaatcagagggatgtgtgactttggacaaattatgtttacctttctctgcctcatttcttcatctaaaatcaggtgacagcaatgtctccctgtaatattgcagtggggattaaatctgttaatacttgaaaagtgctgagatcagtgcctggcacataagtagtgctcaataactgttgtaaacctgggtttggatctcacttccattgctttctggaggcccactttggtcaaatggctgacctttctggacttcagcttcatctgtaaaatgggattatggcatctacttcagcatcatgttaggggtttaagtgagaaaatgcatttcacacagtgtcctgcacataaagggcccaccatatatgtaatgaaaaacaaacaaacggccgggctcagtggctcactcctgtaatctcagcactttgggaggcccaggcgggcagatcacgaggtcaggagtttgagaccagcctggtcaacatggtgaaaccccgtctctactaaaaatacaaaaattagccgggtgtggtggcgcgcgcctgtaatcccagctactcaggaggctgaggcaggagaattgcttgaacccgggaggcggaggttgcagtgagccgaga

SEQ ID NO: 131140 - DNA, 388 bp, Homo sapiens
ctggtagaagcctctagcctcaacctcgattcagtgaccccacgaccactgcacctgcacctcccagggtggcaagaccaatggaggacagaccccaagccagagctcaagtctgttctcatcccagctagggtggggagcccccaaattaaaggctcctctttaactcccccagctccacccagcccccgaggctggcaggagcaggcctggcatgtcccagcagtgcccgcccaggcgtgggtgggcaggaacagcagctgggtcctggcacacacagctctgtcagaggcagggaagccaggagagtcctggaggaagtcaccctccccatctacactgaactatgcccttccctctgccccacctggctaaggctcgtgtccat

SEQ ID NO: 131141 - DNA, 277 bp, Homo sapiens
atttttagtagagatggagtttcgccatgttggccaggctggttttgaactcctgagctcaagtgatccacccgccttggcctcccaaagtgctgggatcacaggcgtgagccaccgcacccagcctcctttctctacttcttaaagtcttaaggcttattgtacatatttaaggaaaagcccaggtcagatgttcccactagctttggtaaaatgaaggggcttgcaactttctgggagtattactcctgtttattttaagtttcaggtttaagca

SEQ ID NO: 131142 - DNA, 176 bp, Homo sapiens
tcaagaactcctgctccagatacgccaccagaatggaagaaaacatctggccctatttgatatcaaaccacattagaaaatgccacagtacgattaagtctttcataagataaaaagaaaagcttcaggccaggtgcggtggctcatgcctgtaatcccagcactttgggaggcag

SEQ ID NO: 131143 - DNA, 415 bp, Homo sapiens
cacaagctaaaatgtgctgaatatcatcagttatcatgaaaaagtaaattaaaaccacaatgataccacttctggtcaagatggagtgaataaaggggaccagatatagcctccttgcacgaaataataaaaacctaataaaatgaatgaaacaacagcactgaagatattggacaagcaacaaaacacagtcatccctggaagacaaaaaacaaatgggccgcacgtgtgcccagcttactgccttgagagagtttccaggtcgtggaacagggaggaggaacccaggcagagcctgtagtctccccaagttgaggaaatgaagctggaagtccaaggaggccaaggtgcctagagctcacagtaagcaataactacaaaagaaaacactgataaattaaacttatcagatata

SEQ ID NO: 131144 - DNA, 515 bp, Homo sapiens
agtacttctgattctacttcctaaaatccattccttttcctcagttcccactgccattgtcttagctgaggtcttaattatctctgcttcccatctctctaagccagcccccatctggccaataattctttttccaaacacaaatctgaccggatccttcctctgcttaaaaactcaaaaatggcttcctataggagggagttcacccttctcagtctagcagtgtaattcctattacacgctattccctacctgccattgactttgcataccctctttcctttgttcaaaacacactttccctaggaactcctagtcatttccaagaccctgctcatccatcacttctgtggtgtggacttcacagataattctggggaaggatctcctgccctctcccctggattagtcagtgccctgtagctactgctattacaatgtatattatcctgaactgcagtttatttctgtatctgtctcacttaccagactgaagctcctcaaaaacagaaacc

SEQ ID NO: 131145 - DNA, 443 bp, Homo sapiens
tatagtctttgactctttgctccctcaatggcttctggctgcttctagtaggtaaatagatgctaccttcaacttgggggtaggttttggagacatcacttttaaccatatctggaaatcactttagccattacattcaagtacaggagtagatagtattgaaagaaaaaactatcatttcattttaatatactgtgatttttcttgccctcctgtctcctatcactgacaacctgacaactgtacctgatctctctctctcttttcctaatgattccaagcttcaaaactaacagaaaaagcagttttgcccttctttttatttcttatctctttgttgatgatccaggatgaagtttaattgaagttggaatgttctatacttaaaaaaaaaaaacccatgctatcttgctatcactattctatgaatcagtagaaaacta

SEQ ID NO: 131146 - DNA, 224 bp, Homo sapiens
ccaaaacacaacggaactcctatttgcactgaactgagtttggggatatgagatgagtgaaacaccatgcctgctctcagaaagcagacaacctaataaggagataaacatgtaaacaaacacaagcattttactccttgtcacttctttgctgccaggccctccccttctcctggacctcttcatgttggagtgcccaccactcagttcctggtcttcttctt

SEQ ID NO: 131147 - DNA, 168 bp, Homo sapiens
agcctgggctacagaaaaagatcttgtctttttttttaaaaaaatagctcaataagcatttgctgaacaaagaaataaatatgagataccattaacatataataaaactgctacttaataatactgaattattattatcaggtccaatttaataatgatatggctcta

SEQ ID NO: 131148 - DNA, 251 bp, Homo sapiens
aaggaatgaagataaactagtcaggaaaatctagaaagaagatattttcatttgatttcattatgctggtaagctttgtgtgattttgaaaatgaggcagatggctaatcggagaaaactgccataaaagttttattttgaggtatctgggacaagtcaacataatcttttaccagttcttggggtcctgaaaggttttaaaatggccttgataatgatgagctgtaaaaattaaacatcctcctcccccc

SEQ ID NO: 131149 - DNA, 527 bp, Homo sapiens
gactttctccacacattctaagatgtatacttagggcaagaaagatgcctgttacgaagcagcactgcctgtctttcctgtctgcctcgtgcctgagtgcaggaatgaaagagcaccaaaaattgggggcagcggcctgtctgtccgccatctgtcctcagcacactctcttcttgtcacctgactctccctgcatctctcccacttgctcgccacctcaaccgcatcacgttcgaacgggtgatgggtggcaactatccaaagagggaatagaaagagagtccctgtaggtattaaataggtgggagttaggggacctgggctccatgctgacatgctgggaccacaggcaagccccttacctggaagggcctgcttcctcctccctcttctataaaggccctttcaggtcatgactgaatgaagtgaggtgggggaggagtggcttggtttagttaggatctctattttccactttgctttggccttggacacctgacctaaggtgggtccatcacccacgttac

SEQ ID NO: 131150 - DNA, 592 bp, Homo sapiens
ggtggatgtggctaggtgggtgggggcaggagaaggtgttccaggggcagcagcaggacaggcaaaggtatggagtcagggcaggtaggaagtgggtgtgcagtggggcaggaatggtggggctcccagtccagctgaggcagaggtgctgggggagtgctgaggaggtaataaagggagtgggctgtggaggtctccatgtcagccctgggagtttagcccagaccctgaagcaggagggagccactgaagagttcgagcaagggcatgcccaatgaaagatatttccaggtggctggaagtcagtgatgggtggcaactatccaaagagggaatagaaagagagtccctgtaggtattaaataggtgggagttaggggacctgggctccatgctgacatgctgggaccacaggcaagccccttacctggaagggcctgcttcctcctccctcttctataaaggccctttcaggtcatgactgaatgaagtgaggtgggggaggagtggcttggtttagttaggatctctattttccactttgctttggccttggacacctgacctaaggtgggtccatcacccacgttac

SEQ ID NO: 131151 - DNA, 356 bp, Homo sapiens
agggtccccctgcggcccttcagctcctcagatgcaccagaggccatggaatccaaaccccaggcaggcatctcaccactgcagaagcccagatgtcagggcatggtctctcagtagaggtcctctcacaggccaaggtacatatgaggactgcctggggcctggcagaccccagcaccctgatgggggtgtcacattgcccatgggaattccacagtccttggctgtcatgacaacatgctgcagtgatccccgagctgcatggcacccctccatcgtggtggacagctcatgtccctccaccttcaggcagctctggacccacccctagcttggctaggtcttcattcttaagc

SEQ ID NO: 131152 - DNA, 423 bp, Homo sapiens
ttttttttttcttcagagatagggtcttcctctatcacccaggctggagtgcagtggtgtgatcctagctcactgcagccttgtccccttgggcttaagagacactcccacctcagcctcccaggcagctagggctacaggcatgcatcaccacacctaggtaatttttttgtttgtttgtttgtttttatagagacagtgtcttgctatgttgcccaggcaggtcctgcgctcctggcctcaagtaatcttcctgccttggcctcccaaagcagtgctgggattacaggtatgaactacctcacctggccctaataagtcttaatattaaactttccttgtttaaactactatgcagtttctgctcccagactgaactgatgatatactccctttactagtagcatttctgcagtaggccca

SEQ ID NO: 131153 - DNA, 195 bp, Homo sapiens
tgcatctcccacagcatctagcacagagctctgcatatagttggggctaaagaaaagtttattggacaaaagggctgtttctgtttgcacagactaaaatctagttacttgggcatactaacaatttagatggctcttgagccgtttgcttgagcctgctcctgctatgtggagtgtactttcatttcaataaat

SEQ ID NO: 131154 - DNA, 114 bp, Homo sapiens
tgtgagatatatatggtttgcaaatatgttctcccagcctatagcttgtcttttcatcatcttagtaaggtctttcagagaataaaagttttaaataaaagttttactttaatt

SEQ ID NO: 131155 - DNA, 403 bp, Homo sapiens
tattcacttttcagtgagggccagtgacatttatgctgcctaacgtcatcgcataggaaaagttaccttttattggacgggatttgactatagtgtcccaaatgcgcttctccgtcttagcccatctcttaaaacaccctgattaacgatatactaacagtcttactctcttgagaataggctgagaattgggataggtgaaggtttggataggtgaaggcagagaaaattattttgaacattttactggatacagttgtacctgaatttatatgaatgtgattttacggttctgtgtttttccatttttcagtacttcgatatttgtttggaaaggaaagaacttagagatgtaatagcatttcatattgaggatctcaagcaatgtaaacaaatgtagctt

SEQ ID NO: 131156 - DNA, 567 bp, Homo sapiens
  misc_feature (51)..(51): n is a, c, g, or t
ctagacatcgtgtatctgtgctggtgtgggagaaggcacagtgtcagaatngcagcctggtaaggctggtcgctttccctgcctctctgttagctgtggaggaaagaatgggatcagcttggttttcctatttccaggccatccaatggctggtggctttggaatataacctgatcttaccccgaccacctcccttttgttccaaatgggtgagaaggtaaagaaacagatacagaaacctttttttgctgtttctctttcctctttctttctagatctctgaggcattccctccccactgccctccctttactggaatataatggaatacagaaacgtctcctttcgcctcatcttccattcccttattattattttagctactaggaattagcattaggaagaatcccagcaagcaagaggtgtaataaagataatcatttccaagaagggaccagcccagtgttttgttttgttttagattttaggctctttgagtgcaattttcctccagttggtgataaatttttagccgctatgaggtcttttcactttttatcacgtatc

SEQ ID NO: 131157 - DNA, 258 bp, Homo sapiens
tatctagagatccggcgagtgatggtcatgctgtatcccagcatttgcgagcatgtggcagatcacagtcaggagtcgggagcagttgacaatggtgaatcccgtgttaataaaaatgtatataaataagccagggtggtgggcacctgtaatcccagctacttgggaggctgaggcaggagaattgcttgaacccgggaggtggaggttgcagtcagccaagatcgtgccactgcactccagcctgtgtgacagagc

SEQ ID NO: 131158 - DNA, 570 bp, Homo sapiens
gtgtctttcaggaaagaaggggaaatttaacattctcaaatgttgaaaaactaaaagaacttgtcaacattagatctatcctaaaagaataactgcaggaagttctctcaacagagaggaaatgataaaagaaggaatctgggaatgtcaaaaagaaagaacagtgaacaagttaaaatgtggacaaatgcaactttcttcttctcttgagatttctaaattatgtttaacagttaaagcaaaaattatagcactgtctcttatggttctaaacatacacagaggaaatatttagggaacgattttataaatgggggagggtacagggacataatggcaagtaaggtttctacactttacttgaactgtaagatgtaaccatatgtacatagtaataagtcatgtatatatgtaatgtagtacctagaacagccatttcaaatgctattcaaaagagatactcaaaatcaccatggatagatgaagatggaattctatatttagaaacacattgattggaagaccagaaaaagaactcagagacatgacagagaacaaacagaaaacaaa

SEQ ID NO: 131159 - DNA, 623 bp, Homo sapiens
tgatctggccctccaaggctctaacagacagctggtgtccatcacaaccaatcttgtggacctggtatggggatcagagaggccaccggttccaaatcaacccatttatgccctgcaggaggcattcacagggagcacttggcaggagaaagtatctggcgtccgaagccagatgcagaagcatcaaaaggtcccgactgccgtccttctgtcggcgcttgaggagacggcctggctcttcaaccttcgagccagtgacatcccctataaccccttcttctattcctacacgctgctcacagactcttctattaggttgtttgcaaacaagagtcgctttagctccgaaaccttgagctatctgaactccagttgcacaggccccatgtgtgtgcaaatcgaggattacagccaagttcgtgacagcatccaggcctactcattgggagatgtgaggatctggattgggaccagctataccatgtatgggatctatgaaatgatacccaaggagaaactcgtgacagacacctactccccagtgatgatgaccaaggcagtgaagaacagcaaggagcaggccctcctcaaggccagccacgtaagtccacgttcaggcagac

SEQ ID NO: 131160 - DNA, 749 bp, Homo sapiens
gtcatcctgagtagacgcacccatccatcatagtgactcaaggccaccagtagcaagctcttcagaaaagttatggagtagtactttgtgttaaatgagctaattaagagacacaaaccaacatcatttttttttaatctctcaggatgaggatgttgtgtggatagattactattctgatatttagaacagaggtttgtttgtttaaaaattgtatttatttaatctcccaaaacaactgagaaggctggtttttctactcctggtatgctaccatatactagatttgtctcagcatcagatcttggctaatatgagctcttctgacaactgtagacacagagaaattggggtgtgtttagttagaatatttactgttcttatgtgtgttgagaatatctcagttgtggtatagcctcacctctaagcaatgacatcatgacatatattcaaattatattctgctttttttgtcttagatagaaataaacaattacatggaattttcataggcaaattaattaagatgagagcaatcagtctttgcctagtctccttcccaccttcttctcaaagtgatttattaataaactgcatctgaaataattaagaggtagaaaataaaaatctgaagaccatatttcatagcagacttcaattttatatgaaggtctcaatttattcattcctccatcaccaccatctttcatagccaaagtactcatctctaaatggaaggtttctaaaat

SEQ ID NO: 131161 - DNA, 398 bp, Homo sapiens
acaggtgattcttatacatgatcaaagttaagaactagaaattttatacatttattttctgtcattaattccctcctccatttcttagtctaattacaacatattgatatagttaagcacctttttaaaaatataattgcaattagacagtgttagaaaattaggtttaatttgtttttcttttcccagttgattatcgcaatagctgccatttattcttatgctatgctcatccatttttccctgttgtataaatgatatttaagggattagtatcaaaatagtatttttaagagaaagtcttattaaacattgccacatgggagacgtaaatccagggcaattctaccaggacagcaacctctctttattccccatcctgcctcgataccaattta

SEQ ID NO: 131162 - DNA, 755 bp, Homo sapiens
agaaatagatttaatagtaccaaggtacattgttgttataatgaagaaggcgagaatagtttttattaccttaattgacgcgcttttataaaacgtcatttgcatctggattctaaagggaacgtgaattatttttgcacgattatgatttggagtaatattgaaatattaaaaaaattcatccttttattcttaattgaattccaatgcagtaacttcaaaacaatggaaatagcatgaggccagaaaggggaaagggagtagttgacactttgcataccaccagtaacatggaataggagggatgctacaattataggatgctactaaatatgaaaatttattcattaattcagcatttgtacactgagcatctactatgtgtcagctatcaagtatgtaatgatgagcgaagaaaaaaaaacaaaaaacaataatcaacccaaaaagtaatactgtcatgtagattatagcattaagattatccaaaacttaaacattctacaaatagatgtgaaattaattacaagtgttaaagtgttattactgctacaaaagaaaggtaatgttttgcaagatcatagaatagtcaacttaaccttgtagaaagatcaaggaagtcttcccaaggaattaaatgatactttcattatctttgctttacctgtgaagagctgaagtacagttaaataacttgctaaagttttcacaactgctaagtgataaagacaggactgggatccatgcactggtgc

SEQ ID NO: 131163 - DNA, 358 bp, Homo sapiens
aagttttagtagtctgaatattgctatacaaatcgaggctctttggtggttaaaatcacactatgaaaatatttaaacaaagattatgattcatagcattgtaatttcagggctaggcacggtggctcatgtctgtaatctccacactttgggaggctaaggtgggaggatggcttgaggccaggagctccagaccagcctggtcaacacagtaagactctatctccacaaaaaaaattttttttaattagcccagcatggtggagagagcctgtagtcctagctacctgggaggctgaggtaggaggattgcttgagcccaggagttcaaggctgcagtggatcgtgccactatacc

SEQ ID NO: 131164 - DNA, 262 bp, Homo sapiens
ccagctgctggcagggcccatggtcaagatggacagtgggactggagtaggaatcaggggagggaagacaaagaaaagccagccattgccattcactgagaatcactgttgctttctaaagtgacccagttgatgtggcaggactcctgaagatgagaattcactgtgtgctggtagggaggtttacttcatccctttatcaggctccaggcctttgatgccactgccctgctagggtggcaagtgggtttcattccacctg

SEQ ID NO: 131165 - DNA, 468 bp, Homo sapiens
agatgagctcggtaccggtgttatcgatccaccaaatggatctgctttttccttccagtcttcccaggtgccttggccaaactcaaaccataaataaaaggaacacagacaccaggcatggtggcttctgctgtaataccaacactttgtgaggctgaggaggaaggattgcttaaggctaggaattcgagaccagcctggcaacatagtgagaccctgtctctacacaaaatgtaaaaattaccctggtgctgtggcacggacctatagtcccagctattcgggatgatgaggtaggaggattgattgagcctgggagatcaaggctacagtgagccgtgttcatgccactgcactgcagcctaggtgacagagcaagaccctgtcccaagggggaaaaaaaaaggatagaacatctgcaagtccaaacagtgtgccatattcttcctttttttttttttttgagac

SEQ ID NO: 131166 - DNA, 379 bp, Homo sapiens
  misc_feature (108)..(108): n is a, c, g, or t
aagagcataccctccaatgtcacccgattatctttgtataaaacacattcatgtagatcagtctccctcacttaagcaataaaataagcaatgtcaaggcaggctggntcctggcagtccaaactccggcctgctaagccacaggtcctcataacttgatcttcagagagtgaccatttacagtgtttacattagtgctacacaacacgtaagcatttggtaaggtgctcatgtgaaattcagtgtccctgaaaaattactccccaaatataagcaaactaattccaggacatcattttcagattcttccataacttccaaggtttagttcttgaactcctctactttctcattggcaagttaattaaggaaggataaa

SEQ ID NO: 131167 - DNA, 636 bp, Homo sapiens
tgtggtggctcatgcctgtaatcccagcactttgggaggcctagccgggtggattacctgaggtcaggagtttaagaccagcctggccaacatggcaaaacccagtgtctactaaaaaaaatacaaaaattagccaggcatggtggcaggcaactgtaatcccagctactcgggaggctgaggcaggagaattgcttgcacccagaaggtggaggttgcagtgaactgagattgcgccattgcactccagcctgggagacaagaaagaaactccatctcaaaaaaaaaaagacaaaaacaatacaattttaaaatgggcaaagggtttgaacagacacctctccaaaaaaagagatacagatagtaaataagtcatcatttgtcactagggaaatccacattaaaactgcaatgagatatcgctacacaccttttagaacagctaaactgaaaaaacctgacaatactaagtgcagccaaagatgcagagcaatcagaattcttatacgtttctaatgagaatgcaaaattgttcagttattctgagaaatcgtttgggaattgcttatcgagttaaacatacacttatgtgatccaactaagccactcctaggtatctacctacaataaatgaaa

SEQ ID NO: 131168 - DNA, 406 bp, Homo sapiens
tgggttgtgtggggttgtcttaatcattggtggtgggggtgggttcattataaattgctggaagagggcaaagggaaaccagtgctgaatcctagtacctaagtctgaactgtagtcccagatggctccaccgggaagtccaaagctcagcaaactttggtgccatgtggagagggttgatgaagagggaggaaaccttcccggccccactcccagtctcccttctaggcctgtacctggatgcggctgcctcacctggaaaggtgagctgtgagcctgactctcatcctctcagccctcacactcaccttttaccatccgtgccctgacgctaaccctcttttcttcaatcttcaccctcctgtacttgttaaggagtcctccccaatatgttgcctgtcacatc

SEQ ID NO: 131169 - DNA, 760 bp, Homo sapiens
tcttaataaatatcatctcatttagtctgtacaaaatgctgtgagtttggcaggattatccctatttgaaatatgaagaaactgaggttaagtagcttacccaggaccatgacactgagcagcagagctggggattaaacccagattcaaagtccttcttcctcttgtataatacatgcagcaaaaacatgtcagattctactagaaatgatattcttcctagtaattgctttttgtttaataatgaagaaaaaaatctagatgattaagaggaaatatgtgaagacaagttttttcattaaaaataattggggctgggtgcagtggctcacgcctgtaatcccaacattttgggaggctgaggcaggcagattgcttgaacccaggagtttgagaccagcctgggcaacatggcaaaaccccatctctacaaaaaatacaaaaattagccggctatgttagcgcatgcctgtaaccccagctacgcgagaggctgaggtgagaggatcacttaagcccaggaggcaaagtttgcagtgagccgagattgtgtcactgcactccagcctgggtgacagagcaagaccctgtctcaaaaataataattggttaaacttttggaaaaagtcacacaaacctttaccagtgtgtgtggaaggcagtgggcacttgtaaacactgttaaatgggtttctttactaatggcaaatagcacagagaaaagcaatgagaacattctgaattttagagcacatctcat

SEQ ID NO: 131170 - DNA, 552 bp, Homo sapiens
gcataatatcccggtcccatctccttctctcctgaactacagttgacaatgccaacaaacaactcgagttaaaaagtgggccatgccggctgaaacatcgttccaatgcctgtgatttggctgatctagactctggctggtcatagttacagctctgtcccttagttctcatctggggtgcagactgtattttgagcaaaaatctcttcttcaccaatgttcttttgaatgtgaccttgccatagagaaaccagcttgttctagttttcctgggactttcctagttttaaaatggaaagacccatgtcatggtaaccccctaagtcatggggaaacaaagaagttttatcactctaccttaccattttcctatgaaaagggatagtctaattcctttcttctacaatcttgtctgtccttaatgacagccttgtgccagtagaatgttcccaaagtgatgctatatgacttgcaaagctatgtaaaaaaggctgtgtagcttctactatttcttggaacatttgctgtttagaagctttcatctgggacact

SEQ ID NO: 131171 - DNA, 730 bp, Homo sapiens
gaataagaagtattgaggatttattttattttgaattggttttaagtatggaataattgtctttacagttataaaaagtaattagtggtgtttacgaaatgttgggaatttctgctttgacaaatagttaagtcccatggccttcagagagagaggcagtagtagaaactttcgaaaaagtaacatttctctggatttaacatggaactagaaaaatttaaagaataattaaaaaaccatggtaaatgaaatttggtgattatatatagttttggatgttaatgctagttgagagaagagagaaaaaatagcaagtagaagcagagaacaggatcattggaagggacctgagaaattgctgctttatccattttagcaaacttattagcacggcatgtaccagtactaggatcttgagtaagagtgtgtgagtttagctctgcctaatatattactacttgtgggatctttgggagactatgtcctctttgagattgaatttcttctataaaatgagcataatgctaccttacttaaatttaagggttatcatgaagataagtgaaatagtaaaggactacaaaagaccaagggaataatgaattttttttttgtagtggagaaacgcctggggagaatatatgacctaaggtttctgtagtttatgacctaaccaggcccagaacttagtttttcaaatcctagtagtgtgttttttctgatgtgccaa

SEQ ID NO: 131172 - DNA, 626 bp, Homo sapiens
taccaattttgagccccatcagtagtcctcatattcatctgacatttgataatttcagaattaaaatttttttccatctattgaggttgtgtttgagatatattgagatattcttcatagtcttttaaaaaagattttttgttttgtcttccatatttaatctacctgaaattgatttttgtacatggtgttagaagtacagtttcctttcccctgcacctaaattatcatattagcattgtgtaccaatttattctaacctccttaactattcagtagtgctagctctattgtaaatcaagtttctctttatatgcatggatttcttatgtctctgttaccttgatgtgtttgtctgtgcctataccaatatcatgttttcttaaatactaaagctttgtgttaaatcttcatgtctgtctgtcaacctttttcttcataagagtcttgacttggccttttgctctgtgacaaatttagaatattcatgagaatgctcccctccaacacaaaaagaagtattgagtttgtaagtggaattgcattgactttagttttctttgtggaagaatcgataagtttatgtattctttcatgttttctctcaaagttttatatttttttca

SEQ ID NO: 131173 - DNA, 240 bp, Homo sapiens
ttggacttgcaaacactagcaacaatttccttagaaaagcaattctgaaaaatcaggagtccctgttcaaagaatgctctccaaaagctatcgggggcagaggaattaaggagcagatcgtaaaacaaaatacatcaaacatataaagcatccaagtaggaggctttggatctccatgaacagttggacacatcagccatagcagagcagtactgggcaattggatatatgcagagaaat

SEQ ID NO: 131174 - DNA, 344 bp, Homo sapiens
gtatgaccataatggaattacattattatctatccatctatgcgcacgcatacacacacactttaaatacagggtctccttctgtcacccaggctggagtacagtggtacaatcacagctcactgctgctttaaactactgggctcaagcaattctccttcctcagcctctcaagtagttaggactacaggtgtgtgccaccacacccagcaaatttttaaattgttttgtagatatggggttttcctacatcacccaggttggtcttgaactcctggcctcaagcgatcctcctgccttggcctcccaaagctctgaggttacaggtatgagccactgttcct

SEQ ID NO: 131175 - DNA, 308 bp, Homo sapiens
gctttccaagggagttgtacaattttattttaagtcctagtctctactcactgtgaccagctctaatgcttgatgatgagtttttttaaattactgctaattggataggtagtatatggcatctaattaatttgcatttctttgttgctagtgaattatatagttttatgtgtcaggcatttatatttcctccttcataaattggttatttcttttgcccatttatctgttagagtcagtatttttggcattgatttggatgagctctttgttgagaacaaactcagcaactctttaggttgtcattt

SEQ ID NO: 131176 - DNA, 245 bp, Homo sapiens
ctccttttactgtaaaatgagtacaatacctacttcactggattcctgtagtgattaaatgaaataatctaggtggaagcgcccagcatcatagctgtcacatgaagtgtgtttaccagtgtaaactttccgcctccagaaacaatatatgtttacagtgtgcaggttcccatcaccttcagcagcagcatgaaggtactagaaatgataccaaatattgccttcattttctataaagttattgt

SEQ ID NO: 131177 - DNA, 598 bp, Homo sapiens
cggaacacccgcccaggagtccctctctctctctctcctcctgccagagagagagttcttttctctttcctcttgcctattaagcctctgcccttaaactcacttcttgtgttttggagccctcgatttctttggcgtgagatgacgaacctcggtcatttaccccagacaagatgccacttcatttctacttttgtatatatttgaatttttgcataattaaaaaaatttaaaggctttgttaaactactagtcacattttaaaagggggatagacaatctttatttgtcagatatttttaaataaagaaaaggaaaaggggagaggataagtatgcgaggtgttagatgtgttaattagcttgatttaatactttgcaatgtatacatatattaaaacatcacatcgtacaccatatatacagtttgtcaattatatcttaataaagctggaggaacaacaaacaaaacaaaaaaacgcaaacacacattgtggggcacgcccccggcgtccggcgaaaagctcttcgaaaaccccttctgtgggcgcgcccgcgcgcccccctggggtcagggtccacacgggcccccagcgggc

SEQ ID NO: 131178 - DNA, 296 bp, Homo sapiens
ctcatgtctcactcagtttaaatgctattgcctcagaaagaacctcttgaccttataatctaaattgggtctccctgtttttattctaagtacccttcttactttttatgactcttttcataatctgtatgttgactgattaaagttccattaggatagggaccatgtgtggtttgttcattaaaccacccagtttttaaccctgtatacccagagaccagcattgtgcctgtcaaatggaggtactcttttgcagaatgtatgaatggaatgaaagaaattaaatgagagtcaag

SEQ ID NO: 131179 - DNA, 803 bp, Homo sapiens
cagcattcactttaacatttctattttcctttatcatttctgttacttgagtgtgtaagagtaatcaacataaataatctatgtttacatctcttatttctctctgaaacagttccctagaatccacaccacatgaaacacaaattgagtagtgtatgacccacctgaattccaaagcattctaaaactcccgtattttccagcctagcagttagctcctgctctgcaagacacaccctcttgaccttgctgctagactgtatgggccccctgaagtcatagtagctggctcttactcatccccacattcacttggcatagttgatgttcaacaaatatctcttggttgcataacattgaacgagccaagtcacctaagaaatccttaatttatacacaggttcttagggtacctgaatagggcaacacatcagaagtacaaattgagaactatacaaagagtaaaataattcttgggttcaaataccctagagccaatcaagtttagtcacaaagaatttcaattcacttcaatgtggacagttaagaagggaatttatcagccttaggtggaaatcagagccaccatgagtaccacgtgcagcccctatagtgtttagctttgccagaagtcaccagagaaagtggctgaggaacagaattccagctcatatctggctaacagtggcactatgggagtttatatgatctgttcattattctgtggcatcaccttctaagagcagagatgtgacccaataccccttgttttccttaaagataaccattaaattatatccatg

SEQ ID NO: 131180 - DNA, 1219 bp, Homo sapiens
gatgaacaaagggctagatttgaagtttgggatacttggaatattggcagataaaacagcctatacattgttacactttagatctgctaaaggagctctaaataattcacacgcccagtcacagatttaaaaaatagatgcagagatgtatgtttttttctgataaaagagtttacatcatttgtatagtgatagagtagatcaatgcatttcaccaacaactcaaatgaagacaacccattaattagaacaaacacattgtcttatatgtgcttggtagttgaatattacatattaagaactttgggctgggctcggtggctcacgcctataatcccggcacgttgggaggccaaggtgggtagatcacctgaggtcaggagttcaagactagcctggccaacatggcgaaaccccatctccactaaaaatacaaaaattgagctgggcatggtggtgtgtgcctgtaatcccagttactcaggagattgagggaggagaattgcttgaacccatgaggtggaggttgcagtgagctgagatcacatcactgtactcctccagcctggatgacagagcgagactccatctcaaaaaacaaaaaaaaaagaacttgcattggacattgaatgaatatgctagaatcatcttttattgtaaaatagttgagggggaacctgtgattgtctaagaaactttattgttttcttctgtagtatttttatatgaaacaaaatccgtatcaattacaactttaataagtgattttccaacctacatgataactttattccttgtgctggaataaactgtctcttgcctcttccttcctttctcctctgaagcctttaggaagtcagtgattaacacatgtccctagaggacccaagtggtgtggaaaaacctatgacttgaggagaaaagcaagggtttttcaccatgatcttcctaaagactcttacctaatttctactgcgtcctttccctgttggtttttattatcattcttcccactttcaaaagagggaatggttggccgggcgcggtcttgtatgtgcttggtagttgaatattacatattaagaactttgggctcggctcggtggctcacacctgtaatcccaacactttgggaggccgaggagggcggatcacctgaggtcgggagttcgagaccagcctgaccaacatggagaaaccccgtctctactaaaaatac

SEQ ID NO: 131181 - DNA, 279 bp, Homo sapiens
ttgactctagcaggatcctcacgtaatatgtaaccgcacacgcgagggatctaggctgcacattccttatgagaatttaatgcctgatgatctgaggtagacagtttcatcctaaaacgatctcccctgtgcccctactcgccgctgtctgtggaaaaattgtcttccatgaaaccagttcctcgtgccaaaaaggttggggatcactgccttaactaactgtgtgaccttcaccaacatacttaaccactccaactctgtgtcctcctttgtaaacta

SEQ ID NO: 131182 - DNA, 353 bp, Homo sapiens
  misc_feature (24)..(25): n is a, c, g, or t
  misc_feature (44)..(44): n is a, c, g, or t
  misc_feature (135)..(135): n is a, c, g, or t
ctagaggatccagactcggcaccnnttcagcaagaggatcgtcngccggagcccagtatcggagtgtgatgcagaagtacctgcagagagaaatgaaataacctttgacaagattttcaatcagaaaattggttncttgctatttaaagatttttgcttgaatgaaattaatgaagctgtacctcaggtgaagttttatgaagaggtaagaagtaactgttttacaaggcaggcacaagaggaagaggcgcaagtgtttcaggccggggaactagcgtgtacaaaagctcagaggcaggacacagcttgtggtgttccagaaagagaaaagcctggtgtatgataacttaggg

SEQ ID NO: 131183 - DNA, 340 bp, Homo sapiens
tgtgcctcccgcagtctgcccttctgagtaagtgggtattagacaaccattaagtgggctgacccagcccccaatctgagactcatccctcaagctcttgtctctcactccccattctttccagcagcaaaccccacagacttgccttcaaaatatgcctcagatccaccccttctctcccatgcacttcactccagaccaacagcacctctccagtctaccagtctctctgttctaccctcctggcactcgctttggggaactttaaaaactaaaggtatttgtgtcagtcctctctgcaaaccccagtgcagcttcccacccaaacagaaccaaatcc

SEQ ID NO: 131184 - DNA, 352 bp, Homo sapiens
aaacagtagatgctggggactagtagagggaggaggaggcagggggccagggttgaaaaactacctcctgagtactatgctcacttcactatctggatgatggattcaactgaactctcaacctcagcatcacacaaaatacctttgtaacaaacctgcacacgtaccccctggatctgaaataaaagttgaaaaaataaaatataaaataaaataaaatgtgttgtcataatttgggttatcaactaaatcacctgaggaccttttcaagctatagttttcctaacactgctacagagatagaaagttcacaggcatggtatagtccatccagtagcctgtttttttgttg

SEQ ID NO: 131185 - DNA, 678 bp, Homo sapiens
tgttgtgaaaatagtgaaaaatctctaaattctgcgtgctagaaatccatcactattaaacatgagccaagatagacccagtgagtagtagtactgtaaattcttacacccctggctcagtaagcagtaactttagccttgtatttcaaagttttagtaccacttggtcaaatatgttcaggagtatgataaagttataggcccaagagagtggtaatttggctggaagacagaaaaaaagaaaaatataattgcttttttttggagaatatatagacagaacactacatatttaggaaataatatacttaaataaatgaaagtactaaaagagttttcaataaggaactttatctccttcccacagtcagagatgcatctaatccaaccctgactcaatgggtttccaattatcagaaatggaaatgattcagtgtttatatgctctgttgctgaacaagcctcactgtcacaaagtgattccttatatttcacctgtaattgtagctatatgttacagcatgaatgagaattggaaaagagggtagttattttgattgatgtagacagccaaagtgggtaattgagacccctgaaacttcctttaggatttgaatgatcctatttggctgtcttggggagtcacaacagtgggataattaccatatttttactcca

SEQ ID NO: 131186 - DNA, 279 bp, Homo sapiens
tacgaaggaaagactagatagtactttatctcccagaatctctgcttaagcagaagacttactccttagccaaagtatgcagaactcataataaaaaccatgaagatcaaaatggaggcctgagaaggtgtagttgttttgtttttgcttttttaagctgaactggtatcccagatatacagccatgattaagaaataattatctttttttctccccaagaataccaccaggatgataaatacctgtcaacaataaatactaactttggacaattgtta

SEQ ID NO: 131187 - DNA, 745 bp, Homo sapiens
ggaagacatatgtgtacataaagagtatgaaccttgagtcttacagacttgagcatgtgtgtcttttaaagctctgtcatttatcggctgtgagaacatggccaaaatactcagcctctctgagcctcagttttctcgccagtaaaatgggtctgattacacattctttataacttttatgacaaagatggtagcattgtatccagcatgttgtatgtgctcagtaatggtaggtgttatcagtgtttatgcctacagttctgtaacatgtttaaatgcaaagggaattcagactcagagaagtctgtggaaaaaattgatgaaagcattatgtaggcttggtggtggggagaatggaaatgtcatatgtgggagtcatatgctagtttggagagaggaggtggcaagtggggaagtgggattgatagttgatttgggacctgtgatctggtctctgcaaaaaggagcctttttggagagacaggaacccgaccacctggatgcagtctcagctctaccacttgctgcatgtgtaattttaggcaggttacttaacttctctgtaccttagttttccccatctgtaaactgggcaaatatggtggaccacatatagctgtgaaattaaatgagttaacatgtcaagggcttagaacagtgtctagtacagtctgtagtaaagctgcatacatttttatattaattttagattatggagctaaagcgatttttttatatttacact

SEQ ID NO: 131188 - DNA, 466 bp, Homo sapiens
ggagctcggtacctacttttccacaggtacttttccggggtcaaagaaacatgttggacacaccatggtgacagagcaggagtctcttaaccccggcgtggttgaggctgccgttctggtgggatctggggtcagtcaggggttaacagtcgctcctgcttgcctgattgacacagtaataaaggcagtgacaccaaactaggtctcaggaatgtgtcctcgttagaaagactcactaatggttgtgggggggtggcccatgagtccttctgggtggtggcgagaagtaggggaccctttgggctttgccctttttggtcataggacttcactccacagacataattgaaccgttgggtttctgcagccaaattcaaatgtcaccaatcttggtcacccctttcatctcttgggtcctctgtaagttatagctatctgatagtttactgaaaaataaactgaaaat

SEQ ID NO: 131189 - DNA, 217 bp, Homo sapiens
ctcacacccatatgtaaagcctctctagcactcctttccaaaatctgtagcttaattatgctaatgatcttcatttatcatgttggtttacttatcaggacattttcctatttctggtcagatgtttttccagggattcaaggcatggaatccttcattaagtggggaagaaccaacagaatttgttccacatattcctctgacacatccccaaaag

SEQ ID NO: 131190 - DNA, 245 bp, Homo sapiens
ctccctttttggtctccacaaacactaaagtcagtgaatccttccctggtgcatttaagagatcaagcagaaatgaccgtttatctggctcttccacccaaactacttcctgtgtgatagtctcagaggtagagcctactcttcctacagccaaaaagatatattcatccaaaaagtcacgagcaagcatctgtatttcgttaggaaaagtagcactaaacatcatgatgtgatgaatgcccttc

SEQ ID NO: 131191 - DNA, 685 bp, Homo sapiens
ctgctcctccctctctgcatcccatctctcactccatcttagccatactgactgcctggctgttcctggaacccacaaagcactctactgccttggggttttcacattcatgttctcttgatgagaaacctgtcatagatgtttgctcttgttaaaggtccctctcctttaagattgaaagagggagaacctgcaggtgatgaggctatctagaagtattcagttaagtactaggagcatcttttagaagacaaaagaacaaaagcaaagcgcaaaacaccaactggagttttgtaagaagaggactctgccaaagaagtcagtcatccagacacgtggcttaagaaagggcgatgaatgtggatggtattgacaagacgtgtatgattgaaaacgtgttggtttttcgctgggagatgaagattaaaaacctttgatttttaaacacgttgaatttgaggtggtgatggtgacaagacattgaaattaacatgtcctgtagataaaatatagactgtgcttgggtgaagtggccagatgggaagaaaatattgatttgggcaacatcagcttaaaaattaatgagttctctggggaacagtaagggtagaaagggaagatggccaagagctgagacttggggaatgttcaagtggaggaggcaagacctgggcagaggagggga

SEQ ID NO: 131192 - DNA, 785 bp, Homo sapiens
attacatagtggtaaagtcaggtcttttagtgtatccatcactggagtaatatacattttgcccattaggtaatttctcatccttcaccccctcccaactcccacccaatggagaccttctgagttttcatcgactattacttcacacatattaatgtgtaataatgtacatattatttagctcccacttataagtgagaacatgcaacatttgtctttctctgtctgattcgtttattttgagttaatggcctctagctccatccatgttgttgcaaaatacattatttcattccttttcatggaatactagtatatgtgtgtgtgtatatatacacacacatgtatacgcacatacatgtatatatatatgtatatacaaacacacacagggtagatactgttttacataaaggttatgctaattaacattcccaccaacagtgtataagaatttccttttctccatatcctagccaacatctgttatttttttgtcttttcagtaacagccattccgattggtgtaagatgatatttcactgtggttttaatttgcatttctgtgatgattggtgatgttgaactttcttcatattcttgttggccatttgcttttctttttttgaaaaatgactattcatatccttagcccactttttgatgagattgtctgtttggttgttgagtagtttgagttccttgaaaattctggatattagtcccctgttgggtgtatagtttgcaaatattttctcccattctgcaggttgtctgttcactct

SEQ ID NO: 131193 - DNA, 717 bp, Homo sapiens
cgtggtggctcaagcctgtaatcccagcactttgggaggccgaggtgagcggatcacaaggtcaggggtttgagaccggcctgaccaacatggtgaaaccccgtctctactaaaaataaaaaattagccaggcttggtggtgcacacctgtaatcccagctactcaggaggctgaggcaggagaatcacttgaacccgggaggcggaggttgcagtgagccgagatcatgccgctgcactccagcatgggtgacagagctagactcagtaccccacacacacacacacacaaaaaaatcacctaccaatagcacagtccctggaatgatttcttctactgtaaactgactaaagaaatacaatttggaattatgattcttaagaggttaagtgtataggctttgttatctgcctgggtttaagtataagatctatccttattagctatatgactttgggcaaagtatcaaccactcgaaactgcagcttccttttttgtaaaatggaggaataaaaatacacagggtggttgtgaagattaaatgaggcatttcatgtaaagtgcttagaaaaatgtcttgacgcacagaaagccagtaatattgttactactacagggactagagcttgggtgtggttggtggagtttttgaagtttgtaaaccagcctccccaggctcccctctttcatttgcagcagacctgaaaactacagga

SEQ ID NO: 131194 - DNA, 317 bp, Homo sapiens
tggtccctggggtggtttagattctcaatcaagtcctttagccttattgattaaaatagagacatttactatcacaaaatgatgcccccaaacagcctcaaacctgacacattagtttccctttcctgcctctgcccaaaatgaatgtttttctttctcttcccttgggttcttctctccctcccctcctcttccctccctctctcccttctctattcttccctctccctctctatttgtccttctctgctccaagtcctgccacaaccccaggattcatcagcctccctggacacatcccatccagctcctgaccg

SEQ ID NO: 131195 - DNA, 225 bp, Homo sapiens
cctgcctcagccttccaaagtgctgggattacaggcatagccactgcacccggctagaggtacattttgatcaagggagtacttgccagtcactggcattctacatcttcagagattacaagtcaacaataaacctctgtttcagtacccgctggcccctcatttgtcctactaaggaacctgtcagggtccatggtccatacgtgctgacagctcccacctggt

SEQ ID NO: 131196 - DNA, 305 bp, Homo sapiens
gggataataggcacttggccattggagccattttagaggaagcctatcacaaaagccaatactgagagaaacagacctgagagccaagaagtgactgagtccagtgacttcacttcagcccttgaatgttgccattaggttttgtcatatgcaatattctgaaatgtgctagaatggctgcccaaacattagggggaacaattcatccccatttgcccaggactttcctggttttaacactaaaagtcctatatcttgggaaactcctatatcccaggtgaattaggacagttgacacctgacat

SEQ ID NO: 131197 - DNA, 576 bp, Homo sapiens
ggtcttgaactcctggcctcaagtgatctgcctgtcttggcctgccaaagtgctgggtttacaggcatgagccagcctgcctggcctcttttgcttactttctaattggagtttttttttcttcttacccctgaagttttaagaattctttacatattctatatctgagttctagtcagatgtgtggtttacaaatattttttccccagtctatagcttgtctttgcatttctttcgtagagcaaaagtttaatttgataaaggcgagtttattgagcaagaacttttccttcatgggttgtgtttttgatgtgtcaaaatttttaccaagctttaggtactgaaggttcccctctgccattttttaaaagttttgtctattttgaatttttatataatgtgtgagatttaggtggagggttttttccttgccttttttgttttgtggggggtgtgtgcgtgcgtgcgtgcatgttttctggtcttcagatcgtatttaatcactccagcaccatttgttgaaaaatgtatcatttctccattagatagcttttgcatctttgtaaaaaaaaaaaa

SEQ ID NO: 131198 - DNA, 329 bp, Homo sapiens
gctaattcctttttggaatttagcttgcttggattcctttacattgtcagctctttgaagagtttctgagagactataactttatagtagcttatatgacctatttttgttgttaggattggagatgatggtctttttcattgctctatatcaggaactgattttgaatgaaaaacagctccctgctagtatagcatgaccttactccacaatgctaagattctgcaatgaagtggttctattgaggttctctagagactctatacattatataacttgacaacatattcctggcacaacgccatgaatgtctgctttttgtcatccca

SEQ ID NO: 131199 - DNA, 295 bp, Homo sapiens
gcaagctctgcctgccgggttcatgacatcctcctgcctcagcttccagagtagctgggactacaggtgcccgccaccacgcccgactaattttttgtattttttagtacagatggggtttcacctgttagccaggatggtctcgatctcctgacctcgtgatccgcccgcctcggcctccccaagtgctgagattataggcatgagccactgtgcccggcctgtgcaacttattcttgagcctagcaagccgcctgcatttgccatgcctctgcacatggcttgggtgttcccc

SEQ ID NO: 131200 - DNA, 302 bp, Homo sapiens
cgttccttctcatttgggcctgagatgcagggcaaggaaacggtaagcatgccgctccaagtcactgcatttgaaatgaaacagttaaactcatttgccgtcatggttgcaagagcttcttgaaaggagttgctctgaggttaatgagcatgataggtcaattctatgtgtgctgaaattcttggaatctgaaaacatggcagttgtagctagtcagctttcactgaaaaatgtacatgtgttgtcttcgagggtatttacttaactaaagacgtacgtttccacagcttctggacatttat

SEQ ID NO: 131201 - DNA, 235 bp, Homo sapiens
tgtttgctgttttggctactgagtgctttattcattcaacagacaattacagagcaccatctctgtgttgggcacattctagatgagaatgaaggaaagtccttgtcctcagtgggcttacattcaagttgggaagatagacaaatgaaggaatatacaggtgactcttgaaccacacgggtatgaattgagtgggtccacttatacatagattttcttccagatctgccactcc

SEQ ID NO: 131202 - DNA, 789 bp, Homo sapiens
atttcccagctagagacatgacagtgccctcctccccaggctgctggtggtagaccagcattctgcccagggccaggcaaggcgtgatgctctggaggtagtgggctacgaggattcctgaacccacgaggacgtctgggtttccccagggttacggctgctgtgagtcagagccccgatactccccgtccacctgccagttcacaaacttcgactgctgggtctggatggccatcttggacctgaggcgggggcccagctggtgaatgacctgagcgttgagactgccgctgttgtccatgtcacccaccaatacaaggaacgcctctgtgggactcagctgctttgtccccacatacgtgaccccgaagtggtagctggactccctgattgtgctgagggctactgtgtggttcacctggaaatggttactcaaccctttgttgactatgagcttgacaccctccatctgaatgggaaacagctccttgcacttccggtggcactccccgaatgtgcccgggttgggcaggcagccgcaggccccatcctcggcggcccctgaggcgctggcagttgcagccccgggggtcagttccgaacctcgactcgtactggtgccggcgcccaggccgcctcccagcggcggcagcgtgaagcccggcggcgagggcggaggtggcggcagctccacgagggccggcgcaggcggcggtggcggccctgcgggcggcgacctggcggccaacacgttccccatggtctctggcagaggcgcctgctcccggc

SEQ ID NO: 131203 - DNA, 388 bp, Homo sapiens
ttttttttttttttttgagacaagagtctcattctgttgcccaggatctcagctcactgcaacctctgcctcccaggttcaagcaattcttgtgcctcaggctcccaataactgggattacaggcatgcaccaccatacccagttaatttttgtatttttagcagagatggggtttcaccatgttggccaggctggtctcgaactcctgacctcaagtggtctgcccacctaggtctcccaaagtgctgggattacaggtgtgagccactgtgcccggccggcctccctcttaatagaaaagctttggctacccatgctctgctttaggcactggtgctagaggaaggaaccaaataagagcagcaccagcagcaccagcggtagcac

SEQ ID NO: 131204 - DNA, 309 bp, Homo sapiens
gatcttggagtgaagtccttggactgatgaacagagggtttttgccacagtgtccctcctaagtccctctcctaaacttgcaacagcaacaaacagctggtggagatttaggagttcaagattctaacctagtagctttccagctcatcatgagttaaatactcttcttacccctttagaggtaacagtactgaggctcagagcaattgagcaatttgcccatgacaagccttaataaatgtgggatattctagctctgcccatccacctccaatgcccatgccctgtcatgagcacacacacatgcac

SEQ ID NO: 131205 - DNA, 187 bp, Homo sapiens
tgctgagattacaggtatgcgccactatgctgggccaaaagatatatttctagtattagattgaaataaaaacccattctatataactttagctaatttaaaacgcaaataatagataattacatagatacacaaaactttataatatttcacttagtattgctattactatgtacttggtgcgcag

SEQ ID NO: 131206 - DNA, 426 bp, Homo sapiens
gaatcaatccccttcataggctatgccagtttaagatagagtgtttgtccctttgcagttagaattactgactgacacattggacaatcatttatttgaaggaaggcagagactcaggtgttaaggatccagctaacatctggcccataaacttgaaagagaaataaaagcgggaatagaatgtgttaactctgtcagtggctatcattccctgtacaagacattattgttagttttgtatagttttctaatctgggctttaacatttcaaggataattttagtggcttctagccatcatgaggaaagaacatgtcttgagaaacatggggaaaattgaaaactgtacagagaatataagtttttggcaatgttgtatgttaacctaatagccttaatggtaccatgataatttctgggtaaggaa

SEQ ID NO: 131207 - DNA, 191 bp, Homo sapiens
acttttactaagaatatattagagatgttgaacaagaaaagatttttataaaggcacaattctattaatgaaattttacaccctccgaacatgtatataaatcatatacacacatggtatgcaggcagcattagtgtatatgccgaaactctggaaggtaatactaagttgctaagcatctattatctctg

SEQ ID NO: 131208 - DNA, 217 bp, Homo sapiens
ctgtaaaatgggcataactatagaccccacctctctgggtaatggtgagaattaataataaccaatattagttgaatgcctactatatgtcaggtgtcttttttgcatcctcacggcagaccatgagggaggcattattattctgcttcttatacataaggaaactgaggcacaggggaggcagagagactgcaggattaagacttccagccaggcg

SEQ ID NO: 131209 - DNA, 554 bp, Homo sapiens
tattgagagtcacctgttgaaataaatttggaactgactgtagtaaaacctgttacgtggagaccagccttcctcttctctctggtttcttagaaatatatccaacaatggagccgagagtcctagcatctcaggaaacctatgagcagcggtgagagcagacagtacagaggtacccgcaggagtctgctggcagataggaacagcttgattgacttttcatgaaatgagacagaagagcagggatttcctgggagaggtggagagtaattcaagaagggcactgagtagtggaggagctcatctaataagatggtaaagagcatgtactttggagtagcctaccttcacatcccagctcctctgcttactgactttgtgacataaggcacacagcctctctgtgctgcctcacttgctttctataaagtaggttattgaccctgagaagtcaaatgagttaatacttagcattgtacgtggaacacaggaggcactccataattgtaaactgttttatttttgttatacgtatcaacacttcgcagggtttt

SEQ ID NO: 131210 - DNA, 155 bp, Homo sapiens
atacagcttctttattgtattcctttcatctcaaaataccacacagaaggatgttcaatccagagcagcccgctctgggactgaacttcccagcatagcggtgggagaatgaatgagggaaagaatgaagagggaaatgaacacttcaataaaga

SEQ ID NO: 131211 - DNA, 244 bp, Homo sapiens
gaagtgtgctgcttgaggagtgagctggaatgaagggcgtgtggaggtgtgagaattaggtgggtgtggctgggatgggtacagttttgatgggggtcattaggccagaattttccagttaagaagcttggggggaggaaggtaaaaattgaattggagacccatccaagatttgagttgaggcaggtgggtgtcagattttaccatctttataattgaaccgagagaatgcaaaatacaactg

SEQ ID NO: 131212 - DNA, 418 bp, Homo sapiens
ttcagatgggagaataaatgcagtccctgtttctctaagttgcccagaagtggaagtccctggcatagctgctttattcttaatagccaaaaagctggaaacaactcaatgcctaacaacaggtgaatggataaacaaattgtattatagccatgtaatggaatactactcagcaataaaaaggaacaaactaccgttatacacaaaaatacatatttgtgattaaaataaagtatgcttacttaaagaagtcaaacacacacacaaaaaaactaatgtaaaatttcatctgtatgaaattctagaaaagactaaattaaagtgacagaaagtagagcagtggttgtcaggtaccaggggtaaagagaatagacttagtacaaaatggcataaggaaacttttgggataatgaaaatg

SEQ ID NO: 131213 - DNA, 477 bp, Homo sapiens
tctcataatagatcccagcatacctatcagtccaaactttttgtattattcaaatactggaagtgtctattttgcctgtcttgtgtgggcaccatctatgtgtaaatctgtaaacattaatttaaaaaaaagaccccataatccaccctattttttctgactgtgaaactagaggtggggtgtgataactcatggtcccacttctcttacagagtccctttctttgcaatgtcccttcttttacagattcagtgactgacaacttaactttcttgggtaaagccagaaaaaacaggatggcctccaggccgagcagtagaaatgctggggaatggggtgtctggtgtgtgtctggtgtgttcctgcagtgcctgcaggccatgtgtctgtatggtgactgaaacgcaagtcggcatccagccaggatggcagggaccgtgtgcctgggggtgacggcaaacacacagtgagaagctg

SEQ ID NO: 131214 - DNA, 647 bp, Homo sapiens
gaaacaactaactggactatgtgggggcatctgagccatgaggaggcattacataggcattaaaagatgagctgggccaatcaagttccctttctcttgggactctccatgcagacatctcattctgagagaacaatgattcatggcacagtgacttagtcagtgaatgcctcaggtacgaggtggaggtggacccttcaggagtcgtagccatccaaagttatgaggaggttcaaacatggaggagcagccatgaggtagacaaaagataggccaaatacagggtcagaaatccacttgacagtgaggagggatggttggaaacaactgaagagaagctgagtcacgtgtaggctggagttagacagtgagcccctgtccttcagcttcagccgccagatgcgttccttgaggctgtgtgatttggcttttcttgggttcccttgtatgtgcatccttatattaatcccttactctaccctcctaccttaaaattaattcagtgagactgttcttcacagctaaaagaacctaagtaaaatgtttcttctaggccgggagttcaagaccagccttggcactatgtttggttctatgtttagtgagactccatctctgcaacacacactgtggcctaccatggggga

SEQ ID NO: 131215 - DNA, 927 bp, Homo sapiens
tgagccgagatcatgccgcttgcactccagcatgggttacaaagcaagactccatctcaaaaaaaaaaataaaaaattgatgtttgacacactgaatttgagatacctttgaagtatccagtttagatttttctataacagcttgattaatatataatttaccttttaaaaaattatctggtttttaatatattcagagttatgcaaccatcatttctatctaaattattttttaatattttcatcactccaaaaagaaaatttcatatcctttagcagtcatttcctattctcccttcctcctaacccctggcaaccaccaagctgcttttctgtctctaatgctggccttggattcggccttcatgagctgtaatggctttccctggtggcatccattagaatatttaaggtgacaattttttttttcccattctgggagccaaccacttcaaaaaatctttgtcaggtcactgatgactctatagatagtagaacagaaacctcagtggccaaacgcaactgtgaatacacactttgcaaaaaaaaaaaaaatagtttgaaaaaatcagttaactagtggacagcagcagccttcaaaaagcaaaaatcagcaatcactgaggaggaggagaaattgatttccaaagttaccacattacaaaacgcaaaatatccagttcttaacaaagaattacaaagcatacaaggaaacataaaagtatggctctttcacaagataaaaagagttgaacagaaaccactcctgaggaagcccagacactggaattactagccaaagatgtcaaattaactctcttaaatatagtcagtaggttaaaggaaaccaagaaaaagtctgatggaaaacaggagaataatgtatgaatgaatagggaacgtcaataaagaaatagtaaaaaagaa

SEQ ID NO: 131216 - DNA, 337 bp, Homo sapiens
gaatatttttcattagctactacagtgttactaatccatacctatattattcaccaagattagtaaggaatccagccaagttatttccccatctcttcctactttatttccaactaagggactcacttcttcacttggaaactgttctgctctggtcagtctccttagtccaatattccctccattctcaggattcactctttgttcaaatcctctgtagcatccagcagttgctaacagagacaagcagttaaaacgcagagatgccaagcatcaggaactgtggctggaggaaataaactggaggttttggggctggctgcagtggttcacgtct

SEQ ID NO: 131217 - DNA, 341 bp, Homo sapiens
gtgatggggaatgggcagagtcctggcctccagttccaactttgtcattacctcacccagtaaaatgtaaaagttctctcacctccctgagcctcagtttcctcatttgtgggtggaggggcactaaccaggtgctcactgaggcctctgatcctccatggttggctctttggataaaggtaagacagatttcctccctgccatgaaataattcctcatttagtaatcccttcagaaagtgtctgctaagtccctgcggtgcagaccttggcatcagaggccaagcctataagaaagggaagacaaaatccccattctcaaggtaaagggggaatataatg

SEQ ID NO: 131218 - DNA, 558 bp, Homo sapiens
agagagacaacaatcactgcagttcggctcacaggaagccacatccataggaaaaggaggagtatactacatcaagggaacaccccgtgggacaaaagaatctgaacaacagtcttcagccctagaccttccctctgacagagcctacccaaatgagaaggaaccagaaaaccaaccctggtaatatgacaaaacaaggctcttcaacacccccccaaaatttctctagttcaccagcaatagatccaaaccaagaagaaatccctgatttacctgacaaagaattcaggaggttagatattaagctaatcagggagggaccagagaaaggtgaagcccagtgcaaggaaatccaaaaaatgatataagaagtgaagggagaaatattcaaagaaatagatagcataaagaaaaaaaacaataaaaaattcaggaaactttggacacacttttagaaatgcaaaatgctctggaaagtctcagcgatagaactaaacaagtagaagaaagaaattcagagctcgaagacaaggtcttcgaattaacccaatccaacaa

SEQ ID NO: 131219 - DNA, 618 bp, Homo sapiens
tgtttaatccttatgtttaattttttgtttctgctatcacatttttaattttcaagaactctttttttagtctctcttttttttttttcaaaccatcttattcttgtttcttggttgtggtatcttctctgaggacattaatgataattttctccatatagtctgctttttgttttctccctaaagcacattgttttgtttgtttgttttggtatattttatgttaaggacatctctcagatataactgtatctcacctaaactctgaggtttctccagggcaaggactatacatgatttatctttgtgttctcagtgcttagattcaagaatgccccacacaccaaaagcattttgtaaattctctttgcagttactattattattaaaagcttttgtcaaatcccttttctattgaacttccaacaataaaagcaataattttctttttcttaagaacatcgatgaatgctagaattgaaggtagtagctactgtagacaactcagttacccacattcataaggatagtttgttaatacaaaaagctggaaattttttttttagatggagtctcgttctgtcgcctaggctggagtgcagtggcacaatctggact

SEQ ID NO: 131220 - DNA, 425 bp, Homo sapiens
agacagccatctggagagggggacttctgatggacagccagtgggtggtctagaacaagatgacttcttgtgacctaacctggcactctggttctgagggtctatgacagtttggtggtttagagggaagcattggcctcaagatgccaccattgggcacgtttaatgagtgacagctttggttactcttttaacatagtagagtttcgtagcacctggttcagccctgtcattctttggggagaatgagaaggatctaatctcctgggagaaggaggattccagctcctttgaatttcagacctgcttcttgccccctgtgacagatttcagcacctctgtctcctcggtgttggatgcgaacaatgaatgagtagcaacttgctggccaaattcctattccttaagtgagagagaagacagat

SEQ ID NO: 131221 - DNA, 715 bp, Homo sapiens
gtggaaaggggtgggggagggatgattaactcttgactgtattgaagaaagcaagctgacacttctgccctaattgagcacctaagtaattgagttctttcttcttataaagtacattactttgtagggtattaaagttccaggcaggaattcttactagttttaacccacgaatttgatggtctaaagtaaaagcacttttcccgtttttcctttgaaatttaactcaggaatttgcacccccttgtggtcaaatataaaattcttagttttcaaaagaccgttttttacaatcgggctctctgttcaggcataggaactactgtatgttagttgattttgttttctcccattttagcaaatcaagaagctttcatgaaagattttttcttaaataagactttaaacacaattagacttaaatcttctaaaagtgacttacacataaactttagtctctgcaaaatagagataattgcacccacttaatgagttacatgatgattcgatggaaaaatgcatgtacatgcttagcccagtgtctgacacatattaggtcttcaataaatgttatcatttatcatcatcactttagaattctcttgacatattatatctaaaaggggactaagataaaaaattctacagtgaggaaaccagattgtgctacttacctatttgtaagttctagtacaattttacacatgtctcccaa

SEQ ID NO: 131222 - DNA, 708 bp, Homo sapiens
gaattcaaggcaaccaaaactaacaaagcagctgccatggtctgtggggaccaaggaaatgaataagacacaggtgctgcctgccttcggggagctgacagtccagtgtggggcgattgggtcactgttgaaaaatctctacccaatgcagaatatgcctgtgaacacctagaggaccccagaggaggtctcatccatctttatagtccctctgcaacaagcacaatgacctgcatgtgatgtgcaggcaagtactgtgtatttaagggccctgaaagaagtaccaacagaatgctcttggggttggtggagaaggagggacagctttgtgaaggaggtgacatttgagctgtgcctggaaggatggggaggtttttcacaggcagtggggactgggggagggcctttgcagtccccaggaaagagcaatggcaaagatcctaaggaaagagaaagcacggtgtgatttggaagagcaccaagcagtctagtgtggccagaggacaaggaagcagtaagagctgaagttggagagaaaagttgagacctaagcagagagaccgttggacagcaagctaaataatttcacaggggaatatcattgaaggtctgagcaaggggagtagtgataccaccaaggcagggcttcctgctgcatcatcctgttctgcccaaggaggcctcccttgccttgttggtagtatgagt

SEQ ID NO: 131223 - DNA, 467 bp, Homo sapiens
  misc_feature (444)..(444): n is a, c, g, or t
  misc_feature (458)..(458): n is a, c, g, or t
aaggccaatgtgaaagaaatctgggcaagtgaacagaaaccgggaaacactgccgttagaaagacattgaaacgtgatgcattaaagggttctttattcctctcctttattcaaactttttatttaaactacctccttttttgtaattcatccactaaactactaaaaactccattataattatcctcggattgaaccaagtcgatgataccagccctgtggtccgctagtgtatcattactgtgaacggtctggcctggctttgtgctttaattgcttggggaggctgacaggggagcagccctgggaggaagctgctggttcccggggcacagggaagtgcttgttccttgttctgggagactcaagacattcccaggaatctttcttaaggcagagctggctggggggagtagcccctgttaggcaagttaccatggcttnttggacaggcagcntgagagcgt

SEQ ID NO: 131224 - DNA, 384 bp, Homo sapiens
aaggccaatgtgaaagaaatctgggcaagtgaacagaaaccgggaaacactgccgttagaaagacattgaaacgtgatgcattaaagggttctttattcctctcctttattcaaactttttatttaaactacctccttttttgtaattcatccactaaactactaaaaactccattataattatcctcggattgaaccaagtcgatgataccagccctgtggtccgctagtgtatcattactgtgaacggtctggcctggctttgtgctttaattgcttggggaggctgacaggggagcagccctgggaggaagctgctggttttagccaaacagaaaacacgcagctgtggagccaagtcccagacttgaggcctcagctcat

SEQ ID NO: 131225 - DNA, 185 bp, Homo sapiens
ccacaagtgtgcaggacgcaagctgggttattggaagcggacgacaccaaggaggcgttgccgcggatgtggtggacgatgccaagtcgtcttttaaaaaaggaagtgaagaatgattaagagggtcacgccctctaccactccaacctctctaatcagtctctttctgctccgtctgctgtaca

SEQ ID NO: 131226 - DNA, 236 bp, Homo sapiens
ccctccggtaacatttggggtggggactgaggctcccaccatccttctggggcagagaggatagaaggaagaagaggaccctgagcattctattagaacattagcaggggacacatagcatgatcttggccttgaacattttaacctaaccactgtgaggtcatgtcttagatgtgtttagaactctaacttcatagtcagagatgaccctcatgtccttggatgcttgtccctag

SEQ ID NO: 131227 - DNA, 348 bp, Homo sapiens
ctcatgctgcaaaacagagaaaggaaggctaccatagtcttcccatccatgcatccctgagaacctttttgctgtgcaagagctttgattcctatcagtcaccctgtgtggccaaatctactatatgtggttccagggacagggacagtctaggaaattcagagcaacagatggtagtaagtctcctccctccaaacactttttcggggatgactggtgaaaatgatgacgcagagagaagcctgtttgtatatacacatcaggatggatgaagcagtgccaaagatgattaaattagatcagattagattggattagattagattagattaacctgcagattagtgt

SEQ ID NO: 131228 - DNA, 407 bp, Homo sapiens
aggcaaactcccctttataaaaccaccaggtctcatgagacttattcattatcacaacagcacaggaaagacccgcccccatgattcaattacatcctacccgctccctcccatgacatgtgggaattgtgggagctacgatccaagatgaaatttgggtggggacatttttaattttagtatttaaaagttgtaggggagagagaaatggctttcctccaccgctctgggtttcttggctgggttatgaattgacgtaagacaaattaacagaaagaaaccccatatttaataatgtaggtgcacatgggagtcccacaaaatatgagacttgaagaagggtcacacggttgaaactcatttagcatcctgagctatggaacggaataggggcttggggcttctgg

SEQ ID NO: 131229 - DNA, 944 bp, Homo sapiens
gggtctgccagagcctcagataccaagacatatgggtctgccagagcctcagatatcaatattgggtttagaattttagacccttaaagtagtctgtgtttgaattaagctgggatgtaattctgggtgggctgaaggtactgagcaggtaataaagaaaggaacgtagggacaataacacagacacaatttcaatggtcaggactgtgacaaatggcagaggctgggtcttatgatataggttttcattcatatattcaccctcattattcatgtattctttaataaacaagtgtatattgaacatccgtgtatcaggcattggggaggacactggaatataaggacaaacataactattttgttatgtgataggtgtgacaacagaatacataggttatattttagaagcacttgggtgaatcattcaaaccagactaggaagaaggggagagaaggctttctgaaaaatgtaagatgtaagggtgtagtggcgggcatctgtaatcccagctactctggaggctggggcaggagaatcgcttgaacccaggagacagaggttgcagtgagccgagatcacaccattgcactccagcctgggggacaagagtgagacttcatctcaacaaacaaacaaacaaatcattgaatgtcaaatatatgccgactaactaactctaggacacaaagttaagtgggagggagggtcctttcttcaaaagcttacagcatgatgtgatcattatataatcagatgtcactaatgagagttggctacatcagataggaaagtgaaggaaacttacgtaggtagtaaaatttgaatgatgagagaattaattaggtgaaggtggaatatatgtttacatatattatgtacaacatataaatttattctaggcagataagaagtttgtacaaaagcacagagatgtgaaatg

SEQ ID NO: 131230 - DNA, 256 bp, Homo sapiens
  misc_feature (248)..(255): n is a, c, g, or t
gacgatgagtgggtgtctctgaattagaagatgagttttaggattctcttacccctgcctcgcattctgtggactgcctggtatgtcatggtcgctcagcaagatttttagaaacgaatgaatgttgctgctcggaatctgagaagtgcataatgacgctgcgagtatcatcgtgattagagctgggcctgccacacagctcacattcagtcaacacgtgctgaataaacaagtgggtatccctgcannnnnnnna

SEQ ID NO: 131231 - DNA, 267 bp, Homo sapiens
tgctggcctttcctcttctgccctagctcttctgatctttgctttctcttcacctctcagatctcagcacagaggcctaccgtgctcactcaaccatgcaagtatgcctccatcacgtgaccctggtgtactggctcagagtctccaaaattacaacatggtggccgagcgcagtggctcacacctgtaattccagcactttgggaggccgaggtgagcagatcacgaggtcaggagtttgagaccagcctgaccaacatggtgaaa

SEQ ID NO: 131232 - DNA, 420 bp, Homo sapiens
tgctgtgagccaccactcctggcctgaaagtatttttcgtaattggatttttccatatgtgcactaaggtctgcctttttccctgaatgaggcataacaagtatttctgtggctgtgttctctgtgggaatattattgtgacatgcttgtaagaagtaagtgaaaagcacaccagcacggtattcacatagcacagaaggttataaaaggcaaacgcagacatgggtgagggcagagttgttcttggtttgtcacaagggcgtgtgaacgcggttccccacctgccctgctctgctcagcagctttgggatatgagtgccttgggtgcctggtgcctttttgggccagccctgtggtattttggagtatccgttggtattgagagtctggaacttacttagtgtctggggcatgggccgt

SEQ ID NO: 131233 - DNA, 781 bp, Homo sapiens
gattttaagcaggggagagatacaaatattgtttgatcagtggtttagtaaaatcactctggtggcagtgaggagggctgcagaagatgatgatgattttgcggtgggaggtgagtgcagggtacatctaaaagctgaactgttaaatagaaaggctgttacaatgatccagttgagggatgattaagacaagacagtggctggaggagttgagagcaagggcaagactgacaatttagactgtgcatgaaagtgatgaatcacatgacaaccatttgagtcccttcccatgctctgatttcactccaaagaagatcgcagatcttcagattcaatattgaccacaaaccttcctgcagaagtagaggcatctgtagcctcttgaaacctacagtacatccttgcggtgaaactgctttgttgataaaaatgatccctgtgtgaaacagatgtcactggtgctggcacagagagatgaggaaggataaagaattacagtggagttgaaaacactgttaaaaaaataaaagacctaacagtatagcacagcaaagaagcaaaactgctttgaagctacatattttttctgcacctgacagtgaaaacctgtgaaacttcatacttcatggaaaaaactgaagtgaaatttgttacagtagctcccttcaatttgtgctatacatacgtcttatctctttaatatgaccaagagcaacctgagggaaggtacctagccatgtgtctcctagcttattttaataaccctgtgcctatgtttata

SEQ ID NO: 131234 - DNA, 2472 bp, Homo sapiens
aacagggaaagaaaacagaaggtggggaagaggaaggaagagagggaggaaggggcagggtacttgagagaccatgaggatcccagatcagtcccacacatgattacactgaattatgaactaagatatttaccgaaacgttttccattaatgcatatttgacttgctttttctgacctaatgaatttgcaaaacgatgacaatcatgtagcaaatgtacatggactagtactcacaattaattttttattttctatgccagcaggagacaaagatgatagaagaatgaaattcatttttgacccagaaatcttattttagctactgctttatctgctcttaattttctaggagtggactttggggccgtcgtgccggatcctccctgaatgtggagcgatggggggttgcacacaggccgttctgccccagcagctaacaagaaagacccttgcattcctccctgcatctctcccttttgggtcctactaatgtctgttgaatttctcttttttccaaagcaaaatccttctctgcattttgtctgcttgtctgtttcccagagccgcagactctctccttgtctggagttccagagagcccccactttctctttctaagctgtgttgtgtgtttcctgggtacattctaggttccccaaagataaacatgactaaggattggaaaggaggaaaggccgcgcagattgtttaatctggaaagtcaatccccggatttagctctcaaaaatggctttatttttgggagaaaagcaatagagtaaggacagaaggacttaacgcttgcagggaagtggctttctgccatgtagagccaggctggcaacctgccctctgccatcagggagtgagcatgaacctggaaacctctaggacgcaagagcgaggctggctgtcccctcgtgtgcagtgcttagaccttcttgccacacatcccgtccctcacctcactggatagcccccgaatcaactgttcacacgaaagcagctgcctggttctgagtggccatgctcactcccaagcacaggctgaatgaaaagaaaactgtgcaagtagcttgtatggtgggaagcccccagcagaggctgagggtgcagccaggtgctctggaagccttgaggcctctggtgtcatcttcctcacctctaaataagagatgggctaggttggtcaaggtcctccctgtcctaaaacactttaatgaaatggaagaaaggctgcaggctgatagaggagggacagtctggtttggttccctcaagtcttcaggagagggctcaaggacagtctcccatttcttgttggcaaaatgtaaagtgcagtctggaccctgtccattgagtagagactcaggaggccaaccaagatccctgaaaagctaacagcgtggtcagccttcccacagacagtgcacccaccgtgggaggacacttcgccccccattgttaacgtccaccgcgcccagactcccacagcgagctccttcccttcctccccatgtttgcagtggagttcccactcgagaagacagcacagtagcaagtagaggctggtcctgggacactcgcacccatgtgtgtcaggaagcccctgcggtcacacggcccatgaggaagccagaggggctgctggggctgatgaggccagggcagggcggcctgctcttccataaatgacagctggcaccaaagcccagagctggcagcctccacctgaggagtggcatctccatgaacggcttgtgttctcgcacagccccattgcgtagatgaggaaactgaagctcagagaggttcctgcccttgcccaaggccacacagccggatgagctagaaaggtgctaggggactgggaggtgggggagctgagacgctgtcccgctgctgccaggatgcggccgccccccgtgccagccaggcctgcctcctccctctgtccggctcagcagccccggcctcctgttgctcccagtccgagctatggccaagggagactgattcctgctcaccctgggagagagctcaggattttgtctcaaaaccttataaaagatacgaggctcgacattttactaaggccgaggactcttgatctcccagacagatcctagaaccacagggcacatgtgaccagaatccaatctgtgcaaatcaatcagcaaaaggagcccccagcaaaggcgcaggcgggggcctccggggaccggcaacctacacagcgcacagccccccagggtccgagtcctccaaacccgtgtaggcaggagcttcctttaccttgattttgcttgatgtttgctaatcttctctttgaacaccccacagcgtgaaggtaagcaactgttccctaaacgacttagatccttaaaatatgtgtggttgggccgcatatctcatgagagagcctccgcccaaaccagagccctcctctctctgcggccaacaccctggt

SEQ ID NO: 131235 - DNA, 1513 bp, Homo sapiens
aacagggaaagaaaacagaaggtggggaagaggaaggaagagagggaggaaggggcagggtacttgagagaccatgaggatcccagatcagtcccacacatgattacactgaattatgaactaagatatttaccgaaacgttttccattaatgcatatttgacttgctttttctgacctaatgaatttgcaaaacgatgacaatcatgtagcaaatgtacatggactagtactcacaattaattttttattttctatgccagcaggagacaaagatgatagaagaatgaaattcatttttgacccagaaatcttattttagctactgctttatctgctcttaattttctaggagtggactttggggccgtcgtgccggatcctccctgaatgtggagcgatggggggttgcacacaggccgttctgccccagcagctaacaagaaagacccttgcattcctccctgcatctctcccttttgggtcctactaatgtctgttgaatttctcttttttccaaagcaaaatccttctctgcattttgtctgcttgtctgtttcccagagccgcagactctctccttgtctggagttccagagagcccccactttctctttctaagctgtgttgtgtgtttcctgggtacattctaggttccccaaagataaacatgactaaggattggaaaggaggaaaggccgcgcagattgtttaatctggaaagtcaatccccggatttagctctcaaaaatggctttatttttgggagaaaagcaatagagtaaggacagaaggacttaacgcttgcagggaagtggctttctgccatgtagagccaggctggcaacctgccctctgccatcagggagtgagcatgaacctggaaacctctaggacgcaagagcgaggctggctgtcccctcgtgtgcagtgcttagaccttcttgccacacatcccgtccctcacctcactggatagcccccgaatcaactgttcacacgaaagcagctgcctggttctgagtggccatgctcactcccaagcacaggctgaatgaaaagaaaactgtgcaagtagcttgtatggtgggaagcccccagcagaggctgagggtgcagccaggtgctctggaagccttgaggcctctggtgtcatcttcctcacctctaaataagagatgggctaggttggtcaaggtcctccctgtcctaaaacactttaatgaaatggaagaaaggctgcaggctgatagaggagggacagtctggtttggttccctcaagtcttcaggagagggctcaaggacagtctcccatttcttgttggcaaaatgtaaagtgcagtctggaccctgtccattgagtagagactcaggaggccaaccaagatccctgaaaagctaacagcgtggtcagaagccttcggccacgctagtcctgaactcccgacctcaggtggtccgcctgcctcggcctcccaaaatgctgggaatacaggaacgagctaccactct

SEQ ID NO: 131236 - DNA, 183 bp, Homo sapiens
atatgcagggagagaaactgaggcccagagagctgaagcaaattgccccaagtgccacagctcttaagtgatgggaccaggactcatattcaggtctgtctccaaagcccgtttctctatattcatcagctgttgatgctgtgctcggccaacctaatgccactgctggtgtgggcagtgact

SEQ ID NO: 131237 - DNA, 522 bp, Homo sapiens
gagtaggagtcttgcaggccccagttgaagacggggcgagggtgtagtgagcgggggcattgacgtgcagatctgggcgatcccaggaaggtcggggaccccagggtaccccagctggcctggggagaagggcagaggcgggctcggaggagatggcaggatgcgtggccaagaggagcctgatcggctgggtaccgggcaggagtcccaagatgaggtgagaggggaaggaactgaaaaggggcggaatggaagggttgcccctaaacaagggaagcgcacgggagccacttggaggctcaagtgtgggggcggagagtgggggcgccgggctgggaatgtgaagggtgaggggacctctcttcccctccgatcacttcttggttgcattgacatcccttcccaccccccaccccttagcatccccctttctcgatgcctcttgcttggctctggccagccccagctgtcagctctgaggccgggcggaaggggtcggagcagggaaaaggaatgtaggaa

SEQ ID NO: 131238 - DNA, 186 bp, Homo sapiens
ttctttctagcacttttctcattcccgcttttcttctttctctttttatcgtgtgtcagctaaggctacctaagtgaacttgatccatttatttagctctcagtctaaatatgccataattaaaatggttagaaaacactgcaaattatagtcttatgataggtccgctgaacacacaataaagaa

SEQ ID NO: 131239 - DNA, 708 bp, Homo sapiens
tgcagtggctcaagcctataatcccaggtttaggaagccgatgtgggacaatcacttgagcccaggagttcaagactagcctgggcaacatggagagaccccatctatacaaaaataaaaaataaaaaataaattagcaggtatgatggtacacacctgtggtcccagctacttgggaagctgaggcaggaggatcacttaagcccaggaggtcgaggctgtagtgagccatgatcacgccactgcactgcagcctgggcaatagagagcctgtctcaaaaaaaagggggagggaggaggaagccaaaaaaattatttgccacctctggcattagcagtgatcatttcaccaaaactctttactctgaaagatcattcctccaactcctaactctgaaatgttcattctttccttctaatctgcctcttcagtaggaactgtaagcaaccaggtaatgaaacaaaactttcccttaccagaatgcagcaaataaatgtaaaagaaaagttagatttagaaagccatcattttgctacaactgactccagcgaatatcatcaatggatgcataaaaccattaggaaaaaggctgatgaggaaataaatattttcatattgccaaggctgcatcgctgtgcagattacttgccatctcaagtatttaggaagaagagattttgctctcactaccttaacccagtaatcca

SEQ ID NO: 131240 - DNA, 223 bp, Homo sapiens
ccactttgataaaaatatcatttattcattcaacataggggacttcaaaaacagagtaatattctttcttgcttttttttttttttggtttaactaggtgttagaaggtaggaaccacttttattgtcattttttattctttataacttgatatgttataaacattatttattatctactaaatagcaaatacaaatgataactcttcattgttgatgaaagc

SEQ ID NO: 131241 - DNA, 365 bp, Homo sapiens
tcaaactcctgacctcaggtgatctgcccaccttggcctcccaaagtgttgggattacaggcgtgagccaccacaccatataataaacaagcaaacataagtgtttccttgagttctgtgagagccattatagcaaattattgaacctgaggaggggatccggggaacccctgatttatagccaagtcaaacagaaatttgggtaacctggagatcaactacctgtgattggcatctgaagtaggggagagtcttgtgggactgagcccttaacgtgtggggtctgcactaactccaggcagtcattgtcatcatagaatagaggacacccacttggtatctggagagctggagaattgcttagc

SEQ ID NO: 131242 - DNA, 453 bp, Homo sapiens
gcagaatgttctcctctctggtcctggagtcccatcatctctcaccttgcctttcacctgctcttctccttctcagtttccccttctgtaaattatattctgtgacattgagagctattcctacaccctgacttttaattctactcttagggaattttgacctttggggtttagagttctagtcaagatacatcatgtctgggacagcactggttgaccagcagcagaaaggggccgagggcatggggaactagagttggtttggctggagtgagcgtggggttagggtaagacccttcaattttagggctgccaaggagcaactgagaacagcagagagcaatgcacaccctccttaatcccccagtatgcctgagctcttggccgctgaaagcaagctccatctatcctccttaggtggggtccccttgggtgccacactccaaataaagc

SEQ ID NO: 131243 - DNA, 294 bp, Homo sapiens
agggcagtagtggtggtgaagtcccagaaaaaaggcatatggaagctgtgagcgtggttgaaggtagacatttcagtcagctgaactggaaggtaagcccccacaaaagaccactctcctgagaaactgaggcaccctctgggagggactccagctaagggaagggagagtaggggatacatgcctaacccaaggacaatgccttggtcactggaagtgggagatgattctaagtgcagtgtggtgctggtcacttgcatatttctccctgccaggcctctggggacagggaca

SEQ ID NO: 131244 - DNA, 393 bp, Homo sapiens
ctgtatccaaacactgccccgcgggtgacctcaactgtaaaccaagggagagcgccacttcttcaggataagattagagaggcttcaagtgcccaagagtgaatttaaccctctctgaactggacaaaattgaccaagagttgagctcagtgaacatcaccatatctgcaaattttgagacctctaaagctcaatctgtctcttgtacaccaagggagtcttgaatattcatataatttcaataaaagctcaagacattaaacattatgcttgttttcacaacagcatccaggacaccaggggttcttaagaatgctacaggtttcatatcagctttggagacgagtaatagaaaaggtttttacagtttcacctctttcttatcagacatga

SEQ ID NO: 131245 - DNA, 92 bp, Homo sapiens
atgccagtccgcgcctcattgtcaagccggatgttcacaactcaccataattccagaggctgagggacagagaagaggctgcagcaggtggg

SEQ ID NO: 131246 - DNA, 457 bp, Homo sapiens
ccagcacagtccacgctgctcaatagatggtccaaaggtgcctgcatcagacaaataagggacatggtttctctgagaccacatgaaacctgaagggtagccatcagtgacttccagagagaaaacccagaaggcactgagcacttggatgatgctggttctcagtaggcacattagctgcattaagctaaactcactagccaccctacagtcctgcagagggaaggcctgggaaatctcagaacaagaggcagtccgcaggccttaacccagcagcatccctccctactcatatcaaatacataaaatgccactgagagtcaatttaacatgctgctttaattttttgttttaaatgactgtcaaatctatcagggctctcacaggtgtatgtatcagttcagtccctgttatgattaattgtatgtgtctatttgactgggctacagcatatcca

SEQ ID NO: 131247 - DNA, 723 bp, Homo sapiens
cggacgcgtgggcagctgtctttgtctggggcggcggcagcgtggcaggagcgaggggcgccccgacccgtcccctctgccctccactacccctgccggctccagcccgtccgtgtctcaccgtctttatttaacaaagaacggagagactataaatgaccctgagcagagtggctgcgagcagggcccctggggcgtcccacgggcgtcatcctagccgcgtgagcgccgagcttgggcaccgggggggttggcgtgcttgtacacttgctccgttttctctaaactgccgcgatgaatgtcagtccccagagccggaaccgttcccggttttctctacttggatctgagaactctgtccctccagccctgcgagcgctttgccagggtgacgggcggaaatgtccccgcatccgtgcctgctttcccagatgggaccctccagcagtcccctccactgcccgtgcttcctcctaaccacttccccccagcgaccgcggaaggcgcttcctcccccgcagcgcgagccccaagctcctccagagccccagctctccccgcccccttcccgaccttgtttcatatgacccctcccccgcacatactcaatttcgtcttcccaaggcgcccactctccacatcctgatgaaaaaaagagccggctgctgtcctatgttattgtcatacttctttcctcccgtgcactacacaacttgaacaact

SEQ ID NO: 131248 - DNA, 266 bp, Homo sapiens
cgccacaggctgccctttatcaggggagcaagtgaccaacttccctgcctgttctgaggctgcaagacggtccactgctggtgggtctggcagggctgacttatggagtaatttctcccagtgtctggaagcagctttctgcccatgcctggggtcagggcaggacagaggctatggggaggggttgagtgtcttgctcaaagtcacaaggcagctcaagagtggtgacgcaaggactggaccccagatctgacttgtgtgccctg

SEQ ID NO: 131249 - DNA, 349 bp, Homo sapiens
ccggtcgcacactgcaacatattcctgtttgagttaatgtttaatcattaaagtcaaacaagaatattttgcagtgttttcgcatgcaaggaagctttataaataaaaaggtttatatagtttccactccttaaactttcaggtcatccttgtgtaatttgagatcacttttctcaaatactatggatgaaagattctagattaaataaaactttttggttttggcaaaaacaggacacatttttaagctcttgtagatgaaggagtgggttatttttgctttgacagccaagatttgagcagtgtaaggctattctaattttgaagctagtgttgcagtgtgcttccg

SEQ ID NO: 131250 - DNA, 390 bp, Homo sapiens
tgctgggattacaggagtgagccaccacgcccggcctcttgccccttttaattgaggcttaacttacatacagtgaagggctcagatcttatggtattgcgtgatacagttttacaagtgtgtacacctgtgtaaccagcacccacatcaacaaattgagcacttcctcctcaccggtaattttcttcaggcttccttctagctgatacccctgtacccctaccaaaggcaatcactgttctgacgtcttccacggtggatgagttttgcctgtttctgagtgtcatttctgttgaatcgccccatgcatcctgtggtccttgtgtctggcttctttggctctacatttagttggtgagatccatccgtgttgtgtgtgtatcagcagtg

SEQ ID NO: 131251 - DNA, 490 bp, Homo sapiens
cccagactttcaccaaggaattgataaactagtcactgcaaatatattaatgggctttcagatgatggcttgtcagctaactaacttactttttaatggagagccttcataaggcaaagctcagaacaccaataatttattctactgacatatatttcaggctgtttctctctaattttatcatgtaggcagcttctcctgtgccaacatgagccaaatgtttagaaaaatgagcctatagaaacacttttcttatgatttgtctactattcattctttaatttggcttttgcttatgactctctcagttctaactttacacagttccaactcaggtcatcaagaacttcctcttttctaaatttaatcaacacttcccagtcttttgacccggagaggcattgtacactgctaattattaccctggtgttgtttaaaacaacacaactaacaacactaaaactgacagcaattgtgtgtccactgcatc

SEQ ID NO: 131252 - DNA, 434 bp, Homo sapiens
caggcgcgcgctaccacgcccagctaacttttgtatttttagtagagacggcgtttcaccatgttggccaggatggtctcgatttcttgacctcgtgatccacctgcctcggcctcccaaagtgctgggattacaggtgtgagccaccacgcctggccaacatggatctttattcttaatttcttttattaattctccagacattgttgatcaccattacttggcttccttaggaaacagcttggggttggcacaggaggcagggaaataattcttacccccttaagggctattaacatgaaattgatttcatgccattgtgtcagttaaaggatgttgctctatttcttgctgttctttgcttttggctttatttctgcattgtttagtgtttcaaggcttgagcgttttttttttttggcccttcagtttga

SEQ ID NO: 131253 - DNA, 239 bp, Homo sapiens
ggctgtaatagtagtttggaatatacttcatttattctagttcttttctctattttattacctttctgaatgtgctctctgctcccctggggcccattcccaatccagtagcggcaattaccattgggataaacctcctacctctgaggcccacagttttcctgaccatctctctacagcctcacttccacctctacctctccataaaacaatgtgtatacttctgttcatcagctaaa

SEQ ID NO: 131254 - DNA, 190 bp, Homo sapiens
ttttgaaatgttaggcttcagcatgatttagtgccctggcatttctgagctagtttacagtaatcaggcatttgttaatgctcactttctcctccacggactgttgctgacacaggaattttctttgttgattagatttagccctgtgctaaacagtaaccgggggagggtagtaagggaagcctggacg

SEQ ID NO: 131255 - DNA, 877 bp, Homo sapiens
ataaacataacagaatttgtttgggcaaagaatgatttgtgaattgggcagcattcaaaactggaagaggtttctagagctcttctctctccttaaattctgcctgtatgtatttgttaaggtggccaagcatgggggtgggtgacttggtagtcagggtatatttccaaaatggtctgtctcaaagggcctcattctttatgttatgtgcaaataagtcattaatgagatattgtgtcctggagacagttcaaggaaactgtcccactttaggcattatgttagccttgatgttcatgattataaaaccatgagcaatctgaatttgttatctgccctgcctaccatccatagtttgttgccatctccttttcttctcaaaattaccagagaaagacttcctgaaactgattatttctcccaaatattttcttacctactgctctgttgaacaaaatgtgagactaagaagcttagtttggtttttagtaatccattttcaaactggcatgtaccctccaatgttaaataacttactgtccccaagcatatgcaaatatactggttagccctctgaggacaaaccagggtctttgaaacaaaatcagtttgaaaatttgctttctatcttcttcacagtttttcttctctttttattattctgctacatttctattagagatgccagaaaagggcacagaggaggactttgggagggtataaccagaagaaaaaattgatgagggttaggtgagaaccaccgttatattgccatatataaaaatacatggagggccgggtgcggtggctcatgcctgtaatcccagcactttgggatgctgaggcgggcagatcacaaggtcaggagatcgacacc

SEQ ID NO: 131256 - DNA, 408 bp, Homo sapiens
gtgaggcttgcccaacgccaggtggcttccattagtctgtgggtggggccgagggtgaggctgctgggctctgtccctcctcccctccccgtccccaacaacactggggaggaatgccgcagacaagctgcctggactcctgcaccactgaggcccaggagggaaggctgatgtgttcagggacagccctcttgtttgccatggtagcccccatgcctggcatggggtacatgctcaataaataacctgtggattgttatcagagacaagaggcacctggaggatgggactagaacctctcccttcctcccctagacacttctatacctgcagggtgtcctggcccacttctcagccagcccccactttctagtgaaccctggaagtcttgtaggcccagggaaggct

SEQ ID NO: 131257 - DNA, 455 bp, Homo sapiens
tgaaaggtggtaggtagtacgcctgtatcattcgaagaaagtctccgaggggattttcatacatcttatttcaccctctgttgagactcacagactcatctataagcacttaatttagctcttcaagatcctagattctgaaatctgctaatagctctttatattcagataaagtcccttatctttgcccagtgcttcagtatatagtaattttacctctttacccaacctaaacccccaccatgatccattttaacaaagtacttccaatttagaaactcatcaacttaaccttcctacatctccaatttaaataaactcaagtagtatactacggttatgtgcttaaactctgagagcacacagattctagctggtatccaagctcaaatatgaaaacagtaatcaggaatctgaatattggccaggcgcagtggctcacacctgtaatccca

SEQ ID NO: 131258 - DNA, 399 bp, Homo sapiens
ggctgaggcaggggaattgcttgaacccagccaggaggcagaggttgcagtgagccgagatcgcgccattgtactccagcctgagcaacaagagcaaaacctccgtctcaaaaaaaaaaaaaaatccgagaaagcatgaatctgttgtgctttgccacagttgacattgcacttcaggaggattattttcttttatgaaggtatgtaagtgtccttgcatgcctagactaaaatgaggttagggcttcatttggcaaagacgtttggattctgattgcaagttaaccctgagtccgatgctgaaaaacgaaaaatggtttaagatgtgcccctgcccttggagtccacaatccagttagggaaataagatagtatattctttatttattcctgtctttc

SEQ ID NO: 131259 - DNA, 610 bp, Homo sapiens
aatacttctccccaccccactgccatcgtcatcgctagagacccatgatctcttgcctggattacaggcatcccagccttcagactcgccctctccaatctactttgtagtctgttgtgacagtaattcttctaaagcgacatcagataaagactgtacttacttttctatgtctccctcaatgaaagtttgacctcagcataatgcccactttgtgaaatggcttataaaggagccctagtttatctatctgttttcctcttccatcccttgctcccttactcactatgtcccagtcacaccacagtttgtctgttccacctgccctttcatccttcagaactatgtccatgctgttgctgctgccactaacacccttcctttccccagcccttatactagtcaattcctattcacacatcaaagctcatcttagctgtcattttctccagaaacccttgtaatactgtatttgctctaacttgcctgtattcccaaactgactgtatatattataaagggagggtatgtgtctgactcatgtaccactgaatccccagtggcttgcagtgcccagtaaatatttctctttatttagtttttaaacttg

SEQ ID NO: 131260 - DNA, 455 bp, Homo sapiens
gtttattgttgttttgctttaagtagattatttacataatgtatgcagaggtggaaagttttgaatctatagggatattactattaaaatgaattaacagtcttacacaatggttatgagtttagccagtgttagcagaaaggctagagataaatccagtataattagtttagaagctaaagttaaagctaaactcagccccctctccatatgttttgggtttgtttttttagacggagtctcactctgtcaccccggagtgacaggctggagaacggtggcatgatcttggctcaccgcaacctccacctcccaggttgaagcaattcttctgccttagcctcccgagtagctgggattacaggtgcctgccaccatgcccggctaatttttgtatttttagtagagacgaggtgtcatcatgttggcaaggctgatctttaactcctgacctc

SEQ ID NO: 131261 - DNA, 419 bp, Homo sapiens
ctccatatctccaaatctcatcctcagaccttcccagaacattcacagacaggtaggcactaggagaataataagtctcagaaaacattccttttggttccccttaaaacaagatgttgccacttttaggggctgcattgtggaaggaaggaagggagaagaaagaagtgaccttctcacagtcacttgatctgactttccttatctgaaatcaaaatataatgcaagctggccaggcgcggtggctcacgcctgtaatcctaacactttgggaggccaaggcaggtggatcacctgaggtcaggagttcaaggctagcctgaccaacatagtgaaaccccatctctactaaaaaatacaaaaatcagctgggcgtggtggcaggcatctgtaatcccagctacttgggaggctgaggc

SEQ ID NO: 131262 - DNA, 459 bp, Homo sapiens
gactcattgtcttcctctgatggcatcttaatggaattcaatacaaaggccaaaattcctttgttttgaagccacaagaaaacacagccaatggaaaagccgtgttagtgctgcctgtcctattctgataaggtgaatacttaaaagctatgaaagaagcactgagtactgctggacagtttgagttcatttggctggtagaattgagtggaagtcaattctcatgccatttaaactggaagaaactgaagattctccaacccaagctcctctttttgcagatagtcaactgaagccctgtaagactgtagttttatagataaaaaagagccatgtgaatttcctaaatcacataacagtcagtttattatttgacatttatggtacattcacatggaagagaatgattagacatttccaggagagaatacgactcccaattccctgagttaccattag

SEQ ID NO: 131263 - DNA, 320 bp, Homo sapiens
ctttcttctaggatagttattaaaatgcataccactttcaattgtgtatccggcattctttccgtgatgttcagtgcctcgctagtcattttcatttaaagagacccaaatacttccatagaacagtacatagaaattcctgggtcaataattaagttgtaactaatagctcatagtcagacatcatgttattacaggtaagattatcttccacctgtatcgtttttcacagacctacagacatgaacgtatttgtattttcctgcccccccctcaaaattttatgaaatttatttcatttgagtcctttatgtctggtt

SEQ ID NO: 131264 - DNA, 288 bp, Homo sapiens
ttctcctcttcttttgcctcttcttcttttttgtcttttgcttttgcctctgcttctctttttcccttcactttcagatcaggacagacaagtgttctaggagactgcttcttcttttgctccttggtgattcagcatgtctctctgcagtactaggcctagagaaagcttcacttttgttcttaatttagcactgatgaaggtcaccagtttagtctctctggtataccaaaaaccttcccacatgttgcttttaagtgaaatgtcatggtgaacagatcctttacc

SEQ ID NO: 131265 - DNA, 678 bp, Homo sapiens
gtacccactgtcaacacttcaagtataatcctcaagttccagtcaatgcaataagataagtaaaggaaatactcatttaaaatatttaaaagaaacaaatttttatttaaaattccagacttgcctacagaggagactcaaaagaatccattgattgtgagatttgacacaggaggttagtaaagtaactggatatgagatcagtatactaatatcagttgcttttctctcttctaacaacaaatatttattaattattttcatcagttttattaaatgcctactacataccacaccctgttttaggtgcttggataaattaataacatatatagccaacaatccttatcctcatgagagtactttctgtaatgactcctacatttacaatgacaagagcaagcaaataaaagatacttaggaaacctgggggctggggggaaggtcagttttgtggagaaaatttggaattatagccatgaaagtttacctaaatgaatgaaaagctctaccatgtttatcaatagaaatatttcacttcataattatattgttttctgcaagtgatttctaaattcattgcatttccgaccaaagtggaattttggggatttttgtgaaatgtgatgttttattttaaaatttatatggaagaatgaagactcaaaatgggtgaga

SEQ ID NO: 131266 - DNA, 560 bp, Homo sapiens
gaaatcagcctcaacccaggaacctccataggaagagaaattatccttgttactggtttagtatgaagcacttctcgtctagagttctgtatagccagctgaaattcttcgttgtgtactcagaacatgtcaaagccttctgtgtatcttgtagttgaatggtcactcttaggttctagatgtcatctcagagatagaaagagctttgggttgcaacggttagagctttgaggcttgaaccaaaggcggggcagctgtgcacccagtggctcacatcagcctttcagagcccagatctttgaaaatgacagataatcctggaatctctagtttttggcctgctgcttttctaccatgcgtgtttcctggggaatgaaccagcagcatagtggctttgagtttcagaagtttttccctctagcgtcttgtgcctgagctaatgaacggaaggaatggttataaaattggccaggtcaaggggaggaggagataaattcaaggggacaaatcctagtccccataacagcagcctgtgttatgacagcacaccacagccccaa

SEQ ID NO: 131267 - DNA, 338 bp, Homo sapiens
gctggaagaatgaaggatgaaggatgaggccaaagggtcgtggcagaagggtctgagagagagctttccaggcagaggggtagcctctgtagagcaacaagtgccccaagggaagaagcaaggaacagaaataaggcctgtgtagctggagtgtggagatggagagaaagcccaagacaagcagagaggccactgttagataacgtagcattaggcgtagggttctgcaatttggtgtttggtcatggagcaatgattgatggctcagcagggataagacccgttggatttgcattttagaagatcatcctagctgcaggtggagagtagattccagt

SEQ ID NO: 131268 - DNA, 743 bp, Homo sapiens
gagtggagaaggtcaaggatagcttctaacaggaagtgacacatcagctgagacttgagggatggcaggggatggtctggggaggacgcaggggcggggagtgcatgcaagagaaaagcttgtgcagagggaagcctggaagccagccaaggcctggggcctttggagaagagaaataactcagtttggcaggacccgggagcactgcagtgggagcaggagcttgtggggacagaggctggggagggaggctggtccagcacggtcctgctagagagtttagatactatcccaaaagcaagaggtggagtggtgttagaggccacgccagctgccatgggggtgggctgaaggggccagcctgaggctggaaggccctttagaaggcgcctcacctagggacgaagcaggggggagcagttggtgaattggcacccaccacgtagcacttgctggcaggtttacgggtgggagaggtggagggtggagtcagggtttctgggtttctgatgagggggtggatgttgccctcactgaagtggggagcactgtaccccaaacagaaggggaacacagcaagtgctcagacactgaaagaaatcataattcaccatccacgatgctaatgccagaatgatttataacatcaaaaattaaaaacagtggcttacacctgtaatcccagcactttgagaggctgaggtgggaggatcactgaagcgtaggagttccagaccagcctg

SEQ ID NO: 131269 - DNA, 668 bp, Homo sapiens
gtatacaacttgtgaggttatacttgttttcagctacttttctatagggattgtgggagatgggtgctgagaggggtgtttgcctgtgctgtggggatccccgttcttccagggtcttggcagcctcctgcaacaaacttgctggggcctgctgtgtgtacacactgtatcaggctgggtgtacctcgttaagcacataggtggtaaaataagtaccacggtaaaattatggcttagggctcagggtaaaattataaaaaaggaacagattacatcccactgtgggcaataagaaacactttctgcaggattctgagatgggcctggaagaatggatgatatttcaacagggggtaatgaggaaatgcagtttcggtgtgggcacctgaacggacaaaaggacaggtgtcatggaaaacaggttctgggaaacctgcatcacctaattcactggagagggataatagtgatgctataaatagcaaatgaagtcagttgggctcttatatgtgttgagcaccaccatccatctgaatagttgcttaagccagaaactggggagtggccccagctgcttcttccttcccttcatccagaaagttagcagttcctggattttcctcctctagaatgtccctcaaacctgtcctcttttgtcttttctcatg

SEQ ID NO: 131270 - DNA, 153 bp, Homo sapiens
cctacagtagttcccattttccagacagatgcttggtgggtaagggaaccagaaacaagattacaaactgaataggtactgcagggaagggttgtgttgctaaaatgtcctgttccttaaacaagaagaaaacgtttattatgaaacttttca

SEQ ID NO: 131271 - DNA, 194 bp, Homo sapiens
gatctcccacactggcgacgtggggttcctttcaagcctgaggaatgagcactatattttggccacagcattctcactaatgtcctaggatagcagcttagtgttggctttagaattctctgtcatttaaatgtcatgcaaaaacaaacgtataaaagaaaacattaacccagatatctttatggttccttgtc

SEQ ID NO: 131272 - DNA, 558 bp, Homo sapiens
ttttattctcaagattcaaattttaaaatattcaatatgcttcagatttatactaactgtatggtaggtgatatggcaggtcagatactactacttacctggtcaaaacaatcagatataaagaaagacaaagccaaaccaatcaactaaacgcgcaccccaaatcttattaggattcaaatctttaaaattaaaaagtagataatgacatacatgggaagacaatcatataaagctacaatttagaatatgtatagctctttgcaatgcacatcatcttatatgtgagttagtctacgaacacagttataagcttggctactagtatatgcgttagtctgtgaacgtaattttcagtatataataaagttatttatagacaacttgtaaagctgaaataaaacaactcttttaccagcctgggcaacatggtgaaaccctgcctctataaataccagccttggcaacatggtctaaacctgtctctacaaaaaagtacaaaaatgagccagatatggtggcatgaacctgtagtcccaggtattcaggatgctgagg

SEQ ID NO: 131273 - DNA, 336 bp, Homo sapiens
cgaggatcacaccgtaatatgtaaccacacctaaacagaccctttttcaagataatgactgactctctccaaggatcatttaaattccaaagagaactacctacaagttaatttctgttccctgatccagtcattctccctagcaatcatttattacccctcatctaatctaatcccaaaccctaaatctaataaaatacttctaaaatctgcacccctaatgccctcccacactcaaccattccacttactttgtaatttagagaggcctaaattttgttaaaatagaggcacagctaatagatgtttgttacatattacggttgagtccttttg

SEQ ID NO: 131274 - DNA, 726 bp, Homo sapiens
tatgtgtatccgctatggaatagttggttataacttttagaattctagaggtctaaaaccagcatgatagctcattcctcatctcttggtctgaagaggagggaggcacaattgtttataaacataacggcactgaggtggggtgtatgggtatgaaatcctagtgtttctacatggttactttatataggttttactgagttaaagctctgtttttaatatgggtcaagactcatatatatatatatataataccataccaacaagccctgcatccctagcatgatcctttgaacctctagtaattagggcagtaactaaattggccctttttattttccactggtgtcaataccagctaagaggattacatcttgcttggatattaagactcttttcataactgaaagcatctaatcctgattattcactgtttgtatttataaaatatataaaactagaaataaatctctcaactgaggcccaaatgtcacagtcaaattaaccttccttgactactgattcactttgactcacagctaatgaggacagctccttttttttttcttctatttttctctcagtgcctgtagaataaatcctacatagaactggaaatagattttattgtgcatatatttacttatctcctgtgcccttcacattgcttccagttctgtatcccctgtgcccttcacaattgcttccagttactttggagatttt

SEQ ID NO: 131275 - DNA, 501 bp, Homo sapiens
tatgcattctttctatccgagtctgccattagtcttgcatgaagcctcagtgccatggaaatgatggcatctgtttaatttggtgaatgaaattaagcttaacgcttgttactttcaggaaatagccttcattttaataactcgagagggttaaacaattcaaaagtgctattcagttccgtaagtttgatggaatgaaaattggtatttgatgatgaacttcaaggtctaaacctcaagggaactcaacttggttgtttcagtaggctgtgaatttatgttttcagttcaactttggtgcttgattttctcatagtttttattaagcgttaataacgtaaggtggcttcattcaaaaagaagacttatttgaaatattttaattatgccttttatgtgttttgtttaaagtaatctagcctgtcctcatttgcagtgtggtatagtttatcatagctaacatagcacatcccattaaaagttatgcctagatagtttcag

SEQ ID NO: 131276 - DNA, 398 bp, Homo sapiens
tccgcctacctcggccacccaaagtgttgggattacaggcgtgagccactgcactctgcctcctcatacaaacttgtactctgcctctgcctcaaacttctgtttctcactgtcacagttcttggaaaagcagcccccatttgctgcctttataattctttgccctttaacttaatgatatggcttactcttctctcccacccaattgtatagaacctgtcagtcataaaagtattagcaacctcctgattatcaaatgagattcttctctgataatatttatcctcttttctggtattattgctcatttcctctgcttctcttttggtttttatgacattccctccttggtcttctctctctcaaatcacgtttgtttttcactgacttccctcccc

SEQ ID NO: 131277 - DNA, 372 bp, Homo sapiens
atcttctgaattcttaggaagctattcttcttgtagatatatactagatacataaagttttaaccgatacacttgaatttgtatttctaactgattcataatatcagttagcttaaaaacataagaaataggtgaatgatttctgctattgaaactgaagatataaattaataatagctgccatttattgagtccaagctatgtcccaggctctaggtgaagtagtttacaaatatctcagtagatcctcaaaatgatcaagcgtggaagaagtattgtcctcattctgtaaatgaggacatggagactgagaggaataaaataatgtctgcaggatctcccatttaatatgtggtggagcctaagttagaa

SEQ ID NO: 131278 - DNA, 300 bp, Homo sapiens
ggcggggctctgttactgggtaattttacctagtatgtttgcttattagactgatttttagcagtcgtcattttgtaaaatagataggaatggtcatagccactggatttccatgggtagggttttgtaaggtaagttgcagtataagccccaaggaataatggtattaaatcacaatttgtgagatatttggtctgtcatcagtagatctgtgggccattgtgctgcaagctgtggtataccattgagatgatagtgactgtcttttccctcaaagagcctgcagtctagacctggcag

SEQ ID NO: 131279 - DNA, 713 bp, Homo sapiens
tagtgtccctgtggagatcttgtcagtttaggtctggtttttattcttgctgatccagttagtaatcagaaagtggcttggtgaacacagactcagaataaaggaagcagtagttttgaaggagatttcattataccttagcgaggactgatgtattaagtttgctttatagtacaaaacatttgtctctcaaaatcataatgcctgctgagtcagtatccattttccttggacagtgttgggtgaatactgcgaaattctttttataaccccctccttctttctaaaaactccatttatactactgtcttctgttaatacattctttatatgaatttcagtatcattaggttacgtctttatatatgtcatttttttttctgaaatacctaattaccttattggacttgggctagaggaactcaaatggtctttttatggtggacgactgttatagatagagataccatccattatatgtttaccctttctagattcatgtttagttttgtcttctaaattctgagtatactttgttctcatatgtcgattaatctggtgtttgtttaatatttcatagttatgcaaataaagttcacatatatcatgttgttttatccagttcagaccctgtgtcagttatctgcgagtgtgtcgtgattcccatttttaaaaacaaagaaactgatgatcagagaatataagtgactttt

SEQ ID NO: 131280 - DNA, 327 bp, Homo sapiens
ggaaaacttgggagtgggggttcctttatgagggaggtcacaccccctgcacaaaaacatcccaaagagaactggcattgagcttgtgttggagaggtggagataccccagggaggaagtggcgaaaggtgagcatgggaacacccctctttgatcccacaaggtgcgtcagggaaagttggatttcatttagtccgggatggtgacatctctccgcacgctgccaccaggctcagtgggtcagaggaagtgaggctcccctcctctccgacctcaggtgatgcgtgtgcgaccccagccatgggtctgacctcctttcgctcccgc

SEQ ID NO: 131281 - DNA, 480 bp, Homo sapiens
acattccatgcatgtttgctgaataaatacagaagtataactggggctggagtgggaggagaaacctgggagaggaaaataattctttttaaatctaatctccaaaaaacaattataaaaaagtagcacagtgcttagggcacagcactggcagagcagatgagacctttgtggcataaggaacatgtatctggtctctgccccctgttcctggaacagaacttctaaaacccctgtaatttctcgggtgacaggaacgtcttttgttctaataaggtgactcttggtgggctcctggatgggggctggtcaccagaaagactgagccatgattagaagctgggaacttccagcccacccccatcctctggggaggggagaggagctggagctggagttaaaaatcgataatgccaaagtgatgaagcctccataaacatcctgaaaagaggagattcaggtttcagagtggtgaacaca

SEQ ID NO: 131282 - DNA, 438 bp, Homo sapiens
ctgagacaggggtctagaaacaatacgcttgtggtgaaacgcccatccagtcacacggcacggggctcctgagtcggagctacactttgtggtatgcatcttaacacatccagcctctcaccattctccaaagatcttggcacctccgtggagtgtcaaaactgcagtgtgggccatggctcatcaggcccagcgttttccagaggcccagggtgagccctgagtttggccgctaaactgtgactcctgagttcgcatgctctgtctggtgctggctctgttgtccactgccttgggaggatgcatcacgaggactttaatctcctactgtcaatagctttaaggtaaagtacatgcagggtaagctctccaaatgtcagagccaggcgcaggctttgtgtttggtgctgatgcatggcatttactctgaaggttcag

SEQ ID NO: 131283 - DNA, 215 bp, Homo sapiens
ttgacacacaggtgaggactcaggagtccatggtgtgtttcactacagcatcctcatctgatttcctttatgccccaacatacgttaagtgatagagatactgtcagggtttgataacccttgagtaactagttaacatagaggagggtaaatccttttttctcaatgttgtagtttccagaaatatttttctctggtgggcctcttagtcggag

SEQ ID NO: 131284 - DNA, 771 bp, Homo sapiens
gatggagttagttagctacgttatgtttctgtaactgttacgtcttacttgtaggattacaacatctacttggatgaatggtgatgtcattctagcatgaggagcaggtgggattaggttgaggttgaatgggaccatagttctgtcaggacgtgtcatctttgtggagcccaggggtcatccattaagcagctgggaatacagttctggggctcagcagagacctcagcctggaagaacatgtttagaagtcatcaacatctcattaggaaagagaaagagatcgcccaggagaggaaatagagcaaggagagaaaatggtcaacaagggaaaccatgctgggattgagtctctgtggtaccaatggtcttactattgacgtcagagttaaaaaagaagagagttatattcaaattctggttgagttagtctcttattaacatttcctgactcaccaactggtaaatgtccaagaaaaatatatctttttgttttatcagaaaatatacatgctatttgatcactcttcaggcattaacaaatggtgtctatgagaacattttaacaaaatgtcctttctactgttaatacccacagcaaccaacttggaaatcagtcatcatagaagatgactgcaggttctggctttcccaaatcaccaataattcacacctttgtacatggttctgtgcatgatctgttcctaatattatgcaacacttgtgaaatctttaggactttaagtaattcatcgttttgccccaaaccta

SEQ ID NO: 131285 - DNA, 402 bp, Homo sapiens
gttatagtccccctagaaattaatacaggattcatggtctgccaaagtctcattccctgctcagaccgacaatggatagtgggatcctttgtgatatgtgctctgtgagttagaagtagtaacttagagctgttgaggacaatacctttgcaccccatccactgaattttgttttcaaagatacagtctgaaactcccagagggtgagtgcctttccagtgtgtcagagccattagtggctgagcagaccgctgagcatgtagatttctaggtcagggccctctccccaaagaatcatactccctggttgaactgaacctaaatcaggtttaaaactagacagatgccaaccaacttaaaattccaaagatatccaagacctgcccatggccctgggatttg

SEQ ID NO: 131286 - DNA, 280 bp, Homo sapiens
gtaacacagcatagtccactataaaatgaataccatatatgtattgacattcaggggaaatttttaattataaaagtcttatccagcacacagcaacagcacatgctgaaaaacattcttttattttcaactatgacacaattgttttcacatcaaatgaaggcatccagctaccgacagaggctactccagataacggacatttggtatcaactaggtcctttaatttccacagtttacaagcactgggttaaatttaagtgtgagccaagggattgtc

SEQ ID NO: 131287 - DNA, 604 bp, Homo sapiens
ttagcagctctttcatcagcagctctcttacgctgtctcttctgtctcagctgcttgagccagtcgctcccgcgcacagctgtgtggccagctctcacttgccttcagggtcagcagcttaactctttctctgggcatgagctcctgtacagtgtcaacagggcaattataccttttacagacaatagtggcttagagccaagtgatggccttccgtgttatggctacatggctgtgatcacaagtggagttatacacctgtgctctaaactcactgagtccctctggcccggatgtccaccttggcctatcctagaccaaagcacagccatgtaccttaaaccatcctgcatgcagtggcacaggaatgacttctctgaaaggtcaatctaattatctacctccctttgacaaaaatctgtcagtggcttccccttaccttagggatatggtcccaacctgtcatacaagagcacagcccatctgtcacccttgcctctcccagtccttgtgcccctcagatggctgccaggtcctccattacaccatccctcccacctctgtccccttgctctcatacttagatcctttaagactcaatgca

SEQ ID NO: 131288 - DNA, 796 bp, Homo sapiens
actctagtggcttaataaaactctatgaggttgccttggggggaagtagatgttgagtagtaggtgagtcatccaccaaatctttgactcacagttgatctcctacacagcagtcactttaaacctccacaactggactctgaagataaaataaaagttcaagatgtacgtgtgtttttaaagttatgtaagtagtatacttaaacatgtttttgtgatttccttttctacccaactctttaaatgagatttaaccatgttgatatatttatgtgtagtttattcattttaatggatgtataatattgcattattttatgtaacacagttgattaattagattgttctcagttttctgtatcatacactgagcttcaaggaacatccttatatgacttttgcctcctgatatatatgagtaaagcaggcaagcttgacctgaaattgctgggacactgaatgtgtacatcttcaactctaacagttattgcccaatcactctccaaaatgattataacaatttacactcccaccaacagtatgtgagtgttcctagtttcttacatcattaccaatactaggtagattcagatttttaatttttaccaacatgagctcatatatatgcaacaaaaggattaaaacaagcatagaaaaaaaaaaaaaatgtgggcgccggcccggaaatttaaacattgttgggcgggccagaaggaaaggcacggccgagccggcgagggggttcccaaaaccgggccgggtggaaccggcggccgctaggcctaccccccggggg

SEQ ID NO: 131289 - DNA, 379 bp, Homo sapiens
tgcaatactattgtcactcatgcaattagtataattaccttctagctggtctcacttgtctccttatcgcctcccaattcatcaggctttcccaggttaggaaccccagtgactccctattctgtaaaatcaattctaatttgtgcttggtccttcgcactccccatattttggtagcatggaacctatccagcctcaattcccaggactcttctgtaacctggtcttctcacctgctgtgcaaactcctaccttcaggcctctgttgattccccctttttgcctccaattccctcactcctccactgggctttcttcagtggttaagttctgttaagctttcattaccttcatagcccaccaagatctcttccctttc

SEQ ID NO: 131290 - DNA, 383 bp, Homo sapiens
cagggtagatacctgatagtgatacagcaaaaagtggagctcccggggggctctgtgttgttctcagaaggacccggcgtctcctgactgtgaccttccaggccggcgtgccctgctatcggcctgcatctctgacctcagtcagatcactctttcactgagttccagctgctgtttgttcaattctcaagcacgtggtctctttcaccgcaggatcacttgtgttctgttctctgcctggaagtctctgcctccagctccagcctgcctggtagctccttctcagccttcaggtctcagcccagatactcagagcacagctgactgcctgtgtgaaataggcctgcctaaccctcagtctttcctagcattttctttctttc

SEQ ID NO: 131291 - DNA, 2576 bp, Homo sapiens
caggcacctgccaccatgcccggctaatttttgtacttttaaagtagacatggggttttaccgtattagccagaatggtctcaaactcctgaccttgtaatctgcccaccttggcctccctaagtgctgggatcacaggcatgagccaccgtgcccagccacatttatgttttagtaaactgtcaagctgttttccaaagtgctggttctattttacattctctccaccagtgtttgagagttcgaggtcctccctatcctccccaacacttgctatggtcagtctttttaacttaagccattcaagtcgatggtagtgccatctcattgtgattttcatgtatgtttccctgatgaataattatgttgaacatcttttcttgtgttgataagtctgttactttggcatcacttcacatccagcttactctgtgcataagagaatttcactcttttaactgattgcattggaatgctgaccaacatgtcattaggaacaactgtggattttctgttactttatatttaactgggcatgtttgtgaaaggatccagaacatcctccaacttaattttctttgtatgtgttaggttatttcgatgctctaaaattttgaccaaattgatttttaaggtgtggcctgatttcaaggcaaaattaggggttatcaacttattttattagatgtctaattctgtaaatgaatatatatacagaagtggatttccacttgaaataagctgtaatattgacatctcgctatattcagaaataagatgtttgagttgggagggaccttagcagtcactctcttcagccattcccttcatgccccctgcagcactcataagggggttcatctttccactgtcagagattcgagtatctggaaggaccttgtacaataagcatacaacaaaaaaattctccttttgtagatggttgctaactgaccttcatttgaaattgttttatggtagttatttgatgggagttatcaggtgagatttagccatccagagcaagcactgcctattaagaatttcattgctgtgtttttaaatatatgtaaagcgtaaaaaggggtgggggagtaggcagaaagagcctagaatctgtattcccctcagtctgtgatgaaggaagccctttgcaagccttgctttcacaacctcaacatggcatgggctttgctgtcagtcaggtctgagttggaatcccagctctgcctctccttctccatgaacggggtcatgagggattatgggtattttgtgggtagggaggtatattataccctcctcgtggggcagctgggatgcctacctgagataggagatggagggcactggcaccaggaaagcactgggtctgtttccttttcttacctctttctctttctcctcttccacatgttttctctcatcacttaggtcacttatagaaatcgttctttttacttctatttcaatcaattttggaaatttctccaaaaagataataatggtaatgaatacttaagcagtaacatttagcaagtcccttttatgtaccaggaatatcaagtacatttcatgcatttttttttcatttacttttcacaagaactcatgaagtaagctgcaattaaggcagagaggaaacggaatgagtgatggagtcaaggtgtgaaccaagccctaactgaccccagagctcttaatcactctgtatattgcccctatatctaattttaggaatgctcagttgtctgtgtttccacccccatccagatgatgataatatgaaaacagtaacagctggtgcatacctcgcactgagcactggtctgcctgctttccacatattaactcatataaggctcactgtaacctgtcacaggttctattgctgtctccatttttgtgatccccattttttaggtgaggaaatgaaggtgcagagacgctaagtaacttgcccacttactcaggttcacatagagttacaattgatgttcagtctgtcgttcctaatgcctccggtgtctttcccctatcacttcatcatttcttaaaattcattttaagcccatttcagaccaatcagagaagagatgggaactccctcctgcttagcttagacatccgagctactctttccagtaacctgtagaattctttccttatccttgctgcagtctttctaaagtggtgatatattggacacttcatccaaaggctgaactgagactaatgcctaagcaagaaagaaaaaatagcaaattcattaactaggaatctatttacagtcaattcccaaggctcattgtgcagtcagtggttctgcatcatttagagttgctaataaatgaaagtctttgcgtctttccaagtgccttgatatttacaagtctcatattttaccataggaaatggcttcaacaagcatattcatgtgttgacagttctaattaatacaagtaattagccctgacagaactgtgaaaaggagacccattcataaatttgctaattatgttactctgctcagaatttaatcgcagtctagtctttaatcatatctgtatatgggc

SEQ ID NO: 131292 - DNA, 348 bp, Homo sapiens
ggactgtttgagctgctgagcacagaagctactgccagcatgaccagaaggtatcacttaaagtggcatccttcagccatctctgtgtgctctgagactgtggataagagtcctctagtcacccactatctggcatccccctctcactcccctccctgtccccagagctcctgctctctgcttccctccctttaatgcagggtggataggcagagaacacaggacgcttcctgccctgggccctgctcagacctcagtggttcaaacacagccctccccacagagttctcactacctgctccccattatgaccacagcctctctgcatcacccacaggtaacatggcc

SEQ ID NO: 131293 - DNA, 539 bp, Homo sapiens
tagtaatgtcatccaggagctggggcctggaatgggggtctcacaactctggccagtgccccatcctactgtggctgagctggtatccaagaggtaagacaaagtcctcctcagtcttccctgtcctgtcctcaagtgaaaggaaggggtctctttctcattgctgcgagctgcactgtctggggttgggggaggagtggtgcaagcactcccttagccacccctgctggtgtctccctaagtcacatgccaccctagtacactggttctaagcttagcacagcactaggagttgcctagaaattgcaatccttgtgccctagactgcctttcaagtttacctagaaccccagagtactttggcctgcgattggtgaggttactgagaaacttaagttcaagctgctggcatgagcgattcccatctggttagggctgatccaaatgctcccgccatgcctgggtgcttgttgagcacagcacaactttgttcccctctgtggcagggcagcactaagttcaatgtaaagccccccagt

SEQ ID NO: 131294 - DNA, 296 bp, Homo sapiens
atcaaaagcactgccagagccctcagatggaacggccagagtggcccaaggcaaatggcgtcgagttcactggctgtcctcctcctcccccagctctggcacaggaagcccagtgggtcagcagcaaagctgcatgcttcatctccaggtcctgtgggacacccggtccaagggacactctggtgtgggctcccccagccccactcctatcagaggcagagatgaacctgctaaggcaaacggtgacggagccttacaagttctctttatgggccaggcgcggtggctcacacctg

SEQ ID NO: 131295 - DNA, 214 bp, Homo sapiens
ccccgactagcccgacagccccgactagcccgacagccccgactagcccgacagccccgacggtcctcctgccctatctcctccctgaccggtcctcctgccctaactcctccctgacccgtcctccagccctaactcctccctgaccagtcctcctgccctaagtctcctccctgaccagtcctcctgccctaagtctcctccctgaccagtc

SEQ ID NO: 131296 - DNA, 787 bp, Homo sapiens
tatagatgcagcagttaagaagcagaagatttgggtgaggtgacattaaatttgcagcagttctggagcaaatgtagattagttagtgcagggaggttatcacacaatgatctgacatgagatagtctgtgtttgtatgaacttgagcacatctgttaaaatttctaggtccagtttcctcatctgtaaaattggggccgggtgaagtggctcacgcctgtaatcccagcactttgggaggctgaggcgggtggatcacctgaggtcaggagttcgagaccagcctggctaacaaggcgaaaccctgtctctactaaaaagacaacaattagctgggtatggtggtgcacacctgtaaccccagctactcaggaggctgaggcaggagaatcgcttgaacctgggaggtggaggttgcagtgagccaagatcacgccattgtactccagcctaggcgacagagcgagactccgtctcaaaaataaataataaataaatacataaaattggaacaacaacatctgccacataaggaaataatctcatgtgtagcaaagaataagtattcaaataaatgagttttatcagagtgggaagctaaattttattatttgatctgttctcctcttgtatgtttcatatattcaaaattaaggatgaaaaaaggagctgggtgtggtggctcatgcctgtaatcccagcactttgggaggtagaggtgggaggactacttgaggccagaagtttgagaccagcctgggcaacacagcaagacctcgtctctaca

SEQ ID NO: 131297 - DNA, 375 bp, Homo sapiens
tatagatgcagcagttaagaagcagaagatttgggtgaggtgacattaaatttgcagcagttctggagcaaatgtagattagttagtgcagggaggttatcacacaatgatctgacatgagatagtctgtgtttgtatgaacttgagcacatctgttaaaatttctaggtccagtttcctcatctgtaaaattggggccgggtgaagtggctcacgcctgtaatcccagcactttgggaggctgaggcgggtggatcacctgaggtcaggagttcgagaccagcctggccaaaccccatctctactaacaaaaatacaaaaactagctggcgcaatggcggcacgtgcctgctaactcccagcctaactcgggca

SEQ ID NO: 131298 - DNA, 503 bp, Homo sapiens
ggaatccactgatatcatccacacaggcccgcctccccagtgtggtgggtccccaggagagagattcatggcaagtgggcctagtagggcaaatgggaactagccagcctgtagtttaactgaatattttccatttccgtacccatggagtcttccccaggtggttacagatgtaccagagtcaaaagaaaactttctatttcgtcgttgacaatgattgtgtctaaatttagtccaaagccaggaagttggattcatggacagtgttcagctgactccagcctttctacccatgtcataagttgcctttgctttctaatcacatgtcctttctctgtggcccctcgggctacacaagcaaataaatgtggacacaggaaaggcagcagcaatgaggaaaaacatttcatcattagctctcataaaccgcagagctgcttccccaaatcactactgtgtcccccagtcccagagctctggaaaaggacctcagggatttctca

SEQ ID NO: 131299 - DNA, 2561 bp, Homo sapiens
  misc_feature (1059)..(1059): n is a, c, g, or t
  misc_feature (1274)..(1274): n is a, c, g, or t
  misc_feature (1308)..(1309): n is a, c, g, or t
  misc_feature (1348)..(1349): n is a, c, g, or t
  misc_feature (1404)..(1404): n is a, c, g, or t
  misc_feature (1453)..(1453): n is a, c, g, or t
  misc_feature (1464)..(1464): n is a, c, g, or t
  misc_feature (1476)..(1476): n is a, c, g, or t
  misc_feature (1494)..(1494): n is a, c, g, or t
  misc_feature (1507)..(1507): n is a, c, g, or t
  misc_feature (1520)..(1521): n is a, c, g, or t
  misc_feature (1523)..(1523): n is a, c, g, or t
  misc_feature (1540)..(1540): n is a, c, g, or t
  misc_feature (1598)..(1598): n is a, c, g, or t
gcctcgtgccgaattcggcacgaggctgaagagaagctatgaaaagcttcagaaaaagcaaatgagggaattcagaggaaataccaaaaatcacagggaagatcggtctgaaattgagaggttaactgcaaaaatagaggaattccgtcagaaatcgctggactgggagaagcaacgcttgatttatcagcaacaggtatcttcactggaggcacaaaggaaggctctggctgaacaatcagagataattcaggctcagcttgtcaatcggaaacagaaattagagtctgtggaactttctagccaatcagaaattcaacacttaagcagtaaactggagcgggctaatgacactatctgtgccaatgagttggaaatagagcgcctcaccatgagggtcaatgacttggttggaaccagtatgactgtcctacaggagcagcagcaaaaagaagaaaaattgagggaatctgaaaaactattagaggctctgcaggaagaaaagagagaattgaaggcagctcttcagtctcaagaaaatctcatacatgaggccagaatacaaaaggagaagttacaagaaaaagtaaaggcaactaacactcaacatgctgtagaagctataagtttggaatctgtgagtgcaacgtgtaaacagctgagccaagaactaatggaaaaatatgaagaactgaagaggatggaagcacataacaatgaatacaaagcagagattaagaagttgaaagaacagattttacagggtgaacaaagttacagttctgcactagaaggaatgaagatggaaatctcccatctaactcaggagttacatcagcgagatatcactattgcttccaccaaaggttcttcctcagacatggaaaagcgactcagagcagagatgcaaaaggcagaagacaaagcagtagagcataaggagattttggatcagctggagtcactcaaattagaaaatcgtcatctttctgaaatggtgatgaaattggaattgggtttacatgaggtacataaatagaaacttaagtttttctactntccaagccttcaaaaaattactttgtaaatatttacattataaagagagaattaagatcaacttagatccttttgcagaaattttctcaaagaaaatgaaggtaaaacaatactggaagtgagcaaaatatgactctccactccagcagcaggaagggtttttgtttgtttttttgagacggggtttcactcttgttacccaggctggagtgcantggcgtgatcttggctcaccgcagcctccacctnncgggttcaaatgatgctcctgcctcagcctcctgagtanntgggatcacaggcatgcgccaccacacctggctgatgttgtattttcagtagagncagggtttctccatgttggtcagctggtctcgaactcccaatctcaggngatctgcccgnctcagcctcccnaagtgctgggattacagncatgagccaccgngctcggccagganngnatttttttatattatgnatgtgataaatttacctacagtctgtgttcttagttggaagaatgtatatgaaggacntagcatatagtacatagtacctgacacttagtaagtatgcaatacatcctagatggtggtattattattattattattattgttaatgattattatgtttgttatctttttagaaagtatattgtctttaaaataatttaattttaattttatttctacaagatattcacataataaaatattttagaatcttttatatccaaggacttttagtaggtgctataatgaacacaggctgaataagatagcattcttgcctttaagagagattttggatcagctgcaattactcaaattactctagcctttaagagactagagtaatctagtagcaaggataagaaatgcatacaagcttctgtgaaaccagagagaacatgattagccaacagtgaattacagtatagatgctcttttaactgttttgttacaaaattcctataatttgcaaaatgactcatctattctgacccatcttttcttggtgtaggtcagatgtctgaaaattgtataaatgcttttttcctgcatttccagagagtattcctccaaaaagatatatggttccaacatgctccctgtttgctctgaaaaattctaatttcacaatccaggattgtggatactggggtggaagaacatgcaaaagactattatagagtaccttatttcaactggaaaaatgggggactatttttgtaatctttcagaagggtaagattctccaaacatcatgacgccatagaggattttacaacataaaaatgtgaagtttctggatggtaaaaggccctattaaaaaagactaatagggagaaaacagtttataatcagacaaaaggttaatgtaaattattaatatataaaaattccctacaaagataataaggaaaagataatctagtagaaaaataggcaaagaatgtagatagatacctcacagaattaatataaatatctagt

SEQ ID NO: 131300 - DNA, 2449 bp, Homo sapiens
  misc_feature (947)..(947): n is a, c, g, or t
  misc_feature (1162)..(1162): n is a, c, g, or t
  misc_feature (1196)..(1197): n is a, c, g, or t
  misc_feature (1236)..(1237): n is a, c, g, or t
  misc_feature (1292)..(1292): n is a, c, g, or t
  misc_feature (1341)..(1341): n is a, c, g, or t
  misc_feature (1352)..(1352): n is a, c, g, or t
  misc_feature (1364)..(1364): n is a, c, g, or t
  misc_feature (1382)..(1382): n is a, c, g, or t
  misc_feature (1395)..(1395): n is a, c, g, or t
  misc_feature (1408)..(1409): n is a, c, g, or t
  misc_feature (1411)..(1411): n is a, c, g, or t
  misc_feature (1428)..(1428): n is a, c, g, or t
  misc_feature (1486)..(1486): n is a, c, g, or t
taccccttcgcaatatatatatatattttagtgagccaatgcctttatgtttttatggaaataatagtttcattttagtcttattcattgattattttatcatttcccttttacctattgattgatagtctgtgtttctaggctcagcttgtcaatcggaaacagaaattagagtctgtggaactttctagccaatcagaaattcaacacttaagcagtaaactggagcgggctaatgacactatctgtgccaatgagttggaaatagagcgcctcaccatgagggtcaatgacttggttggaaccagtatgactgtcctacaggagcagcagcaaaaagaagaaaaattgagggaatctgaaaaactattagaggctctgcaggaagaaaagagagaattgaaggcagctcttcagtctcaagaaaatctcatacatgaggccagaatacaaaaggagaagttacaagaaaaagtaaaggcaactaacactcaacatgctgtagaagctataagtttggaatctgtgagtgcaacgtgtaaacagctgagccaagaactaatggaaaaatatgaagaactgaagaggatggaagcacataacaatgaatacaaagcagagattaagaagttgaaagaacagattttacagggtgaacaaagttacagttctgcactagaaggaatgaagatggaaatctcccatctaactcaggagttacatcagcgagatatcactattgcttccaccaaaggttcttcctcagacatggaaaagcgactcagagcagagatgcaaaaggcagaagacaaagcagtagagcataaggagattttggatcagctggagtcactcaaattagaaaatcgtcatctttctgaaatggtgatgaaattggaattgggtttacatgaggtacataaatagaaacttaagtttttctactntccaagccttcaaaaaattactttgtaaatatttacattataaagagagaattaagatcaacttagatccttttgcagaaattttctcaaagaaaatgaaggtaaaacaatactggaagtgagcaaaatatgactctccactccagcagcaggaagggtttttgtttgtttttttgagacggggtttcactcttgttacccaggctggagtgcantggcgtgatcttggctcaccgcagcctccacctnncgggttcaaatgatgctcctgcctcagcctcctgagtanntgggatcacaggcatgcgccaccacacctggctgatgttgtattttcagtagagncagggtttctccatgttggtcagctggtctcgaactcccaatctcaggngatctgcccgnctcagcctcccnaagtgctgggattacagncatgagccaccgngctcggccagganngnatttttttatattatgnatgtgataaatttacctacagtctgtgttcttagttggaagaatgtatatgaaggacntagcatatagtacatagtacctgacacttagtaagtatgcaatacatcctagatggtggtattattattattattattattgttaatgattattatgtttgttatctttttagaaagtatattgtctttaaaataatttaattttaattttatttctacaagatattcacataataaaatattttagaatcttttatatccaaggacttttagtaggtgctataatgaacacaggctgaataagatagcattcttgcctttaagagagattttggatcagctgcaattactcaaattactctagcctttaagagactagagtaatctagtagcaaggataagaaatgcatacaagcttctgtgaaaccagagagaacatgattagccaacagtgaattacagtatagatgctcttttaactgttttgttacaaaattcctataatttgcaaaatgactcatctattctgacccatcttttcttggtgtaggtcagatgtctgaaaattgtataaatgcttttttcctgcatttccagagagtattcctccaaaaagatatatggttccaacatgctccctgtttgctctgaaaaattctaatttcacaatccaggattgtggatactggggtggaagaacatgcaaaagactattatagagtaccttatttcaactggaaaaatgggggactatttttgtaatctttcagaagggtaagattctccaaacatcatgacgccatagaggattttacaacataaaaatgtgaagtttctggatggtaaaaggccctattaaaaaagactaatagggagaaaacagtttataatcagacaaaaggttaatgtaaattattaatatataaaaattccctacaaagataataaggaaaagataatctagtagaaaaataggcaaagaatgtagatagatacctcacagaattaatataaatatctagt

SEQ ID NO: 131301 - DNA, 1253 bp, Homo sapiens
gcctcgtgccgaattcggcacgaggctgaagagaagctatgaaaagcttcagaaaaagcaaatgagggaattcagaggaaataccaaaaatcacagggaagatcggtctgaaattgagaggttaactgcaaaaatagaggaattccgtcagaaatcgctggactgggagaagcaacgcttgatttatcagcaacaggtatcttcactggaggcacaaaggaaggctctggctgaacaatcagagataattcaggctcagcttgtcaatcggaaacagaaattagagtctgtggaactttctagccaatcagaaattcaacacttaagcagtaaactggagcgggctaatgacactatctgtgccaatgagttggaaatagagcgcctcaccatgagggtcaatgacttggttggaaccagtatgactgtcctacaggagcagcagcaaaaagaagaaaaattgagggaatctgaaaaactattagaggctctgcaggaagaaaagagagaattgaaggcagctcttcagtctcaagaaaatctcatacatgaggccagaatacaaaaggagaagttacaagaaaaagtaaaggcaactaacactcaacatgctgtagaagctataagtttggaatctgtgagtgcaacgtgtaaacagctgagccaagaactaatggaaaaatatgaagaactgaagaggatggaagcacataacaatgaatacaaagcagagattaagaagttgaaagaacagattttacagggtgaacaaagttacagttctgcactagaaggaatgaagatggaaatctcccatctaactcaggagttacatcagcgagatatcactattgcttccaccaaaggttcttcctcagacatggaaaagcgactcagagcagagatgcaaaaggcagaagacaaagcagtagagcataaggagattttggatcagctggagtcactcaaattagaaaatcgtcatctttctgaaatggtgatgaaattggaattgggtttacatgagagatggggttttaccatgttgtccagtctggttttgaacttcgggattcaagcaatccgccagcctcagcgtcccaaagtgctggaattacaagtgtgagctaccaccactggcagttaagaattttaacaatttgtcaatgaaacaagaatctcaattagagtctttatatacaatctgtactgttggaattttcaaataaatattgtaaagaaaattaaaaaaa

SEQ ID NO: 131302 - DNA, 929 bp, Homo sapiens
gcctcgtgccgaattcggcacgaggctgaagagaagctatgaaaagcttcagaaaaagcaaatgagggaattcagaggaaataccaaaaatcacagggaagatcggtctgaaattgagaggttaactgcaaaaatagaggaattccgtcagaaatcgctggactgggagaagcaacgcttgatttatcagcaacaggtatcttcactggaggcacaaaggaaggctctggctgaacaatcagagataattcaggctcagcttgtcaatcggaaacagaaattagagtctgtggaactttctagccaatcagaaattcaacacttaagcagtaaactggagcgggctaatgacactatctgtgccaatgagttggaaatagagcgcctcaccatgagggtcaatgacttggttggaaccagtatgactgtcctacaggagcagcagcaaaaagaagaaaaattgagggaatctgaaaaactattagaggctctgcaggaagaaaagagagaattgaaggcagctcttcagtctcaagaaaatctcatacatgaggccagaatacaaaaaaaaaaaaaaaaaatgacacacacaacaaaaattgcttggtgggccggacctggagacccataagaaaaacgtctttgatgagaccccacactgtgtgttgtggggcaccgggtccccccaatgaaggtatgtcagtggcgacccacggctgggccaatagagcggtgtacccccctaaggaggaactccgggggtgccaatgaaccatgagtcgctgggcgacttcccccaccaaaagtaaaaaaaaaccgccggggggcgaaacacgcagaagggttctggaaacaacaaccccagagaagatgggagtgcacggcagaggccaccaaacagggggactcacaatacacgacgggagtcc

SEQ ID NO: 131303 - DNA, 1429 bp, Homo sapiens
gcctcgtgccgaattcggcacgaggctgaagagaagctatgaaaagcttcagaaaaagcaaatgagggaattcagaggaaataccaaaaatcacagggaagatcggtctgaaattgagaggttaactgcaaaaatagaggaattccgtcagaaatcgctggactgggagaagcaacgcttgatttatcagcaacaggtatcttcactggaggcacaaaggaaggctctggctgaacaatcagagataattcaggctcagcttgtcaatcggaaacagaaattagagtctgtggaactttctagccaatcagaaattcaacacttaagcagtaaactggagcgggctaatgacactatctgtgccaatgagttggaaatagagcgcctcaccatgagggtcaatgacttggttggaaccagtatgactgtcctacaggagcagcagcaaaaagaagaaaaattgagggaatctgaaaaactattagaggctctgcaggaagaaaagagagaattgaaggcagctcttcagtctcaagaaaatctcatacatgaggccagaatacaaaaggagaagttacaagaaaaagtaaaggcaactaacactcaacatgctgtagaagctataagtttggaatctgtgagtgcaacgtgtaaacagctgagccaagaactaatggaaaaatatgaagaactgaagaggatggaagcacataacaatgaatacaaagcagagattaagaagttgaaagaacagattttacagggtgaacaaagttacagttctgcactagaaggaatgaagatggaaatctcccatctaactcaggagttacatcagcgagatatcactattgcttccaccaaaggttcttcctcagacatggaaaagcgactcagagcagagatgcaaaaggcagaagacaaagcagtagagcataaggagattttggatcagctggagtcactcaaattagaaaatcgtcatctttctgaaatggtgatgaaattggaattgggtttacatgagtgttccttgcctgtatctccccttggttcaatagctaccagatttttggaagaggaggaactgaggtctcatcacattctagagcgcttggatgcccatattgaagaactaaaaagagagagtgaaaagacagtgagacaattcacagccttaaagtagcctcttaaaaaaatcacaatcttggaaataaaaataaacaccaaagagttactgtcatctgaagtagcagctctttaaaaacatgaagagataaaattataaaaatgatacatctaaagcagtggtgaagaaagctgaaaaactgatacttttgataggcattttctctgcactggtttgtttaaaggacttcttccagcaataagttgaaagaataaaccactttgctagaaaaaaaaaaaa

SEQ ID NO: 131304 - DNA, 850 bp, Homo sapiens
gcctcgtgccgaattcggcacgaggctgaagagaagctatgaaaagcttcagaaaaagcaaatgagggaattcagaggaaataccaaaaatcacagggaagatcggtctgaaattgagaggttaactgcaaaaatagaggaattccgtcagaaatcgctggactgggagaagcaacgcttgatttatcagcaacaggtatcttcactggaggcacaaaggaaggctctggctgaacaatcagagataattcaggctcagcttgtcaatcggaaacagaaattagagtctgtggaactttctagccaatcagaaattcaacacttaagcagtaaactggagcgggctaatgacactatctgtgccaatgagttggaaatagagcgcctcaccatgagggtcaatgacttggttggaaccagtatgactgtcctacaggagcagcagcaaaaagaagaaaaattgagggaatctgaaaaactattagaggctctgcaggaagaaaagagagaattgaaggcagctcttcagtctcaagaaaatctcatacatgaggccagaatacaaaaggagaagttacaagaaaaagtaaaggcaactaacactcaacatgctgtagaagctataagtttggaatctgtgagtgcaacgtgtaaacagctgagccaagaactaatggaaaaatatgaagaactgaagaggatggaagcacataacaatgaatacaaagcagagattaagaagttgaaagaacagattttacagggtgaacaaagttacagttctgcactagaaggaatgaagatggaaatctcccatctaactcaggtggtgggggtccgagctgaattc

SEQ ID NO: 131305 - DNA, 316 bp, Homo sapiens
acaggcactttagagaaggggttgttcaccaagttggctaggctggtctcaaacttctggcctcctgtgatccacccgcctcggctcccaaagtgctaggattccaggtgtgagccaccgtgcctggcgacacagcctactcttgaggaatggggactcatgctcacctcttcaaaggtgaattgtctgcataaattatttgggattcttctgcctgacagttttatcttttcttcccctgaatgacattttactcacgtatgagtttgtaataccattgaatgttggaaaatagtagtttactgggttatagaga

SEQ ID NO: 131306 - DNA, 693 bp, Homo sapiens
tttacatggaatatctttttcaattcttccactttcagcctgtatgtgttcttaaagctaaaatgagtctcttgtgggcagcatataggttggatcttagttttttttaatccattcacccactcggtgtcttctaattggagaacttaatccatttacattcaagcttattattgatagggaaggacttacttctgctattttgttaattgttttctggttgttttgtagagcccttgttcctttcttactcttgttttcctttgtgatttggtgattttctataatgctgagctttgattcctttctctttattatttgtttatctggggtggttttttgctttgtggttaccatgaggcttatgtagaataaattgtagttagaatagcttattttaaactggcaacaactttagatgtagaaagaaatttactcaacgtaataaagactgcttatgaaaaacccaaagccagtgtcataatcagtgtggaaaaatgaaaactttttctctatgatctggcacaaggcaaggatgaccactctcatcacttctattcaacatagtaatggaagtgctagcaagagcaagcagacaagaaaaaaaaaaggcatacaattagctgaatggtagaagttatgtccatttgcagatgacatgatcttatatgtaaataaccccaaaaactctac

SEQ ID NO: 131307 - DNA, 349 bp, Homo sapiens
accgctgtgtgtgactgttgctggctcacgcattcgttagtgtcttaaggatgtccagccctggaggagtgtgtgtgtgtgtgtgtgtgtatgtatgtgtgctcatagacttggaacgttgtgtggctcatctttgggaggtgtgctgtgcagcctgtctggcctaagggcagaaagatatgaggtgcccaccggcaacacctccccttggctttcctggcctatgccattcatgggtgaggaaagctgttcagatgttgcctccctgactccatgaagattgattgtgctggggagagtctgagtggagagtatcttggggtagaggaggaagaggagagctgagata

SEQ ID NO: 131308 - DNA, 340 bp, Homo sapiens
tcaaacacaatttagacaaagatacagagactgaaataaaaggatgtaaaaagatatcatacacacatacaggagctggaatggctatattagacagaacagacgttaaggcaagaaatgaaactaagacacttcataataaaaaggtcaatacaacaggaagataaaatgatgaaaaaatatataccctaaaagcaataaccaaagagaggaacgacagacactggggactatttgacagtggagggtgggatgagggagaagaccagaaaaaataactacagggtactaggggtgatgaaataatctgtacaacaaccccccatgacattagtttacc

SEQ ID NO: 131309 - DNA, 187 bp, Homo sapiens
tgggattacaggcgtgagccaccactcccggccatgtttccatcttaatcagacttctgtggctacttgggtgcagaaaacctattaagcaaatggactgtatttcatcatatcaaagatgccattgaatttaataagccctattattttatgtcctactaagaaaaagtgatgccaattaaactgt

SEQ ID NO: 131310 - DNA, 113 bp, Homo sapiens
agtgaatctttctgggtctctgtttcctcatctgtaagatgagggtgataaacctaaggaggtaatgtttgtaaaggactcttcacatatccctatcacacattaggtgctca

SEQ ID NO: 131311 - DNA, 818 bp, Homo sapiens
catcattataaaatgaaggacttgggcttgacatgtgccaaggtccttttctagccccagaggtaattggttaacttctggaattatgactccttcatgaagttgaaacttttaggtctttttatttttactttttaaaaaactttctatctagcgatcctatataaataagtctttgctaattaggatatgtttaactttccttctttattcattttgtcaaaggtaaacaaagctgcatactagctaaagttctaaggacaggttttagtcagtaatacacttttgcaatagggaagagagtccagtatgaaatgaagtcaatgttgatttgcagagatgactgggagttttaaggggagcatggcaggggacttggcagggtggataaacggaatctgtagactcaaagaagtgaagaatttaaaaagattggtcaaaatatggtgattaggccagctgtgcctgttagctgacacttgtgactggggaatagataccctatttttcctgatggttacatttttaacggaatggctttcaggtccttgagaaagacactcctgagttgtaggagtacagctcaaagggacagaggaaggattcaccagttgtaagccctttttagtaatggatctacagaggatagttagggcctatcttcagatgctggctagaacaaacagtagattctctggcagcttgaagcttttaagaggcagaaaattcgacagaggccacggtccaaccacggaggtaacctggaaccggccacaacggccaggatcaacaccacagccggacatagaggagtgagc

SEQ ID NO: 131312 - DNA, 312 bp, Homo sapiens
atttgggctagtttctcttcccctgcgtcggcaccaacgtttgactccatggttgtgaaattgaagaagtcgtgataagcttcaatgcttggggccaggccagaagtggtgggaggcaaactggtagaattcaccttttactttttatttttaggtgatttggtttatggcacctgatcccttatctcctctaactctgcattttggttctcttggtataagccttatcttcaaggtttcttccccatttatagtagattaaggggtactcttgttgcccctaagttgcttctctcccattttccagttttt

SEQ ID NO: 131313 - DNA, 637 bp, Homo sapiens
tgggtcgagggatatccatgtcccagtgttagtgttgttctgacaaaactcatgctttcggctgggcgcggtggctcacgcctgtaatcccagcactttgggaggccgaggcgggcagattacgaggtcaggagattgagaccatcctggctaacacggtgaaaccccatctctactaaaagtacaaaaacaaaattagccacgcgcggtgcggacgcctgtagtcccagctactggggaggctgaggcagaagaatggtgtgaacccgggaggcggagcttgcagtgagctgagatcgcgccactgcactccagcctgggcgacagagccaaactccgtctcaaaaaacaaaaaactcatgctttccctcccctccctcgttccttcgttatcatatagcactgttgaggatggagggtggactgtgctcttggtgaacacgagctgtgtaaggaccataatgcctcctgattagaaattagcttaggtgatttacttgggttaaaaaaaagagagagagaataaatacaagagatttattggggttaaaaacaaaaaagaaaaaaaaagaaattatctaaggttatttattggcctcttagatcctgtaagctacctaatgtaagaaaagtggga

SEQ ID NO: 131314 - DNA, 707 bp, Homo sapiens
gtgaaattgaaaaggtttgctgaatgaagtattttactattgaaaggtcttctagaatgtaagtttcaaacacatcgtctggttggtgcattacttaatctattcctgtttggctgctgcttggtatttcccacgcaggagttcattgacttcaaggcaattgaatgcattattagccagaagaagaaaacatgtgagtctccttcacccaacaatagattttttaaaatacattgtgcacagtcctcttaaaaaaggcatcaatggcaggtgggtgtgaacagaggaatttcctcctccaccctggctgttgctgagctgtaagctgtaaacattgtgagagacaaaaagtatcaaggtctcaactttctttcggatattgctttgtatttctgtttactagtatgaatgaaaattttcctgaaaatgctggctaaaactgaattttggtgttgtctttctaatggaatttctgatcaacaatttcctttatgttggcaattgcttaatctgctgaagtaggtaaggtagttgtgctgccttaaaatttatttttatatttgtcattaaaaacaaacatgaaacttggaggttaattttgtctgtttaaattttgatgctttcattttgacaaaatcttttaagaataatgacgaggctgcagtgattgaaatacaatttgtgtggcttttaggcaagtgagcatt

SEQ ID NO: 131315 - DNA, 270 bp, Homo sapiens
attaacagttttgtgggccaggcccagtggctcatgcctgtaatcccagtattttgggaggtcgaagtgggaggatcgcttgaggccaggagtttgaaagcagcctgggcaacatagcaagaccctgtctctacaaaaacttaaaacaatttgccaggactggtggtgtgcacctgtagacccagctactgtggaggctgaggcaggaggattgcttcaacctgggaggttgaggctgcagtgagctaggattgcaccactgctattgtc

SEQ ID NO: 131316 - DNA, 877 bp, Homo sapiens
  misc_feature (310)..(310): n is a, c, g, or t
  misc_feature (318)..(318): n is a, c, g, or t
taatttttgtacttttagtagagacggggtttctccatgttgctcaggctggtctcaaactcctgacctcaggtgatccactcgcctcagcctcccaaagtgctgggatcacaggcatgagccaccgtgcccagccaccctgcaatatttaatttgacttggaacatcagtattaacttactttttgtgtttctgaaagataaacatctcctagctatgcccactgaaaagacctaaaaaaaaaaaaaaaaaaaaaaggggcacccttgttggcaccccgggcccaaatgggggccccggaatggcccanagttgggnaaggggcgcaagtgccagtgcgggggggacggaactggccaagatagacccctggcaccactacttttgggcgcccacaaatacagcggcacccactcaaagcgctcgcgcgagcgggtcacaaggcacacccgcggaaacacatccgggacggagggccccagatgggccaacgctgtgacgccctcaaaaataccccaacgcgcactggctggaacacccaacgcctgcaatcccacaagcttgggtcactgatcaattcgttttaaaaacacagtgaaccccacgggtaccactctgggcagccggtgaaggacctcatctggtgtaccccaacaatgtggctagcgccgggagcaagactctcagacttcttcaatagtgtttcccatcacaacctatttttcgcttatccactactcgaggaggacaccctctcttttgggaacccctaccgaaagaatacgggggctaacgtgaaatcatcatggctatctagcacagcacacgcagcccacgggtggcaggtccgacacttaggcaagggcactacagcaag

SEQ ID NO: 131317 - DNA, 887 bp, Homo sapiens
ctattcagtgttcatattttcctgtctcaaaaatgtatttttatagttggtttgcagttgctttggttgatatactcttaagtctcttatgttagtttgccccttacctcccttttctcatgcgacttgtatgtttttctgtagaatctcccacattctggatttaatagtccactttttttctggtgtcatttaagttgttcctctatccaccagttttcaagtaaactcttagtgaaatctagaggcttaatatgattaaagttcaatttttaatctaggagacaaatacctcataggtggtgttgaatattattgcatcacagcaggaagcacatatctagttgtctcattttcagtgattgatctttgatgaatttaagtgatgatatacagtcatgtaacgtccaacacaatgaacatacaggatttcaccctaaaatgcctttttgcagttgatcctctcttcctggccctagaaaactattgatctactttttctcactgtagttgtaccttttcatgtacattgttcctatcaatggagtcatacagtatgtaatcttgtgtttgactttttaaacttagaatgttgattcattcttgttgctaatatattaatatatctttttattactgagtagtttcagtagtgtggatatatcataatttctttatcattcaccattttgtggactttggggttctttccagtttggggtgttatgaataatgcttctgtgaatattggtgtgtaaggttttgtgtagatgtatgttttcatttatcttgggtaaactcccaggaatgtgattacagggtcatatggtgagtgagaaactgccaaaatgtttttccaaaattgctaaaccatttttcatttccac

SEQ ID NO: 131318 - DNA, 649 bp, Homo sapiens
caaatagtgtgaaaaatggtacctctgcataaaaataatttaatattagtgctaaagttgctccttgttttcctttagaggaactacaaaaggatagttattagattgccaaatcctgcagaacctccagcaggcacaagttggtttttctccctcaagaaagagaagtgagccaagcgtggtggtgcatgcctgtggtcccagctactcaggaggctgaggtaggagcttcccttgaacccaggtgttcaaggctgcagtgagccaagatcacactactgtgctccagcccaggcaagagaatgagaccctgtctctttaaaaaaaaaagaaagaaagaaagaaaagaaatttttgggccggcttgggccccgaaaaagtttttaaaaccttttgttgtggggcgggggggccccagtaggtgatagagtgaaacacgtgtggccacaacgcgggttttcccgagaggaagaacctggggctacgtgaaaaagcgggcgggggatttcccccccacaaaaaaaaagccccggggggaacacggagttgtccgcaaaacaaaccccagaaggagcccgaaacgacaaaccggggcccataacacgggggctccaggggaagcccaatataaaattgcgcgaccgggaaa

SEQ ID NO: 131319 - DNA, 830 bp, Homo sapiens
gagaatatttcagttaacaaaatccatctcattacaggatactggcaactgcatcaaatctacattttgcttgcaaatgttcatccagtatgaaagagagaataaaaatattaggataaaataatttttttaagtgaggagataggcagtcacacattcttttgtgacacaaaccagttctacagtagaataatgaaggcattgttcagcagtttgaaggtttgatttataaaactaggtgttaactgattggcaatcaaccaatagaaggtaaattgctaaactagtctgcatgtgcagatgctagtaagaaattttcaaaggcacagctgcacttttatacaaagttccctgatcatctacaggtacttccccacatgtggtcatgacctttgatgacacccattcaggatatcagtcgccagtttgtttataaaatgattcagatgtacttaattagattattcagagtttctgtgggagtgcaggaatgtcctgtatttcttgtccctttctcccataacttctacctccctacaaaggcctaaatgctctgcttttgatggaggcgtgcaacttcagataagctccggtaagaatataggtgtttttgataggctaaaatggaaagcacaaatttctgaaaccccaggaaaaaggtgcaaactctacatacactgtgcaatctgcatgaaatccaccataggagaattgagtagtgattaagtctggtttgaaaattctgcatcaaattcacagagttttactttcaacccatttgggtgaaagaaataatgtccttacaacatctcttccacttctttccttct

SEQ ID NO: 131320 - DNA, 1097 bp, Homo sapiens
atattggtctgtagtcttctttttttgttatgtcctttcctgggtttggtattagggtaatactggctttattccatcttttggaatagtttcaatagcattggtaccagttcttctttgaatgtctgatagaattcagctgtgaatccatctggtcctcgattattttttcttggcaatttttcttattactgtttcagcctcactacttgttattgttctgctcagtttctgatttatttttatttgtggtttaatataggagggttgtatatttccaggaatttatccatctcctctaggttttctagtttgtccacgtaaaggtgttcatagtaaccttgaataatcttttgtcttggaagacaaaatggggtgcaggagggatggttttggcctaaactgtttcagctcagatcatcaggcattagttagattttcataaggagcatgttacctagatcccttgtatgtgcagttcacaatagggttcacactcctatgagaatgtaatgccaccattgatctgactagagttggagctcaggtggtaatgcttgcttgatgccactcacctccagctgtgtggccggtgcctgacaggccaaagaccagtggcagtccgcagtcctgtggttggggacctctgatctaaagaactaactctatcaaagagaaactgagatcaagttaggtcagatcaatgaatacatatctaggtgtcagagctaagtcttctaaatccattttgcgtcctcagttctggcgggataatgatatttttgtgttttattccctatttaagatttgcagataatcagtttgcaaattagtgaagagtcaccataattttgtaggtacttgatatggtttggctctgtgtccccacacaattccatcttgaattgtcatccccacgtgttgagcgggggatggtgggagttgattgggtcatgggggcagtttccctcatgctcttctcgtgatagtgacggagttctgacaagatctgatagcttaaaaatggcagtttcccctgccctctctgtctcttctgccgccttgtaaagaaggtacctgcttctcccttgccttct

SEQ ID NO: 131321 - DNA, 787 bp, Homo sapiens
gcaacaaaaggtgacagcaagtatgggggaaacaaatatttcatttatttgttgtcgttctgtcttttgacttgaatttccagggatgaaaaatgcaattgtttgtgcctttttttttctttgaaggtagtaggcagtattctgagttagtactttaaagtacacacaggcaaattttatataatccattcagtaagtattgtgtgctggctgctgttgtaggcattgggaaaagggttatgaataagacagggacttgtgacttagattctagtgcaagggagataaacacaaaaggataattttagatatttattggtgctataaacaaaactttgcatgccaaataattaaaaagttaaaaaatataaaaaattttttaaaataaaacttgataggatggagtcttgaatcatatattttttatttcagccacttaagtatcttctctgaaaaccatggtgctagatgcaacaggataattaaatatgagtaaatgatcagtacttaattgttctcagacattatattggtgtttatatttgtagtagggatagagtttgcaaggcaaggataagtgaaatacatatgaataactgatataggactgaataaggtaaatgcatgaacaccgcgcccggccgtgttaaaccattcttagcttgcaaaggtggatgagctggattgggcatggaccatagtatactggtctcctggtacaaaggaaagggttaacataagggttgtaggataaaaaccagcagagactaaaacctcaggaaaatgc

SEQ ID NO: 131322 - DNA, 332 bp, Homo sapiens
caccaatctctgcctctgtcttcacatggcattctctgtgtccctgtgtctttacattgtgttttttataaggacaccagttggtggactgaggtccttccctaatccggtgtgacctaatcttgattacatctgcaaagaccctgtttccaaaacaggtgacattcacagcttccagggcttaggacatcaacacatctttgtcagggacacagttcaacccatagtatcttccttctaccaccaactttatagtgataccttctccatttagttggctgacctccacttagttgaattgaatccaaacagccgtttcatttggacagtta

SEQ ID NO: 131323 - DNA, 600 bp, Homo sapiens
ggaaatagttgattttatagtattccagtgctgtcacaatgtaatactgaaaactaaaagttttcattttgttcattacaattttttgatcctcaaatatggtacaatatagataaataattgttgtcatattttcgagagttcagaaaagacatatacattagcagtttgtgaagctatttttgtactgataaattttaataacagtttgattaccttgatagaaaatgggctcttttaaacactggttatatttagattcttctaatgtttagataacgtgttctcatggtgcttctagaatttatgtatttttggggatattgcatgtaccttctattctgttaaagagattgttttctgccacattatgtgtttccaacagataatcattaaaggatgtatgcagaaatattattttctagcatattagtcttgctttatatcagtataactacagttttatcacaatgtatgacatctgtatgggtttactccatctgtatttatcatcaaagttttagaaacactctaaaactatgactaggaatttttgtgcaatttcaaaaactaaatttcactggaaattttacatagcat

SEQ ID NO: 131324 - DNA, 321 bp, Homo sapiens
gaaaatctggggacagattctggagccctgaaagcattccatgttaaggaatcttaatggcaataaggaaccatagaaggtttcagataaaggaatgttttgatcaactgctgcttaggaggttaatcgggtccctggttgcaggatggatggggcagaggctgtgggcagagatgtcaggagtgacatgatgaaggtctgggcagggcagaggtatggagctgagtggggagcgttgatgggaaagcgggtcccagtagggaagtgactaacttggtgaccgaccagaggtacgggctgggaaaaaggcaaggggaaagg

SEQ ID NO: 131325 - DNA, 767 bp, Homo sapiens
gatgttgagcatcttttcatgtgcttcttggccatttgtatgtcttttgagaaatatctattcataaagttctttgcctgtttttgaattggatcatttgttttttttggtgttaagttttaggatttctctatgtattcttgatattaatccccttttagatacatgatttggtaacattttctttcattttacaggttgcctttttactgtgttagcagtggcccgtgctgcacaaaagttttaaattttgatgaagcccaacttgtctgtttccgcttgttgcttatgcctttgttgttgtattaaaaaaaaattgccaaatccatgtcatgaagcttttccccttatgttttcttctaaaagttgtatagttttagatcacaaattttggtgaattaattgattttaagtttggaatatcatgtaagggtccagcttttttttacgtgtagatgtccactttttccagcaccatttgttggaaagactgcctttgccccagtgaatggtcttgacactgttacagaaaatattttgactgtatatgcaagggtttgtttctgggctttctattccattccattggtctgtatgttcttatgctgataccagctcactgttttgattactgttgctttgtagtacattgtgaaatcaggaaatgtttttccgtcaactttcttctttctcaggatagttttggttattcagggtcccttgagattctgtatgaatttcaggagagatttttctttttctccaga

SEQ ID NO: 131326 - DNA, 795 bp, Homo sapiens
cacaaattcctcctaactgaaactttgtagcctttgaacagcacatgctcatttcatttccttacccccactcccatctgctggtaactaccgttgtattttctaaggcagtggcccccaacctttttggcactagggactggttttgtggaagacaaattttccatgggcaaggttggggtggggatggatttgggatgattcaagtgcattacatttattgtgcactttatttctattattattacactgtatcatataatgaaataattatacaactcatcataaggtagaatcagtgggaagccctgagtttgttttcctgcaactagatctaggtcccatctggaggtgatgggagacagtaacagatcatcaggcattagattctcataaggagggtgcaccctagatcccccacatgcacagttcacagtagggttctcatcctatgagaatctaatgcagctgctgatctgacagaggtggagctcagacggtaatgtgagcaatggggagcagttgtaaatacagatgaagcttccctcacttgccctctgctcacctgctgtgtggcctgtggctcgggactgctgtaagacatgatgtatttttggttatttgaaaggtggacatagtaatgaaaagaattttacatcaaacatttgttctacttaagtatattttaaaacaaaaatgtttgaggattttagatttttaaactttaggaatccacttttctattttgtttctttgagaaaataattcttgaaatatgagacttgtacaatttcc

SEQ ID NO: 131327 - DNA, 137 bp, Homo sapiens
catctctttctgttctctctctctctctcctgacctcttgatttttcttcttctctccttatttctgcctctttacctgcttgctcctgttatggtgtctgcctgcctgcctgtctgctcctccctgactggctggc

SEQ ID NO: 131328 - DNA, 316 bp, Homo sapiens
tgacctaagaaggcacacgaggaacatcagcaaaggactgacagaaaaagactcatatttttatataaggaacacggggggaaaaagaaaaaaaaattaaaaggaaaagatgaatagatgatatggccagaggtttaaagaaagagacaacgagataaaagcaggaagccccagcaacactgggctgcctccccaggcccttcccagcatttcctgccagcagggcccctgccccaagccaaaaaggaaccacgttcgcctcgtcagggctgttgcacgacagccgcacacacctaagaaacaaactccttctggg

SEQ ID NO: 131329 - DNA, 148 bp, Homo sapiens
tgtttttgaacacatttactttttcattgcaaaagtattcataatattttggaggctgaagatctttcagctgtttgtttacaagcatgtcagataaattatgaacctgactgtggttgatacaaagtaatcccttccttaaaatatt

SEQ ID NO: 131330 - DNA, 368 bp, Homo sapiens
agagcgcaagggagacagacagcagagcctggttccctgaaaagagccagtaaagatttattaggcaaagcgcaggaattgacatcagggataaggtatgcaggctgggctgggcaaagcatgtgaggggtagagtatgcaggttagcaaggctggttgtgatggttatcttgagtacgagttaactggtggtctgtctggctggcaaaaacaaggctggaaatcagttgttcagcattccttccagaggtgagacactcaacaaccttggttcgattttggatctcctaaggccagtttctggagttctttaagcacaaggcatggttaaacagtatgagagcacagaagaatggctattttctttg

SEQ ID NO: 131331 - DNA, 386 bp, Homo sapiens
aatttttattttaccactgcactgccttctaagtacctgatacaggttcagtgtattatataactttcagaagactaaaaaattactgcttttcaaactttctgcctggtaatgaatgacctgttaagtaatcaaagcagaggccagagaaaagaggaaaaagatatctgttaggtggttgtcatgcagatttatctggagggaactgtttccaggtcatgatcatcagtaagttctgaaatggcaaacttttttccttttaaataacacttttcttcatggaagacgacaaactcttatttttaaatatattttcacaattccagaattatatgaagtcaacatgaaactaaagcagtatttttcacagaggtgatttataatta

SEQ ID NO: 131332 - DNA, 319 bp, Homo sapiens
aataaggcatggtccctgaggatcaggacttttagttcagcgtgccagggttccctcaggacaggtaaaactctgctaataacaaggagagaaaataagcagttttgtttgcagcgtcaggaattcagacattttagtggtgatgggagacagcagtgctgcttctaagaagcttttggctctttatgcccaagtgagagaagggttgggaggaggttgtagctggtgaatagcttttttcttaattgtagtagtttatcttactttttcaaaactctctttgaattgctgctgggtggtttgtaggatagggaaggag

SEQ ID NO: 131333 - DNA, 196 bp, Homo sapiens
caatatatctaatgttttcactattattttatctgttatagtgatatgtgatctttgacatttctattatcattgcggggctggcacacaaactgcacctgcagaagaaaaagaacttaatacatatgtgtttcaaatgctccactcactggccattcccccatctctctcccactcctcatgcctccctattccc

SEQ ID NO: 131334 - DNA, 119 bp, Homo sapiens
ttcacgtgtcagccacttagcacagtgcctggtaggaaggttaatgtgccataaacatgaaataatagttgttattattaattattgacagggcccctccctcttgggctcatttttct

SEQ ID NO: 131335 - DNA, 305 bp, Homo sapiens
cgcctcggtcttcccctccagccgacccggctgtcgccgctgttgcctgccacacccgcgagggacttcgagaatggacctagatgccgtagtctccactccccctttaccccactcccgccctgaagctaaacctgctggagaggaaggcacctttagaacttacagcactctctagtacccccacactcctccagcacccaaaatggatatattgtcacatgtgcatatttggttgtgggaagtcgtggcttcccacgttttgttgagtggaatgagtcatggcatcttgccgccatgaagtc

SEQ ID NO: 131336 - DNA, 176 bp, Homo sapiens
caatccccggactaggggccggggtcggaccccagtggagtagcagggtctgggcgtggagagctcggcgccgcacggggtgggggcgcgcggaggacgcgcgcgcgggaagggcacccccttttgcggctctctcccttccccctccgcccccggacggccgctggggcgcgcgc

SEQ ID NO: 131337 - DNA, 393 bp, Homo sapiens
agtccctccacgggtgcactgaggacgttcctgcacatcgagggcaccctcagagctgctctttctgtcattgctattttgtttataccggggattggcaaactttttcttgaagggcccaagagtagacatttttggctttgcggccacagggtctctgttagcaactccctctgccacggtggctggaaagcagacatagaaaatagatgcaccagtgagcatagcctcgttccaataaaactttatttacaaaacagggagcagtggaccagcgagtccccaaggacaagggccaggttaccagagaatttccaggcacatccgttggaggcaggggagacaacaaaagccgaggaacgagccttccccagccgctccccaaaggcacgg

SEQ ID NO: 131338 - DNA, 397 bp, Homo sapiens
tgctgggattataggcatgagccaccatgcccagcctgttcccatcttcctccccctgccaacacacgaccactgatgcgggttctgtcactgtaggttagttttcattttccagaattttatgcagatggaatcatacagtgagtactcttttcggggggtggttggcttctttcactcggcacagttattttgagattcatccattttgttacatctattagttactcattcctttttattgctgagtagtattccattgtagagatacagtacactttgtttatccactcacctgtctgtggacattttggtttctagttttgggctgttaagctgggatgaacgtatgtgtatgtgtgcagctttgggatgaggtgtctaacatgagccacat

SEQ ID NO: 131339 - DNA, 151 bp, Homo sapiens
cagagtgagactccatcatctcaaaaaaaaaaaatgtatgtgtgtattagaatatgcttagaaaaaaggcttcaaagttacccaccaaatgtaaaaagctgttatttctaggtggttggataaaaaggacactttcacttcatttaatata

SEQ ID NO: 131340 - DNA, 210 bp, Homo sapiens
aaaggaaaatgagaatactgttaattatatgtgacctatgtaaaaatagacatttctaggaaaatattacttgtaaaaaccgagggagaaattaaaagtctgaatcttcccacaaagaaagcaacaagcccaagtgatttgccaataaataagtctctaccaaaattttgaggaatagattattccaatctgttgcaatcttttaaaatt

SEQ ID NO: 131341 - DNA, 150 bp, Homo sapiens
gtgaccgccctcttcccctttggcaggtcctgtctcccactttcaacaccctcacttaaggccaggcagaacccttcctactgtcaccagtcattaaaataaggttgcatccctcccttcctaacctcggctgggaagagtgcgagcttt

SEQ ID NO: 131342 - DNA, 469 bp, Homo sapiens
acaacagagaagcctgtgttttaggaagatttattttagcaatggaaggcaggatggatcagatggcagggagacctactccttatgaggtgcaaaaaggcctccaatcacaaaacacttctgcacctcaaagccacctgtcagggctctgtcctcatgctgaggtccttcaagagggctgagccatgtacactctgagagtgatgcagggagaacctaatacttccaggccttagagcatcaaactgctttcctctgtgctggtgatcatttgagcagctggggacatttaggagggtgtgagaagagaccaagaggagaaaaaattggacactgtaacatgtaactggagcctaagaaatcccttctcccatgtccccatagtgaatatttacaatttcctgatttcaaaaaacacctttaaaagctggctggaaagaactgtttactgggcatcttttaaatgaaa

SEQ ID NO: 131343 - DNA, 719 bp, Homo sapiens
tacatataagtggtttcaaaaatattagagaaacaatacgttaagaaatagattattaccagtccctatgaagttcccctgtgtgtccctcctcattcaaatttctctcctctctctaaaggtaactccaacttgaattttaccacttttctatgtatccccaaacaatattgtttaacttcacctttttcaaatattataccatttgaaatcattgtttgcaaccttctgtgaattgcattttttcattaaagatattgataaaatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaagcatagagtggccgagaaacacaacaaaataagtaagaaacacgaacgacaagagcaaaaaacagtaacaaaacagacaaaaaacacaaaacgagtagaatcaacaaagaaaaaaaaaacgagaggtagagaacacgagagctataaaaaaaacataaagataacaaaaacagaaaaaaagataaaggcgaaacacaagaaagagggaaagagagggacaaataaaaaaagacccgcagtgaagagaaaaaagtgatcacaaaacgaaagagaaatgaaaagaagacgaaagaacaaagagagtaagagaaagacagagaagaagcagacaacgcaaaggaag

SEQ ID NO: 131344 - DNA, 442 bp, Homo sapiens
gttaaaatataccatgatttgatgaataagcaagcacaacacaaagcaaatttgaagtaaactgaaatttagtttgccttgggcaatgtttttacccattctgtatgctacttagacagctgttatctaatccttaatgctgatgaaaatttaagtcatggctgggtgtggtggctcacgcctgtaatcctagcactttgggaggctgaggtgggtggatcacctgaggtcaggagttcaagactagcctggccaacatggtaaaactccatctctactaaaaatacaaaaattcgcctggtgtggtggggtgtgcttgtggtcccagctacttgggaggctgaggcacaagaatcgcttgaaccaggaaggtggaggttgcagtgagccaagatcatgccgttgcacgccagcctaggcaacaaaagcaaaactccatctc

SEQ ID NO: 131345 - DNA, 384 bp, Homo sapiens
gtgtctgcagggcctgagtacctctcagacaaaatcactcatgctgcctcccactagtgtgtcatccgaagggccttttaagtctaaggagctttgtcctgagcaattggagacacttcgggaggtggactctcatctcaagtgtgcactggcacatgttttatcttcacggaaatcaaatggaagaatcaacaggagattcagggcaaaattaatcatcattaataatcctcgacacatacatgcaaatcctgaagggagcctgggagagcaagacttctataaccacaccactatcttaagaagtcacagagagtgaagaaagaaaatttccaattgtgggaataaatgtgcaccttctattaacttggagagacaataaag

SEQ ID NO: 131346 - DNA, 276 bp, Homo sapiens
gcaaaactccgtctcaaaaaaaaaaaaatcctcccaaaacttaacaacaaaataaaattcttaaaagaagcataggagggagtaaatcttcatgatcctggggaaagtaatagtttcttatatacattaccaaaagcacaaacaatttaaaaaatcaataaatcgatttactgaaaatgtaaaacctttgcatgtcaaaaacaccaacaccatcaagaaagctcaaagagactgagcacagcggctaatgcttgtaatcccaacactttgggaggc

SEQ ID NO: 131347 - DNA, 331 bp, Homo sapiens
gtagctgggattacaggcacccaccatcacacctggctaattttgtatgtttagtagagacggggtttcaccatgttggccaggctggtcttgaactcctgacttcaggtgatctgcccaccttggcttcccaaagtgctaggattacaggcatgagccaccgcacccagcccaaaggcatggaattataaaaccacatgatgcatttgggaaatcacaagcatttcagtctggctggagcaaagggttcaggattaaaattagaggggctgatgagtgtgggatcataatgggccatggatgctgaagtaccctaaactctctaagggat

SEQ ID NO: 131348 - DNA, 418 bp, Homo sapiens
caccctaattccatggggagggggccccaagtcctcaaggctccctgggcctccctggaggggactgtggatgaatagtgaggccctgaggtgactacttggcaatgttgcgtccggatgggcctagagtcaccctgctcttcctggggtctggggtctggtctttgcctcgcagtggagtcgtaactgagcctgacttggcctgcatggctcacagagtcctcagtttcattgtctgcctggtgagcgtgaggcacggctgcatcttttgacctgtgagtcccacagccctgcttgtaaaatgaccagaccttttctcagcctggtcacatgggactgggtttaacgcaggtcaccatcccacaggctctttctgaagctttgctgcctcaaataatgccatggatttgttcaggtc

SEQ ID NO: 131349 - DNA, 419 bp, Homo sapiens
aactctcctcactctactgaaactgctgcagccgaggttactagttatttaattaacaaaagcaatagattttgttttttttaattgcattatactctactattttttgacatttaaactattgacaatgtctttcttgaaaatgtgtcctttttgtttttttcaaaacacgactttctccttgatgtcctcctttttctctcattatttcacctttacattctctgctgacacctttcaccttaccaaaccttaattaaatgtgtatgcttcccagtctcccgttcttggctctcttcccttccctcttattgatcattattgtattctgtgatctcaccaattctcttggctttaacaataaccagatgactccagaaaactattcaaaattccggacctatggagactttgcaccc

SEQ ID NO: 131350 - DNA, 362 bp, Homo sapiens
gctccgcattggccaattcaatagattcacagaaaatatcaccaggacccacctccaacacgggggattacaactgaacatgaacgcagagccaaaccatatcactagctctgcctggagacattagagacaggttcccagcggggaggcttccttagcccagagatgaattaagaacagcattgactggatggtgctgtggtttcaatgtcccctcccgaactcacatcaaaacttcatcactagtgtggcagtgtcctttcagaggtagtgggatcatgaaagctctgccctcaggagtagattaatccattcatgaactaatgggttaagggatcagtgtggtataaagacgaactaag

SEQ ID NO: 131351 - DNA, 420 bp, Homo sapiens
cgcagtggctcatgactgtaatcccagcacttttagaggccgagacggtcagatcagttgaggccaggagttcaagaccagcctagctaacatggcagaaccccatctctaccaaaaatacaaaaattagccgggtgtggcggcacgcacctgtagacccagttaattaggaggctgaggcacgagaatcgcctgaacccaggagttggaggttgcagtgagctgagatcatgccactgcactccagcctgggagatacagtgagactgtcaaaacaaacaaacaaaaacaaacaaaaaccaactatttattttgggtttgaatcttgtttttcaaccttactctgaaactgtcctcaggagtcggttgccactcaactatcctataaacattttttcaattcatcgtctaatcctggac

SEQ ID NO: 131352 - DNA, 484 bp, Homo sapiens
tcccagccaccccaagggaagagagtactttcccatttataccaaagattccaccctcggcttcaagtgcacttaaacagaaacactacaggtgtctctccagaactctgcatgaattctcaccctctctaggtctacctgatcaatcagactctcccccagtatagtcctgctggctgctgaaagtggatgtagcagctgacaaagatacatcgttccaaactaaggtctcagcctagcttctccagggaccatgtggcctcctcgaaaggtggacacagcctttaagtggagtcttatcaatggatcacaccaaccagtgagattgtaagatgcaccatgtattgagacaccctctatggtgttcccacttcctgtcagaaggatgcccaccactcttgcttgtcttagaaaacagaagtaacagataggtcctcggttcaaagaacgggtggggataccagggggggccccgcgctcgact

SEQ ID NO: 131353 - DNA, 357 bp, Homo sapiens
caaatttctgattttttcagattttttcagaatatttgcataataccagttgatatctcaaatccaaaaatccaaaatatgaaatgttccaataagcatttcccttgaagatcttgtcagtgctcaaaaagtttccaattttggagcattttggacttggggatttgggatgctcaacctgtatgcagaaatatttgctgaatgaatgaatgagtgaataatacagactagctgggatctgaatcttaggacatgctgatgttcgtaaagtgcttgtgatacaagctgtgttcacaaggccttctatttctgctaagggtgctacccattggtttacgtaaagccttgctgaatggg

SEQ ID NO: 131354 - DNA, 470 bp, Homo sapiens
tccagtaaggtgtgccaaaaagtaagaaataaaaataaaaccaagcgtgtgcccccactaccggggcacatgtcatcaggacctcctgaggctgtcatgaactggtctcaggtgatccgcctgcctcggtctcccaaagtgttgggattgcaggtgtgggctgctgctcccagccaaaaataaactttctaaattaactgagacccttcttagatttttacggttcccaccacgaagcctggctaattttaaaattttctgtagagatgggggtgttggcgggttgggccgagggaagagggtggtctcactatgttcctaggcctggttgtgaactcataggctcaagcaatccccccatctctgccatgcagccaatacaagatttttttaaagttcctcggagaggtgaggaggctgaggtgcgtgttcaccgactcctgtccctcttgggttgaaggttgctcgtg

SEQ ID NO: 131355 - DNA, 335 bp, Homo sapiens
cgtaggctattggaaggacttttgcttttactctgagtaaaaagaatacccttaaggagatattttttaaagggatataaagagaagaatgtgtcagtattacagaaaaggagattttaccctaatattatggcaggcccatcatagcatttctgaaaactctcagatgatttgttgcttttagctactcagctgaccaacattcatattctttttccattttaaaacccagcttaatactttggaatgtaaaatgcaccagtaagatacaagttgatttgtatttcttttgtttttttttttgaaacagagtcttgctctgtcgcccaggctgg

SEQ ID NO: 131356 - DNA, 644 bp, Homo sapiens
caatatcttccacactaaatacagttttgaaccatgaaattgagaaattagaaaaatcttagatctcagtaattaacacaagcgctcctagcatttgtatgtatttcctttgactttttttaatgccttgtgggatttttacataatcttagcttatatataattttgtatactttttaaaaattattaacattttcccaccttgaaacttagcctagtaaccattatcttgttacgtgcatagcaaattgtaatgagattttgggctaataataggattttacaacagaacttattataagccacagattaaaactggttatattattttctgtttcagtaatcttttgtcacaaatgacctcaaaactaaattatttacaacatcaaaaaaaaaaaaaaaaaaagaaaaaaaaaaagaaaaaagagaagaaaagaagaaaagaaagaagagagagagagaaagagaaagagagaaaaaaaaagaaagaagaagagagaagaagaaaacaagacaagaaacagataacaacacaagagaagagagagaaagagaaaaagaagagaagaccagagaagaatgaaagaaataagaaggagagggaagaagacagaaggggaaggagaatcatctaaagaaaaaga

SEQ ID NO: 131357 - DNA, 370 bp, Homo sapiens
accttattctactctctactttgctcaaaacatgccagccatatgggccttcttaaagtgctcttatatatgctgggagacagttctctattggtctctccattctgcaagctgggagcagagacactaaactgcctttgttctaggctatctttccaaagccgtttcagcctcataagacaaagcagcacaggacaggcaggtttactgccagttataaggctgaggtggcctgaacatggagttcctctcctctaacgtaacacactcaatgtacaaggcttcaccttaccctcttcttagctgccccataggaagtggggctaagggaaccaaaagaaatgctgatactctggctacgctattgcta

SEQ ID NO: 131358 - DNA, 337 bp, Homo sapiens
taattctgctggtgataactatttagtaaaatcccagaaagcaaggactgaaagcaaggtatttaatccacattttatagtgcagagccaataagatcccttgaggaagagacaaagaagaggaggggaaagaaggcttcaaagaagtagctttgctgcctgcagacacagctaactcctttcatgaacaagtctgtttctagagaaaatgtgcactgaacatttgtacccaaggcaagatggagttgaatagctccacgcaccctgactcttatcttaccaggaaaggtctcttctcctacccaaccttctaggctcagctttgcccagttcaaag

SEQ ID NO: 131359 - DNA, 440 bp, Homo sapiens
ctcactctgtccaccgtgttacagaaccaaaccagcagctcaaggttacccgaggtttacagacacataatttttcatctgcttttattgcctctctttctggtctgtttaccaggccctgaattttgagctggatactgattttaagtagttgtccaggctaccgactcaacaaagtctcaccagaaacaaaacttcttcctgagcaagctcttaaacgtcaaagagctttgagcaaagcctcaatcactgtcaatgccaaaccccaactgaataattctgcaaaccacagtaacagtaaggcactcgtatgtgcaaaactgatttctacacttaggagggaaagagacgatttctatataagagcagatgggctctgaatataagactaagaaagacatgaaaggcagcagtgagccactgaaggtttgggagcagag

SEQ ID NO: 131360 - DNA, 578 bp, Homo sapiens
tcccctagacacagagggcccataggggtccttggtgagcatgcactggcttccttagccacaaagctgtcctgggacctacgcctggttgagggtccttgaggcagcagccctggccttggctgccctgggaggcatcattttaatgaaagcagctatttctgcaacagcgaaaagaccatcagtgggattgcaggtcacctttgcagctctgggctgtccatccccagatgcaacatgatgtgggaggccggaggctctggcaggtccacgctgggaggactggcctcttctctcaccctgatggaacccctgcaggcctggccaccagactcagggcccacgacctcccagctttcattccagctccattcccaaggaagcctgggaagttgggggtgggctgggggaagtggtatgtcccagcggcctgtgcctgccaccggagctcttcaccatccaccaagaggcgggggcccctggggggagagtgggggacacctgaccctcctttgctgggagcaagaacttcatttgggagaccagcgatgtgtttctgcagctccaggacgatgata

SEQ ID NO: 131361 - DNA, 559 bp, Homo sapiens
ttttgaactcctgacttcaggtgatccacccacctcggcctcccaaagtgctgggattacaggcatgagccactgtgcctggccttttatttttatttttatttatttttttagacagagtctcactccatcacccaggctggggggcagtggcacgatcttggctcactgcaacctccgcctctcaggctcaagtgattctcatgcctcagcctcccaagtagctggcattacaggcgcccaccaccaaggctaattttttttctttttgtatttttagtagagacggggttccgccatgttggccaggctggtctcaaactcccaacctcaagagatccacccacctcagcctcccaaactactgggattacaggcgtgagccaccacgcctggccctttccccattctttcttcattttcctgaaactattttgtgaaatgctgccatcttgggcccctttcctcccttctctatcccacttcccaatccccccattagctttttaggtctgtacagcacccaggcatcagttggctctgaaagctatagcaatgt

SEQ ID NO: 131362 - DNA, 314 bp, Homo sapiens
atataagggcactagaccatttatgaaaggcttgaaaaaggagagcccaaaaacatgctctgcaattgccagccaaacacactttgagggattacaagaatacagaagagtctcagtggagaaaatcatcaatatgctgcagcagtttccctcacatatcctttccattctacctataccattgcccaccttgtggagggaacaagaggggaagagagtagaatctttttctctggcctcagtcacatgagaagaggcacttcctggggactattcaaagtagcccttcggaatttaggttttacagtaaaatg

SEQ ID NO: 131363 - DNA, 118 bp, Homo sapiens
atttatttgttttcttaaatattgtctctggaatcccaagttaactcttgtagctcactttagctagagttagtctagtctgccagttaatgtacactttacagtgttctgtgttttc

SEQ ID NO: 131364 - DNA, 253 bp, Homo sapiens
acgtatgtttgggggtagatggtttagagttctattaggagagagatgaaggtattctaggtgagtgttgagtggctgactgctgttagagggcaaaatgggataatcttttacaaaaaacttgaggtacatgatttagtactttgattatcctagtgattgttacactgaatcagaaaatgcatttaccttaaaacctttattgtaactaggtgaaagtaaatgtggtgtaacttttggtttgactataatg

SEQ ID NO: 131365 - DNA, 389 bp, Homo sapiens
aggtatcctgcaaagtagccttcagggcatggatgattgctaactggagtgttgtcttggtggcaggtgcatcaaacagggtggcccacttaggcctttcaaatccatcagtccttgctcctcttgatagttgtggtaaatgatatagtcagatgtcttaagtgagtctctatgaacatttaactcctggaagctgacgtgtttgggcacaggtgttgttgttgtttttccagttggctttctctgaaggaggagatatgggaaaaagcatgactggttggctgtgatgatagtgttgaagaacaaaacttactcccctctgtgcttacagtatcggctgatactgtgatatttccttgagaagaaatgtctggtacatcttttaagta

SEQ ID NO: 131366 - DNA, 401 bp, Homo sapiens
ttttaaaaggagtatcttaagagactaattttatagaaggcactttttaaaaaaaaaaagaaatacaggtatatcaggtgtgcaagctgtccttccatatccactcttctcttcttatatgaatcagaacctgttatttttagcttggtgcatggccttccaaatgaaggctatgtttctcagtaccttcatgagtgaattctggtcagtgtcatgtggacagaaatgaggtgcatcacttccagaaggtgcctgaaaggcaaggagcacattgcccctttctccaccctgctacctggaatgtggatgtagcatcgtatcacagaggggatgctggagccattggtcaacgtgggtctaggtccctggatgaccctggagatttgggccagtattctagc

SEQ ID NO: 131367 - DNA, 396 bp, Homo sapiens
cagcctcccaagtagctgggactacaggcgcacaccaccacgcccagctaattttttgtatttttggtagagacagggtatcaccatgttggccagactggtctggaactcctgaccttatgatccacccaccttggcctcccaaagtgctgggattacaggcatgagccactgcgcccagccggtttttcgagagcttttaagagctcagagcactttgcagaggtggctcttgatcctctgagccacctgtctctcttcaccacctttaggaagtagatcgtatgacccaaaaacaccaggtcattcacttagtctcagacattggtacattcctttatccatctacccacatgttcagtgagcagtcacttgtggcgcgctcgatgtgccaag

SEQ ID NO: 131368 - DNA, 304 bp, Homo sapiens
tgctggggttacaggcatgagccaccgcacccggcctgcttttttgttttattcgatgcttcgttttgttttttttcctgctccagactagtttcttctctctcagcacctgttgatgtggggtccctgaaaccttaaggacaagactgagatcatatgtgcaaatcaccaatatggtttggccttgggtggtttgtccaactgcctccattttagtttttgccaagatgtttaagaatatcctaagcaacggcacctaagggaaatggtgaattcaaagatattgaagctattttgaagccca

SEQ ID NO: 131369 - DNA, 246 bp, Homo sapiens
tttaagttgtgattgtgtctgatgaagaggaatgcatacttacatatttgtgtaaggaagatttccttattgtcatttccttccatcgcttggtccataaaagcaaagaggaaggaagggaggtctgtggtcatacacactgtcacccatgctaagagaaaaggtagttgagagctctgcctgcccacgtgcccatctgctgggtcatccttgtcctatcaggagagaaagagcacttcctttcct

SEQ ID NO: 131370 - DNA, 814 bp, Homo sapiens
gtgctcgcttcggcagcacatatactaaaattggaacgatacagagaagattagcatggcccctgcgcaaggatgacacgcaaattcgtgaagcgttccatatttttgaagcaggaaaattgcttgaacctgggaggcggaggttgcagtgagccaagattgtgccacagcactccggcctgggtgacagagcaagactccatctcaaaaaaaaataaaaaataaaaaaataagagcttaattataaaatatgattaattatgtgcatttatctatgattcccacatatttttaaaagatttaaggaagcataatcaataacttctttccagtgcaaataatagaaaagcaagttgtcttgaaatttgtcttttgctaaagatgtttaccaactttgctcccttttatgtgaacctctaccttacttcccataaaccctaggctcaaaaagtgttacagcatactagttggaaaactgattcattctgctaattattttttatttctaaaaaatctcttaaaagagaagccataaccataaaaactctaggtttctaaatttttacatctttattcaggcactatcaatgtaaattaatattgattttttacttacttttttgttcaaagtaaaaatataaaggagttctgcagcttctgtattttttaaaactaggtgaatattcagtttcaggaatatttaaaaacttacaagacctagcatttctttcattttatatatattgagcttaaatttgaattctctatgttcccttcaatgcccttaaattttcacaaatgaaaagctagtgtg

SEQ ID NO: 131371 - DNA, 152 bp, Homo sapiens
gaataaaaatactgctctccccatgccccactggctgtaggaaaattgagggaaatggttgttattttctctttgtaggttggattactgaacctcggagtgagatgacctgtgagttttatttatttttatttatttcattttatttattt

SEQ ID NO: 131372 - DNA, 807 bp, Homo sapiens
acttatgattgctccaatataaaaccacatttacacctcagtggccactgaaccattcagcacagcttccttaactgtcagctgttagaagctagcagtgtaagcactgttgactatttttttcaggctctgaatagctgtcaggatctcagtaggagttggaggagttagctcaactttggcttaatatctaaatgtggccaatctaggcttcaaatacgtcacagcagtgttcaccagcgctggagcctcctcctccaggttccagacaaatcagaccatggttttaggatgaaaaatccatggccccaaatggctagctaattatacttttaaaattcctcctatctttattgctaccttcatctctttcatatttccatttctttactgttatactttctgtactaatttacctttgtaagtcatctcagaattttttaaatttaatttttttaaaatttttcatatggcatgaaaaaattacttgtagacatctataacataatggatctcttattggtaatttgtttgggaactgacttggtactaactttgatttctctcactggattcctagactctccaggatgttagaactggctttggcctgtggaacacctcgtcttgtgcattctatttcctgaataaagggtcttctttgttttccctgcaacgagtggtcttttgctcctcatttctgtggtcctttacccattctcccaacccaatggcatttcaaaactatttaaaatttaaaaaaattattaatataattgcttacattattactctgtgatttaataa

SEQ ID NO: 131373 - DNA, 140 bp, Homo sapiens
agggggttgggtgagttcatttctttcatttttaagaaaaaaacaaacaaaaacatggtgtggcttggcacaaaaacacaccttacgaataaaaatgggttgctagaccctcatggctaagccatcccaccattttcttg

SEQ ID NO: 131374 - DNA, 720 bp, Homo sapiens
cagaatatcctgagctcatttgtaccatgataatgaacagcagggcactgaatctttttagttttattggcattgtatacagtaagttattaaatttcatctctgtaatatacctgcagtaaaataacaaaatattggtgcacttaaagaacatgtgtgtgtggaacaatgccctccccatcatttcagccccctgcaaacagctgcttacagatttcaagatccattgtatgtattccctcgagcccacctctaataatcgagacacatctgccattgcagtattataggcatatgtagttttattgaaaactatacctgtaaaaaaattaaataactcctgcctcaattaaattggcaagctaccttttgcaaagatcatattgcagacctcttgagacccaagtgagttcattttattcttacattacaaatcactaaatatgttatttttatttagctgagtagctagctttcctcgtactttgatggtaagttactttcatccattctcacttttgttttccttctcccctcatctttacatattaaaaaaattatgcaaattgcatgaagcaaacattttgagaatctgaacagaataaaatcaaagggaaaggaccctaacatgcagctttaactctgaagtgattattaaataaatacatgcaaaggttacaaaattggggtcaaatttataactcacgttgtggcttgtga

SEQ ID NO: 131375 - DNA, 847 bp, Homo sapiens
tttttttctgcccaatttcattattggggtgtgaatccttgttgatgtttactgtctatttattttgaagatactaatcctatatttttgtaagtcaatgtcctccggccaggactacaagaaaccaactttaattaagcaagttggttttattactcagtcatgagttatggagaatttcagggcatctcagcacgaggatgttaggaagatcctatacagattttgggcttttatttggggattttggaaagggttgaaggaagcaggctttgctccagactgaatgctgcaggaagatactcagtacagtgagtatattttatatatcttttgtatagggaggacaggtgagagagatactaaagctgtaattggtcaagaagtagcagctatagtactggtataaagatagatacatcgacctgtctctattctggaacagaacaaacccttgcgtgtggagtcctaattagggaaaaggagtcaggctggctggacgaagggaagcaaaaggagaaagcagacaagccataagtctgcctttcttcgtggtccaggacacatagccctgctgtgcaaataactcacaatctgcctgtgcccagccatcaccagaccctcagctgatagaaaaatggaagttagttcactgcaaccctggcattattagtactgcacaaagccctcttccacccacaacataagcaccattctacaaaatccccagcaagcctttgtttcctagcagtcagcttctctcttgctgacctgcctgttgcacccttgcaatgtattttcatactttatctaataaacctgcctttctttacctaacaaaaaaaat

SEQ ID NO: 131376 - DNA, 423 bp, Homo sapiens
ctgaaatctttttcttttcaaattatgaaggcactgcttcactgccttctagctttcagctctgctgttaagaagttcaatgctattctaattcttaatctgtcttatattaactgcctttttccctctgcaaacttcatccttggtgttctgaaattattcactgttgtggcctgaagtggcttccttactattcctctattaattacagtgggtacttagtggaccctttcagtcaagaaactgaagtcctagctctggaaaatagacttgtatttttggtatttttgttattggataatttcctacattctgttgtctctattctctctttctagaatttctataagctagatgttggttgtcctgaaaggctcaattcacttattcattcaacaaatacttactgggtactcactatgt

SEQ ID NO: 131377 - DNA, 145 bp, Homo sapiens
tctcaaaataaatagttttttaaaagtaaaaaaacttcaccatttactaaacagtaaagaattataattgcatactataaactttgaaaagtagcagccaaaaataggaacacagattgtagtcaagaaccgagattcctggctg

SEQ ID NO: 131378 - DNA, 532 bp, Homo sapiens
cctctgcctcccgggttcaggtgattcttgtgcctcagcctcctgagtagctgggattataggtgtgcgccaccacacctagctaatttttgtatttttagcagagacagcgtttcaccatgttggccagggtggtttcgaactactgaccgcaagtgatccaccctccttggcctcccaaagtgctgggattataggcatgagctaccgggcctgtccctgccgcctcttataaggaccctgtggttacactgggctcaccagatcattcaggggcaccttccgtctcaagatcctcagcttaagcaactctaagggtccctttgccatgtcaggccacatagtcacaggttgaagggagtaggatgattagggccattattgtgcctatcatagcaggggagagtgaggctggtgggcaggcaatctaaggcctggaggtgagtgggtgcttggctttggaggggtgctgggcgcctaagtacctggaggaggagctcctggaggggagggtgagacagcagagggcctt

SEQ ID NO: 131379 - DNA, 313 bp, Homo sapiens
ctttaatctgcagctccacagtttgaacaaaaacagactgaaggctgggcgtggtggctcatgcctgtaatcccaacactttgggaggcctaggcgggcagatcacgaggtcaggagatcgagaccatcctggctaacatggtgaaacctcatctctactaaaaatacaaaaaaatagctgggcgtggtggcgggcacctgtagtcccagctactcaggaggctgaggcaggcgaatggcgtgaacccgggaggcggagcttgcagtgagccgagattgcgccactgcactccatcctgggcaacagagtctc

SEQ ID NO: 131380 - DNA, 236 bp, Homo sapiens
gatgtacagagaccaagggaagcaaatgattaatcttctagaggtatggaggagtttggtataaataaatatttcactgaaaatggtatatttgagctgagacttgaaggatgagttagaatccactagatcacaaaggggatacttggtcaggggtagttggtaagcagcacagggagggaagtgcagggagaagtaaccttgtctgcgagaaaacaggagtagaaaggccccgg

SEQ ID NO: 131381 - DNA, 297 bp, Homo sapiens
tgggggttgcaggaccggttgagtcagttcctttgtatgagtcacatacaaagggtggcatcagttggttcaccagaatgcaaaagtctgaaaaatatctcaaagaccaatcttaggttttacattagtaatgttatctattaggggtaattgaagaagttatatatcttgtgacctccaggtacatgactcctgatcagtaagcaaactagggaacaatagctggttattgcttaactattcatagatcttagcaaattcaagactctaccataattctaaccttgtggcctttta

SEQ ID NO: 131382 - DNA, 694 bp, Homo sapiens
atctatcgttttgatattcttctgtttatctcatttctttggtaactgttttatgtctttctgctgctgtctgtgttaatatgatatttttaaaattccattttagtttatccactggcttttcagttacacatttttgcatttttaagtggttgaggacatgcattcttagagcatgatatcacaaccaagaaatgaaaattagttcttgtagaggcaataccatgccagatactgtagtggtttgtagtcttccaaagagctacagtacataagtaaatattcagtatatttgtgttattaaaatttcacatggagaggaaaataggaaacaaagcttactatggggagtataatgaaaaagtgttctaggcttatagtatacatccttaaattagatagtgtacatagatgtactattctgccactccatgtaaaatcagagatatttttataagtaagatctacttgaaatatagtattatttcaacagtgcaacattaataccatagaagtatagatttgatagggattttaaaaatttcttcagccatcatctattaagtacctcttattttcaaagaggagcagtaaaacaaaatactctatcataaaagcacccatttcttgtgattcattgtgtcagctaagaagttttgtagtaaatttttaaaagttcagaaaattaaaggat

SEQ ID NO: 131383 - DNA, 408 bp, Homo sapiens
tgataatacataaaatgttcagtctaatgcccactatattgtatgctcttaaaacatggaactacttttattatcattgatctaagatgaacatagcaaacacacaagagaatatataatgaaaattgggataagtgctatgcagaaagtggggtggtcattacccttaaattgctgggagagctgaggatcgcgaggagggtcggggaatgctccgaagaaggatctttggagcctctgagatgtgaagattggaggaatgtagtcagttgaagggtgaagggaagaatcttccaggtggggggaacagcattaatgaaggctctaggcctggaagatcttgacatacaagaagcttgggaaaggtcatgtagctagagtatggggagtgagagaagggtaagtggc

SEQ ID NO: 131384 - DNA, 419 bp, Homo sapiens
cggggcagaggacggcagcagctcaaaggagggcacctctgtctgagtttcctctttggaaaaagaagttactgttcaacttaccaaaatgccttacacattccttacaaataaaccaaccaacctacacagcgttatccaggcccaacttccggtactccgagagaagccatgagagacaaatctagcctcagcccggtttcccagctccgcctggcctggtgctgcgtcccagggtttgggacagtctcgtctggtggtgtcccttggttggacagtcagtctttggccttgaggcagcgtctgctagtgagggagtggcatcctgatcacacgccttacgctggaaaggcaggcctccagctgcccccttttcctttaagtctccttctgtaactccggaacattcctcccagctc

SEQ ID NO: 131385 - DNA, 440 bp, Homo sapiens
ctctgcctctttgtctttactgagaattagtcctaggtaggtaaatagcaccaggcctagggcaagactagtttttcttaaaggcgatgcattcactttgtaatgaaataatgcaagtaattgcaaagaatgtatcactgtaattaagagccatgtcaacaaataaaaccctttgggagactgattgtttatttcagttgttatagccaatcagattggagagaactttgtaacttcttcaataattaatctgagttattccatcagtggtcataaattaacttatggaagaccaagtctacaaaactggcatatttattcatgattaaatagatttttggtgccatttgatggtataaattttacctagtaaaagacagtcactgattcctagtcatctttgagggaaaaaaaagatgttgataaagtgatacagatgg

SEQ ID NO: 131386 - DNA, 379 bp, Homo sapiens
agagagcctctcagactaggccaactgctcataatcctgccgaccctctttggcccctatgatgttgtaaaggcaatgtggcactcatatcagcagcacacatactataactggcacaacacagaggtcagcatgggccccatgcacagatgacacacaaattcatgaagtgttctacatacatatatgtataatttttttttttgaaacagggtcttgccctgtcgcccaggctggagtgcagtggtgctatcatggctcactgcagcctcaacctcccgagctcaagtgatcctcctacctcagcctcccaagcagctggaactacaggtgtgcacccaccacacctggcgaattttttattttttgtagcgatgag

SEQ ID NO: 131387 - DNA, 432 bp, Homo sapiens
ggcaactaacagctattaaactagttaacatttataaaccattaactctcacctacaccccttgtaaactattaactctcagctacaccccttggtaaatgttaacagttaaagttctctttcattcattaaaatgcaaatagcttaacatgtctgtgacaatacacactaataatttcccactttttattaaatgtttaatagcactgatacccaatctgaaaaaacttcccatattagagagatagactgtggtgctaatattttcctagcaaacgacagaatttttaaattggaacagactttagagatcatttcatccagcttctcattttaaagattaggagatagaaccagagcctctgaaatgtccaaagccacagagtttattagtaaatataaaatcagaacacccagggtcgggtgcggtag

SEQ ID NO: 131388 - DNA, 486 bp, Homo sapiens
gcacttgtgacgcaatttagtgagcaagttaagaaacgtatcctgtttgaggtagcatcttataatgtgaaaccatgaattgcgctcagcacctggtatactgcttaggtagtaggtacagtgtaagtggtgatcatatgaataactatgcatagatgaatacatgaatgaatgaatgaatgaggaagacgggcatcaacactcacacaggatactgatattaaatcctaaggcatttggctttggattttgaaaacagtaaatgctcaataaacaacaactgtgttgacttgaattaaaagatgtgctttccatgtgtccagactccaagagaaggcagagtgggctgaaaataaatcacagagctatactagaagacactctacttaggagatctagttcaaaaacttgctgtggtgacttgggaaagtcaactttcttctgtggattttagttttcttttctgtaaacagactaacctcactt

SEQ ID NO: 131389 - DNA, 364 bp, Homo sapiens
cagactttgctagatcaccataaatctccaacagatcccagtcactggaaagagctggctacttgcccagcagagtgcaaaaacaaacaaaaaaaacttgcaggccagcatatctacctataggtggccaatgggtactgccagctcagatgtcaccctgaagtttgtatctgttttctcagacacaaccaatatgaattccccaacaatagttctttattgggctgtaccaacattctttactacacttgagaagtccacaatcagtacaagaaaaaaggtcaggtcctcatttcacaacaaaataggcctcccacctgaaatgctaggctgagaatcagaaatgtgccattagatcagataa

SEQ ID NO: 131390 - DNA, 427 bp, Homo sapiens
agtgggccaccctgatcccagcccccaggtctggagtcaccatttccagttcttcaaacctgcctgttgccgacatgctgggtgaccttgggcaagtcacttcgcctctctgtgcctcgaggcctcaccaatagaatgaccctcactggaagctgataatcaagtccgcccacccacttggacattccaggactgttcaatttcagtgccatatagacttacataagcagggctgcatttctttaatttgagtaaaatgcaaatgctcctggtggatgagtctgcacttctcaaccccaagcctgctcaggtgcatcacttgggcgggagggagaggtcccacccagacccacggacctctgctcttggggtggacaggccctggagattggcattttgcagagcctcctgaggaggggagttcaga

SEQ ID NO: 131391 - DNA, 519 bp, Homo sapiens
gctctgtcacccaggctcaagtacagtggtgtgatctcagctcactgcaacctccaccttccaggttcaagcgattcttctgccacagcttcctaagtaactgggactacaggtgtgcaccaccacacccagctaatttttgtgtttttagtacagacggggtttcaccatgttggccaggctggtcttgaacttccgacctcgagtgatctgcccgccttgacctcccaaagtgctgggattacaggcgtgagccaccatgcccggccaactttatggtaataaattaagacagtgaaagcgtgacttactcaagggctacatatataaaggtgacagatctgtatgtatctacttaaattcatgcccaacacagcacatgttgggcaagaatttgtgagctagctcagcttacaaatggcttagactaggggcatgtggcaaggggtatggggttctacttacagtttagggtcacaaaatagggcgatccaactctcccacttcacacaaagcctg

SEQ ID NO: 131392 - DNA, 342 bp, Homo sapiens
tttcactgcatatatcctaaagagaaacttgattatgtagtaagatttatttatgtacaagaacagtcatttcagccctgtttgtaatagtgcaaaactagagacaaactaagtgctcattgataaggaagtagctaaataagttcagtgcatattatggagtgccattcaggaatctaaaatatttatatggaagattctcatgtatgtaacacttaaaaaattgaaatattgatatttatattttgagagagagagacagagagatgcaaaagcctaaatatttatggcagcgtcagactattaacagtggtattctgcagatgggattcagagttagga

SEQ ID NO: 131393 - DNA, 742 bp, Homo sapiens
gtacatagtggagaatctgtaaatatttgttatataaatgaatattccccttttaatttaggttacttcccaaacttctgtaaggaatataaaattgacttatatttgaacatacttaaatcaaaacctaggtgtcatgtttgatccctcttttttccttaccctcatggcagaaaagattgctgttccatagcaaaaacagcattccatttacatccagtcatctccatcttctccaccaccatactagttgaaaccaccatcatcacatggattcctacaatagcatcctagctgttctctctgcttccacttccctcgttcttaacaataggttcttcacattgtgggataatctatttaaagcataactcacattatgacaatttgctgcttaaattcttccagggactccctttgcacttagaataactcataaccgtgtcttagaggaggtcctaaatattctggcctcaagcttcctctttgaatagttattttctgtcactgagccacgtcttgacttctgcagctctttcctcagattaattagagtgccaagagtaggagtttagcaccttcaagtcaccagatacccccaccaaaggcacctcaaataaatatataaactggggttatttttaaatgtgattgttgtgtaaatacacctttggattaagtcccttacttttcttccacctagattgttaggccacctctaagtccctttatagaaattctg

SEQ ID NO: 131394 - DNA, 815 bp, Homo sapiens
cattaataccatgacatcttgcttatgaatattccattgctctgtagttcaaatctgttagctttgtgaaagttcatcactgtgatgtctgtattcttttttcctttttattctgtttaacagaataaaagaattctttagattccctgtaaaaaaaaaaaaaaaaaaaaaaaaagagacccggagagaaaagcgcgggttctgcgccggggccaagttggtcaccgccatttaaagggcgccgggtttttacctttgacccacattttttaccgggctaattaccagcgttaaccagggagtggctttgtggtgttaccccttattcctctttttggggaggtctttaacgagacgggtccccagtgaggggtggagttctcatttaacaacccaaagagagaagtgccccttggaaccagagaaaccccggggggtcccaaaggggtgcgtaacgggagcgaccagcggatttccaagcgccagagtttttttccttttataataggttttccccggaatttgtgttttctggactgcgcgccaacatctatacaccggggggagattcgctaattcatcactctttcgtcgtcggacacacggccgtggggttcttccctggaggtttcccacgcttccttgttgtgtgacacggacccccttggtgtttctccccttgtggctattcggacactcggtggttatggtcttccccctgttaatttctccggggagacggccacgtgttcagcctgcggcttttggtccgcttggagcgacggctgtcttcccaacagggtttcccgaacccg

SEQ ID NO: 131395 - DNA, 480 bp, Homo sapiens
ccagctctgctgggctagggtgaagagggtgaaggaaggcttcctgggggaatgtttgtggctgagatttcacttgtagctgaccaactatttcaggtcacatagcactgaaaatcaaatgggtataactgctaatattctttcatttggtttagaagaataattctactgtaggtcagcagcatgttttgttctgtcccagaaatttttaaattaaactacatctcgcatacatatagccccttagagttcacaaacttaccgaggagtgaggaaactgaaacttacagagatgaaataactagccctaggtcatgttgccagtaagtggtggggccaaaagtggaatctgggtcttttgagcctagcgcaatcacaaaacaccaaaacgaatgtcatgggctctgccagcaacatggtgagctttggttatatatggtggttgttgtttaaagtaccaagtgacctgggatctacttt

SEQ ID NO: 131396 - DNA, 707 bp, Homo sapiens
gagtgacagtagctgggagggagggctcagtgttcttagatttagcattctttcctcccatcctttcaccccaattatttccattcttgctatagaagacttcactgggggaactggataatagcaggacaggcactaaggctggcagagttagtgggaatggagacgatcagggagcagaggtcttcagcaaaaaaggaaagggaaattgtagagctggaatggggaaggagtcaaaccttagtaattggatgaaggaccaagtttgtttactctttgcatttgcacctgggtgttaatcaccaagtatttgtgaatggtgcagaagatgttctgaagacccatagattaaattggaaatttaattctgatttgttagactgaatagctttaaactggttttatggagaagttgaagaatttgtctatagagaatctctaatatttaagtattgccagttaaaatatacattttaaaaattggttacttgaacttaagtgaataattccgtgactgaatactagctattttgtttgaggctgtgtctgtttgaggggagcagagggggacagaaagtgagttaatgaaatcaagaacattctcaaacagttgaggggttgggatggaaagggagctagtaactacctataaccactagaggcctctcttaggccaagtttcatggttaataccactaggtttccac

SEQ ID NO: 131397 - DNA, 167 bp, Homo sapiens
tagaggatcccgaccgtacgtatgtaacataaacagtatctttcatgaaaaacaactactttctaaaacaaaatgtaaggtgagatgagcagcactgttttacatttttggaaatctctttttttttttttttttgagacggagtctcgccctgtcgcccaggctgg

SEQ ID NO: 131398 - DNA, 199 bp, Homo sapiens
caggagggagtctaagacttcagacacagcacagatacgatcctgggcaagggtcattcagtgttcttaagaaaattctaaatcctagggtgtgatggttaatattaggtgtcaacttgataggattaaaggatgcctagatagctaagtattgtttctgggtgtgtctgtgagggtgttaccagaggagattaacatt

SEQ ID NO: 131399 - DNA, 668 bp, Homo sapiens
taaatacagatttgatcatcctggtccactttcccaataagatagttaacaaaggtttacctaatgtgttatttatggaaaaccaatttacacagagtttggaatagggaaaaaaagtttctaagtaatgatttcttttcctgtaacccattgtcccagattaagtctgatagtcttatgatcaatacctcctaaattccagattattgtgtgtgaatctttgacctaaacatttacatatggctgatagtactatttgagtcttgcacgtgatggaaactcatgcttgttgaatttgaattgtcagttctcctaggacataggtttgtccatatgattttacacagttatttagaaaactagcatacctcagaaatattgcaggtttggttccagaccattgcaataaagcaagcctcacaatttttattttttggtttcccagtgcatataaaatttgtgtttacattataatttagtctgttaagtatgcaataacattatgtctaaaaaacaatgtacataccttaattttaaaaaatactttattgctaaaaagtatctgagccttcagcaagatacagtctttttgctggtggacagtctttcctcagtgttggtggctgctgactgatcaggttggtggttactgtaaattggagtgactg

SEQ ID NO: 131400 - DNA, 800 bp, Homo sapiens
cactatagttcttgtgaaccaattcactaatttagggaatctaatatttcgaagggaaaaaaatagagacagatcctctttgtggtggttgaatttttaagttaacggagaagatttccatatgatcagagttgatgtggaattatggtgacagaaatgttcgacttagagggataataagtcagtttaatggctcccaaattatctctataatttagtcagcttttgagacaagaccgttgtgtcattgatgacttatgcctcaacttgactggtaattttgttcttttagtgagtccactctttagcttatctccttttgactgttgtaatgtttatttttcagtaaacaaaagattgaactggatttacagtagctaagaattacataaatagctatatcttaatttctccactttattggtataaatagctcaaagagaatggacaagtagtgatacagtacagtaattgtagctaacatttatttggttggttgttacgtgctagggactgttctaagcattgtgtatgtatattaactaactgaatcctcacaacagcctaccatacatttcctaccacaggatatgttcattcaagaagagtaagctgcctaacattaccatttggtaaggggcagagtggattcacacccaggcagatttttaatctttatcataatccgtatgctattcatactaggattttaatcactatcgtatatcaagattgaaccatagtggcctcctgcctatataataatttagtttcaagacatatctaagaaattctttttg

SEQ ID NO: 131401 - DNA, 152 bp, Homo sapiens
gccaggtgtggtggcatgcacctgtggtcccagctatgcaagaggctgaggtagaaggactgcttgatcccaggaagtccaggctgcagtgcctgaccaggcttcagtgcctgaccaggcttcagtgcctgaccaggcttcagtgcctgacc

SEQ ID NO: 131402 - DNA, 461 bp, Homo sapiens
tcatactcttacaaaaaggaaaattatcactagaggatgttggcaaaccaattcattattttgaaaattgcttaatataaggagaaatgcaaacatttatcctgatttctcatatgtattctacacctaggtaagcaaatggctgatgagagaaaacttcactttaagtaagtggggccaggtgcggtggctcatgtctgtaatcccagcagtttgggaccccaaggtgggtggatcacctgaggtcaagagttcaataccagcctggccaatatggtgaaaccccatctctactaaaaaacacaaaaattagctgggtgtggtggtgcgtgcagtgtcttaatcttggctcactgcatcctgcatctgcctggttcaggcgattcttttgcatcagcctccccagtagctgggattacaggcacaaactaccacgcccagctaatttttgtatttttagt

SEQ ID NO: 131403 - DNA, 631 bp, Homo sapiens
ctcagatattttgcagagagctatcttaatagcatggcatgtcatagcagttgtttggatttcttcataatattttaacatattaactaccattcctgaactattgattttcaggtaggcttgtcaatacaagcactagcactgtgcttaggtgacattgcttaagcacttactgtgtaccaaacactgttctaagtgctgtacaaatatgaacttatttaatctgcataatatctctatgaaatagaataattatttccagtttacatgtgagaaaactaagatacaaagaggttaagtaacttgaaaggtctcacagctataagctgtcattagaattagatgggctagctgagtccatgttcttcatcactaccttatgctgccttatgtttaagctataacaaattataataaaatgaatgataaaatagcaaaatagtaacaaaattccatttgaagacattttgatcccagtgaaaacaaatgtggttcacacagtattgacaaggatagactggtattttaccagtttgagtggcatcacccagttcatgtggaagcatagtaggctacagtaaagaatttggacttcatctcatcacaatacagaatggtctctgggttataa

SEQ ID NO: 131404 - DNA, 376 bp, Homo sapiens
aatgtaggttcagaattttacccaaactgaagagattgtatttggcttctagatcaatgataggcatgacattaaaagcccacagttaacatcaataagtaagagtaggtcactggtaattaagaatggaaatgccaccatctccagcagttgaaatctcactgcaagtgatctgaattcaattagaaaaaccagagggggtagatataaaaacagttggctaaagacaggtatgcttcaattcagtactcatatagggtctactatgaacagtactatgataaactctgtagatctaaaaatgaatcagaaatggtccctcccatcaagaaagaatgatttaatagaaacatgaagtttagtctagtagtagtaa

SEQ ID NO: 131405 - DNA, 613 bp, Homo sapiens
aagtgaagtttcctcaagctcttattttaacgcagtctttgtcttttttatttaatattccttttagatggcatataggcagaccttgtttttttaattcagtcttataatcaaagtcttttaattggagtgtttcttttctttccatttattctaagtattgatatttgttccaaatactaatatatattttgttctgcagatctttatctgcccttttttgatgagtaatatgtttttctagtattttatttgtatttcctttacaaattcttgagataccctttttataacatttctctctttgacttccctagagattactgtatgcatattttgcttatctacagtgaaacaatgtgtaaaatttgcaacagcgtaatcccatttaacattttcctgtcctttgtgctcttcttacgtcttctaaatatgtttttaatgctacaatacaatattgttccttttttgctttaaatgataaccctttagagaaattttaaattttaaacatttcatagtgtgtttgtgtacatgtgtgtaatcttcccttccgcctagtattctttcagaaaatttaggtccattaaaaattaagggcttttaaaaacac

SEQ ID NO: 131406 - DNA, 773 bp, Homo sapiens
cattctgaggaaagaaactgaattattgcagatttttgtgaaatccaagtcttaccttggatccctgtgagacagttactagatttttttttcaccgtttttcataagtctgtgtacacgtaatggaaaagcccgagttcttgttttgataagaaagtcacttggttgtttgatcccaaaggattagcttaacattatcaaggactagcataactgtgattatgtaaaaaaaacaaaacaaaacaaaaaaactattatttagtctggtagggaaatacttctatgagtatgttacaattggaagttgtatttgtgcctattttatctagttttagttaattccattgcttcggaagataagtggacgtcatagatccatcgcaagttctcgttttttggattttaaaattttgaccattaagttttctacgatagataaacatgttgtggacatttaaaaccgtaatttaaaactatgagcgaaaaatcttttcaagatggatacattttaattcattcaagtagcatctgattagccaagtcggggaaagattgcagtccgcaaagctggcttgtgataaggttgaggttacattttaagggtttgggtaggtgtgtttcttacagtgcttttatatgttaaggtatcttaagcagacacatggtttaaaagttcagtatttttagtactttttcattggcagaatttggacaagctaccagaattgctaactcctaaaggataaaagtaataataatagtgtgtcccaggc

SEQ ID NO: 131407 - DNA, 305 bp, Homo sapiens
ccagctccagacaccttcacaggcagctgtgcatgaagccctcctcacctatttaggcacacccacagtctaggctgccgcgcagaagcccacagaagggtcagtgcgtccagagtctccccaacattggacacccacatcacacacatgcacatgcacccatgggccagtccctggtgagcacacacacggcacctgcagacatgcctgcacatgcaaaagcacacaagcacacacaactgtgcagggccacacaagctcagtcacacacacggtcacacatgcttatgcacacttatacaccc

SEQ ID NO: 131408 - DNA, 726 bp, Homo sapiens
gaagttttctcaaactaccctcaggttaaaagaggggtggaggaggagtggtgaccagttgcttccagtctttcaaaggagaaatggacatctaatttgtgtatttgatttgcagagccttaatgacaacctagtattgtgtttggtggtttaaattttgtgtgttttctgggtatagcactttattaaaggaggatacccaattcagactgaatatgtaaagaaaagaaaggcatgactcaagtcataggaaccaataaataagttaggtatatcccatgcacgtattttcttcttcctttgggtaccttgacgctcagagtggcatgagaagacttaaggtttttgaggaagtctgtgatttggcagcctagtattacatatgtctactgcaagcacacgtgactacacactaaattaactaaattaaaagtagattataggccaggctcagtggctcacagtgtaatcccagcactttgggaagccgaggcaggaggctcacttgagcacaggagtttgaaaccagcctaggcagcatagtgaatccttgtctctacaaaaaaatttaaaaattaactgggtgtggtggtgtgcacatgtagtcccatctactcctgggaggctgaggcaggaggatcacttgagcccagaaggtcaagactgctgtgagccgtgatcatgccactgcattccagcctgggcaacagagtgagaccttaccta

SEQ ID NO: 131409 - DNA, 344 bp, Homo sapiens
tggaatgggtgataagcctggctgcccatcctaaaatgctataactgaagtcctgttgggtcagggtagggataagatgcagagcatctagcaaaagaattttgttccaagtggtcttgacttatgcagtaactgggatcctaaatcagtgcccgtgaatgaaattttagaaagcgatgcagagaagtccttttgcaacgtgaataaaacctgaattttcaagggtccagtgttgaacccacctggattatcacctcaagggatttctgctatttcactgcattcaagctaggcataatagttcataagtgcattctgaaaatgactttttattgccacagctt

SEQ ID NO: 131410 - DNA, 193 bp, Homo sapiens
gatgacttgacctcggtttgtagacagaagtaacttgctgtttttaccactgctatttatacctatcacccaaatcaaagaattataccacattcctggatactgcattccaaattgtaaagggaacttctccttccttgctagtatctctggatggtgcagagatattagaagggaagtatctgtgcatctt

SEQ ID NO: 131411 - DNA, 725 bp, Homo sapiens
aacactacttttctaataccctacatcaggtacgttcctaaataaactggaacttacctcagaagcctcagaaaattaggaaaataaaatgcattactttgtatattaagaagctcaaaatcccatatttgattcactatagaattacttcagaatctcatatgttgtttaagcaaaacctgtctcatattaaaacatacctactgctgtgttgtctatttgcttttctctttttaaatgcccttttgagaaatgctgcaaaaattttgtcctgacatgtgggggcccaactgtttcctgctatactcagcttggaggacatagcctctaggttatactcttttgaaattgtcctgttgaaatgcatgttttgattttgggattttccagatgcttcctaagtaggtcccatgtgttaaaacttgtggaaattcagcatgtttctcaatgtgaggcatctaagtagttcacaaatttaaggcaattagtctattactgggataagacgattaattctattatattccattgtttacatattacttgtttaatccatttcctattctatgctttgttttttcatttgtctgaattattaaaagtcactacattttaacattttaagcaatttaatttttatatataattatatcctttggctatttaaactgaagacacattgtatatgtaaatcaaattaagaaaaataaatggagagtgtgttc

SEQ ID NO: 131412 - DNA, 293 bp, Homo sapiens
gtcctctttcccatcaccaagaaccaaagtcctgggtaatgccggagccacgctgtgagcaccagcctttgggccaggggccgattatcccacatttgcagaacaggctggagaagattcagatcttctcagctcatttctccagatagaaacatgttgctgagagctggctccaaacccttctctcccgcttccattccctcctttgccctgaggcagatggcttggcttggagaggctctctggtgttagacgcagcaagtttttctttcccacaccccatatatgatggc

SEQ ID NO: 131413 - DNA, 771 bp, Homo sapiens
  misc_feature (7)..(7): n is a, c, g, or t
ggccgangccgggctcggctcaccctccccggatgccgctcctcctccatccccagaagtttcagccactgagattccccttgtcccggaggctggaggggaagacccaggcggctgcgctttggaggctggaccatcgtggggcttgtctgtgcccacttttcccccattcaagagttaccactgccaggcgcagttgctcaggcctgcaaacccagcactttgggatggcaagacaggaggatcgcttgagcccaggagcttgagaacagcctggacaacatgagccagccaggcccctgggcctggagcatccacaggaggaaagtacaagaaccctggcaccctgccaagcagcagggattcttcagacacccaagggctggtttgctgggaaggactcatgtgaccagaaggggaaactgaggcactgctgagcaccaacagtcctggagagctttaagaatggttgccatctgaggccaggcatggtggtttatgcctgtaatcccagcactttgggaggccaaggcaggcaaatcacttgaggtcaggagttcgaggctgtcaggcctctgagcccaagctaagccatcatatcccctgtgacctgcatatacatccagatggcctgaagcaactgaagatccacaaaagaagtgaaaatagccagttcctccttaactgatgacatcccaccatcgtgatttgttcctgcccaaccctaactgttcaactgactttgtgacaatataccctccccgcccttgc

SEQ ID NO: 131414 - DNA, 512 bp, Homo sapiens
catgacgtagacaggcaaatcatttgtggaactcaggccagttaattggtcatctccctgaaacaattcaaattggagaaaattctgtacaaatgtagtaatagtgatgttttatatgtgtatagtattttaaattttaaggtgtttttatgttcatgtcagggtgctctcaggaaaatgcttagcatcttgtaaaactgcaaatgttagatatcatcaacccagtgttataattgagaaaacaagcagagtgcaagtctaggacttatttggagtctcaccaaagaagtggctggcaaagcctaaaattggggcactggacactttcctatattcttctatcctgggaatcatgatttcctttgaagaatgctgtaaaatgttgagtgtatttgtttttgtctgttatgaactgtgattggcctcacacataaataatgaattcttttaggttgctttaggaatgtgttactttagtatctcaaatcaataatacaatcacaagtgaaaca

SEQ ID NO: 131415 - DNA, 297 bp, Homo sapiens
agaaaagccttctatggggaagctgttgaagatgacacaaacaatggcaatcccacgaggactatgggaagcagagagtaagtactctggcatattaaaagaatggaggaaaatgactgatactaatccaaccacaataacagcaacagcagcagctaagtgtgggggaaagaaaaatagatcagaccgttactgtgtctatgtagaaaaaggaagacataagaaactccattttgatctgtactaagaaaaattcttctgccttgagatgctgttaatctgtaaccctagccccaa

SEQ ID NO: 131416 - DNA, 372 bp, Homo sapiens
caaatctcttaccccaagtggcccaaacaggagagaaccctgaggctgttttggtgctggaggctgctgtgagacttttcaaatactgtactccttttcgtcataaagccttgtccagaagccccagcctctgcatgtgacatagacacaatgtattttagccttcactgtgtgcctgggctgggtcttgccaatactgtgaccacttagcaggagcaggctaagagtcttactgcagaagtcaaggccaactcagtggaaacagtgatgtcttttcaaggttgctttattcagcgacaaagtaaaggtttcagtgccctggaagctgatcagtgcttcctgtttagcacatggcctttctcaggcactgag

SEQ ID NO: 131417 - DNA, 436 bp, Homo sapiens
aatagctgttataattgatgacattaaaatttcttataataggaaagtagaattgaaacttctttagttttgaaaatataatggaaacaatagcaaatctatgattactaagtgaaaaatactgagaattctcagtttaaattaatattttggagatcacatggaaattctataaattcttacagtgggttctagccatgtctttctgtgattatgtgtacatgtttacatcattttcgagtcttttttcttctcattggtaatttttgggcccgttgtcaagattaaattagatatagtatatgaaagtctttagctcactcattagagttgcttaataaatgttgttttttcaaaaatgattatttaaaaaatgatcaagaatcatgtggttttcaacaaaatgaggcaatgtggcctagtagaaagagcttgg

SEQ ID NO: 131418 - DNA, 520 bp, Homo sapiens
accactaccctctaccctgggtaacagagcaagaccttatctctaaaatacgtaagtaaataagtaaatgaagaggtggaaagccacagcactagagcacaagctctttgagggcagaaagcctgtctcattcatttttgtttccttgggcctggcacaatgcctgggaaaaaaataggcttttaagaatgtttgaagagatgaattaatgagttcagggaagaaataaggcatgactattgaacattatggacacagctactaaataatctctgaacatgtcttaatgtgtttagctcaatgcatacggtttcctgaaatgaggaaatgcatttcagagagtgaacaaataatttattttctgtattggaagatggcacctaggaagctgggtttgagttccatcctgaaggatagtcaggtcatgtgttaagtgtggtatagagaagggggacaagcattggcttaggggtcctgagtgccagtgcttgctctaccctgaacttctgggaacttagat

SEQ ID NO: 131419 - DNA, 177 bp, Homo sapiens
tactcataatgacagaaatctgtcaaatttctattcctcaaaagagactgaaccctacttaagttgataaatacccttatatgcaatataattttacttgtttaaaaattatcataattattttagatgttttaaatcatggtgttttcaaaatgaggataatttctttgtgtttta

SEQ ID NO: 131420 - DNA, 399 bp, Homo sapiens
tcatgatgaaaacacccagcaaactaagaatagaagaaaacttccacaacatcataaaagccatgtaagaaaaccccacagctaacatcatactcagtgttgaaagacggaaagcttttcctttaagattaagaacaacataaggatatctacccacctttgccactcagcatagtactggaagttctagccaaaacaggcaagaaaaagaaataagagcatctggactgtaaaggaaaaagtaaaataatctgtgttttcagatgatatgatcttactggtaaaaaatccaaaagatttcacaaaaaattaaactgccaaaaataaaataatattaaatttttaaaattttgaaatttattgttgttcagtaaaagacagtacagattgcaatctggg

SEQ ID NO: 131421 - DNA, 165 bp, Homo sapiens
taaacaagaatttcagaagcaagatgtggagattttgcctattagagatttttttcttggtcttattttcttttatatcaagtgatttgactaaaggactgaaagtcctgagtgaggatccagggcccaggcagacatactagggccttgtgggtgacagaaaaa

SEQ ID NO: 131422 - DNA, 394 bp, Homo sapiens
tttaaaacccacaggaaggtgctgccgggagcctgcccttgttagggtgggactgtggccaagctacccttcagcaaggctgggtaggctccacctacccagcaaatgcgggcctctccgctcccatgtgtggataaggccaaggggtattggaaagggagtggtccagggtcctcaaccagcttgcagcttgccggccatattaccttgggcacaccatccccacagctcagggcctggcttcttcagtaaaataataggactggacttgatcatctcttaacagccatcagaaaataatctatgatccaatgaagacataagaagattccattgtatattgggagttagctaaccttaccgtcaacacccccatctgaggtgacactgtgat

SEQ ID NO: 131423 - DNA, 244 bp, Homo sapiens
agacagggtttcaccacgttggccaggatggtcttaatctcttgacctcgtgatccacccgccttggcctcccaaagtgctgggattacaggtgtgagtcaccgcacccagcctcagggtactttcaacatagatgttcaaaaagtatgcacaaggaaggaaggtgcaatctgtgctgatttgagagtactcagcaaggcgtctttctgggcagaccagtgagtactcagtggaagtggagact

SEQ ID NO: 131424 - DNA, 308 bp, Homo sapiens
ctgagaaggccagatgagcctggggaactgagcctcatgacacaaacattattggatacctcctgcatactaatgatagcaagcacatattaggcccctaccgtgtgcggccccttgaggtacacaatctccagttttcccagcaaccctattcccattgtccaggtaggaaaaccaagcctcagagaaggggtcaacttgcatgaggtcacatagctgggacatgcagaggtggggtttgaacccaggccagggctcttccagctgctttctgctgcccttgggggtgtgtcagagcataaggccga

SEQ ID NO: 131425 - DNA, 210 bp, Homo sapiens
tctactttaaatatctgtcaccaaaagatgattttctaataatcctctatgaaacaaaggtttattcagagcaggaattgaaattccatgttgttatgcatcaatataaaattgatttagcatttctggaaagaaaattagcaaaatacatggagttttataactgtggtattctttgaaccagaaattccacttttaagaattaaccct

SEQ ID NO: 131426 - DNA, 649 bp, Homo sapiens
tcgtattaacctctgctatatcagcaactcaaagtacaatatctcatttggcttgattatagtgccaaatgatcatagtgcatgattatggagggggctaggaacagaactgcagaattatccagttttgctcctttttcaatttagaatgccctatcctttcgttcagtttggtgattgtaagtgtgtacctataaaataaaaatagacatgtaaaattggggattggagtctttgggccaaaagcttaatggcagtaactgagaaggcagtaaaagaggagacactgttaccccggttcttttcctttttcctacacgtttaaaaattatttgtgggacagttgagagtggaagtgaggctgagatgggaggggggaagagtaggtgtgagaaggttgcagagtttaggtagggatcagaataagaggcaggatttatgtgttagtgtgttttgatgctattttctgtaaatccctggactgggaatttaatttcatacagtgtttagcatatgggattaatatattgatgaagcagacttatatagctgtccagtattaaattttttcaattttcagctaatcctaaaaatcctactaaatataatttgctagaattaccagtgtaataatttatcctagaactcc

SEQ ID NO: 131427 - DNA, 583 bp, Homo sapiens
agcagtagcaggggaagtacttcatttgggaaaaaaagcatgtaacttggcaactatttagcacctcttcttctctggcagtgatcagttaggaaatcctttgctggaagcatctactcagaattttaaaaatcatgcagttcttgctgctgaaatttatgagcacgtagatgagagagagtatgtatcatggatgaggacggggagagcaggagcaggagtgccccatgagagccacaaacaggaaagttacaggagctggcccgtgtgcaccactgccttgtcccaaccacacagcagtcccagccacacgctttccacatagccctgtggggttaatgacatcactcctgatagtgcccacggcaccattctctatggccatggtgtaaaaatgggtttataatcaaacaaaatatccagatatatggttcaatatgcttcaatttgcaaacatcacttatctaaaaagtttttcaaagaagtaagattaaatatttgatatacaaaatttactgaaaagaacaagattatataaaatcagcttgcccataagactgggtgtacccacatgcaacgaaga

SEQ ID NO: 131428 - DNA, 351 bp, Homo sapiens
tcataatgtgctatgtgaaaacaaggatgaaagattggagctatggggatagtggggtgagggcagggcatgaaacaacaaagaacaaagtatgtgtctgtatatgggtatgaaaacaaaaacaactcgcccaggactgttttttcttaagactctttacaggcatagagataatactagtagcaactacaaagaaaaaccgattagcttggcttatagtaatgagcaatgggaattttttttttttcgtttttttgctaagactgtaaaagcagaacatagtctctgagataaactgacagcagtgcagccgggcatggtggctcacgcctgtaatcccagcactttggg

SEQ ID NO: 131429 - DNA, 754 bp, Homo sapiens
aaggggacagtgccttactcatctttccatctctgggacctaactcagggcctggtacacattatatgttcaataagtactgattagattactgggaaagagttagtaggggagatgggacttgaattttttgaaaatgatattaatggcattaccttttatggcatactggccaggtactcagctaagtttattatttagttgtattaactctcacagcagccctatggctattatgatccctggagtaaacttaggctgaagagagattctatatcttgctggaggatttaaagtctcagggtggttggtgttatttgggggcttttttttggcttttttgttgttgttgttttgagacagggtcttgctctgtcgcccatcctggagtgcagtggcgcaattttggctcactgcaatctccgcctcccgggttcaagcgattctcatactttagcctcgtgagtagctgggactacaggcatgcgccaccacatccggctaatttttatatttttagtagagacggagtttcgccatgttggccagcctgtggtggtttgtttgtttgtttgttttttcttgattttgaaattattttttttcctaaagcagagaagaaggcacaagtgaaggagaaaaggcagacgtgagtgatgatggcagaaagtctgctcaatcacactaatcccatatctaacaagtaaaaataaaatgacagttgacattaaaaaaaccaaccaattcctcccaa

SEQ ID NO: 131430 - DNA, 385 bp, Homo sapiens
tgagatggagtctccccgttgcccaggcttgagtgtggtagcgtgatcttggttcactgcaacctccgcctcctggattcaaccaattctcctgcctcagcctcccaagtagctgggattacaggtgcctgccaccacacccagctaattttcgtatttttaatagagacagggtttcgccatgttggtagtctggtctggaactcctgacctcaggtgatccatccacctcggcctcccaaaatgctcccaaaattataggcctgagccaccacgctcggcttataatgtcaaatcttttttaacatagtaacatgctgttggaaaaaataagttgttgaaagtaagttgttttcccatttaaaaatatctgtgaatattaata

SEQ ID NO: 131431 - DNA, 385 bp, Homo sapiens
cagatttctgtttggagtgaagaaaatgttttgggaatggcggtcatggttgtccagcactgtgaatgtgaaaatataattcaacggcactgaattgaacacttaaaaacaattaaaatggcaaattttatgttacatacagccatgtatccccatcgttaagtgatgcattctgagaaatgtgtcgttaggcgattttgtcattgtgtgaccatcacagagtccatacataagcctagatggtgtggctaccacacactcaggctatgtgcagagcctattgctcccagggcataaacccatacagtatgtgactgtatcaaaaactgtaggcagtggcaacacaatgggaagtgtgtatttaaacatctaaccatagaaaagg

SEQ ID NO: 131432 - DNA, 630 bp, Homo sapiens
cactcagtaaaggaggttggttttgttttttgtgtgttatttttaatttttttcctgtggctgagaatccaatgcagacaaaagattagctctcctagttattcacagcctggctgtgcagtcacgcaaccagatcagacacgttatgtagaatttttcgccgtatacctgtatctgtattctgatacgttacggagaagcagtacagtactgtagttaaaaatgtgggcaaaggctctgaattttcagtgttcaaatgccagttatgccacttactggccgtgtcagtctgggcagtgagcacctatctgtactcagttttgtcatttgtaagatgaggctataataatacctacttcataaagtccttaagagttgatgttttataatgaaccacttagaccagtgcctggcatatcacaagccctcaaacgttcattgttattaacatttttaatgcttctttttgtagttgatgctattgtattgttgacgatgggaagaatgcctattacccaacatacaacacagcattttccaatttcagatgatattttgcagaacactggacaagagaaaaagaatttcccaaggctagagttactccatttaaaaaaaaaaaaaaaaaaa

SEQ ID NO: 131433 - DNA, 674 bp, Homo sapiens
gcttgccgatcaagagagcagcatgggtcctacagttgtgattccttggagcacccccaccctgccgccctaacgttcccttggcctgccacccaatgagccctcatagtgcatgctcagtcggagcggcgccgcaggtggacagagtaatgacgggattgtaggggacatgaccagagcgcataggctgtatgtgtatttcgtgatacgtgtacaggtgagacgcaggtacgggtactggtagatttagcaacatgatgtgcgtcgagaggcatcgtgcatcctcttcacgttgttcaaatgccagttatgccacttactggccgtgtcagtctgggcagtgagcacctatctgtactcagttttgtcatttgtaagatgaggctataataatacctacttcataaagtccttaagagttgatgttttataatgaaccacttagaccagtgcctggcatatcacaagccctcaaacgttcattgttattaacatttttaatgcttctttttgtagttgatgctattgtattgttgacgatgggaagaatgcctattacccaacatacaacacagcattttccaatttcagatgatattttgcagaacactggacaagagaaaaagaatttcccaaggctagagttactccatttaaaaaaaaaaaaaaaaaaa

SEQ ID NO: 131434 - DNA, 1321 bp, Homo sapiens
gctgggattacagtcatgagcatccatgcccagccacaagttctcagttcttaagagacatggtgataattcatgctgaagaggaactttacaaacttgaaagatgtgacagtgcttttaccaccacctccaacttttctgtacataaagatgattatactagtgtgaaaccctagaaataatagaaaatttgacaaatcctttatatggttgcaagacttgattgtaggtaagataattcatactggcaaaactcctacaagtgtgaagaatgtgggaaaactttttaatcagtgcatacaccttatttcacaggaaagctagtatccttgagaaaaattgcacaattataaaaaatatggaaaacccattaatgcctactcacatcttacccaacagaaggtggttcacagttaatgaaagcatttaaagtgcaattatgctcaagaaatctttcagaaaatagaagcctttaaagtgaagaagagtattctgaagacaaccattacacatataaagggggttgtattacctttacttgcatcacagatttcattgcacacatttgtactagaggaaaaccctgaagcagttgctccagcttgttcaacaacagggaatttatgttagagaagaatcctgcaaatgtagtgaatttggaaacaaattttttttcaaaaactacagcttagaaaacaccagagagttgatactaaaatatatgtttgcagaaacagtaaatataaaaaatatttaattcaaaatgaattccatgtaaatatcagagaatttacagtagaataaggcactgatacttcagacattacactaaaacagtgttgagtataaaaaagaatccacaacaaaaattgttagataaattatatatagctttaaaaggttttttgaagcattgtaattacattgaaagtatacttgctttcttgagaaaaaatttttgaaaagtgaataaggtaatagagctttcaaatttatgctgttactttatttctattcacatgtgaaagcatgtgatcaattgatgctgcatcagagatattacagattctttattgggcattccttataaccttttctattaaagagaaaggatattaaaatgtaagatgcatgatgaaaatataagtggacaggctgttcgtatttgacctatattaagtaatgtataaggtagtgttcagagtaatacttttctacattatagtgagagaaattatgaattacagttaaaggtatattaaattactgtattattttactaattttatgtaataaaatacactacattaaaaaattgtta

SEQ ID NO: 131435 - DNA, 383 bp, Homo sapiens
tcagggtctgagacatagtcctgcaggttgctcctgacggacatgcccccaggccagccaaacaggcaagaacccatatcctggaccagagaaacagtcccataagccacccaggttgacatgccccaggctgccaagcagccctgtatccacatatcaggcctcagaaacagcccacaggctgtccccagtgagcacgtccctgagtcagccaagcagacttgcacttgtgttccagatttgagaaacggctctgtgggccacccacccagtaaacatgcccccagatcacccacacccaagcagctgtgcacccacatccctggtgcatagctctgagaaacaccaggcctgagaaacagctctgtaggctgctactcata

SEQ ID NO: 131436 - DNA, 636 bp, Homo sapiens
gaaaaaagggtcagggaacaagagagagacggagagagagctgggaaagagggtggggaagaagcaaagagacagataaagtgtacacacagtggggagggatccacttgcaaaccaaatctagccagaattctttgctccatgaaaccttgtctttggatattttccatcatggggagaactccttattctccctctgctttaggggtctcccactggaatctgattcatagataaatttggtaagttgcaggcatcacaactccatcttctgagaagcagggagaagctgagagagggaaagaaggggaaaaaaagcctacaaaaccagcaagtttcccactttacagagtgagcctagacagaacttgaattttcttcccttgagagttaggaggaaagctggtagctgtgtcacactcctgagttgtgtacacgactcacaagccaaattttctagcacagcagaacaattttgtttgctgctggatatataaagcaaggaaaaaaaaaagatggcattccacctttttgaattagcaccaagtctttcaaactccaccctttccaggaaatgttctttaatgcagtgggaggtggtaattttactctctccaaaccctcattttacttccc

SEQ ID NO: 131437 - DNA, 457 bp, Homo sapiens
aatgaaacactgtggtgagatgaactcttcccttaaacggagcagactggatagggagatgctactgctgaagggtgattactcagagtgagctcatgaggtctccatgttattttctgaaaaccaggattttctttccctttcatgctgccttcctccaatgtttttattcctggatgatcctgcatgattgtaactgatattatcagctacgaatggtcccctcagccctgggaataagcaggaggtaaaagacataattccagttatagggtgcttatacttgagttagagaagagcttgaacgacttattttctatcctcttagggagttcatttccaagatacagacagtatattttggtcgtgtgttgtaggatcagatgcttccttggttctctcaatgaatcttctgtttgtttttgtgaaatagttggcaggaaatctcagcttcttt

SEQ ID NO: 131438 - DNA, 496 bp, Homo sapiens
aaaaatagccatcttcagtcctttgcctgtactgttttttccttctgaaacatttacaaagcaactgtcagacaatgttgccaaggctaaccatgcacagaaaaaaataagacacgtcaatttgactttttagaaaaagagaattttccagctgacaaccgaatctcaaagttggccaatccaagtgaaaagtgcttggaagtgttctgtttaaggttgggtgaagcctctgttcatatccttgaatatttaatttggcttttctgttactaaggaaacatggcatgatgagtgaatatgcacattacttccatttgggtggtgactaagaaaaccatcctcccttagatacagggccttactgtagtcattatccatgtactgaccacaaacaaacttggccatcttggcctccttttcaaggattaggttcaactatagaatgaatgaataggaaggctttaaacatagcttgtgaaaggaattggggaaacct

SEQ ID NO: 131439 - DNA, 418 bp, Homo sapiens
tgtataacatcctgctgagatataaagtgaagagagaggacactatggatttggtggcataagcgttcttggtgactagagatatagggggaatagaagtcttgttggaatgagttgtgggaagaataagaaagagtctactaagaaaaatggggactgagaatgggatgttaactggagggaatgtctgaattcaggctgctagaataagctaccatagatggtggcttataaacagtagaaactgatttatcatagttttggagtctgaaagtccaacatcaggatgctggcatggtccagttctggtgagggccctgcagactgtgggtttcttttgtatcttcaactgctgttactagggtgagagagatctctggggtctttttctttataagggcactaatctgatgcataa

SEQ ID NO: 131440 - DNA, 353 bp, Homo sapiens
tgtgatacggcattggagtgcacacgttactcatccttttatttaaaaagtcaccctaccatctgaacaccagtcagctggaggagttggcccctagggttctggactataaggtgctgatcttgggtgatgaccaagtcaaaagacttatgtaataaattccaaaggatagacccatagcaggaacatttgaaggagaacaggcattatttcaggtgaagaccgtagccggtgtgcagaggggtgccctgagaacaatcagtaaaagctgacaagtgcctttgttcttgagggataagcttctagaaaccacaagctaaacaagatgccaagatacgtgtgcactctcaatg

SEQ ID NO: 131441 - DNA, 233 bp, Homo sapiens
ttcattgcttccagaagagtcattgcatatgtcaggtttgggtcagggtgctgcctccaaagtcttccaggggaacacagtttattgcagaattggctggggcccccagctcatcacacagaacttttctcacataaggtcccataactaaaaatagatacacagcaatattaaatatttgcagaaccttctccccagagtattttgttctgaatagtacaggaaacaccatt

SEQ ID NO: 131442 - DNA, 359 bp, Homo sapiens
gtaactgggattacaggcatgcgccaccacacacaactaatatttgtatttcagtagagatgggggtttcaccatgttggccaggttggtcttgaactcctgacctaagatgatccacccacctcggcctcccaacgtgttgggattacaggggtgagccacggcatgtggccaggatatgcatgttttatttagagatatagatatccctatgtacagtatatataccactttggtggtaagattgataaaaaatttgaatgacttataaaatgtgattatggaatttagagaatctcttgaacacaggaggcagaggttgcagtgagcggagatcgcgcctctgcactccagcctgg

SEQ ID NO: 131443 - DNA, 792 bp, Homo sapiens
gaataaattttacaaaagaagtgcaaaacttatattctcatttataatgctgaaagaaatgttaacagacctaaataactgggaagatatatcacgttcatggactgaaggactcaatattttaagaagacaatactttccaaattgatctacagattcattactatccctatcaaaatcttagctcacatttttgcagaaattgatgaaccaactctaaaatttgtatgggaattgaaagaatccataatagtcaaaacagtcttgaaagacaaaaaagttggagtactcacactttgcaatttcaaacgtgctacaaagctacaatcatcaagacattatgaaactggcataaaatttgacatatagatgaatggaataaaagtgagagccaaaaatatagcctcccatttatgacttactgactttcaacatggacgtcaaaagcaatttaatggaggaagaatattcttttcaacaaatgatgctgggacaactgagtatcaacctgcaaaagaatgaagttggacttctagctcacaccatataaaaaaatcaacttaaaattgatcaaagactctaatgtcacagctaaaactagaaaacccttagaagaaaatataggcataaatctttgtgacctgttgttaggcaatgatttcttagatatgacaccaaacacacaaggaataaaacaaacaaatagataaattagatttattcaaataaaaaacctttgtgcttcaaaggacaataccaagaaagtgaagagaaacagaaagaaagaaaata

SEQ ID NO: 131444 - DNA, 1156 bp, Homo sapiens
ggaggctgaggcatgagaatcacttgaaccttggaggcagagcttgcagtgagccgagatcgcgccactgcactcagcctgggtgacagagcgagactctgtctcaaaaaaaaaaaagaaaataattttgtagctctcttggtggctaaaaataagactttgaggtacgggtctgtgatgacactataaataattttaagtgtaaataatagaatcgccaaattttatgtgcaaatcacaattgacattattatgcaaagttttaggaaaatagaaacaggagtaacctcctctctcagactcccttacaccagccaggtgactcccccctcatttttcttttattgtggtaaaaaatatatatattataaaatgtattttcttaagtgtacagtgtaaggatggggctagtggcgtgtggttaggtccttctgagtgttacttgtttactgtgtgatagttattttagtaacattaccattgtttgtactgtgttttctaagagcctaatgacagatttcacaggcagattggaaagatgctgcctgtcttacttcttcgtgtgtagggtattagatgctgctgttgatgaaatgtttcctatttgggctatagcatgctccctcctttatatttaatgcctaagaagttatctgcaataaatgacagattcataattatttgaaaaggaatagcctagtgtatctctttaaggagattacaaaatggtttttgtgctttatcttcttagagtttgttaataacatgtaatgaaaatgtgatgtattttatcactaaagcagtcataataattctggggaaaggagtgttattggaaaagagttttggctgggtgtgctagctcatgcctgtaattccagcactttaggaggctgaggcaggcagattgcttgagcctaggagtttgagaccagcctgggcaatatagcaagacccccatctctacaacacgaagaagtaagacaggcagcatctttccaatctgcctgtgaaatctatcattaggctcttagaaaacacagtacaaacaatggtaatgttactaaaataactatcacacagtaaacaagtaacactcagaaggacctaaacacacgccaatcggctttcctccttacactgtacacttaagggg

SEQ ID NO: 131445 - DNA, 412 bp, Homo sapiens
agacaggttatactgcatctcagcggggaaactggtgcctcccttcatcccaggatacctaatttaggacagcaaaactaattccagaccatgcctgctggggaagaggaggctcctcttaccctccagctcagccagggctgcaccagggcagttggggaggctgaacatacaggagcttaggggaccagcaaactgctaatgagctgctctctgcaggtcaactgtaaaattgtacattttggtcaaagaataatggcaggaattgaatttcaaaacacatattcaacaatatatcccaaaatcaactgagggcaagtgtcccactgggaaactaatgcatatgtcctgaaattatctgtatatttttacctcttgtcattagacaaaaaggaataatatccttattgca

SEQ ID NO: 131446 - DNA, 356 bp, Homo sapiens
caacagggggaaaccccatctctattaaaatacaaaaattagtggggcgtggtggtgcacatctgtaatcccagctactcaggaggctgaggcaggagaatcacttgaatccaggaagcagaggttgcagcgagctgagattgcaccagcctgggcaacaaagcaagactccgtctctaaataaataaataagaaatatttggcacctggaaaagccaagaaaaaaaaaagaagaagaaataatgggagctgccactgacacaaatcagagcctagtattttaggctctgatggaatggacaacaatctaaagataggaagaaggctgaaggggacagatggaacatgtgtgcatc

SEQ ID NO: 131447 - DNA, 569 bp, Homo sapiens
gaggtgttcaatgttgatcgatccaaggtcgtgcacatagggtctaagacggaagagaacttcctgcccctcttggagcttctattttagagggagacacggccagacaggtctcgaactcctggcctcaagtgatccgcacaccttggcctcccaaaatgctgggattccaggcgtgagccaccgcgcctggcctgtcctagggagaatgagcctgatgactttaccattttccacctctaagagccaatcgcaaaggaggctggctggcatcttgtgtctgtctagcatctctaccagtttctgtagaaaaccctcaagctgtgccaagacgatcatgtctggacacagctcttggtgtcacggggtgtctcctcctactgcctatcgccctttgcagccaccagaataatcatgcaggagccagggccccatattatctaccgctgtccatctgctctccagcacatcagagcagcccttcccctgtgtgagattcctctccagggcaagacttgaagggagcatcaaggttgcagtggaagaaataaattggaagtggagctgga

SEQ ID NO: 131448 - DNA, 346 bp, Homo sapiens
gaggtgttcaatgttgatcgatccaaggtcgtgcacatagggtctaagacggaagagaacttcctgcccctcttggagcttctattttagagggagacacggccagacaggtctcgaactcctggcctcaagtgatccgcacaccttggcctcccaaaatgctgggattccaggcgtgagccaccgcgcctggcctggagccagggccccatattatctaccgctgtccatctgctctccagcacatcagagcagcccttcccctgtgtgagattcctctccagggcaagacttgaagggagcatcaaggttgcagtggaagaaataaattggaagtggagctgga

SEQ ID NO: 131449 - DNA, 235 bp, Homo sapiens
ttctcttccacagggtacactcttcctttggtgaactcattcagactatggctctaatacaggatatatgctgacagacttccaaatttatacctcaaatctagacttctttcctaaacttaaaaaatgcctatttggcatggatgtataatcagtgacataaactggagtatctaacaaaaatagcaaatttgacatatctaaaacctaattccaaatctccccttgaaaagtt

SEQ ID NO: 131450 - DNA, 715 bp, Homo sapiens
cagtgttggtccttcggtggctcattttcctgagcatagcgtcctcaagattcatccgtgctgtggcctgtctcagaattgccttcctttttcaggctggataatgccccgttggatggaggggccacactttgcttatccgtccatccctcggggggcacttgagtggcatccacatgttggccatggtgaacagtgctgctgtgaacatgggtgtgaagtaatctcttgaacaccctgcttccggttctttggggtatacacccagaaactgaattgctaaccacataagaattccatatttaggccgggcgtggtggctcacgcctgtaatcccagcactttgagaggccaaggcgggcggatcacgaggtcaggagatcgagaccatcctggctaacacggtgaaataacacagtgaaaccctgtctctactaaaaatacaaaaaattatccaggtgtggtggcgggcgcctgtagtcctagctactcgggaggctgaggcaggagaatggcgtgaacctgtgggcagagcttacagtgagccaagatcgcgccattgcactccagcctgggtgacagagctcaaaaaaaaacaacgaaagacggacggaaggaaagacggacgaaccgaccgaagaaccgagagagacgaacgaccgacaccgacgaacgagacacgactgacgcacacacatgacacaacaaacaaaac

SEQ ID NO: 131451 - DNA, 374 bp, Homo sapiens
cccccacaccatcccatagaaatactgttcactatatctggttcaggaggactgactctcccaactcctttctccaggagtggatacatgatccaggactggccagaattctacatcaagcagcccgtaggcacggaggagaatacaaattagaggatcagccagcaaacttgatgggtgatgagaactgttcaagacaaccctgaagatgttgcttatttgataaggttgctggtgctgctgctactgaagatagaacaacagttaagctttctgtgtatgtgtgtgttttccatctgtttttctttgtaatcagtcggtataaaagtgagcagtgaagaatcggggggaaataaatgtactttttaaacatg

SEQ ID NO: 131452 - DNA, 288 bp, Homo sapiens
cctgcctcagtcttccaaattgctgggattacagcagcccgtaggcacggaggagaatacaaattagaggatcagccagcaaacttgatgggtgatgagaactgttcaagacaaccctgaagatgttgcttatttgataaggttgctggtgctgctgctactgaagatagaacaacagttaagctttctgtgtatgtgtgtgttttccatctgtttttctttgtaatcagtcggtataaaagtgagcagtgaagaatcggggggaaataaatgtactttttaaacatg

SEQ ID NO: 131453 - DNA, 375 bp, Homo sapiens
tctccctactgtatcctaggctggaatgcaggggcgtgatctcggttcactacaacctccacctcccagcttcaagcggttcttctgtcccagctacttggaaggctgagctgggaggagcacttcagccttgaagttcaaggttgcagtgagctgtgattgcacctgggagaaagaccttgtctctctaaaaaaaaaaaaaaaaaagttactagaacagagaattaactgcaggcagagttaagaaatgaaaataaaaggttgtaatgttatattacattaaagtgatgtactctggacaaaagaagagatgtaacgagcaagctttcggattctgcccttttcagaaagtaatccccaagtctaaagcaaggg

SEQ ID NO: 131454 - DNA, 453 bp, Homo sapiens
gcagaagtttgcaagctcactgaccttcaaacaagggttatggttatgagggttatctgaccaagtgttcattggataagaaacacataaggtttcctagtgaagataagtgaagacattttaacacccacagacacaacctaacccaaattaacactgtccattcctttgtcacattcaccactgtccctggctagcacaggctctagttatgattttattaacattaccttaaaactataaggtgtccaacattatttctgaggccacctcttgcctgctcagaaaacaccaagggaaaaaacaaccaataattctccccctttttccaacatacgttgacctgttttagttccttattcaagataccctcaaccacagtattggtttatgtatacatttgtccttcataagccaactgtggagcatataccaggagcaatcatgaacagg

SEQ ID NO: 131455 - DNA, 689 bp, Homo sapiens
gaaaggattttttgttttttacccttgagtcaccagtaagcaccgggcctcctgtcttttcctgattgcctagatagaattcgtaatttctgaccttggccccacagcctggtattgtttcaggtcccttttggtcctcttgcagaagaggatttgatatctgggggcatggccttgactgcttctgggagagtggcccaggtgtccaggagaacctgttttcttgcaaatgcccataattgtgatggcgtggatggaacagacctcttaggcgtgtgagctgtgaggctctggtggttgtgggacaggctggcagccaaaatggtatgagggagcttttctttattagatctcattgtgagaataaaaaaatgagatggaatgaccttcaacctgtcagtgtgctcccattcattcataaagaaaaactgttcagatagcactgggacccatccatgtctttttatatatggatatatagatctagatctagatatatccagatagatagatagatgatagatagatagatacctggccaggtgcagtggctcacacctgtaatcctagctaaactgagaggctgaggcagaagaattgcttgaacctgggaggcagaggttgcagtgagccaagatagcaccactacactccagactgggtgatagagtgagactctgtctccgaga

SEQ ID NO: 131456 - DNA, 342 bp, Homo sapiens
aaaatacatggagatgtgtgaactatgcatgcctctgtgtttatgactcgaagataagctgtggtgagggaaagtctatattagtattcaaggccacagaaaccagtctcttttacaaattaccgtgtaattaaacagaaggcacatgagatgtattttaagcacatcccctttcttattcttagtattccactcaacgtccaaacccttattaatatctctggccaaaaccacaacttaaaaactgcaaactcattgtactatcaaggaatattttctaattgtgccttaaaaccaactgtcagacaagctgagttcccatcatgaataatggtatacaga

SEQ ID NO: 131457 - DNA, 917 bp, Homo sapiens
agtggtgggagctaagtctgaagaggtagagaggaccagttgttgagggccttgtgttccaaataagctagagcttgggctttatgtgaaagatttactggtaagataactgttttgatgtacctacgtgactggtgatggggaaactagcccaaaggctgctgttctgccctgctccccagtgagggaaaacaacaacacacacaacacaaaaaaaaaaaaaatttgtggggggccggggcccgagaaaaatttttaaacccttccggttggggggggggccccctggtttgggaacctgggcccaagggggtcccaaaggagaagcccgtgggccacagacttatgggtggggttttcttcaccaatataaaaaaacggcgccgggcggaaaacccggcgtctgttctggagaccaaatctccaagatgggggtttccggggcgcccaaagccggggctctttaccaaccaggggggggcccacggcgagcgctccgtttatccaatacggcctctcggggagggaaacacgagatgagcataccagacagccaacagaagacaacgtcaagagagacacgcgacaacagactagccgagaatagccaaccaacgaagagatggatgaacgttaagaagtgaaaagacccggcagcaagaaacccgaacaggagacacacaaagcacgaagcgagcatatgccacataaagaagcgataacgaacagacaactgagaacaagaaaagcggaaagaaacatgatcaaacgcgctgaagaaagacaacagaagacagagcaagaaaacgagaacgaacaacaaaataaagaaaagacaacgacaaaaaagtcaaaaacgagaaacagcgacagaagaaagaacaaaaaaaaacaaaaaacgaaggaaaagagacagt

SEQ ID NO: 131458 - DNA, 385 bp, Homo sapiens
tcagatatacttaccttcatgcctccttcagccacaaatcaccagttaccagctgtgtaattttggactgacttagctcctttaaacctcgcatgcaccatctggaaaatcagataataataatgatactcacttgctagggttatagtcaggattagctgtaataatatttgcttggtacacccagttaaaacgtaataaactcaaaacttttttttgtatgactagacatacctgtgttttttgacaattactagtaactgaaggttggagggattgcctcattaattccttcattcaacaggtatttatttatagagtactatgttggcattggcgatgcaaattggatgagatggttgctgtcttcaagaaattcaaaact

SEQ ID NO: 131459 - DNA, 372 bp, Homo sapiens
tagaatactgtagcatctcttctcctgaggaatccctttactttatccattcttttctatttatttatttatttgagacaggttcttactttgtcacgcaggccggagtgcagtggtgcgatcttggctcactgcaacttccgcttcctgggttcatgtgatcctcccatgccactgtgctcgggtaatttttgtattttatttgtttgtttgtttgttttgagacagagtctcattctgtcactaggctgcagtgcagtggcgcaatctcggctcactgcaacctccgactccctggttcaagtgattctcctgcctcagcctcccgatcccgagtagctggggattacaggcacgcaccaccacgcccag

SEQ ID NO: 131460 - DNA, 494 bp, Homo sapiens
aaaacatttggttaggatacttatagtaagccttttgtgatctagaaattagaacatgagctgtaacaagtaattgaagaaatacatatgcagcttcttaaagcataaaaagattcaattaatacatcaaatagcactgtggcttttatgagctatcacagcaattattttcagaaaattatcttaaaacagcatattcaagtggataaaacatttgtgaaagggcctgcaagggaaaccactattaaggttttataagcaaagagctgtgttttttgtctgcattggacaatgagctctttgggatacttaggcatttctaaatctcttttcataacgaatctaaatgtatccattttatactaaattctactcttccacactgcagaaaactttttatactgagtttccaatctaaacttttaagctagggaaggaatctaaacctttttcggtggtgacggggggaggcaggggaataagcatttagaata

SEQ ID NO: 131461 - DNA, 591 bp, Homo sapiens
aattcaaggcctcgtctgtctggttccagagccccgctcccccaacctctaagtgcagacagcacgctgcattggtagttcacttctgacagcaccccacaggctggtattgttagcccattttacagatgaggagtgtgaagtccggagaagtcaagtaacttgccaaggccacacagcaaattagagccaaggtctgtctctctaaagctgagcctgtttcacatctgtccaatggctggtggaaggaaggtcacgtgaaccgtcctgcacactaccgcatgcaaagcattcccacagtgctcttgagggagtggtctggctgctcctcctagaagcaggaaagccaagactcccatgaggctaaagccatgggctccagcagatccagcaactagggagaggctggatttgcaggggggctgtgtatgcatccaaaactgctgctctctgctgtggtgggaatgtttgtctcccctcagaattcatgttgaaatcccaaccccaaaggtgatggtgttgggaggtggggcctttgggaggtgataggtcatgggggcagaggcctcatgaatggggttagaggcctta

SEQ ID NO: 131462 - DNA, 346 bp, Homo sapiens
gtgtttctttttatcggcatgaggagaggggggcgggttgagctggggctggtggtgctggagatactggggctgaagcatatggagtcacccagcccggtgtccatgtccttggataggccattgcttttagagctggagatgggtgcacaggctgatgtggctagggatggccactttcctgggactttgatggtagatgtccgaaggtcaatctcttctttatgaatattcttcatataatcacctaagcttgaataataggtgagcacgccattggaacacagggtgacgtatttctttttccatgtcttcagccatttcccacttcgctttaagagcatgc

SEQ ID NO: 131463 - DNA, 499 bp, Homo sapiens
cactggactctagcctaggtgacaaagagaaaccttgtctcaaaaaaaaaaaaaaaaaaaaaaaattaacacacagtaaaagtttattgcaaaaccaaatagactcattctgcaaaaccacttagaaagttaactgtaattgaatcatgtcctctcagtttatcaatgagcaacagatatagtaagcagctcaattacatcattctatactctggagctaagtgataccgcttttaatctagtgtttactacaagaaaatgactgtcattattctgaactcctaaactaacatctagttaggacactacagaaactcctagaggcaaaggagcagccctgtcttagctgggcagattaaggacactcttttgactaattggatttaacaatccattaccatctttcaaaaggacaaaaggggtgcattttgtgttttaatctctttgataaagatacagcatttggggccgggcgcggaggctcacgcctgtaatccca

SEQ ID NO: 131464 - DNA, 597 bp, Homo sapiens
gagtcatgtcatcccacaagcacctgtcatgcactcctcacagagttcatgggcttctccctctttagtccgttgttaaacaaagtccgcattagtaattcagcccagctctgttgtgggacaaacaacctggagtgtagcaaggtgctgcatatttgcaggacagtatgaaagcgttctggagatggatgggggacatggctgtacaatgtgggggatgcacttaataccactgaatttttcctttgaaaatggctaaaataatagattttgtatgtattttaccacagtaaaaaatcaagctggccgggcatggtggcttacacctgtaatcccagcactttgggaggccaaggcgggtagatcatttgaggtcaggagttcaagaccagcctggccaacatggagaaaccccatctctactaaaaatgcaaaaattagccaggcgtggcggtacatgtctgtaatcccagctactcgggaggctgaggcaggagaattgcttgaacccgggaggcggaggttgcagtgagctgagattgctccactgccttccaacctggacgatggaacgagactgcatctccaaaaaaaaaa

SEQ ID NO: 131465 - DNA, 370 bp, Homo sapiens
tccaccagggcacaatgtctagcacttagaagcttaaaaaaagattgttgagatactaaatgaatagattaaccaaaagtttaatttttctagcagtgttcatgggtgggaacaaagcagtaaaacaaacacatacaaaaataaatggaggtcaaggacctataatactaaatgagctagcaccatttcatctggctgtgctacttcctagctatgcaacctgagacaaatcacatatactctctgatcttctatttcattatctgtgaagtggacacaaaaataatacctacctcttagcactgtttataaaaccaaataaaagtaagtaaagtgcttagcagagtgtgtaaaacacaaatttgtgctc

SEQ ID NO: 131466 - DNA, 137 bp, Homo sapiens
ttttcagccaagtatttgagacagttatatgaacaatgattcacatgttcataaacatattgccgcggaagataagtgggcttttgttttcttccatgacattctggtccaatgcttccttatcggctaccgatcac

SEQ ID NO: 131467 - DNA, 269 bp, Homo sapiens
ctccccatgcgtacagcacaccacagccaccatttagagaaaagccccatttcttgctgctatgggcccttgaccccctgttccccaacaagcagagcctctagctcaggcaagcagtgcagctgcttcaccctctggctgaacactcccagtagcagcagctccacatttctcagagatggagctcccaggggcaaccaaaagtccctctgccactgcctctccagtttaacttccctgtttacccttgaactagggaaggagcaaag

SEQ ID NO: 131468 - DNA, 376 bp, Homo sapiens
aaaaaaaccccaatacatggggatctccattgcccatcccctcctctaaggtaattatctgtaggccatcgccatatctcttctttgttttagaaagacatcttttgttatcattcatgttaatattattgaaagcaaataaaatggaattttacattcttttcttcacatgccatctattttgatgggcagttttatcatacttggaattccatcatttctcggatcctttacttttttgttgttgttgctgtttttgaggcagtgtcttgctctgttgcacaggctggagtgcagtggtgcgatcttggctcactacaacctccacctcttgggcccaaacaatcttgccacctcagcctcccaagtagctggg

SEQ ID NO: 131469 - DNA, 494 bp, Homo sapiens
tccaacaaagggttttaatgtagattttttttttgcaccccatgctgttgattgctaaatgtaacagtctgatcgtgacactgaataaatgtctttttttaaaatgtgctgtgtaaagttagtctactctgaagccatcttggtaaatttccccaaaagtgtgaagttagaattccttcagggtgataccaggttctatttggaatttatatacaacctgctagggtggcgaagccactgtctttggaaaccttggtgtagttgaactgatagttactgttgtgacctgaagttcaccattaaaagggattacccaagcaaaatcatggaattattggttataaaagtgattgttggcacatcctatgcaatatatctaaattgaataatggtaccagataaaattatagatgggaatgaagcttgtgcatcatccattatcatgtgtaatcaataaacgatttaattctcttgaaaaaaataaaaataaaaat

SEQ ID NO: 131470 - DNA, 271 bp, Homo sapiens
attaccacttcactgttatgacagtgaggcctggagacattaaatgttttgcccaaagttaccaacatgttgttggcagaaaaatctggaacatatggcctcatctattgtctaaattttttctactagtgcacagtgccttttcaattgctttttatttgataatagtgacaatcataaataggggatttaatcaatactcttttaaaaaaaaaagtcacagaaagaaagcaattgtattgaaaacccctttctagtttttccagtaggt

SEQ ID NO: 131471 - DNA, 748 bp, Homo sapiens
gggaagcaggcgcaggctccgtgaggaggcaagaggaaaggccaagaactgacaaattaataaagggccatctacaagccaggaataaggccatcaccagaagacaaccccgccagtccttgatctgggacttccacatttcaaaactgaaaaaagataaatttctgttgtttcagctactcagtcaatggcattttgttatggcagcctaagctaagacataacctcagcctgctggcctgccttcactgtcctgggggaggcatggagagaccaggtggactggagtagactgttgagagacactggtctggtgaagatgtccaggaaaccacgagcctccagcccattgtccaacaaccacccaccaacaccaaagaggttgccaagacaacccggaagggaacagggacccgtcaaggaagttccaggaacaaaaggctctccctaaaagaccgccgcttcaaaaaaacctgaggaatggagtgggccaacactatccagccactccgaccagccaaaagaactcaatcaaaatgagacacagtaggaccacaagggcaaggagaccaccaccttctccagtctctctttgggcagccagtaattcccgggcaaggccagaaacctcaaggctacctgaaaagtctccagaggtctaaccccagaaaaatagccaacagggtgtagagtacattttacaccccaaagggtataccccatggtgacgaaaataaaatgaacatgt

SEQ ID NO: 131472 - DNA, 773 bp, Homo sapiens
ataaacatctttttgtaacctatattgaatcccagaggtcctgactcaggtttcagacaagctcaaaatacaggcacttacaacacaggtgctaacaacaatttgtcctaatcagttcagggccaaagttcagttccttcttctctggccaataggatgttttaattatgaaacgcagacatctcagcactttgggaagccgagactggcagatcgcttgagcccaggagtttgagatcagcctgggcaacgtggcgaaaccccgtttctacaaataatgcaaaattagccaggtaatgtggtggcgtgcccctgtagtcccagctatttgggaggctgaggtaggaggattgcttgagcctgggaggttgaggttgcagtgagccatgactgtgtcactgcagtgaagcctgggcgacagataacctgtctcttaacaaaggaaaaaacaacaaaaaaaaaaaagaaaaaaaacacatgtgtgtcggcggcacaccggggcctatggaaaaaggtttcttaaaaccaactcggtgggcgcgcgcgggccccatggtgggtaaggtgaacaggcggccgaaagcggtgtcccaggagaaacaccgggcccacacacaagagcgctgggatctctctccacccaatagaaaaaagcccgcggggacaacacggaaggcgttcgcgacaacaactcccaaagagaatttccgagagagacacacagcggggtcgtaccaacggggagtccaagagaagctccaaaatcacaatgc

SEQ ID NO: 131473 - DNA, 332 bp, Homo sapiens
gtggcattctcatttccagagtctcctagatttctagctagtctgctacttgagatctcaggctagtaagctgtgggtttctttctcaagaaacggctttctcaagccgtttatttctcaagaactttgccacttttagctgataaaaaagtacacttcttgaggccgggtgcggtggctcacgcctgtaatcccagcactttgggaggctgaggagggcggatcacaaggtcaggagtttgagaccagcctgaccaaaatggtgaaaccccgtctctactaaaaattgaaaaattagccaggtatggtggcaggcgcctgtagtcccagct

SEQ ID NO: 131474 - DNA, 775 bp, Homo sapiens
ggataagtttctcaactttacagtatgagaagaaatctcaacagatgtgactacctaaaaataaaggataatgtacttttaaaatgaccttaaatttaaaaaccaaacatcagctttgtgcagtggcagtgtcgtaaccagagagattttcccaagatactgttatggctaataagaaccttgctagttcaactgtgttcaactcgttgaatttcagtgagataaggcaaatatacaaaggtgaattgggcaggattgttcaataaagaattgattattgattataataatgaaaaatcagaaactaaacatccacaattggagggttgattaaatacattttgataaagctctataatggaatatcaggcagtcactaaaaataataaggtaatgaatatttattgagaatgaaagatccaatttattgctgagtgagaaattagattagagaacaacattaaaagtagttaactctgggccgggcgcagaggctcacacctgtaatcccagcactttgggaggctgaggcagttggatcatttgaggtcaggagtttgagaccagtctgaccaatatggtgaaaccccgtctctactaaaaatacgaaagtgagcttggcggtagtggtgcacacctgtaatcccagctactccagagactgaggcaggaaaatctcttgagcctgggaggtggaggttgtggtgagtcgagatcatgccactgcactccagcctgggcgacatggcaagactccatctcaaaaaaaaaaaaa

SEQ ID NO: 131475 - DNA, 248 bp, Homo sapiens
atccaaattggtctcatcttctaatccactactaccaagcttagttggtatgatctgcagccctttctctcccccacaattaactcctcccaagcctcatgctagctgcttccttgctcgactaacagtcaattaccagcagttcccagactttggggaaagggatagatctgaatatcccataccactacctggatcaaagcttctccctcattcccttttatttcatttatttatttatttatttt

SEQ ID NO: 131476 - DNA, 294 bp, Homo sapiens
attccaagagataagcgtaggccaggttattggtgacctccccagtgaggccggttgctctcctgtaggtagggaataccgaacctgagaaagatcctcaagccccagatgtcactgctggaaggccttagagatcatttgaatgtcactagaattttggatccctgagggcagggcctttgttttgttccctattgtaactccagagcccagagtagagtctggcacatagtatatgctaaataagcatttgctgggtaaatgaaaagctctagctcaatccccacttaattt

SEQ ID NO: 131477 - DNA, 378 bp, Homo sapiens
gaagtccacaggtatgtaacatatacaaagccacgaattttcacccaaactgaatgcaggttgttgagatcagtgctgaggtcatagtcctgaagccattagagtccattccacattagtgttgcctggattagcaatatttctcctgggtaatagggttataggtcagacaaaagatgcttcaaaggatatagtaagcctatggttgtattttccttattcattaactgtggatattaataggattactatatgccctgaaataagaaattggcaatacaaactaaagcaattagataatataattgtactatgtttttaagttcctcactactgaaagcagtccctaaataaagcaagtcttgattagttatctgg

SEQ ID NO: 131478 - DNA, 1082 bp, Homo sapiens
tgcaaaaagtgaaaagtctttttttgtgaagacttcatcactctatatcaaagacttaactgcttttaagctagtttgcaatcaggtgacaaatacagtactaatcataaggcaattctggaacaaaaacctattgctttgaaagctcaaaagagaagtttacatcttttaaatgaaataatgaattaaatagtgcaaattatttgcccccttttggctgggtgcagtggctcatgcctgtaatcgcagcacttcgggaggccgaggcatgtggatcacctgaggtcaggagtttgagatcagtctggccaacatggtgaaaccccatctctactaaaaatacaaaaattacctgggtgtggtggcacatggctgtagtcccagctactcgggaggctgaggcaggagaattgcttgaacctgggaggcggtggttacagtgagccaagatagcgccattgcactctagcctggacgacagagcgagactccatctcaagaagaaaaaaaaaattatttgccccctttcaacaaatatttagtgctaaaataaaaaaaaaatcaacaggagtggaaataacttcgtatggttactcaaagatagccactaaatttctcttaatatgtaaatgtatagttctctaagatttatttccttcttaaagtcttacccaatttagcttcatcattttatttctctatctttatagatagttttgcacttttaatcattgtttagatttctttatgtatagatttacatattgttcatatttatgtatccttttgctaaactgtgacattctcagcattataaaactcgtttggtgtgtttttatgggtgcatttcagcagtactgccatgtaagtctttttgaaatattagtcttttgttttatgagagtgatcaaatatattgtgaaaaataccatttttttcttagaatatatcagcatctgtttctgttgtatatagaatacaagttttatccttaatataaaagcaatacaagctttatccttaatataaaagcaatatttatttttcctgtttaattcaactcccttttattaaaaacaaaa

SEQ ID NO: 131479 - DNA, 253 bp, Homo sapiens
aaaaaaaaaccaaacttttgtccccaggagaatagtttgactggtttcctcatttctctttcaaatatatatttaagagatcttttatttcagcataacaataattatttgcaggagtttttgtgttagcgactaatttagaacttgtagatttgagctgcctgaattggccagacagctgtaatcgcactcctctattcttaatctctttatctgggcagcagctgccatatggccacagtcagctggatca

SEQ ID NO: 131480 - DNA, 790 bp, Homo sapiens
tatgaatgtatttctaatatgtgtaggtgttaaaaggtggagataaaaactttaagccagggcagaaagtagatagagaataataaatatgccatgatgtaatgaatcctttctgccaaaagccactcatctgagatggctgaaggatcagaaatccatttgccttgatcaattacaggagcaaaattctgacacagcctatttctctctctctttttttttttaagggacggggtcttgctctgttgccctgggtggagtgcagtggtatgatcatagctcagtgccgccttgtactcctgggcccaggcgatcttcttgcctcaacctccccagtaatatgatgacagatgcttactacagtgcctggctatttttttttttttaattcttaattcagacggggatctcactatattgcccatgcttgaggccagcagttcaagacaccgctggggtgactagtgagaccttgtctctcccaaattaaccagtctgggtgtgtggcgccccttgtgttctagcactgggaggcggggggaaaaggatcccttgagcccaggagttcaagttaggggggctatgattggacctctgcatcccagtctgaggaaaagccagaccctctttattaaaagccaaaaacaacaaaaaaaaacttgtgggcgccccgccccaaaaattttaaacactgtgtggcgcggccagttaagaaatggcactgctcaaaaccggcagacgcggtcacaaaaaccggccggtgaaccaggtggcaggtcaaagacgagca

SEQ ID NO: 131481 - DNA, 115 bp, Homo sapiens
tgtgggtttttttggattaaagtaaaatatgtaataagtaaaaatggagtgcagtgtataatctgaatctaatcatgggaaacaacaggaacttttttgtgacggcgttcaccat

SEQ ID NO: 131482 - DNA, 526 bp, Homo sapiens
ttatctgcagtgtatacattcaagaccccagtggatacctgaaactgtggatagtactaaaccctttgtgtgtgtgtgtgtgtgtgtgcgcgcgtgtgtgtgtgtatatactatgtttttccagctgataatgagctactaagtgactaacaggtgggtagcttatacaaaatggatatgctggataaagggacagttcatgtcctgggagagacagagagtgaaggggcaagatttcatcacgctattcagaatggcacgcaatgtaagacgtgtattatttatttctaaattttccatttaatattttcagaccgtggttgaccataggtaactgaaaccacagaaaacgaaaccatgtatgaggtggactactgtaccacattttctttatccactcatccatcaatagacgtcttggttgctttcacatcttggctattgtgaacaatgctgcagcgaatatgggtgtgcaagtatcttcaagatcctgttttctatccttttgaatagatatgcggaagtc

SEQ ID NO: 131483 - DNA, 481 bp, Homo sapiens
aacaaatttaaaaattgagataagcaaaaaagaaaaatccctatgaccagccctcccccggccgctgtgagtgggcagacgctggcactcgctaatatttggttgatgtttttccggacttttttctatgcatacttgcgtataaggcacttatttttttcaaaagcatgcaatcccacccacagcctggcactgaggagccaggacagccactcattcaggaagggcctctaccagtttggatgacgaatattatctcccaatcatgacctgtagctctgtggcaagaggctgttaggacatgacatttcaaaacagaattgttctgaaataatttttacttggctacaaagaacaaatagcaagagtgatgccagtctggggtaggataggcagctgctgggcagatgaaatattttttgtgtaaggtagtgatggtctttgtggaaggttacagtttttgctttagcacagtgcctgg

SEQ ID NO: 131484 - DNA, 272 bp, Homo sapiens
tgctgggattacaggcatgagccactgtccctggcccaatacatattttaaagtaaacattgtattacagaataccacagacagaaaagcacacaatgaattttcatgatgtgactccgtatacccagcaggacgttcccggcccccacgatcacccagcatggcccacctccgtgaccatcccttctccaacaccagactccccaagccctggcacagagatggctgtctggggtggccccgtagggacagtcgctcagtgctgtgtggtg

SEQ ID NO: 131485 - DNA, 813 bp, Homo sapiens
aaccgttccaaacaatggaaaaagtggaactccttcctaatcattttttgaggccagtaccatcctgataccaaaacctggcagagacacaacaaaaaaagaaaatttcaggctaatatccctgatgaaaatcgatgtgaaaatcttcaataaaatactggcaaaccaaatccagcagcatgtcaaaaagcttatccaccacgatcaagttggccacatccctgggatgcaaggctagttcagcatacgcaaatcagtacacataatccatcacataaacagaaccaatgacaaaatccacatgattacctcaatagatgcagaaaaggccttcagtaaaatattcaacaccccttcatgctaaaaactctcagtaaactatgtattgatggaacgtatttcaaaataataagagctgtttatgacaaatccacagccaatatcatactgaatgagcaaaagctggaagcattccctttgaaaaccggcacaagacaaagatgccctctgtcaccactcctattcaacatagtattagaagttctggccaggacagtcaggcaagagaaagaaataaagggtattaaaataggaagagaagaaatcaaattgtctctgtttgcagatgatgtgattggatatataacatttttgaggcctttaatgcatgaattctttattgttccaaaaatgtgaaaaagtagtacatttctggtagggaagtggagaacttgttatttaacaaataatttcaatgcgacattaaaattctataaattttaaacttttcttcatcattaaatttagtatagg

SEQ ID NO: 131486 - DNA, 273 bp, Homo sapiens
ccagaactcttaaaacaccccccagacagatattccaatttggactacctgacaacaatgagctacaaacttcctgtaccaactcttttctaaacttacctagtgtagtaggacctgccagatgcaccgtattacctaaccttgtaatgaatgccattgaatcctttcaaaggccagttcccatcagttctcctaactgacattctcaccatgccaataagacaggcagattacaggacaattcaagactcattcctgacacatggcaaagtt

SEQ ID NO: 131487 - DNA, 707 bp, Homo sapiens
attttcatgtttttaaataatattattatcttgatttttcttgacttttcagtcttacatattgtctgttgacttccaagaggaaagctgtgttaactccgctaagaattgtacaaaatacgcttaaagtagaaaggaggtcacatcctttatataggtcagctcatttaccattctctgaaggtagtagactggtactcccttgttttatagacaaactaaaattcagacaagttaaattacctccacatgctcacacagctctgtcacggtctagtgcatcaaactctagtctgagtccaaagcccgttgtctttctcaccaaaccaaattacctccaggatagagaaatcaggaaaatttctagaaaagggaaagaagtaatacataacagttgagccagaccttaagaatggactgaattttctgatgtatctgtttgattatacgatacatataaggaaggtgtgggagaaaagtctgggaagatagtttaggcttatggcatggaaagctaaagtaagaagcttaaaattacatagaaaggcagcatgtcatcaaaggttttttggacagaggattagaattatctctgaggaagattaagctagaagtggtgggtagataaaatagattggaggtagaagcctgaagtcaaaatggtccaggaaaagtattagttgaagagatggtgaggaaaaggttga

SEQ ID NO: 131488 - DNA, 266 bp, Homo sapiens
cttctggtcctgccatggctgctgctctctgctgaaggctgtggggctctagggagagtccagatcaccctgggatttctccactgcccaatgtgaagcctaaactgtggggtcccagctcagccttcctcactggctctcaactccaccccacccctctattcaggaaggtgaggggcatctctttagcagaccagactgttttgagaagtgtctctcatactttaactgaagagtcatgcagattctaatggtctggggagggc

SEQ ID NO: 131489 - DNA, 473 bp, Homo sapiens
atcatgtagaaacagtgggagccctgagcttgttttcctgcaactagatggtcccatctgggggcaatgggagacagtgacagatcatcaggcattggattatcataaggagcatacagcccagatccctcacatgcaccgttcacaatagggttcacactcctatgagaatctaatgccaccactgatctgacaggaggtggagctcaggaggtaatgtgagcaatagggagcggttgtaaatacaaatgaagtttcgcttagttgcctgccactcacctcctgctgtgaggcctggttcgggagcaggccaccgaccagtaccagtccgtggcccagtggttggggactcctgaactaaatgatgcaggacctaaaggaggaagcatgttgggaatacactagtggaagtggaagctattccatcagtagagagaaccctcagtgaggcaggtggaaccaggtcacagaga

SEQ ID NO: 131490 - DNA, 551 bp, Homo sapiens
agtggaccttatctcatttaagcctacctacaatcctattttacagatgagaacattgaggccaggaaagataaatatttcccaaagttacatagcctgtaaaaaaaaaaaaaaaaaaagtggagctagaattcgagcccagaggctgctgatttttaaggctatgaataaagttgggatgaatagaaaacatcacagggaacagaatctcctgtaggatccgaaagggtccctaaagcctagtgagatggacccccctccaagcagatgaagttttacagggtcatatgtgaggtcccaaaaggagggactggagggctgagcagcagggaagaaacacagtcataaatatggcattagcatcacttagtgagaacaagtttgcatcctaatcccagcaacacgagctggcaacttccctgccattcacaaggtgtgatctcatacccaggcacgttccacgggagctgcagggcacgaagtcagaggcagctcaggggatctctccttacctaggagcccagaggccgcctgcagcaggagcaggcagc

SEQ ID NO: 131491 - DNA, 253 bp, Homo sapiens
aaccctggtattctgactccatggccttaactgcttaatttatgatatagtattactgtggagatatgcataaattgcagtgagaatgaacaggaagacatctagggatgttattgttctatttttagttattgtggttaactaaaattttaagtctttgtagaggaggtgacatttgtgtagggtgctgaagggatgagtaagtttactattggagaagagtgagaaggcatttctagtagcaagtttgggt

SEQ ID NO: 131492 - DNA, 335 bp, Homo sapiens
cattttagcaatatacccaggtgattataaagtctgagatgcctgacgtggaacaggcctggggctctcctagttgatatttgggaagctggcacagtattccaatgggagctagtgaaggggtggtgttttaaggagaatttcacaaggaaattcattttacatgtaagttgtgctgagtaaatagtcctgcattagtgcttagcccactgtggggtgactgatgtttcttaagaaataagtgtatgaataaacaaatattcctcctgtttatacagccctgctaaaatatttaaagatctgcattctctgaaattgattaaacagcctgtctt

SEQ ID NO: 131493 - DNA, 369 bp, Homo sapiens
ttactggaggagggagctctgtgagcaaaatcctggagatggggagaaaacactgagtgtggttgagccgcgtggtgggctgtgatgtcggggttgggggtgagaaaacctggaagaggctagttggaactagaagggagttgaatttgaaatttacactaagaaatttgtacttaacttggtaggtagtgagttgttatggaaatattggagcaggacatggcaggagaggaagtgcacttggggaaaccttattgggcagtgtgtttgtagggtggataggagtataaagagccttgttaagaaattatttcagctgtgtagaaggatgagagctaggctttctggagtaaagatgttgggggtaat

SEQ ID NO: 131494 - DNA, 406 bp, Homo sapiens
atcaaaataccaccatcattcttcacagaacttaaaaaaaaatcctaaaattcatacagaaccaaaagagagcccacatagccaaagcaagactatgcaaaaagaacaaatctgggaaacttcacattacccgatttcaaactatattataaagtcaccaaaacagcatggtactggtataaaaacaggcacacagatcattggagtagaatagaaaacccagaaataaagccaaatacagccaactaatcttcaagaaagcaaacaaaaatgtaaagtggggaaatgacatcctattcaacaaatagtgttggaataattggcaagccacatgtagaagaatggaactggatcctcatctctcactttatacagaaatcagctcaagataaatcgaagtcttaaa

SEQ ID NO: 131495 - DNA, 340 bp, Homo sapiens
taatgatagctgatgagctaaaaaaaaaaaaaaagcaaaaaaatttcataatgttttcagaaagtttatgagtttgtgttaggctgcattcagagctgtcctgggccacatgtggcttgcaggccatgggttggacaagcttgctataaaccatccctaatattcagtctctagaactgaacaggcagttaaattcagcctctgtgcttttgagcttgtcaccctcacctgtgtggtagaggcccgagtcgataaggcagccatccctgcaggtgggcagctgtgcagctctgttcccaatcagatatcccattctcattctgctagactcttctctttc

SEQ ID NO: 131496 - DNA, 743 bp, Homo sapiens
  misc_feature (714)..(714): n is a, c, g, or t
taattttcttctcttagatctaagaccatctttaaaacttttctgcattaatattatatcaaggatttgctggaaggtactttaattcagtcataaggtggtggaattaattctttttaatgattagataaacaattctatttccaggtttaagcaggttttagtgcagaaagagatcttagagataattacccagttcaataagttttacattttttaagtagcaaagctcctattttaaaaatgacaggaccagtagtgtcttttatccaactacactatatggtagaaaagttacattttcccctcactttctcatatgaaaggcaaagatgttcatacacaatcacttctttttagaaagcttttcagaaacatttttggagtttcatgcacctttacagcatgtaaaaacaatgaatgagcttcttaaacagtttaaaacttcattgtttgtccatgaatactcaatttttaatttctgtaatttattacttctgtgacccaagagagattaatttactctgagttttgtttttccttctgtaataataatacataataatatctcaatccataggataattacgagattaataagataattcatggattcggtttataaaggaagcatttgtagtaagctctgttaccattatggttaccttttttactgttcccagaccagtgctttttctaggggcttttatttcnacctcatgctaaaattcacagttagaaaa

SEQ ID NO: 131497 - DNA, 436 bp, Homo sapiens
actatgcctggctaattttttaattttttgtagagataggggtctccctatattgtacaggctggtcttgaactcctggactcaaatgatcctcctgcctcggcccccacaaaatactgggatttacaggcatgaggcactatgccctgccaagatacagaagattttaacatgaccaacgaatttgatttagtgatgtacatggaacattgcacctcaaagttgcaaatgtacatggaacatttattaaaattgatgatatactatgaatatcattgattgtatacaatttctctgatcacagtggaattcagctacaaatcaatatcaataagatagccaggaaatctaaattaaagaaaaacaaaagaataagacagatggagaactgaaatagggctttgttattaataaagctaatttagatatggcatgt

SEQ ID NO: 131498 - DNA, 116 bp, Homo sapiens
ttattttccttctttattgttagtatcactggtggttggcaccctcaagtgtcttcaaacattttttattatagaaaatttcaaaatatacaatgatagaactataaaataaactc

SEQ ID NO: 131499 - DNA, 287 bp, Homo sapiens
ttgtgcagggcaccctgagcttaaattcctaccatgacccctgattggaaaagatgggctaggaaaggtatctctctggtccccagcagttaagcttgtatttaaactagaagtttttagatcaccagccctcatcctctatcacctccaccactcctgtccctgggtagccttactttttgttttgttttgagatcagtgattaaacctgctggtgcataccagggctgcccgggtgctcagctcttgtttgctggtgccaccgctcaggaagcatgcatctccct

SEQ ID NO: 131500 - DNA, 684 bp, Homo sapiens
atatttattttaaaaagtgatactgtgatttttcagctacaaaaagttgttattggtgttttcttttattactgtcaagaagataaatggtagagtatacataaaatatatgaaatttggcaagttaaagttattgtttgaacactttgtattgaagaaattctgcacttgaagttcttgagtgttctttgttgcccattattgtttgagatacagaacgtctttaccactaatgcagctgagtttttagatttaacaccagattaaggagaatcaaaatgatcagtcttctacatatgatgtataagtttgtggtccctttgtggcacttatttaaaaccaacttctaacagagtcatgtgtttctatttctcaccctgcataagtgcttcaggcctgagtcagacattccttccatcacagttatttatttatttatttatttttgagatggagtgtcgctctgtttcccaggctggagtgcagtgacgtgatctcgactcactgcaagctctgcctcccgggttcacaccattctcctgcctcagcctcccgagtagctgggactacaggcgcccaccaccacgcccggctacttttttgtacttttagtagagatggggtttcaccgtgttagccaggatggtctcgatctcctgacctcgtgatccgcctgcctcggcc

SEQ ID NO: 131501 - DNA, 677 bp, Homo sapiens
cacggtggcttacgcctgtaatccctgaactttgggaggccgaggtgggcggaccatgaggtcaggagatcgagaccatcctggctaacacgtgaaaccccatctctaccaaaaatacaaaaaattagctgggcgtggtggcaggcgcctgtagtcccagctactcggtaggctgagacaggagaatggcgtgaacccaggaggcggagtttgcagtgagccgagatcacaccactgcactccaacctgggcgacagagagagactcctgtctcaaacataaataaataaataaaaaattaaaaacacaatgaatacatcttgctctttaaggtcacaactttatgggagacaggaacctttcacactttatggaaaggtcaaagctatcctaaaaatggcctttgaacccaatacatttttgactcagaggttcagtttatctgcattttatcatttcattataaaataagatgaccaggcccttttttttctggtctattatttattagatatgagtaaagaagcttgcttttactgaaagtctgacacataccactgtatactgtgtcttctccttgtaaaaagcatattcaatttctccctcttttcttaaaaatagaagtagtttttggctctgttctttcttgctccctgtctctctccacatctttaaaa

SEQ ID NO: 131502 - DNA, 424 bp, Homo sapiens
aataatcatccccaacctgggtaatatacgatttacatttttgataaatgatattaaagtataaatctcccagtaggtacggaatttccaagctaaaacattcatcatttataaaagcatcaagtggagatgctgagataaatattctcttctcaccgtgactagcacctactagttttttgttttgtttttgtttttttgccatcaggtgtcatcagaaaaaagttgtaggaaggaatttatttgaagaagcttggccaggcgtggtggcttatgcctataatcccagaacttgggaggctgaggcaggcggatccacctgaggttgggagttcgagaccagcctgaccaacatggagaaaccctatctctactaaaaacacaaaattagctgggcgtggtggcacatgcccataatcccagc

SEQ ID NO: 131503 - DNA, 336 bp, Homo sapiens
tgatgtgtacctaggactgaggacaaacctgttccagagaacaggagtcaaacccaaagtgagacttgaatagctttaaggaaagcatttgtgatcaaccagtgggcctagggccagaccagaagaggactctttttctccattgatatacagggacacatagagcaggaagattcatagctttggtagctttgccacccagcaagccataccagggcatgcagccgccattgttactttgtctttggaaacccctctacccttgacataagcaaaagtgcataaggcgcctcctctttaggacattcatttgcctcaaatactgcattggcttcc

SEQ ID NO: 131504 - DNA, 448 bp, Homo sapiens
agactgagagaaaattaatttatgttgtttaagccacccagcctgtggtattttgtttttgcatcctgactgcctaatacagatggttaccagagggtaaactgaaaaaatgtgaatagtgagagcataaagtaagacaaggaaaaagaagccttcttttgtttgttcataaatattcaaaatttatcttgtgccagacattgtactagatcccaaggttaggataatgaacatgatacaatctctacctgcatagaacttacatttttggcatgtcacaaacaagaaataatagaaaagccaaatacagatcatgagaagtggtatgaatgaagatgaaagaaggaagacgaaataaagaataattatattcagtgcaagtgggtcttgagcagtcaattaagaactctgaggagatagtatttaggctgagacctgaaggatgaaa

SEQ ID NO: 131505 - DNA, 294 bp, Homo sapiens
ccagccagcctatgagccttgcctaattgactctttgcagtggccttagaaggttagcattactgccccatcttaaagatgataaaattgtggctcagccagagtgccactgtgcccaaggctgcccgccagtgagcgcggggctggtgagtggggggagagtcagggcagcctgcgtggggtggctccctctggcttgccagggatcccagcctgccttagtccagaggtgcactgggcgggatgagctgtcagcatcagagcccctgccctcaaggcctggcccaatgcatc

SEQ ID NO: 131506 - DNA, 656 bp, Homo sapiens
taaggtcgtatggacctgtattgtgcaagatggcagccactagccatgtaaggctatggagtacatgaaatgcaactagttcacatggagatgtgctttgactattacttagtacaacaaacaaacaaaacaaaagcaacgtaacatatctcagaagtgaaaatactgttaacatactgggctaaataaaatacattatcaaaattaacttcgagtggttcattttccattcatttttcctttatcaaaaacttttaaattacctacgtgaccctcatgtgtagcttacattatatttctattgggcagtgatgagataagctatgaggtcttatggaccacagtaagggtgattgcttttactgagagagaagaaaagccactgcagggtttgggcacagcagagcatgatgtgacttaacatttcacggattgttttcgctgcggggaggactacagcctctaaggggcaataaagaagcagatgagagaggatggtggcttggaccaaggtggtggcagcggaagtagttctgatagatgaaattttggatatattttacaggtagagtcaacaagacttactgatgaactggatgaaggacagatgagaaagagggaaatcaagcatgaccagaggtgttttcgataagcaa

SEQ ID NO: 131507 - DNA, 459 bp, Homo sapiens
ccatatagagattccactgtaccactagaatggctaaaattaaaatgaaaataccaagtgttgacaaggaggagaagcagctcttcactctcatgtactgctagtgggaatgtaaaatggagccaccatgatgaaaactgcctggcagtgtggacaaaagcaaaccatatgcttccccaatgactcagcaattcaatctcaggtatttacccaaaagaaatgagtacatgtgtccacaaatgacttctatccaagtgttcagagaagctttcatcctaacagtcaaactgcaaacccaaacatcctgcaatgagtaaatggataaacaaattttcatatattcacacaacagaaaattactcagcagtaaaaaggaacagatcactgctaacacacaacatgaatgaatatccaagatggcaaggacagtgaaagacccacccacaaaagacacattca

SEQ ID NO: 131508 - DNA, 384 bp, Homo sapiens
acatgctactcctatggatgaatctcaaaaacattataccaaatgaaaaagctggatgtagaaaaccacctgatatgtggtccagtcatatgaaatatccagaaaaagcaaatctgtagaggcaaaaagtagactagtggttgcctggggttgggatggagactgactgcaagtgggcacaagggaactttctgggcgatgaaaatgttctctgtaaattcactaaaaatcgttgagttgtacacttaaaatggatgaatattatggtacataaattatactccaaataaagccatttaaaaggatagctaggagcagtggttcacatctgtaactccggaactttgggaggcccaggtgggagaatcacatgagccccaggac

SEQ ID NO: 131509 - DNA, 485 bp, Homo sapiens
tacttgtaagacatcctattgttctccgtggtattcattctcccttgctgcagtaagtcagtaaacccaacttcattcaactacaggtgtgttcctggtggtctttggagcacactgatacatcttaccagaacttttaagaaccttgcatttacattcctagtatggcctataatctgttattatctactcagtgggtttaagagcactaagctccaaattatactcaattaaaagtttaaattagctaagtttaaattaattaagttaatattaggtgtcagcttgattagagtgaggaatgcctagatggctggtaaagtactgtttctgggtgtgtctgtgagggtgttgccagaggacactgacatttgagtcagtgaaccagaagaggaagacccatcttcagtgttggtgggcaccacccaatcagctgccagtgcagctatcacaaaacaggcagaagaaggtaggataagtttgct

SEQ ID NO: 131510 - DNA, 2428 bp, Homo sapiens
ggggtagacctgtgggcacggacgcacgccactttttctctgctgatccaggcaaatgtgcaataccaacatgtctgtacctactgatggtgctgtaaccacctcacagattccagcttcggaacaagagaccctggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggttttttttttttcttaaatatgtatatgacatttaaatgtaacttattattttttttgagaccgagtccagcctggatgacagagtgagacccaatctcaaaaaagaaatcgtttcaccatgttggccaggctggtcttgaactcctgacctcaggtgatccacccacctcggcctcccaaagtactgggattataggcgtgagccacggcatccagcctcatctttcttttaaccaataaacatgatgctgtatcttaaaaagagcactgagcagggacttaagggatcgagtcctcaaccaaactgatttaattactcaggatttttaaaaagcatcagaggctatttacaatcttaatcataggggttcagtaaaataaaaataagaagtaaaaaagcaagagaaattattctgtaaatctaactggtgtaattcccataatcatgcaattaagttttactcttgagtttcctgacagccattggtaaaaagagaaacacatcaggatttataatttttatcatccaattatgggaagcaagcatgttggccccaggagacgaactcttctactaatttatagcatgtatcctttcatcaagggccactgagccagttggtgagtcaacgggtgaacctaagatgcaaggatgttttccaggtgactatttaaaaaaataaataatccaccaacgtgattgaccttggcgagatcatgtttctagtctatacctcagtttccccatctgtaaagtgaggataatgtcccaccccatgtaactgtggtgaggaccaactgcaacactgtgcctgcgagtctccttggaaaagtgtaaggttctacacaaatggaaagtgatctgatcacactcagtgtccccagcccagcctttcagtgccctggccctggggtgggggacaatactctcctcacccccttcactagtcttcatgaatagcaaggaggccataacataatttggtctaaaccccttcctttttaaaagaatgatggcaaaatgtgcataacattaaatttaccattttaaagatttct

SEQ ID NO: 131511 - DNA, 1726 bp, Homo sapiens
ggggtagacctgtgggcacggacgcacgccactttttctctgctgatccaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaaggaaaatatataccatgatctacaggaacttggtagtagtcaatcagcaggaatcatcggactcaggtacatctgtgagtgagaacaggtgtcaccttgaaggtgggagtgatcaaaagaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggttttttttttttcttaaatatgtatatgacatttaaatgtaacttattattttttttgagaccgagtccagcctggatgacagagtgagacccaatctcaaaaaagaaatcgtttcaccatgttggccaggctggtcttgaactcctgacctcaggtgatccacccacctcggcctcccaaagtactgggattataggcgtgagccacggcatccagcctcatctttcttttaaccaataaacatgatgctgtatcttaaaaagagcactgagcagggacttaagggatcgagtcctcaaccaaactgatttaattactcaggatttttaaaaagcatcagaggctatttacaatcttaatcataggggttcagtaaaataaaaataagaagtaaaaaagcaagagaaattattctgtaaatctaactggtgtaattcccataatcatgcaattaagttttactcttgagtttcctgacagccattggtaaaaagagaaacacatcaggatttataatttttatcatccaattatgggaagcaagcatgttggccccaggagacgaactcttctactaatttatagcatgtatcctttcatcaagggccactgagccagttggtgagtcaacgggtgaacctaagatgcaaggatgttttccaggtgactatttaaaaaaataaataatccaccaacgtgattgaccttggcgagatcatgtttctagtctatacctcagtttccccatctgtaaagtgaggataatgtcccaccccatgtaactgtggtgaggaccaactgcaacactgtgcctgcgagtctccttggaaaagtgtaaggttctacacaaatggaaagtgatctgatcacactcagtgtccccagcccagcctttcagtgccctggccctggggtgggggacaatactctcctcacccccttcactagtcttcatgaatagcaaggaggccataacataatttggtctaaaccccttcctttttaaaagaatgatggcaaaatgtgcataacattaaatttaccattttaaagatttct

SEQ ID NO: 131512 - DNA, 3110 bp, Homo sapiens
ggcacgagggaggcaccgcggcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatggtccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggttttttttttttcttaaatatgtatatgacatttaaatgtaacttattattttttttgagaccgagtccagcctggatgacagagtgagacccaatctcaaaaaagaaatcgtttcaccatgttggccaggctggtcttgaactcctgacctcaggtgatccacccacctcggcctcccaaagtactgggattataggcgtgagccacggcatccagcctcatctttcttttaaccaataaacatgatgctgtatcttaaaaagagcactgagcagggacttaagggatcgagtcctcaaccaaactgatttaattactcaggatttttaaaaagcatcagaggctatttacaatcttaatcataggggttcagtaaaataaaaataagaagtaaaaaagcaagagaaattattctgtaaatctaactggtgtaattcccataatcatgcaattaagttttactcttgagtttcctgacagccattggtaaaaagagaaacacatcaggatttataatttttatcatccaattatgggaagcaagcatgttggccccaggagacgaactcttctactaatttatagcatgtatcctttcatcaagggccactgagccagttggtgagtcaacgggtgaacctaagatgcaaggatgttttccaggtgactatttaaaaaaataaataatccaccaacgtgattgaccttggcgagatcatgtttctagtctatacctcagtttccccatctgtaaagtgaggataatgtcccaccccatgtaactgtggtgaggaccaactgcaacactgtgcctgcgagtctccttggaaaagtgtaaggttctacacaaatggaaagtgatctgatcacactcagtgtccccagcccagcctttcagtgccctggccctggggtgggggacaatactctcctcacccccttcactagtcttcatgaatagcaaggaggccataacataatttggtctaaaccccttcctttttaaaagaatgatggcaaaatgtgcataacattaaatttaccattttaaagatttct

SEQ ID NO: 131513 - DNA, 2019 bp, Homo sapiens
ggggtagacctgtgggcacggacgcacgccactttttctctgctgatccaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtaaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggttttttttttttcttaaatatgtatatgacatttaaatgtaacttattattttttttgagaccgagtccagcctggatgacagagtgagacccaatctcaaaaaagaaatcgtttcaccatgttggccaggctggtcttgaactcctgacctcaggtgatccacccacctcggcctcccaaagtactgggattataggcgtgagccacggcatccagcctcatctttcttttaaccaataaacatgatgctgtatcttaaaaagagcactgagcagggacttaagggatcgagtcctcaaccaaactgatttaattactcaggatttttaaaaagcatcagaggctatttacaatcttaatcataggggttcagtaaaataaaaataagaagtaaaaaagcaagagaaattattctgtaaatctaactggtgtaattcccataatcatgcaattaagttttactcttgagtttcctgacagccattggtaaaaagagaaacacatcaggatttataatttttatcatccaattatgggaagcaagcatgttggccccaggagacgaactcttctactaatttatagcatgtatcctttcatcaagggccactgagccagttggtgagtcaacgggtgaacctaagatgcaaggatgttttccaggtgactatttaaaaaaataaataatccaccaacgtgattgaccttggcgagatcatgtttctagtctatacctcagtttccccatctgtaaagtgaggataatgtcccaccccatgtaactgtggtgaggaccaactgcaacactgtgcctgcgagtctccttggaaaagtgtaaggttctacacaaatggaaagtgatctgatcacactcagtgtccccagcccagcctttcagtgccctggccctggggtgggggacaatactctcctcacccccttcactagtcttcatgaatagcaaggaggccataacataatttggtctaaaccccttcctttttaaaagaatgatggcaaaatgtgcataacattaaatttaccattttaaagatttct

SEQ ID NO: 131514 - DNA, 2112 bp, Homo sapiens
ggggtagacctgtgggcacggacgcacgccactttttctctgctgatccaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagagagatggagtttcactatgttgcccaggctggtctggaactcctgggctcaagggatctgcttacctcggcctcctaaagtgctagatttacaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtaaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggttttttttttttcttaaatatgtatatgacatttaaatgtaacttattattttttttgagaccgagtccagcctggatgacagagtgagacccaatctcaaaaaagaaatcgtttcaccatgttggccaggctggtcttgaactcctgacctcaggtgatccacccacctcggcctcccaaagtactgggattataggcgtgagccacggcatccagcctcatctttcttttaaccaataaacatgatgctgtatcttaaaaagagcactgagcagggacttaagggatcgagtcctcaaccaaactgatttaattactcaggatttttaaaaagcatcagaggctatttacaatcttaatcataggggttcagtaaaataaaaataagaagtaaaaaagcaagagaaattattctgtaaatctaactggtgtaattcccataatcatgcaattaagttttactcttgagtttcctgacagccattggtaaaaagagaaacacatcaggatttataatttttatcatccaattatgggaagcaagcatgttggccccaggagacgaactcttctactaatttatagcatgtatcctttcatcaagggccactgagccagttggtgagtcaacgggtgaacctaagatgcaaggatgttttccaggtgactatttaaaaaaataaataatccaccaacgtgattgaccttggcgagatcatgtttctagtctatacctcagtttccccatctgtaaagtgaggataatgtcccaccccatgtaactgtggtgaggaccaactgcaacactgtgcctgcgagtctccttggaaaagtgtaaggttctacacaaatggaaagtgatctgatcacactcagtgtccccagcccagcctttcagtgccctggccctggggtgggggacaatactctcctcacccccttcactagtcttcatgaatagcaaggaggccataacataatttggtctaaaccccttcctttttaaaagaatgatggcaaaatgtgcataacattaaatttaccattttaaagatttct

SEQ ID NO: 131515 - DNA, 439 bp, Homo sapiens
agagtcctctgggctgggccggcccccaccctgctgtctgcttggcttctggcttctctgggtgccatgcctcctcctgctgcacttgggggtatgtcttgggggatcactgaggcatgtgtcttcctcaccctgtctgcctctcatctgtctccttccctctttcttcctttctccttctctctctctctcccctttcattccttctctccctgtctcgcttcccaccactctgtttctggcacactctctcttcctatctgtctctcctttctttgtctctgtctctgtctctctctctcccaccctccttctttctcttcctctctctttctccatgtctctttccctcatccagcaaatatttattctgtcctgctgcggctggggggttactgggatgtccttcgggatgggagggctaacaccaaattcacca

SEQ ID NO: 131516 - DNA, 119 bp, Homo sapiens
cacagactgctatcagactccaagctcttcatgagtagcctcctgcccattctccagcctcctttcctgctcttaccctgagttgtttttggtccttgaacctgccacattctctccca

SEQ ID NO: 131517 - DNA, 149 bp, Homo sapiens
agaaatcaactgacttaaaagcgaacacccagagtaaacaatgcaagctggtctattacctctgggaagtggtctggaacttgggaatgtggccacctcccagatccgcctcctttggaatcactgaatggtggtggcctgaatgtcca

SEQ ID NO: 131518 - DNA, 595 bp, Homo sapiens
tctctccttagcataccctacatttggctcttataatgaggagactttttctctaatgtaccccacagttcagttatcttgtttaagcagatccttgccccagtagaatatatgcttcatgatggcagggattttatttttctgctgtgttccccccaccatcccacctagtatatatcaagtgcctagaacactgactagtgtacattcgttgaaaaaaaaatctctttcatttaacaatatattgagtagcaactagctatcatgctcatgccagggaatggaagatcagataaacaaaatagacttcattcctaatcttttggagtttacctcctagttgaggagccagacattatacaagtaattacaattgtgacaattgctacaaagacaaaatacgagatgagaggtgagagggtgctaagagagggaggttgttgatgtagccggtggagccgggaactcccctgaaaaagttaagttgcccacaagaaaaaaaggcaaaagcagtcaggtgtctggtgctttggaggagctaaaggcaagcagctgtggccagagtcccgccagagaggagaaatgaggctggaga

SEQ ID NO: 131519 - DNA, 516 bp, Homo sapiens
gagagacttctataacactgacccacaatttcccccatacttaatattaagcaatactacaaccctgtcaggccccatagtacccagaagggataaaaaccacccaagaagatatactataagacagctgaatagctccatgggagatataaatgtgtggcatgctgccttctccttttcagacctgtcatcattatctaacattgacaataatatttgtggctattgaaaaaccatgccagcctttcaagttccaattgcttcccacccaaactatattaatatctattccaccactccctgctaggtcctacctatcaatgccatcccatgcctctccaactgcctaggaaacttcatatgggaaatcagaatacatagtgaaataagtatttgactgccattgatactaatcagctccaatacttagcacaattggacagatatcagctagaagagcagttataggagctttcctgctaccacaaaacattttaaaatatgtcggaattttcc

SEQ ID NO: 131520 - DNA, 541 bp, Homo sapiens
tcagctgaaaaagttggatcactggatgtgtagcccaattccttctctcatcagggagaaactgggagccagagttgtcacctacttgttctgcactgatccagggagagaagttgtgacaaaagcctgcacactcattcagagtgcatgtcattttggattattgctttgctctccattacccatagatatctagagaatgctgggcttcatcatctctcaaagagagggggattaatggtcagccccttgaatagcagctagaaaagtcagggtgctagatgtctagtccacctccttctgagggaaatttgaaggattggttttatcactagagaaagctggagcaggagacacaagaagagctaacattcagaaaaccaaatcagttcctagagacagggaagttagaagccagacccttgggctgcagccagaaaagttgggagattagatgtgcaatctaactccttctggggagaatctgagaagtgtgctttatggcctgtattcactgtttactgatctgaggggtagagcc

SEQ ID NO: 131521 - DNA, 475 bp, Homo sapiens
gtaagagctgcagcaggagaacctgaatgactgtggcatgcctgctttcctgtgttttctcctaagaaaaatatttggagcacatggctttttgacaccttgtctggcaccatggcttgtgttccaggaaatgaccctcagtgttaagtagaaaactcatggaaaaatcatatggctgattgcaagcatgtacttgaaaaactgtggaatccgaaagtggcattcacatgtaaaatatctgagtatggaaaactagctcttaatcacagcttgttgtaaagaaataacacaggacaaggatgtgctgcctgttctgtaagaaatccctgtgtacccaacagggtaagtaaagcaagctgcaaacagagtgaaagtgagtattcctcgacatgtaatagatgtgatgattccttgtgtcaggaatcatccctacacgaaatttacaagtagaactatacttaaacagaaagacgac

SEQ ID NO: 131522 - DNA, 552 bp, Homo sapiens
atgaaaataatagataatatgattgaaataccatgccatctatgcatggagtgtattaatataatacacgcacacatttaccacataccaggcattgtgctaagccctctgtatggattaatctttcaaacctcacaatgtattgtcattatatagttaataggtaaggaaacagatttaaggagcatcattaacttgctcaaagtcacccaggcaataagtggtagagcccagatttgaagccacacctgcagacgtcggaagcagtgttctcagcttctcctgttttgccttactggtttctgacagtcatatgcacataccctgtggaggagatgaagataacggctaattcagcgagcatgctgagtgcctgtggccacccggtcatgttctagaagccatggtagctgtcctgtctgggctaatgattctgtaacaatttaggaatgcattcagggacactacctatgtttatcccatttgaaccagggaaacaggaaccttcatcttcccaaaatacttacacatagttttaaaaaaatctattcc

SEQ ID NO: 131523 - DNA, 241 bp, Homo sapiens
cctcaaatgatctgccagcctcaacttcccaaagtgatgggattacaggcatgagccaccatgctcggcccatcagtaatgttttgatttcttcctgatttccctctgtgctgaccctggccttttttttttgctttcaagtctattcttcacttttcccctgctcttttcaaaatggcagtggaagccgggttcagtagctcacactggtaatcccagctactcaggaggctgaggtaga

SEQ ID NO: 131524 - DNA, 276 bp, Homo sapiens
tgcatgttcagattaagggaggctctgttggagcctggcaatctgcatttctggagagataatggagaattcctttccaacattaattcttccgtgtgatcttcatttggcctttgatgtggtggcccatggcctcccacaacaccatctgtgatattgactttgattttatagctttggcatagtgtttttatatttccgttattaaacttctggatgaatcatgccgtagaactttttcgcttgattttggtttgaatctaagctaatgtttgt

SEQ ID NO: 131525 - DNA, 230 bp, Homo sapiens
atcttgagggaggaaaggagcagatgcctacccgcttccctgcaccgtgccccgccccacccccaccccatacacactgccccgtcacctgaagcttgaggctgaggcctctgcccactggaagggcccatctgctgaaggagaggagccacagcaggggccagcccttcgccagctaacctcctgggggaagaggatccttggcccacctcctcagctgctttgcaagg

SEQ ID NO: 131526 - DNA, 526 bp, Homo sapiens
ccctacctggagaaactgcatgaacagaggaagggagtgtgaatatatatgtacatcttttgttatcacttatacttttaaaaaagtaaaagtaatgtattattacattaatgtattattaattcaaaagcactttattaaggaaaaaaaatgaaaccagtcaggaaaaacagaccgagaagaacctaagtaggctaaggatggaaatgcacgcataagcaatgcctggagcaaaaagaaaagatgccttcatgaggactagggagggaatcaaagttaggaaaggacagctcagagggtggcattacagacaccaacagaggagactctccaaacaaagaccatggttaacaatatatgcagcagaccaggcaagtaatgcaaaggcaaaaacatgcactagccttgactatgatttggtggcctttgccagaactgattcaggtgagtttaggtgagggaataaggttgcattcatcagattgaaacataaatgagaaacacagaaacaagtcggaactgtcag

SEQ ID NO: 131527 - DNA, 122 bp, Homo sapiens
agcaatcgagcaggttcggcaaaaaagaataggattcctacattctcagttcatctccacaaactcacgtattaaaacaatcattcagttctgggacaaggtccacctgtattcatttagtg

SEQ ID NO: 131528 - DNA, 453 bp, Homo sapiens
caaaggagttaccgagctgagattatttcatcgctgagtcggtcaggataaagtatgtgtaatgtgctccttatagcttaaagttatggtattcatgttctcttgccaacaaaaaatagcacttagtagaaactgacacactgtccacagttccatagggagtcagggtctgaacctgtttgaggcctcacaggagccgcagagcgctggcatggtcctgtggtctccttgttttagcacagtgatgacagagacccctcactctgttgtggccttctgattgagcttgaagaactgcactcttgggtacagtttcattgagtaacctgtaagagacaccatcactaatccagacaattcagatagtcctcctctcgtgtgctagcatcgtgtagttcataaaacacttcttaaagtgccatcattacgccccgccgtgcttaccgttcactt

SEQ ID NO: 131529 - DNA, 648 bp, Homo sapiens
  misc_feature (1)..(1): n is a, c, g, or t
  misc_feature (18)..(18): n is a, c, g, or t
ntgatctagaggatcctnaagctcgcactcttcccagagattgggtttcaggaagagaatatggcaaggacacgtggtcactgtataagggaggcaatctaagatgtgtcctagaaactggagaatgggctacaaagaaagcagcactaaggaacaatgctgcagagggaaactgttgcagagtattgagggtgtcagtgagtttgtatgtaactgcaagcagagagtcactggaggttgggtagtaacaaaataggaggtggctcagacatttccacatgcaaatagattcagtagttcttttttagttcaaatgaaccttctattgcccttattagtgattctataaagtaaaatctacacagtgcagagggtggccttagaggctaacgagcctggtttcctgcctcagctgccctcactgagtgtaggggtgctttctttaatctctggaaacctccactgtctcatctgtaaaatggagataatactaacaccttgatgtgatgtcatgaagagaaattaagagaggcagtgtaagtaaagtccccacatagagcctgggacatacaagccacttcataagtgtcaattcttattgaacctttttattaagaaactaacaatattctatcattctggacctac

SEQ ID NO: 131530 - DNA, 255 bp, Homo sapiens
ttcccctcctcccctgctgagaacgggatggagcatctgaaggacgcatagtctagaagtgcttacagtggctgatgactgatagggtggtttagcaaggtgctgcctcacccagcagacagcagccgccctctgggccaccccgagggcccagcctggaagaagaatgtattcaggcagggcacccacagttgtgtgtgcggaaacgctgccaagcccagtgggatttaccctctaggggctggaaagccatta

SEQ ID NO: 131531 - DNA, 500 bp, Homo sapiens
aataaccatcttaacctcctctggccacctgcttccctatctgtaaaatggggataatattagtacctcccgtagggttgctgtgaagagtaaatttgatcctgcccgcaatgagcctaacccagcacctgcacactctacgtgcctgctacatgctggttgccctaattagaagtttagagtcctgcattgatgagaggacctaaaaggcttatgaggccaggcatagtggctcaggcttgtaatcccaacactttgggaggctgaggcaggtggatcacctgaggtcagaagttcaagaccggccttaccaatatggtgaaaccccatctctactaaaaatataaaaattagcggggcgtggtggcgtgtgcctgtagtacccagctactagggaggctgagacaagagaattgcttgaacccgggaggtggaggttgcagtgagcggagatcgccgcactgcactccagcctgggtaacagagcaagacaccatctc

SEQ ID NO: 131532 - DNA, 417 bp, Homo sapiens
tcagttctgagcgcctgatactaaggcagggacccagcaccccacatccatctggggccccagccctgcctagtccccacctgatggtatggtgaggaccctgccatgtcagccaccacagggtggcagctaccccccagccgcagcggcccagcctctgaacatctgtctcctcaccttcgagcagaggccgcagcatgtgtcgcagaccagggctgggttggggccatggggaggggtcctacctgcccccgcctcccggtgatctgggcgccgctcacaaggcctcccctggtagacccccggggtcggacgacggcttgcaagaagagagtccctgctgggccaggccaccgtatgttaggagcaagcctgcctgctgcgggccacgtgcgcgtgctggggtggcaggagccc

SEQ ID NO: 131533 - DNA, 475 bp, Homo sapiens
ggacagggactgttttttgttgtgtcttttgggctttcatttttttgagacacagtctctctctgttgcccagattggagtgcagtgacacaatctcgcctcccggtttaagcaattctcgtgcctcagcctcccaaatagctgggattacagatgcgtgccaccacacctggctaatttttgtatttttggtagagacggggtttcaccatgttgcccaggctggtctcgaactcctggactcaagtgatccgcccgccttggcctcccaaagtgctgggattacaggcatgagccaccgcacccagccaggacaggaattgtttttgatctattgcacaatatctccaatgtagatatgcaataaaagtaatgatgccagtgaagatggtcctgcaacaaaaggcaccttaggagaggctctgaggagagaagatagccagacacagagcagcacagagggaaactgagacac

SEQ ID NO: 131534 - DNA, 214 bp, Homo sapiens
ttcttcccaaagtgccacattcagttctgcatcctggttccaggggggtcctacctgcctcagtacactatcatttttcctcatcctcagcattagttgaaggtctcttccatcctaagtcagcagctcttcttcagctgggatttgtctgcctcttcactctcttctgcttgtggcccagaggacctgagttgcagaggtcacaactgctgtg

SEQ ID NO: 131535 - DNA, 738 bp, Homo sapiens
cgtgaaagtctttcataaatattcaaatgcaaagagacataagataagacatactggaaaaaatcctttcaaatgtaaagaatgtggcaaatcattttgcatgctttcacaactaactcaacatgagataattcatactggagaaaaaccctacaaatgtgaagaatgtggcaaagcttttaaaaagtcctcaaaccttacgaatcataagataattcatactggagagaaaccctacaaatgtgaagaatgtggaaaagcttttaaccagtcctcaactcttactagacataagataattcatactggagagaaactctacaaatgtgaagaatgtggcaaagcttttaaccggtcctcaaaccttactaaacataagatagttcatactggagagaaaccctacaaatgtgaagaatgtggcaaagcttttaaacagtcctcaaaccttactaatcacaagaaaattcatactggagagaaaccctacaaatgtggagaatgtggcaaagcctttaccctatcttcacaccttactacacataagaggattcatactggtgagaaaccctacaaatgtgaagaatgtggcaaagcttttagtgtattttcaacccttactaaacataagataattcatactgaagagaaaccctacaaatgtgaagaatgtggcaaagcttttaaccggtcctcacaccttactaatcataaggtaattcatactggagagaaacc

SEQ ID NO: 131536 - DNA, 395 bp, Homo sapiens
tgatttctctaaggtcttatctatcccatcttgatggataatgcatgaggctgcaggacataacaattaaaatcatggactcctcaaccaaactacttaggtttgcctctaatctccaccactaaataaacgtgatcttgggaaaatgaacatctctgtgcctcagcttccttacctgaaaaatggaaggaaagtaatagcgcctaccttctagggttgttttgaggtttaaatgagttaatatttgtaatatgtttacaataattccccacaggacttactactgtcactgagagatacgtcagagaagggaagcaacttccataatagttcttgtaaacaatgatcctgttcaatggttttaattatctccagggacctgagggactgtccag

SEQ ID NO: 131537 - DNA, 592 bp, Homo sapiens
aaaagaatcctgtagcatcaaaaaacaagaaagaacaatcaaatagaaatatgaatctataagatagaatatctttctcatttgttttataaatcatatttaatgattgaaatgaaaattataaaatcattttatactcaagaaagtgatatttaatgatagagaaggtaaaatgacctaaagagaaataagttttccatacttcacttgaagtgatgaaatgttgatttccagtagataaggctgttacatttgtgtattttaataagtatgaaaactgtacaaagtgataaactaaaaaatactgtacatatatcagccaggtggaatccaaacaaaaattcaaataacaagcaagaaagcaaaagaagaaatgcagggacgagaaagagaggacacaaagaaaacaaattataaaatggcagatataagttctaacacatcaataattactgtaaatgtaaatggcctaaatagacgaggtagaagtcagagattggcagggtgaataaaacaaaaacaagcaaacaaacaaaaagcatgagcaagttatatgctattagtaaggaacttaacaagaaactcacttcct

SEQ ID NO: 131538 - DNA, 362 bp, Homo sapiens
tagtgcataggaagcacctaataaatcttagccttttaataatcattaaaaaaaacccctctctttacacacaaacacacatacctcacataccaattcaacttctacaccaacaattttggagttacattatttggatgcatatttttgaaaatgtcactaagaataaatattacctcatgcccaacctcaggagcagcttcttcaagcacagttacctataaactttgtaccaaatagtatgcccctccaaaaccaacagacccttctttgtagaagtcaagtggaagcaacgcttagaggtatgaatcagtgtgtcgctcggttccatggagacaaatccaagtaggcactggcagctg

SEQ ID NO: 131539 - DNA, 383 bp, Homo sapiens
cagatgtttcagttggtatgttgcatgtatatgaaaaaatacacataggcaatcacaaatttatatttttaaatattaagagtaagctgggcgggtgcagtggctcacaccttaattccagcactttgggacaccaaagtgggtgtatcacctgaggtcaggagtttgagaccagcctgggcaacatggtgaaaccccgtctctacgaaaatataaaaattagccagtcgtggtggcactagcctgtaatcccagctactcaggaggctgaggcatgagaatcgcttcatcctgggaggtggaggttgcggtgagtcgagatcgcaccattgcactccagcctgggtgattgagcgagtctccatctcaaaaaaaaaaaaaaa

SEQ ID NO: 131540 - DNA, 346 bp, Homo sapiens
tccataatgtgcccaggctcacacagtcttattatgtgtatttcatggagggacattacatggttttcagtcttttggctcttataaacatggttacaaggaaacgtccttgttggtctgactctgtgttctcatatggcaagatcagtaggacccactcctagaaatggaggtggtaagtcaaagaaaagatgcattttacattatgatgcctatggcctagttgctgtttagaaaagctgttccatcttcacagtatacaagaagctctgtttctccacacctccagtattgaacattcttgacatttttcacttggccagttggatgggcacacattatggag

SEQ ID NO: 131541 - DNA, 555 bp, Homo sapiens
ttgaggaaaagttaataataatattattatatcattactctgtgaagctgggagtgggatgaagacagaactgggaaaattttatccagcctcccagagtaactaggaccacaggcacacaccacacccaactaatttttgtatttttcgcagacagaggattttgccttgttgtccaggctggtctcaaactcctgacctcaggtgatccgcccacctctgcctcccaaagtgctgggattacgggcgtgagccaccatgccctggcaacctgttacattttttgcagagtaattctcaggctctgtcagcattgctttcctaagtcgttctctgcccaaatccctctgcctactttctttttatctaaatgtaacctgtcactggagcctcccagagacttagggaagctgtctgaactccagctccctagccttggatgtctggaagcctcactctcatttctgaatcttgcttcctcttgagtctgcttctcttagtgaatccaggcagccttctcatgcccatcactcaccaaacctagacatgaagctt

SEQ ID NO: 131542 - DNA, 193 bp, Homo sapiens
ctacttgggaggctgaagtggaaggattgcttgagcccaggcggttgaggtttgaatgagctatgattgcgcccactgcattcccggctgggcaacagagcgagaccctgtcaaaaacaaaacaaacaaacaaaaaaaacgttggtctcctgtatgaccaatggataaagtaaccttgaccagtctaataact

SEQ ID NO: 131543 - DNA, 373 bp, Homo sapiens
gcatgtatcacctgtgcagcccgggcctcctgaacctctcggagcctcctcctcgtctgtaagtgatgaaagtcccctgcacaaaggcctatgaggactggttctgacagccaggctctgtgcctggcatcagggagacagatcatgaagttttcccttctcggtgcctacatggaggggtgccctcggatgccctcagcagagatcctcaaaggccaaagaggaaccggggacagggtaatgctggtaaggtactgggcatttgacagcctgctctcctggaaacctgtctcttggtttccggagacctccagacctccatcttctctcccaggcatggccatggctgccactcagcagaacccttgtcagg

SEQ ID NO: 131544 - DNA, 398 bp, Homo sapiens
tcctttgaaccctcctctaagtgcctggcttccttttatttttatggtttatttttattttattttatttttattttacctcccccaaattcaccgtagggggaaaaattctttcttggttctgtccctccccccacacgcctcgttccccagggaagggagaccccgagaggctcggtacttgcccgcggcgttgcttccaccggggctccgggatggccacggcgggtgcagggggcagtgatcgaagcggcagctcggtctaggctgtcgctccatgtgcccggcgagcacagcgtttgggtcccccagcgagctgccactgccgcagcccggaaggaatgtcccctgttgttaaggaccctgactgttttacaccaatgatttgccactgcaaa

SEQ ID NO: 131545 - DNA, 377 bp, Homo sapiens
cattccgtacatcatgcatgcttctctgagacatcaggaaaagactaattgatgggcagattcaaatgaacactgggcacatttcatcattgaggcctgggaaaataaggatacctcttttttggtttttgagtttctctgggtttgtttttgtttgtttgttttttgaggcagagtctcgctctgtcatccaggatggagtgcaatggtgcaattacggcttactgcaaccttgaactcccaggctcaagcaaccctcccacctcagcctcccaagtagctaagactacaggtgcactccaccactcccggctaatttttaaaattttatgtagaaatggggcctcaccatgttgcccaggctggtctcaaactcc

SEQ ID NO: 131546 - DNA, 195 bp, Homo sapiens
caggaggggaattgctttttgatttgttgttcactttgctatgttttaaatgtatttttataaaagtgcaaagatacacttattttaatgctttaaaataacttgaaatgattgagcaatcgtaggctagttctgagcatgcctttaaattcaggaaaaaagggttactttgtatgttggactttaggtagaaat

SEQ ID NO: 131547 - DNA, 686 bp, Homo sapiens
gctaagtacccaccgtaatatgtaacacacactccatttctggagaactttaaaatgtgaaaaatgtgctgtttagaattgatgaaatacgatatgtaaggtaggcaaagcaaaagaagtcaaatgatctgaaaacaaattgtcagttacaaaatcaccattaaaaggtaaaactaatctacaaaatcagttattttttaatatgctagttagtggtgtttgggtatataactcagtcttgaaatttaaccaacagaaatgtcaccatcagaggtaaatacttttctagaagtccacaagaaccttcataaatgataaccagcagggcttacactgctctttcatggaaaacttaacaatgcaaagcttctcaagtaaatccacagtttaccaactgcattcatgtaagacagcatacattttcagtcccgtaatgagagaacatttatatactaaaaggaagacttactggaaaaaaaattttgaggagtaatctctttcctggtttcagaacaatatggctccctgggactgcctgaatttcttctctgcacaaacctttcagcatattttaggagattcttgtgttctacagcttagtggccttcacttatccctactctcttttttagtcccaaagtagaaaacaggtgattggtacatattacgtcgggatccttagagtc

SEQ ID NO: 131548 - DNA, 662 bp, Homo sapiens
gggaaagcttgagaacgggagctcagtttcacctgtttgctgagagcaaaaggaagctggcccggaagtggcttgcaggaaggagttgagcagggttagggtggggagactgggcagtttctctggtttttgtaagctagttctctaattacttaccctgaaatgtgttccggaaacactgacctccattctcttattcacatggcagacagtgtacaagctgtttcaagcgaaatactgataatcaggatattaactactatatgtctgcaccagccatgaatacaaatcactggtcaccagtgtttgctctgttcctttttaaaaaaatgtttaattaaattaggtaactaattaatttgtaaagatggggggtctccatcttgtccagactagtctcaaactcctgggctcaagcaatcttcctgcctcggccttccaaagtgctgagattcagtggctcacgcctgtaatccccacactttgggaggccgaggcaggtggatcacgaggtcaggagttcgagaccagcctggccaacatggtgaaaccccatctctactaaaaatacaaaaattagccaggcgtggtagcacatgcctgtaatcccagctagttgggaggccgaagcaggagaatagcttgaacccgggaggcagagg

SEQ ID NO: 131549 - DNA, 661 bp, Homo sapiens
aaataaagggatagataaagcaaccatgctagcattcattgaaaggaaactggagtagccatattaatttcagacaaaccagactttggaaggagacaaattactagtaataaaggagtatatcattaataataatggcaaacgggtcaattctccaagaagaaatatcaagcctaaatatgtatgcaggcagaaacaacacataaaaatacacaagaccaaaactgatagaactgaaaggaaaaacacacaaatccacgaatagagttgaagatttcaacattccctgacagtaattaatagatcaagcaggaagaaagtgagaaagaatatagttgacctaaacaacactaaaaatcaacttgatctcattaatatttgttgactagttcattcaacaatagaataatcacactcctctagttcacatggaacattcaccaacataaatcacattttgggtgataaaatacaccttaacaaatgcaaaataatagaaatcaaataaagtatgttcttggatcataatggaattgaactaaaattaattgaaaatccccatacatttggaaattaaacaacaaactttgaaataacacataatctaaagaggtgatctcaagagaaattttaaaaacaattgaattcaatttatatgaaa

SEQ ID NO: 131550 - DNA, 351 bp, Homo sapiens
gtgtgtgggtggaaggatggatggatggatggatggatggatggatagatggatatgtgaatggagtatggatgggttgatagacaaatggacagacaaatggatgaatgtatgtaatgaataatatggcccaagaactatatccagcttggtcagatcttttgctccatagcctacacaaaagaaaccaactctggacactagagctataactaaagccaaggtggttaatcagttgaagctgtgagaagagaaacataatttggttccagctctaaatgaacacctgttcttcctcaaaatagtgttttcatttttaaagtactttgaagcttaataaatagcccataa

SEQ ID NO: 131551 - DNA, 439 bp, Homo sapiens
caactctgctcctttgggttccagttgatgggcaagtggcctccatgggtcagcgtgttccaagaggaaaccgtaaccttgcactgtgaggtgctccatctgcctgggagcagctccacacagtggtttctcaatggcacagcactcagacctcgacccccagctacagaatcacctctgccagtgtcaatgacagtggtgaatacaggtgccagagaggtctctcagggcgaagtgaccccatacagctggaaatccacagaggctggccactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataag

SEQ ID NO: 131552 - DNA, 652 bp, Homo sapiens
ccaaggatctcctagtgtcatgtagaagatctgtgaacaaaaatggaacaaagcattgtcttcagtgccatgagggctgagagaggaaagccttgtatggccacaggtattatgtgggtgcaggggagagagctggcaaccctcagagctcagagaggtcagaacaagcttcatagatgcagtttttttaagagaactggcctggcagattctcctggaagccaaggggcaggggtctccacacccagaacatggcagatgcttagcaaatcaaggaacttcaagtactgagttcagtaaagctggcacccaaggcatgaggaaggcaaaagattgtactagaaagataagcagagccctgtggtgaatggctttccatatcatcaagtctaagtcttctctaatctgccacatcctcataaatctgagacagacagccagctcatagccgtaaggaaagtgagggttgagcatatcaaaacaacagtatggtttatgtgaacacacctaagttttacaatgtccacaactaattcaacgtttcaaaaaatgctggctacccctgtgtgagccaaactaacgccatgtgcatgtttcagatggagtctgggggctaccagtttgcaacctctgcaaatagtcaacaggcgcc

SEQ ID NO: 131553 - DNA, 811 bp, Homo sapiens
attaatttgttgtcctgatactggagcaaataatgtcagacttttggcataatcagttagtatatgcatataagaaataaaaattcatagagtatgatggtaccaattatgagatatgctaagtgctgaaaatgtttgaaaaagttctgaaactccttggagacagtgtgttccaaagtggcctttgtggacagaaaaggcttggacttaaaattttggtatctttctgaagatctaataaaattcactaaattgaaaggagctgtaaacattttagaatgtaattgttaacaacgtgcttccctaaaacaagttttttcccctcctctatatcatgttgaactatgaaagaaagtgccttgttctgttgaccagggataactttagtgttaaatagtggttggttttcaaattttctgagactatagttcacatttgagcccttatgtgtttaatataaactaaaattattatcttggtgaagaataatagatttgtttcaaccagctgccttagacactttctcttgattaacttaatttagtaatagcagaggtcttattagctgcttcccaaattgaaaataaagatgacattattttgtctcaatacatatcgtttataatacacgatagtaaactggttaaaattgtttagtggaatttaaatttttttaaaaaagacagcataatagtgtgtaaagagattaatttagacaactttagaatataacaacttagaagataagattttgatagtacaaaggtttctaattgaatgttaacaaaattatgagtttaagtttatataa

SEQ ID NO: 131554 - DNA, 469 bp, Homo sapiens
tcctgaacacaggtgatctgcccgtctcagcctcccaaaatgttgggattacaggcatgagccgctgcacccagccgattctgatttctttttaatcgtttgtatgtggtagttctttctggatttagtattttctctttaacctggttattctgatactcacgatggtgtgcttgcttatactcattgtactaggtacacagtggtccttttgatttgttagctcctgttttggaatgtgagtttaggtcagggagaaagtttttgaattatttctttgataatttcctcagttctgctttgtttgccttttctgtatttaaaaaaaattttggatgttagactttctaatctgatcctataatttttgtattttctgtttcagttctttaactctttttactctattttctgaggtgattcctcactttctcttccaactcttcacttaaaaatttttttgtttgtt

SEQ ID NO: 131555 - DNA, 561 bp, Homo sapiens
tcatggaattggaaatgttcagagttgaaacaactaagattttgaatcatctaatttatttaagattacaaccatgaaaactttgctatctcaacatttgtggcaaagaggttacttggaatgggtcagagactaacctgctcatttccaaattccattgtgtcacagtctcatagaaaagggactaataatcacccactgtgcccactcaaattacccctaaattattcttgatggagctcacgaatgaaaatgagacagtcggccgggcgcggtggctcacgcctgtaatcccagcactttgggaggccgaggcgggcggatcacgaggtcaggagatcgagaccatcctggctaacatggtgaaactctgtctctactaaaaatacaaaaaattagccaggcgtggtggcaggcacctgtagtctcagctactcgggaggctgaggcaggagaatggtgtgaacccaggaggcggaggttgcagtgagccgagactgcgccactgcactccagcctgggcaacagagcgagactccatctcaaaaaaaaaaaaaaaaa

SEQ ID NO: 131556 - DNA, 405 bp, Homo sapiens
gactagaggctccccggttacctggacttctaggaatatcacatgcaacctgaactgaccactacagagagaaactaataatagagcatcaggcactagaagcttataacagccgtgctgccttaaggggtaaaggagggtgcagtgacacagggatgaaaactaacatttctgaaaccattacacactggaaagctcccagggctgcagagtggaggctgggagagaataggagaagtgaccaaacagatctgtccttaggaatgattttcactgccttgcgggtagacacatacatggaaaatgtactttctcaatgtgcaaacaattaagcattctggcaagtcccctgtatctagaaccctctttactacctgtccctgggtttgaacttctaccatggtt

SEQ ID NO: 131557 - DNA, 395 bp, Homo sapiens
tgtgccaccatgcttggctaatttttatatttttagtagagatggggttttaccatgtttttcaggcttgtctcgaagttctgacctcagggtgatccacccctcttggcctcccaaagtgttgggattacaggtgtgagccactgcacccagtctatattttttaaaacccgtaataacagaccatctagaccctaaataccaaagactttaaagtccagggttggtgacagtaccataacataaggatagtgagaaaaagtgataaatcgtagcgttaccagttttcagagctttaaaatatgttaacatcttaaaaatctaaatttcttcatagcagtaaaacggtagctatttataaattgttaagttagaagctgaaagtggataattta

SEQ ID NO: 131558 - DNA, 812 bp, Homo sapiens
aacgcagtggcatgatctcggttcactggaacctctgcctcccaggttcaagggattctcatgtctcagcctcccaggtagctgggattacaggcacccgccaccatgcccagctaatttttgtatttttagtagagacggggtttcaccatgttggccaggctggtcacaaactcctgacctcaggtgattcaccagcctcggcctcccaaaatgctgggattacaggcgtgagccaccatgcccagccactaacatattattttgatcaaaattctatttatctatttgtttaatgactgcctcccccactaggatgtacacttcatgaagacagggatcattcctgccctgctcaccaccacattccttgcaccaggatagagcctggcatgtggcagatgctcaaagagtataaaacgtgatgctgtgcaaaggctcaggagtaaaagagatacaatcttcaggcatctatctaatctatctatctatctaaagataggttgtcacccaggctgcagtgcagtggcactatcactactctctgctggacctcccaggctcaagtgatccttttgagtcagcctcctaagtagctgggaccacaggtacacaccaccatgcccatctaactttttattttttgtagagatgggatcttgctatattgcccaggttgttctcaaactcctggcttcaagtgatcctcttgccctggcctcccaaagtattgagattacaggcatgagccaccgcacttggacctacttcaaatttttcagaagtcatttttaaaactttgagtgactctg

SEQ ID NO: 131559 - DNA, 1701 bp, Homo sapiens
aaataattgtattacagatgtgaataaatctgtttaaaaaataagtgaaccctgagacatatgaactatgagacattgttctatatgatgctttgtaagttttatgtgctgtgtcatagagttatatagagttatgtatatatatagttctgtatagtttcagttggcatctaaaaattatataactttattttttaaaatctataattataaatatttttaaactgctagaaaggaagagccgaatatttggctggagtgatttttagacatttctctaccttagggcaccagagaggttcacttgcccagggttccatagctggttggtgccagagtccgaacgagaaaccaggtcttctcagctcctgtcacccacagttttgcagacactgaatttatgaggtggattccattcaagcatgcacataactagcagacacttctcctaatcctcctcaattcccctttgcattgctcagataccacaatcctttgcaggttaaatcccttcaccttgtgaactcattaggcagggcaatgtatatgaatccctgagtccttaagaacgtccttaggctgtgttagaaatgcagttgccataggagtaaccggcccctgctgtcatttggatgttctctcttccccaaaatccagcaccaccttggttaagcacccaccatgtgcctgcccacctggctccttaggcaatgttacaattaaccaggttggttttgatgagggtctagggcaaaatttgaaccaccacaacagccaatgtgcacatccatgcagagggttcagagatggcctcggccaaggatgccaggcttcagctctggaaggagccctgggaggtgggagatctttgtataaaaattggaacccaaactataattcccattagggatatatatgctcacatcactcctgattcaaagctcagaagtggcctctcaggagaaataaaggtctctctctctctctctctctatctcacacacacacacacacacacacacacacagagagagagagagagagagagagagagagagagagagaggccagcattcaaaattcccatgcttagggaatccattgggacttctccccaggatgtactgaattcaaggaagctttctctaggtgtagcagaaactgctgctgtcatgtctctgctcaccaggacgtagcttctctctacagacctttatttctttccctggaggcttcagtccatgttgaagtgtaaactccactcagctccaggaggaatcgtgttttctttatcaccaggggcttcttctacgagttgcctttgatagggaggccaggaggaagataggcccaagctcaggggtgggatcggggagcaggaagcctgtgggctttagaatcgaggtattggtttctccctgtcaccgtcatccaccacctgtgtgaacttgagccatttatcgaacctcacggagccccaagtttctcatctgtaaacaaggggaatgagccctactttgtatggttgtcaagaggatttgagacaatatgtataaagcaatggacacgcagaggaagtcaataagtacaaggtaactctgaaaatgccaccaaagggaggctagggacaggaaagccatctccgccaacctcaagaacgtggccccgaagctgttccaggaactgggcatgtatgaagat

SEQ ID NO: 131560 - DNA, 189 bp, Homo sapiens
aatacaggcatccaataatgaacactgaaggagctcaataccctattattatattttagccacaccaaagtgaaaacccctggcttataaatccattcattcaactaacaagtactgattgtctactatgttaacatactagtcaatataacagtaatcttgggaagacttctactatcaattctaaag

SEQ ID NO: 131561 - DNA, 1492 bp, Homo sapiens
aattagagtggcattaaggttgactgacaagaagatcatctatccctagaaccagttcaaaattttccctgtttgattcacaaaagaaatagcaaggaccaataaatgtaagggagcaaaaatgtttatcttcattaaacattgggaaatgtaaattaaaataacagataccatttcccagataccacttgtcaaagtgacaaagatgaaacaaaattattgtatccgatgttgacaaggataaggaaaactgacactcatataaaaaggtgagcatgtacaaatacaacttttctggaaggcaacttggccatatagataaaaagccttaaaattttgcatattcttagaaaatatactaattccacatttagagatttatgcaacaaagtaagtatgcatatgagtaaagatttactaataatgatgtttactacatcatttataaaaatgaaaacctggaaacaatccaaatgtccaacaataaagaactggttaaactatccacacaatggaaactctatgctatcattaaaaataatgctatagaacaatatttaatgacaaggaaaaatattcataatttctgttaagtagaaagaaatggactgcaaaacaaattacagaatagagtcccatttttgttctaagtacatagccactgagaagaaaaacctagaaaagatatttaccatgtaccaaaatattaaaaatacttaactcttagctgctaggattagggaagaaatatttccttaattttgcttggctattttctgtcttttccttttttttttttggaagatggactctcgctctgtcgcccaggctggagtgcagtgggcacgattttgggctcactgcaacctccacctcccaggttcaagcgattcttctgcctcagcctcccgaggcagggattacaggcgtatgccaccacgcccagctaatttctgtatttttagtagagacagggtttcaccacgttggccaggccgtggctcgtatgcaacgtcgtataaccgtctagttgtatccgacgcgtgcctcggtcctcccgaaaagggtcttggggactttactagggcgtgtataagcacagccgtgtcccctacgccttggcgttggcgactatcttgcctaacagtgtgtatattattacaggggaagtacatatgggtagtctttagtacagttgtgatcatcgaggaaaagagagaccttgtatttagtcacctctaaaaaatgggtcttacctgcctaaagggagaaggaactagatcagctgaccccctgaaagtctaactcttagtgaatgaaacagtatccaggaaatagcatctttagaaaaactgaaggacatgtctacttctggtgctctaagccttctgttctataacaaattcatctccatatttctcctgccttcatgtgctttaagctgtgacatttattccatatctatgtttcttcatactctctttgaaaaggg

SEQ ID NO: 131562 - DNA, 1421 bp, Homo sapiens
aattagagtggcattaaggttgactgacaagaagatcatctatccctagaaccagttcaaaattttccctgtttgattcacaaaagaaatagcaaggaccaataaatgtaagggagcaaaaatgtttatcttcattaaacattgggaaatgtaaattaaaataacagataccatttcccagataccacttgtcaaagtgacaaagatgaaacaaaattattgtatccgatgttgacaaggataaggaaaactgacactcatataaaaaggtgagcatgtacaaatacaacttttctggaaggcaacttggccatatagataaaaagccttaaaattttgcatattcttagaaaatatactaattccacatttagagatttatgcaacaaagtaagtatgcatatgagtaaagatttactaataatgatgtttactacatcatttataaaaatgaaaacctggaaacaatccaaatgtccaacaataaagaactggttaaactatccacacaatggaaactctatgctatcattaaaaataatgctatagaacaatatttaatgacaaggaaaaatattcataatttctgttaagtagaaagaaatggactgcaaaacaaattacagaatagagtcccatttttgttctaagtacatagccactgagaagaaaaacctagaaaagatatttaccatgtaccaaaatattaaaaatacttaactcttagctgctaggattagggaagaaatatttccttaattttgcttggctattttctgtcttttccttttttttttttggaagatggactctcgctctgtcgcccaggctggagtgcagtgggcacgattttgggctcactgcaacctccacctcccaggttcaagcgattcttctgcctcagcctcccgaggcagggattacaggcgtatgccaccacgcccagctaatttctgtatttttagtagagacagggtttcaccacgttggccaggctggtcttgaactcttaacctctagtgatccacctgcctcggcctcccaaaggtctgggattataggcgtaagccaccgtccccagcctgcttggctattttctaaattttatataaggaatacatattgtatttttataatttatcatgagaaaaaaacattatttatcacctaaaaaatgggtcttacctgcctaaagggagaaggaactagatcagctgaccccctgaaagtctaactcttagtgaatgaaacagtatccaggaaatagcatctttagaaaaactgaaggacatgtctacttctggtgctctaagccttctgttctataacaaattcatctccatatttctcctgccttcatgtgctttaagctgtgacatttattccatatctatgtttcttcatactctctttgaaaaggg

SEQ ID NO: 131563 - DNA, 758 bp, Homo sapiens
gacaattaaatgtgaatatcaccctcgttattattgcatatcatcatcaccaccagcagcaccttcatgaccaccatcagcactaccagcatcaccgccattatcagcaccgccaccctcaccattgttgctatcatccttgtaaaccaagaagtatctgagacaagtctcaatcagtttagaagtttattttgccagggttaaggacctgctcagaagaaaagaacacagattgacaaaaacagtgggtggtctgtgccattctccaaaaatgattttgagggcctcaatatttaaaagggagaagcaggctggaggggaaaaagggagggtgtggttgcattagtgaatccttatgttgcaagagaaagggagcaggtatggaaatagtcaattaggtatttgtcttgtgctcatagagttgctatctgtgcaaatacaactttttatctgtagctctctatctgcttaggaacaagaggaaaggcagcttcttgcacagtggggctttcagactaatgttcttccagttgacatagtgaattgtgctcaagattttattttcctttcacttttctcctcccaccccattaaaaaaatctttcaaagaaagcatcttagaagaaaactgagtctctggtcttgggtttggtctgatgtctctcgtgggtaggatggtttattctgagatggcttaggtcccaggtgggttaggaaagctgactttttagtaacgtatgtagtctcgagtctcacag

SEQ ID NO: 131564 - DNA, 737 bp, Homo sapiens
ggatttgctaagtgtgagccactgtgcccggcctcttattcatttcttaacctatgaaaacatctaggtctaatgctttcttgtacatgtgtgttttttgtctctctctatagaaatcagtctgtttaagcttttaatctgtactgggattgattttagtaaattacatttttctaagaagttattcattttgtgtagacttttaaatttatttgcaatagagttgtacaaaatttctttttatttttaacagctctatttaggtataatttaaataccataaatttcacccattctaacagttcctaatttttagaaaatttagattatgcaaccattaccacagttggatattagaatgtttccattaccccccaaattctctcatgcttgttttaaattaatctctgattcactccaagccgtaggtaattagtaatctgtttttgtctctataaatttgccttttctggacattccatataaatgaagccatacaaaaggtagtcctttatttctggcatcttccacttaatggtttttggagtcatccatgttgttgtatatatcatagctgggactacaggcgtgtgtcaccatgcccggctaatttgttctatatttttagtagagatggggtttcactgtgttagccaggatggtctcgatctcctgaccttgtgatctgcccgcctcagcctcacaaagtgctggaattacaggtgtgagccactgca

SEQ ID NO: 131565 - DNA, 717 bp, Homo sapiens
ggctttgtgtctgagtgctaatgtagatctgttgtaaactaggcaatacgtcatcaagccccctttacctcagctaaattatacccatgttcacctgaatgtacaagggccagaggatcttgtcaatccaaacttgagcttcagtcatcccattgctgtagtggtagaatctgaaactcaagccttctccctctggcccacagaagtatcagcagtgagatatttgcatgaacacagcaggctgtgggaatgtcaggaaaatactttctcacctcaggggatctgggcagaagaagaagaaaatggcaaatatcagaggataacatagtactggacaaacataacccaccctaggatcatctcagccatattggatgacaatttaaaggaaacttaaggtcctatagtagcagacagggattaaaacctgggttgcaaaagttacaaatacattgaaaaatccttggtaggcataaatgtatttatctgctcgtaaatttgaattttatgcatctctcacttgaaaacagactcagtaaatacactttcgagtacttattctttcccccagacttacttggaatttagtccttctctctctctctctgctcttcctgaggatgcaagaagacggctgtctgcaagccaggatgggccgtcactagtcactggctcaaccagtaccttgatcttggacttctcaacttctagaactga

SEQ ID NO: 131566 - DNA, 156 bp, Homo sapiens
gattggtggtgcctgcttcctgagattggcgtgggcgtgcagagggcagcaccgtaagggctgtgggttggtgtctggaggaagcacctgaaagatgacaggggtaagaaggagagcagggagggggtggctgcgggacgcccctcagtgagcgca

SEQ ID NO: 131567 - DNA, 485 bp, Homo sapiens
cagcaggaaggacccatggttgaaactcagactcaccagtttccaaacctggcctctgatgttggattgggggttatggtttcatcccagccatgatccctgcttatcctggcctttcccttaggagcttgtatagattgcttaacctcagtttcctcatctgtcaaatgagctcctaacgcaagatgggaagataggagtttgcattaagaagaggagggcctcttggcggaggtgacatttgaactaaggccggatggatgaggaggctgctcagggcagaatgggggagaacatcttgcaagcaggaacagcatatgcaaaggtcctgaggcaggagtgtatttggcaggtggatagaatctagaatgagagtgtggctgaagattatttatattgaggtgtgtgggaggatgaagtactggaagatgagatcagagagattaacaaggacaagatcatggggaccatggaaagatttggat

SEQ ID NO: 131568 - DNA, 564 bp, Homo sapiens
gattttacaatgtaagaaaagggtttaaaaatatttgacacccaagaaggaatggtaggatgttttgagtccaagttagtaaattggccactgactgctctgtcttttggtgaatcaccattgtttagtgaatgaggtaagaatcactaattctaagaagctgtttcagcagcaagataaaaataaattctctctattccctttgtcagacattctgtccaatatgagaataaatacagaagtatggctgggcacggtgactgacgcctgtaatcccagcactttgggaggctgagatgggcagatcacttgagatgaggagttccagaccagcctggccaacatggcaaaacctcgtgtctaccaaaaatacaaaaattagccgagcctggtggtgggaacctgtaatcccagccattcagggggctgaggcaagagaatttcttgaacccgggaggcggagattgcagtgagccgagatcatgccactgcactccagcttgggcaacagagtgagaatccatctcaaaataaataaataaataaataaaaataaataaaaca

SEQ ID NO: 131569 - DNA, 429 bp, Homo sapiens
ccaagttatactgcaacttcttatttgaactctttccctatgttgataaacacacactgggaaaagccaggcatattagtcaggtctctccagaaaaacagaaccaatagaagatatatggagagagagaaagaaagagaaagtgcttgattataaggaattggcaattatggaagctaacaagtcctgagatttgcagttggtaagctagagacccaggagagctgatggtatagtctgagtttaaaggccttagaatcaggagaactgatagcatagtgctagtccaaatgccagcagactcgagatccatgaagaagcagtgtttcagtttgagtctgaagtcaggaaatactgatgtcccaactcaaaggcagtcaggcaagaggaatttccctttatgtgggagagggtcaatcttttgttcta

SEQ ID NO: 131570 - DNA, 159 bp, Homo sapiens
gcagccagcgcatacaacatgcatatactagataaaggctaacagtttacatcctgggtgggacagggtgggatggtgcaagatttcatcatgctactcagaatgaggcacaatttaaaatttaggccgggtgtggtggctcctgtctgcagtcccagc

SEQ ID NO: 131571 - DNA, 332 bp, Homo sapiens
tgggcaaggcaaggtcagcactggagaaagtttcctggcaatcagaatcccccagcagacatcaagctgctgcctcctgcccccaacttctacagaccagctctaccccttctctgttatattcaacattttcctgttcctggaaatcccagccacttttggggaaagatggctaccaggtgcaaccaagagaggaatgctgcttcacacatccctactgtcggcaaatacacaaacctaaaatacttaaaactaagtttcatgctgtcacctttaccatgtttttttctaggttacccattttttcagcttaaaatgaacaaaatgtgacc

SEQ ID NO: 131572 - DNA, 228 bp, Homo sapiens
tcatgagggctctgccctcaggaatagattaatccactcatgggttaatggattaatgggttatcatgagagtgggttagttatcatgagagtaagtctgttatatatgccagtctggctttctctcctgagccccctcaccatacaataccttgcaccaccttgggactctacagagtgtccccatcagcaagaagatcctcacccagatgtagcccctagaacttg

SEQ ID NO: 131573 - DNA, 432 bp, Homo sapiens
gactgttgtggggtggggggaggggggagggatagcattgggagatatacttaatgctagatgaagagttagtgggtgcagtgcaccagcatggcacatgtatacatatgtaactaacctgcacaatgtgcacatgtaccctaaaacttaaagtataataaaaaataaaaataaaaaaataaattgttttactttacatatgaaaaggttatagaaggaataaaatattttagcttaaaaaaattgattttccataaaacgtattatgcattctgggacaattttcaatgtaaaataattactccaggacaactggtgtgaactgagactgtcacatgcaacctgggacatatagagttaccctaggtaagacccaaggtaaaaagcaaagcagatctctccttaagtgaaaagatttcacaagtttccccc

SEQ ID NO: 131574 - DNA, 760 bp, Homo sapiens
tgcttaatttttataacttttaaggcagtgtttatttctgctatatttgattgtgaagtttatttgcctacacatataaattgcataagcaatttcttctaaatgtgttgtagatgtttataatacaaatagaaatacttaagtacttattattacttatatcacagctatatttaaaattctttagatccaatattagttttttactaatttattgcctaaaatgactaattgaatttgacatttccattaatgccaaggagtaaaactgttttgccataacaacttaaatgaaattcaaatgattagttttgaagtttggaaaatttctaaatctttattaccatggaatccagtggtcatctaacagctgcagttgtattaaccatggtaattcaaaattgccacaaatttggttcaggtaccaacatttatttactcagtgcttacacatagtaccataagagattgaacgatgaataaaataggaacactgcctttgagatcttactagttcagcactgtaatagctatgttcctaaagtatctcatttaatacaacttaaaacaatccaatgacatgcgtatattactcctattttacagacatatttgaggctcaaaaaagttagttttctgaaaattacacatccagaaagtgtaagaggcagaatttgaactgaagcctgtctgactcctgcgtctgtggtctttagttttcaccattcttcaatgcagtattatcactgagtgacatgac

SEQ ID NO: 131575 - DNA, 152 bp, Homo sapiens
ctgcctcagattcccaaaatgctggaattacaggcgtgagcaaccccacccagcccaataaatcttaaagccccaaaataatctcctaagacccatgtctcacatccaggctacactgatgcatggaggtggctcccaaggccatgggtatc

SEQ ID NO: 131576 - DNA, 304 bp, Homo sapiens
ctcactgtgccaacagttgtaatttaatgttatattataagcaaagtttccattaatgagcccagaaattcttctatctggaatgtgagatgaagtgtataacaaaatatacctttgtattcttaattaaggagtctcctctatttctcctctcatatttgtcttccagtaactgagatttgtgctgcattccactggaagtctatgtcaagggttaaaaaaatgtcttttggttcttccagtctgcagtaatttgagatattataaaataattggctttttttctttttttttttttgagaca

SEQ ID NO: 131577 - DNA, 274 bp, Homo sapiens
ttatataacttttatttatttgaaaaacatgtaatacaatgccagggtacaaagtttgataaacacaaaaggatatttagtaaaaatctccctcccatgcctacccacattggaatccagctctcctttccataagcaaccagtgtgtataatttcagagattatttatgctcgtggaagcaaatgcatctacatacagttgaaccttgaacaacacaggtttgaactgcatgggttcccttatacacagattgtcttccacctctgccactcc

SEQ ID NO: 131578 - DNA, 138 bp, Homo sapiens
tcctttgaccaaataattctacttttagagtatgttcaacagaaacaccagtaagaaatttaagaacgtatgtacaagtatgtttactaaggcaatttgtaggaacaaagaattttttttttttttgagacggagtct

SEQ ID NO: 131579 - DNA, 115 bp, Homo sapiens
ttactttgttaggatactaatagtaagaataataataagcagttgcttggaacaaatcaatattttattgctaatggaaagtccccaggaatgaagagaattataggcttttgtt

SEQ ID NO: 131580 - DNA, 228 bp, Homo sapiens
tgaaactaagaattcagaccctggtgacagtatcctccacatctggaagggaaacgaatcacttgagaagcttcaaaaagaatgatgatgcccattgttgacatggaagtgaggaaatggtcaccctcacacagctgccagagagcataaggtggtaaaatctttcttgaggacaagttagccatataaatatatgtgtgtctgtacacacacatatatacatatatg

SEQ ID NO: 131581 - DNA, 331 bp, Homo sapiens
tgctgggattacaggtgtgagccactgcacccagtccttaatgctactttataggtgaaaattgtgaaataacttaaatttcattttaattaaagttaatttttgggaaattaacgaaaggttgacattttattcttttgaatattgcagttgttatttgggtttaaattggggggcttaggaaggaaagaagcctgatggttgtttctgaattttctgaaaattatgtttgatatggatctagataaggcattccaatcatttggaagtggtttgagtatctttttttctttttttaatttgagacagagtcttgctctgtggagtgtag

SEQ ID NO: 131582 - DNA, 289 bp, Homo sapiens
agctttctcagtagatatgagtctctttataaaaatggtatgcattatttattcttcatattccatgtctcacattataataaattttaaaaactgttaaattgaatagatttgccacaaagtacagaaaattagtattctataaactcaaagagaagaggccaaatagaaatctggaaagcattcatcaataaagagaggaaaaaaacattgcaaagttcttactatataccagatcttgtgataatttatattccttccctcattaatcccccaaataattgagcaa

SEQ ID NO: 131583 - DNA, 494 bp, Homo sapiens
aaggaggccagagtatttattattgtttggttttcttgcttaacacacaagacttaaggatctcccaactgtgatgcacggtctcgatgtggtttcaaatactgtccaattgatcttgtggtttccatcgagggtgtgaaatccctggttacccaccaggcaggcagtggtttgaatacctgtgatctcccacccctctgggtgtggttctggagtgccgtgggaggttaggacaggctggggcggaccgccagcacaaatagaacatacagtcattcctgcgtctctgtgtaaggttccagattcatgggccaggctcggcttgtgctgggttactgtaaaccaggatgagagagccacagccagagagccacggttcattctcgcactggtcatgtgaaaatcacacccccacagccttgccttaggctttgaaggaccccttcatgctgctgcttgtaccatgtagctaagaggcacgagggatgaccagc

SEQ ID NO: 131584 - DNA, 749 bp, Homo sapiens
ttgcagtgagccaagatcaggccattgcactccagcctgggcgacagagcaagactgtctcagaaaaaagaaaaaagtttctaaagtaaaaattgaaagtacttcccctacaaccacaggttgctttgacagattaatgtaaattcttccagatactcttctgtggatgtagaaacatgcagaatgaggcaagctttaatttgcttatgtcacttactgtggatagcctttcatatcttataagttaatgtcagagcagcaatctcatttttttccaatttgtaaacattttatttaaccttatgatggatattttggtggatttcagtattacaaaaatgcctattaatagtatattttcattatatttctgttacgaaattataatgctacaaacattactatgcctgtggcagtatacatctgcacaagttttgaaaatgttatgcattcataggcaaaaatgggataacttttgggcagtggtcatgattaatctgttgatcagaatccagagattgcccttctccttgccaattgctttaagagtacactagtttttggccgggtgcagtggctcatgcctgtaatcccagcactttgggaggccaagacgggcggatcacaaggtcaggagatcgagaccatcctggctaacatggtgaaaccccatctctactaaaaatacaaaaaaaacccacaaaaaacaaaaaaaccaggcctggtggtgggtgcctgtagtcccagct

SEQ ID NO: 131585 - DNA, 350 bp, Homo sapiens
acaaaatacaaataaatttctctaaaagtgcagttgttgggaaaaagaaaaggcggtttgtcaggctgacatcagagtagccgcagtcaccctgacaagccgcaaagtctaatgttttattcaccaggcctgaaaaataacttcccaacaagggccccataaataaaccagtgtgatgaatattacacgaaataaaaactgataaagcaaaggccctaaacacgagctgcaccacgaggtgagggaagcacatggcttttatcgcctctaatgccaggtgacaggttgggccaggctgcccccagctcacagggaggctgggagggggccggggagggggccagccatgg

SEQ ID NO: 131586 - DNA, 572 bp, Homo sapiens
tgaggactcatcactggggctatgggagacataaggatcagcagagacagaggcaaagctggatttaagaagtcacagcaggcctctcccctagtatgagccttgctttgaacatatctgggaagggcttccttttagtcttgaaaatgtttacaagcctctgctcagcatctacctagccttcagacctcgcgttctcaggcctgtggtgctgtctcctctctgcttcagtatggtcttctctgtccagcttctgcatgaggccatctggggccaagggtcacaggttttagaagttcccctctccccgctccatgccataggcacctgcaatcgcacatcctggataaaacttcagccggctttctctttatgtgcctggcgcctctcttttctctgggtttttggaagtctgcctacccagcccctcagctggggccttccccacttctgccccgccccactgggtcctcccagggtaggaggcaatctctgactgtcttccgaggctctgttgcttctccttcatcaccaaatgccaggaatttgtcagatgctgtttgtaactcaaa

SEQ ID NO: 131587 - DNA, 329 bp, Homo sapiens
ccagctagatttttgtacggtaacattattgataatataggagaagttcattgaggagaaaaacaaagggagcattaaagtctcatactgtatgaaactacagaaatggatcaaagagtttgacaggaagtttaatgtgtacataagtagaggctgacaggaacatgctgtgtgtgccaaaggttccagtgatggaaaactgaaacatagtgctcactgaccacagcatgagccttgacacacattgtaaataatccagagatatatgactgcattaagtgctaggctggtatatgaacggcagtaaatctatagcagcagaaagggtt

SEQ ID NO: 131588 - DNA, 420 bp, Homo sapiens
ggtacagtggctggtttgaggctgttcttgatgatgattcctatgaggactcagcaccagcagcaggcaatgtttgctgaactcccctttgtggctaggactgtactatccataggcatcagggagaaacctgctcctagggggaaaaaactcccagcattgtcctagttatgacaaattcaccaattcacagtgcttatttcctctggggcagggattgtgagggggaagagaaggtggggcaggagagataaaacagaggctgaaaggtactatcaccagagtccaaattccaaggctcataaaaacatggacctttatcaagcctcagaaacccggcatgtgaatgttctcaaagggtgttctgtgggacctggaagatgcccacagtcaaagacgtgtcagacctaccagtcaccc

SEQ ID NO: 131589 - DNA, 250 bp, Homo sapiens
attgtttggaaacttccttaataggaagttaaagaaaacatactgagtagcattggccttttgccaggcttctggatggcgccatttttgccttcggagtgttgcttccaaagctggtcctctggcaacgatggtgcttattcaagggagtccctgggataggaggaggtcccaattttttactctaggagcaacctccaaagttcccccttccttcgcctttctgttccctcataaaggaatgtgtctg

SEQ ID NO: 131590 - DNA, 653 bp, Homo sapiens
ggacagactgaagaggaaaagctcaggtgaacacatgatttgcatccagtacatgttgtaaattattggcatattttggctgttcctcaaagcaggactggctgcatctgtgcttagaggtaaaactaatagaggaccacattttggttcttcctgtgagctcagtactgtgtgagtgagttacttacatcaacacagccatacgagttgagtattattattacttctgttttaagatgagtagatagaggttgagagggcttgggtaatttgaaagggcacaaagtcaggatctaaatccagccctcctggtccagaggtttatccttgtgatcctgaccattctaccccacaggagctgctgttagctttatttctctgttgttgaaaactaacttaatatcctatgtactaaactttttcttttaataacacataaaactggaaaacaaaagttcagaaataatcacctcacctgaagagatgatttttgctagattttgtgtattgtggaggaatatttttcctctaacctcttaagatcctgagggcctaagaattaaaacaacaaaagacagaataacagtaaaaagtctgtgtgtaagaagcttgccaactggttaaagccagagacatgtatacctaacatagtg

SEQ ID NO: 131591 - DNA, 718 bp, Homo sapiens
ggattgggggagggacgaatgaggagttactgttcaatgggtgcagagtttcagctttgcaagatgaagacagttctggagatggttggtggtgatagttgtgtacattatgaatgtatttaatatcactgaactgtgcacttaaaaatggttaagatggtaagttttatgttgtatgtattttaccaaaataaaaataaattagggaaaaaagcatacggaggaaattaactttagtgcctgaaatgaggtatatttatttttactattcactgaaactagaaataactgtttttatgtttggtagaaaaaatcctgatttgctctaaaggcacactttctctctctctgatatttttctaaaaattgcatacagaaatatatatcatgacataatttaaaaatacttctaaaaaactttattgaaagttgtagacgattcactccaatgaaaaccgatttcatagtagcaaaattttggtaactaagagaaaatatcttcctctttataaatctttataaatatgtattacctataaaataaagattttgaaagaaataaggttgtattttggaggtgtactggagagatgagtggagcacagatgtgtagcttatatgagattatataaattcgaaatatattatctatatgagattatataaattcaaagaaatactgttaatggccgggtgcagtggctcacacctataatcc

SEQ ID NO: 131592 - DNA, 400 bp, Homo sapiens
gcaatatctgcccattctacatttccagggagtttgattagattatattctgtgaatgtaagtgacttcataaactctctgaagctcatgaaactaactagagaacactaactgtaaaatgttgatgctaagtttttaaaaaaattaagtatgaaaaatacatataaaataatatgttaaaaaattataatagaatattaaatctttccaacaaattacaactggtggcacagtcactagcaggtccaaaaagctctctctcttttactccatatttgtatccaaacattcattccttgaagtcagttgatctcagaaaaacatttctgtttaaaatagtattggtaataataatccttaaattaccaaggacttgataatatattggttgaaaaattag

SEQ ID NO: 131593 - DNA, 284 bp, Homo sapiens
cctgtccccagtctcactttttcctttttagtagattgttttcaatataacgtctatacagaaaaacacagacgtgtacacagtttgattcttcttagactgaacacctggtttcaccagcccccagatacagagtgtgatgagaacaccgaggccccttcaccccaccccagggctcaacctccccctgggcagctgctgctctgtctcctcaaacttcccgggcgggttctgcctgttctcacagctcctgcatgtggagtcggtgggttctgcctgttctt

SEQ ID NO: 131594 - DNA, 229 bp, Homo sapiens
tgctgggatttacaggcgtgagccaccgcacctggccgggaaatcatctttgctatagactgaatgtctatgttctccccaaatttgtatgttgaaacctaatctccaatgtattggcttggcctttagcaggtaattaagtcatgagagtcatgattagggtagggagattaggtcataggagccctcatgaatggtattagtgccattataaaaatacaccccaaga

SEQ ID NO: 131595 - DNA, 487 bp, Homo sapiens
caaagtccaaacagtgctcagagtccaaacagtgcccatagtccaaacagtgcccccagtgcactgagaaaagtcaatgagaaaacaacatttttgtcctacagatctggctgaaattcatgacttggtttctccaaacagcagagcagttccagaaaacactcaggaagaacccagatatggctactatgaatgaaccaagaactacaaaacagagaaaccaagaccttatttctggaggactgagacagaagagctgccagaaacagaaatcacattgcatataccggaagtgcaggaatttcttttgcttttccatttatctagcccagggaggagaataaagttacaaagtttgtgtaataaacggcaaaaggaggccgggcacggtggctcacgcctgtaaccccagcactttgggaggccgaggtgggcagatcacctgaggtcaagagtttgaaaccagcttgaccaacatggtgaaacc

SEQ ID NO: 131596 - DNA, 450 bp, Homo sapiens
agcggtggctcacgcctgtaatctcagcactttgggaggctgagggaggcggatcacaaggtcaggagatcgagaccatcctggctaacacagtgacaccccgtctctactaaatatacaaaaaattagccaggtgtgtggtggcgggcgcctgtagtcctagctactcgggaagctgaggcaggagaagggcgtgaacccggaaggtggagcttgcagtgagccaagatcgcgccactgcactccagcctgggtgacagagggagacttcatctcaaaaaataaataaataaataaatttcttaggatcggaaggtgattagtgagtaaagacgggcaacacagtatctataactaagctctttttagcatttaaattaccagctgatttgtagaaagagattctgcaaatgagagctatttcccccaatagctattacatattataag

SEQ ID NO: 131597 - DNA, 346 bp, Homo sapiens
aaacaccgccatcacgttgcaaaatccaggggcttgtgtcaatgtgcctggactaattgatcagtaggaaagctgccgttgtgtatgagagacagttgaggttagcctgacagaaatatctgtaaatgactcatgaggcaggaagaagaagcaaaaccagccttcattagccttatcacgatgatatggataaaattatgtctagtttgcagctgatgcaagccctgctgttttcgaaagccaagggatttgtgggcagtaatcaccataggggtgtctgccactcaaaatggcttcagatagacgatcaagagaagttttattgatgatgatgaggccacacaaa

SEQ ID NO: 131598 - DNA, 534 bp, Homo sapiens
cttaggggaaggagagcatgtgactgaccgagggtgaagcttaaacagccttgatcttccagatctctgcagactttggagcaagagagcgtcatcagaccgtcagcaaatgaattcctccctccgtaggtgcttggtgctaaatagacatgtgtactggtttctgagccacacgtaactgaatagctgtgtacccctattcttaaccacttttgtgggaatgcacattccctggtgttgaaatttctcttaatgacaaacatttgtcggcttgggtaatcatattgttttcagtgcaaaatagatgtggtgaaccagcctcctttgctgtttggttcttctaagctgttctgccctagggcatctgctcagtcttgaagcattatttaactctttaagttatgggaatttaacttttcatggctttccaattagtaagttccttcaaggcaagtccagtattgtgcttgtgatatcacagtggcattccgtctccctctcccactgcctcacacagtcctcattgcaggggag

SEQ ID NO: 131599 - DNA, 421 bp, Homo sapiens
aattaagccataggaatgacaacaaacaatttaatgaaatttccagaatgcttaaaaagaaacttgcttggcacagccatactttccaacaaacccactttaaagttttcacagtttacaatatcagaaatgacctcagggtcaggcatttgtcagttaatgacctgttgggctaatggccttcagctttgccttaggcacataagtcctccagtaggtcattagctgccagaaaagggctcttcccaatcactatggctaaataaataaaatttgctcctgggctaagaccctataaaccaactttggcttagactaagtaaattttttgttgcgtatttacaactttaagaatttaagaaaatgatggaaatgctaaaaccaaaattacattaacatgactgagctatatgtggctatc

SEQ ID NO: 131600 - DNA, 414 bp, Homo sapiens
tattaagcacctgccaagcactaggcatagagctaagtaacatgtattttctcatttaaagaagttaggaatcctacaaaatgactattatcatccccattctacagatgagaaaactgaggctcagaaagttaagaagtcttcactcaaggtttcaaataagtaaatggcagagccaaatctaaaatttggtctggctgaccccaggctctcaaccacctgctcactgcctggttttctggttctacatttttacaaaggtctctgctcaaaaagattgtatcaaaccaagcacagtagtgtgtacctgtggccccagctactcaggaggctgagtcaggagagtcgcctgaacccaggagtttgaggctgaagtgagctatgatctgtgcacacatgcccactgcctctcaa

SEQ ID NO: 131601 - DNA, 268 bp, Homo sapiens
gcccaaaaaaaaaaaaccacaaacccatattaggtattcatgcaaaaactcagtgataccgtagccagcaaatcctctgagaagggaatgcagctcttccttaagtctgctttgtagtgtttggttgtgtgggtttttttaacttcataaatcatgggaagctgtgctggcagtaggagataactcagcagtagacagattgctcttcgctgctttcttttaagaagcaggttataaaactgttgggagcctggtggagtagttaata

SEQ ID NO: 131602 - DNA, 399 bp, Homo sapiens
cgtgctaaacatttacatgaattatcttattctcgtaatatatttttgagctatgcattattattatctcttttcaacaggtagaaaaaccaaggcttatcaaacttaaaggaatttgtcaaaagccacgcaagttactaagtggtgaagccaaactcaaaagcagagctgtatggctcttgagctgggcttgtaaccactatctgtaggaccagagtcggcagcagagagaggccagagcgtggcaaatgtatttcttgaatactgagtaagtggcaggttatgctgagtagatatttggttggaaaggtgaattggggcccagttcaatttgtcaggggtcttgactaccatttcatggaatttaactttattttctggacgctggagagtccagaa

SEQ ID NO: 131603 - DNA, 591 bp, Homo sapiens
caggtggatcacttaaggtcaggagttcgagaccagcctggccaacatggggaaaccccatctctaccaaaaaacacaaaaattagctgggcatggtggcgggtgcctgtagtcccagctaatcaggaggctgaggtgggagaattgcttgaatctgggaggcagaggctatagtgaacgaagtttgcgccactgcactccagtctagcctgggcaacagagtgagaccttgtctcagaggaaaaaaacaaaaacaaaaaacagtgaaccaaagtcatccctgaaggctaacagggcacagccttggaagaaatgtgatttgggggtcaggctgaacaaattattcctcaaataagtggttctgaaattcttgtgtgcagcagtatcgccacatctggagtgggtcctgagaatctacatttatttatttttattttttttttagagaccacgcctcactctgtcacccaggctggagttcagtggtgctatcatagctcactgcagcattgaattcctcgactcaagcaatcctcctgcctcagcctcacaagacctaagactacaggtacacaccatcacacccaccta

SEQ ID NO: 131604 - DNA, 1935 bp, Homo sapiens
ctgtgaatgtggttcgctattggattcatcatgggataaacaaaagaactcttgtaatgcagaatcattggggacttccatgccatcagaaactggtgttagtgcttgtgtctctttttctccaactagtctttgttgtgatccatctgtgtactcactggtgacctttcctctccaagaagggggacctggagtcagcccgtcacacctggtttcctctctgctagggtccctcctcccacagagcactggagggcagctgaggaggagctaccttaaaaaaggaggtgtgtgccagggagctgggtaggagcctggctatatatctgcccagcagcggtactctcgggacagagatggcactgatgcaggaactgtatagcacaccagcctccaggctggactccttcgtggctcagtggctgcagccccaccgggagtggaaggaagaggtgctagacgctgtgcggaccgtggaggagtttctgaggcaggagcatttccaggggaagcgtgggctggaccaggatgtgcgggtgctgaaggtagtcaaggtgggctccttcgggaatggcacggttctcaggagcaccagagaggtggagctggtggcgtttctgagctgtttccacagcttccaggaggcagccaagcatcacaaagatgttctgaggctgatatggaaaaccatgtggcaaagccaggacctgctggacctcgggctcgaggacctgaggatggagcagagagtccccgatgctctcgtcttcaccatccagaccagggggactgcggagcccatcacggtcaccattgtgcctgcctacagagccctggggccttctcttcccaactcccagccaccccctgaggtctatgtgagcctgatcaaggcctgcggtggtcctggaaatttctgcccatccttcagcgagctgcagagaaatttcgtgaaacatcggccaactaagctgaagagcctcctgcgcctggtgaaacactggtaccagcaggcccatcatcctggatccggccgaccccaccctcaacgtggcagaagggtacagatgggacatcgttgctcagagggcctcccagtgcctgaaacaggactgttgctatgacaacagggagaaccccatctccagctggaacgtgaagagggcacgagacatccacttgacagtggagcagaggggttacccagatttcaacctcatcgtgaacccttatgagcccataaggaaggttaaagagaaaatccggaggaccaggggctactctggcctgcagcgtctgtccttccaggttcctggcagtgagaggcagcttctcagcagcaggtgctccttagccaaatatgggatcttctcccacactcacatctatctgctggagaccatcccctccgagatccaggtcttcgtgaagaatcctgatggtgggagctacgcctatgccatcaaccccaacagcttcatcctgggtctgaagcagcagattgaagaccagcaggggcttcctaaaaagcagcagcagctggaattccaaggccaagtcctgcaggactggttgggtctggggatctatggcatccaagacagtgacactctcatcctctcgaagaagaaaggagaggctctgtttccagccagttagttttctctgggagacttctctgtacatttctgccatgtactccagaactcatcctgtcaatcactctgtcccattgtctactgggaaggtcccaggtcttcaccagttttacaatgagttatcccaggccagacgtggtagctcacacctgtaatcccagaactttgggaggccgaggtgggaggagcgcttgagccgaggagttcaagaccagcctgggtatcacagggagaccccgtctctacaaaataaaaaaataattcactgggaaaaaag

SEQ ID NO: 131605 - DNA, 1652 bp, Homo sapiens
ctgtgaatgtggttcgctattggattcatcatgggataaacaaaagaactcttgtaatgcagaatcattggggacttccatgccatcagaaactggtgttagtgcttgtgtctctttttctccaactagtctttgttgtgatccatctgtgtactcactggtgacctttcctctccaagaagggggacctggagtcagcccgtcacacctggtttcctctctgctagggtccctcctcccacagagcactggagggcagctgaggaggagctaccttaaaaaaggaggtgtgtgccagggagctgggtaggagcctggctatatatctgcccagcagcggtactctcgggacagagatggcactgatgcaggaactgtatagcacaccagcctccaggctggactccttcgtggctcagtggctgcagccccaccgggagtggaaggaagaggtgctagacgctgtgcggaccgtggaggagtttctgaggcaggagcatttccaggggaagcgtgggctggaccaggatgtgcgggtgctgaaggtagtcaagggccttctcttcccaactcccagccaccccctgaggtctatgtgagcctgatcaaggcctgcggtggtcctggaaatttctgcccatccttcagcgagctgcagagaaatttcgtgaaacatcggccaactaagctgaagagcctcctgcgcctggtgaaacactggtaccagcaggcccatcatcctggatccggccgaccccaccctcaacgtggcagaagggtacagatgggacatcgttgctcagagggcctcccagtgcctgaaacaggactgttgctatgacaacagggagaaccccatctccagctggaacgtgaagagggcacgagacatccacttgacagtggagcagaggggttacccagatttcaacctcatcgtgaacccttatgagcccataaggaaggttaaagagaaaatccggaggaccaggggctactctggcctgcagcgtctgtccttccaggttcctggcagtgagaggcagcttctcagcagcaggtgctccttagccaaatatgggatcttctcccacactcacatctatctgctggagaccatcccctccgagatccaggtcttcgtgaagaatcctgatggtgggagctacgcctatgccatcaaccccaacagcttcatcctgggtctgaagcagcagattgaagaccagcaggggcttcctaaaaagcagcagcagctggaattccaaggccaagtcctgcaggactggttgggtctggggatctatggcatccaagacagtgacactctcatcctctcgaagaagaaaggagaggctctgtttccagccagttagttttctctgggagacttctctgtacatttctgccatgtactccagaactcatcctgtcaatcactctgtcccattgtctactgggaaggtcccaggtcttcaccagttttacaatgagttatcccaggccagacgtggtagctcacacctgtaatcccagaactttgggaggccgaggtgggaggagcgcttgagccgaggagttcaagaccagcctgggtatcacagggagaccccgtctctacaaaataaaaaaataattcactgggaaaaaag

SEQ ID NO: 131606 - DNA, 597 bp, Homo sapiens
catctatgcctgggaaatgggtactgaagaagacgagaatttcatgttggacgaaggcttcaccactgtgatggacctgctcctggagtatgaagtcatctgtatctactggaccaagtactacacactccacaatgcaatcattgaggattgtgtcagaaaacagctcaaaaaagagaggtactggaccactgtttgcccaccaaatcttacagaaaaaaagagagacgggctagtgtaacgtggcatagagttttatggattggctgtattaagcagtaaggctgccaccatagttgagcatcgacctcccacaccaacacagctggcatctcaagttggtggcttatcaaagtcactggggggccatggggcgggtagaagcctgttccttgtttcctaagccaccctccaccttagcttggccttcttgctctctgaagaccatttcagtgctttgtaggagctagcatgggaaaatggaaagaatcttggagactcaagtttaaatcccagctcagccattttcctactgctatgagcctcaatcccttatccataagacaggagtaaactggaacctacgacataggattg

SEQ ID NO: 131607 - DNA, 2177 bp, Homo sapiens
ctgtgaatgtggttcgctattggattcatcatgggataaacaaaagaactcttgtaatgcagaatcattggggacttccatgccatcagaaactggtgttagtgcttgtgtctctttttctccaactagtctttgttgtgatccatctgtgtactcactggtgacctttcctctccaagaagggggacctggagtcagcccgtcacacctggtttcctctctgctagggtccctcctcccacagagcactggagggcagctgaggaggagctaccttaaaaaaggaggtgtgtgccagggagctgggtaggagcctggctatatatctgcccagcagcggtactctcgggacagagatggcactgatgcaggaactgtatagcacaccagcctccaggctggactccttcgtggctcagtggctgcagccccaccgggagtggaaggaagaggtgctagacgctgtgcggaccgtggaggagtttctgaggcaggagcatttccaggggaagcgtgggctggaccaggatgtgcgggtgctgaaggtagtcaaggtgggctccttcgggaatggcacggttctcaggagcaccagagaggtggagctggtggcgtttctgagctgtttccacagcttccaggaggcagccaagcatcacaaagatgttctgaggctgatatggaaaaccatgtggcaaagccaggacctgctggacctcgggctcgaggacctgaggatggagcagagagtccccgatgctctcgtcttcaccatccagaccagggggactgcggagcccatcacggtcaccattgtgcctgcctacagagccctggggccttctcttcccaactcccagccaccccctgaggtctatgtgagcctgatcaaggcctgcggtggtcctggaaatttctgcccatccttcagcgagctgcagagaaatttcgtgaaacatcggccaactaagctgaagagcctcctgcgcctggtgaaacactggtaccagcagtatgtgaaagccaggtcccccagagccaatctgccccctctctatgctcttgaacttctaaccatctatgcctgggaaatgggtactgaagaagacgagaatttcatgttggacgaaggcttcaccactgtgatggacctgctcctggagtatgaagtcatctgtatctactggaccaagtactacacactccacaatgcaatcattgaggattgtgtcagaaaacagctcaaaaaagagaggcccatcatcctggatccggccgaccccaccctcaacgtggcagaagggtacagatgggacatcgttgctcagagggcctcccagtgcctgaaacaggactgttgctatgacaacagggagaaccccatctccagctggaacgtgaagagggcacgagacatccacttgacagtggagcagaggggttacccagatttcaacctcatcgtgaacccttatgagcccataaggaaggttaaagagaaaatccggaggaccaggggctactctggcctgcagcgtctgtccttccaggttcctggcagtgagaggcagcttctcagcagcaggtgctccttagccaaatatgggatcttctcccacactcacatctatctgctggagaccatcccctccgagatccaggtcttcgtgaagaatcctgatggtgggagctacgcctatgccatcaaccccaacagcttcatcctgggtctgaagcagcagattgaagaccagcaggggcttcctaaaaagcagcagcagctggaattccaaggccaagtcctgcaggactggttgggtctggggatctatggcatccaagacagtgacactctcatcctctcgaagaagaaaggagaggctctgtttccagccagttagttttctctgggagacttctctgtacatttctgccatgtactccagaactcatcctgtcaatcactctgtcccattgtctactgggaaggtcccaggtcttcaccagttttacaatgagttatcccaggccagacgtggtagctcacacctgtaatcccagaactttgggaggccgaggtgggaggagcgcttgagccgaggagttcaagaccagcctgggtatcacagggagaccccgtctctacaaaataaaaaaataattcactgggaaaaaag

SEQ ID NO: 131608 - DNA, 2123 bp, Homo sapiens
ctgtgaatgtggttcgctattggattcatcatgggataaacaaaagaactcttgtaatgcagaatcattggggacttccatgccatcagaaactggtgttagtgcttgtgtctctttttctccaactagtctttgttgtgatccatctgtgtactcactggtgacctttcctctccaagaagggggacctggagtcagcccgtcacacctggtttcctctctgctagggtccctcctcccacagagcactggagggcagctgaggaggagctaccttaaaaaaggaggtgtgtgccagggagctgggtaggagcctggctatatatctgcccagcagcggtactctcgggacagagatggcactgatgcaggaactgtatagcacaccagcctccaggctggactccttcgtggctcagtggctgcagccccaccgggagtggaaggaagaggtgctagacgctgtgcggaccgtggaggagtttctgaggcaggagcatttccaggggaagcgtgggctggaccaggatgtgcgggtgctgaaggtagtcaaggtgggctccttcgggaatggcacggttctcaggagcaccagagaggtggagctggtggcgtttctgagctgtttccacagcttccaggaggcagccaagcatcacaaagatgttctgaggctgatatggaaaaccatgtggcaaagccaggacctgctggacctcgggctcgaggacctgaggatggagcagagagtccccgatgctctcgtcttcaccatccagaccagggggactgcggagcccatcacggtcaccattgtgcctgcctacagagccctggggccttctcttcccaactcccagccaccccctgaggtctatgtgagcctgatcaaggcctgcggtggtcctggaaatttctgcccatccttcagcgagctgcagagaaatttcgtgaaacatcggccaactaagctgaagagcctcctgcgcctggtgaaacactggtaccagcagtatgtgaaagccaggtcccccagagccaatctgccccctctctatgctcttgaacttctaaccatctatgcctgggaaatgggtactgaagaagacgagaatttcatgttggacgaaggcttcaccactgtgatggacctgctcctggagtatgaagtcatctgtatctactggaccaagtactacacactccacaatgcaatcattgaggattgtgtcagaaaacagctcaaaaaagagaggcccatcatcctggatccggccgaccccaccctcaacgtggcagaagggtacagatgggacatcgttgctcagagggcctcccagtgcctgaaacaggactgttgctatgacaacagggagaaccccatctccagctggaacgtgaagagggcacgagacatccacttgacagtggagcagaggggttacccagatttcaacctcatcgtgaacccttatgagcccataaggaaggttaaagagaaaatccggaggaccaggggctactctggcctgcagcgtctgtccttccaggttcctggcagtgagaggcagcttctcagcagcaggtgctccttagccaaatatgggatcttctcccacactcacatctatctgctggagaccatcccctccgagatccaggtcttcgtgaagaatcctgatggtgggagctacgcctatgccatcaaccccaacagcttcatcctgggtctgaagcagcagattgaagaccagcaggggcttcctctggggatctatggcatccaagacagtgacactctcatcctctcgaagaagaaaggagaggctctgtttccagccagttagttttctctgggagacttctctgtacatttctgccatgtactccagaactcatcctgtcaatcactctgtcccattgtctactgggaaggtcccaggtcttcaccagttttacaatgagttatcccaggccagacgtggtagctcacacctgtaatcccagaactttgggaggccgaggtgggaggagcgcttgagccgaggagttcaagaccagcctgggtatcacagggagaccccgtctctacaaaataaaaaaataattcactgggaaaaaag

SEQ ID NO: 131609 - DNA, 1129 bp, Homo sapiens
ctgtgaatgtggttcgctattggattcatcatgggataaacaaaagaactcttgtaatgcagaatcattggggacttccatgccatcagaaactggtgttagtgcttgtgtctctttttctccaactagtctttgttgtgatccatctgtgtactcactggtgacctttcctctccaagaagggggacctggagtcagcccgtcacacctggtttcctctctgctagggtccctcctcccacagagcactggagggcagctgaggaggagctaccttaaaaaaggaggtgtgtgccagggagctgggtaggagcctggctatatatctgcccagcagcggtactctcgggacagagatggcactgatgcaggaactgtatagcacaccagcctccaggctggactccttcgtggctcagtggctgcagccccaccgggagtggaaggaagaggtgctagacgctgtgcggaccgtggaggagtttctgaggcaggagcatttccaggggaagcgtgggctggaccaggatgtgcgggtgctgaaggtagtcaagggccttctcttcccaactcccagccaccccctgaggtctatgtgagcctgatcaaggcctgcggtggtcctggaaatttctgcccatccttcagcgagctgcagagaaatttcgtgaaacatcggccaactaagctgaagagcctcctgcgcctggtgaaacactggtaccagcaggcccatcatcctggatccggccgaccccaccctcaacgtggcagaagggtacagatgggacatcgttgctcagagggcctcccagtgcctgaaacaggactgttgctatgacaacagggagaaccccatctccagctggaacgtgaaggtaatggctcctctctgggctgtcaagggcttgaaggtcagaacgacagataaactactcagtatttactcattcagttctgtgttgatggagaacagaactttagagtcaccgtttaagggccagctgcaccacccatgggctccgtgaacttggacaaattctttggctctcagagccttgggtttcttaccttcaaattcttgttctcctttcctttctttttcccataatttactggagaatcagtt

SEQ ID NO: 131610 - DNA, 457 bp, Homo sapiens
cgcaggacactgtttagtccccaccaccaagaagcctctcaccagatgcagcaccttggatttctcggcctccagagctgtaagaaataaattccttataaacaacccactttcaggcattctgctataagcagcagaaaacggactaatacacacgccttgtctccaactagaagctcctccacccactaattatggactgttttactacttggcttccaggagggagggaactgtatgaaaagaacagagatgcataactacatacagaaatggttcccaagggggctgagagctgtgttaaatgtgagctttaaatgttttttaatgatttttatcctcagaaaacttggttcaaatgcagtcttgctggatgcatttgctggatgtccaacaagtgaaacaaatgaaaataattattaccctggggcttcactgactgagagtgaaggaggct

SEQ ID NO: 131611 - DNA, 778 bp, Homo sapiens
agagtaagaccctgtctcttaaaaaattaaaataaaataaaaagtagataaaatctatgtacatgggtggctgaatagaaggaagggagtctgtgacaatgatgtcattggggagatgccctgggctggtttcttttatttatacttctcttaacttgaagaaaataacaactattcttttttgggttttttgctatgggcagctgaatgtaaccctaattttgctgcctaaaaatattttgttacattatctcatatcacaaccttgttattaaaaggtatcagtgctgcccctctgctgcctatatagattttgtcagtagacttgaccagtgaagaacttgaccagctggaataaagaagttatgagaaaaaagcataatttcaatgtaatttgagtgtaagatatcatcaagaatcaaatgattcaagacctctgtcctcctgagcagtaagttgaagaaaacctggcatccagatatgttcttcaatttacaattaggtttctgtgtatagttagcagctttcacacctcttgcagcctggccattccttaagaggtgaaaggcattgagaaaaatggcatattatatacatccgaaaagtcgctgtgtttctccttgacagtgtcagcctgcctgtactccctgtaaaatattcattaggaatggagacttcatggtgcttactggtgacatgttacaagtgttcaggaattgctttcttgactttgtgtagcacagaatcattcctacggtggtggtgagagtattcaggc

SEQ ID NO: 131612 - DNA, 506 bp, Homo sapiens
gccacgttcaccatccctctcctccagagccagcttcagaagagtttccaaaactattgtcaggtctccagctccagcctagtgaggggccctccttccaggcctggaccccaccagggagagacctatcatagaaggcagcacaggtggccgagagttgaggacatgatgggggcaaaggtggctggggccttggcttcgtccatccccatctggcattttcagaagttcttctttatatctcactgctatctttccttgctgcagctgcagcccaggattagtttgaggacttctggtcatttgcaggagagtttaagccaaaccaaactctggcctgatctccccacattgccccccactcacagggaccccatactcaagagacaatttgggttcttgaccctggcaccaaattgcattcgttcccactctcagccctcaaataagcttcctgtgtgtcaggcactgtccctgttccttccagtcagaccgtccagccgagc

SEQ ID NO: 131613 - DNA, 293 bp, Homo sapiens
atgcaaaggctgaaatacacctgaactcatccttctggggcaaccagaagtcatagaagggtttcgggtagggaagtggtgactgggtttccagcagcacccagttgagaggcaggtgcagagtaggcaccttggagatacttgttaaatctcagtccagccaggtgttggtcatcacccagggcagacagcagcaagagatgggcaggagggagggcatggcgcagactgttcatggaggacttctgagagcacaaggaggaggtctcaagctgggtcacaagcctgaagca

SEQ ID NO: 131614 - DNA, 383 bp, Homo sapiens
gttgtatacagtgcatcctaggagctgtaggcctacccagtaaaatgctgtcaaaataggccaagcagcagggcacgcagaggaagcgggctttgttgtgtactctggcattggcagttgtcagagaacaggcagagagaaggaaagaagacccctcctaagtccagcagaacctgactgagcggaaccggggctgggccgggaattgtagatgagagaattcttatcttgtgcgtggatagggagcagacaagtgcaggttggtaccttggccaacaggccctgggtgaagagacagccttctcttcatcctaaactggaaaaatgagccagagagacacaagacaccacaaagtaagagaactggaaattcctcctaaagt

SEQ ID NO: 131615 - DNA, 728 bp, Homo sapiens
ggtaacagggcatatccttgcctggtttctgattttagcagagatgcatttattttttcaccattaattatgatactaactgtagggtttttggagatgtcctttatcaagtgaggaaattcccctctaagttcgctgcacatttttattaccaatgtttcggttgttataaaatacttattcatgatggattgatttatatgaattgattttcagatattgaatagacttgaatacctgaaataaatcccacttgggttgtgatgtgtacctctatttttatacattgatacgatcaacttgctaaaattttttgaggattttaggtaggtctgtgtaataagagatgttggtctgtaaatttctttggttacctctttgtcttgtttcgctattaaggtaatgctagcctcatagaatgagttaggaaatattccttcacttttattttctaaaagaggttgaagggaactagcataatttcttcctttaagatatttaatgtttggtagaattcaccagtgaacctatttgggccttgtgcttttttggaaggtttttaattattgattcaaaatcatcagtagttataggcctactcagattatctatatcttttggtgtgacttttgtcaaattattttaagaaatggtcaatttcatctaagttatcaaattggtgggcatagagtcatttataacatttctttacttttattttaatgtcc

SEQ ID NO: 131616 - DNA, 348 bp, Homo sapiens
cctgctgcagccccagcagaggggctggcctgtcgccttgagcccacctgtgccggcctgtgagtggccccaggaggaagccagcgcaaggacaagacccagcctagacaggaaacctcctgaggccaacctaaaatttactaaggaataaaaaatgacaagaagcagaaggcaagggaatagaataataaacccagagagtaaaaacgaacaacatccgggaaaaaaacccatgttagaaaacagtttaaaaatattagccaggcgtggtggctcatgcctgtcatcccagcactttgggaggccaaggcgggtggattagttgaggtcaggagttcaagaccagcc

SEQ ID NO: 131617 - DNA, 112 bp, Homo sapiens
gctctttttcattatttatgggtttactaatcttatttttaaataaatatttaaatgtgttatttttaatttctaaatatagaaatgcataaaccttcactatcttattata

SEQ ID NO: 131618 - DNA, 324 bp, Homo sapiens
tttagagtctacaacagtttcttcctttttaaaattcagtaatagactgtgttttccctgtgtatcttacaggattgttgtaaagatcaaacaaattaataaatgagcaaatgttttgacaattaacttacaattaattagcagtggcttggtattgagggtgccatctctcctttaatctccacaatagttctatgcagcaggcatagcttgatccctttgacaacttgagcccagcgagacatcgggtgacttgctagagcttaatagccatagagcaggacagccaggattcaaaaccaagcctcctgattctaagtgctt

SEQ ID NO: 131619 - DNA, 942 bp, Homo sapiens
  misc_feature (678)..(678): n is a, c, g, or t
catgtgaagaaggatgtgtttgcttccccttccaccatgattgtgaattttctgaggcctccccaaccctgtggaactatgcttttacaaaatctgagtcataaattacagatattcttgatgaaaattcagaacataggatttattttcaaaaagaaatgtaccccaaaagaactctgagagaatatactcaactgtcctgctgtgattaaacaagactgctgtattttacctgagcttggcaaagcaaggatatgaacaattgtgcaggtgggctactcagggcgagtgaagagataaggcatccaatcagggattggccacctgcagccctgccaatatgcccctccaccagatttccgtaatcccagcacgggagactgccagcaatgggagaaattcaatgggcagaaacaaagagaagaacaaggaagtcgagaatttcagaaattgaaaagggataagaggaaggagaaaatgctgggctggtgtgaagcgatagcccgtaaccctcacagaattccaaacaacacgcgaacacccgagatctcaggggatttggctgacgcctcacaaacctccacattgaatgaaaaatccccagggcgatctgcaaagtcgatcaaagttacattttcacaaaggccaagcaggccaacaacaagggaacaggctccncaggagccagtcaacggttgtctgtcttgtgccatcccactccgggaacatcttgccgaaatccgtcacttgcgcaagggggattgaaggagaggccccccttaataaacctggtgtggcactggggaacatgcggctttgggcccaacaagtcctggctccaccggggttaaaggtcaaataacagctgtgggatcggagagttgatctcatggaacccgcaacgctcggcatgtgggaaacgtaggacaggggggaaaagcg

SEQ ID NO: 131620 - DNA, 788 bp, Homo sapiens
gtaaaacaatgataattcagaaatttcataactatccttgccagctttgatgtatacttttatgctgtatgggaaaaaaatcaaaagaagatcctggggattacatttgccccccttcccaaaaacaaattatctattagaggaaaaagtttttatgttaagtggctggtctggaaaagttagtatgccagatttcttgtttataataagaatgtaataagtaagatctcttccaatggctaatggttcatattaaattagaaaacctgaattcagttaaaaagaacatggaatgggaggacaaggctttcagaatggtgatataagcaccttggtagactctctcccaagtaaaataagaatttaactcatgaaatacattttttaaaaaataccaacaatataaagtctctgaaaattgaagaaaaaaatccagccccatatagaaaagactatacatcattgtcaattatcaaattaaccccatataaaaagaagtatacatcagccgggtgcggtggctcacgcctgtaatcccagcactttgggaggccaaggtgggcagatcacctgaggttgggagtttgagaccagcctgaccaacatggagaaacctcatctctactaaaaatacaaaattagccaggcatggtggcgcatgcctgtaatccaagctagtacttgggaggctgaagcaggagaatcacttgaacctgggaagcggaggttttggtgagccgagatcatgccattgcactccagcccgggcaacaagagcaaaactcttg

SEQ ID NO: 131621 - DNA, 727 bp, Homo sapiens
tgcggtggctcacgcctgtaatcccagcactttgggaggccgaggcaggcggatcatgacgtcaggagatcaaggccatcctggctaacgtggtgaaaccccatctctactaaaaatacaaaaaattagccaggcatggtggcaggtgtctgtagtcccagctacttgggaggctgaggcaggagaatagcgtgaacctgggaagcggagcttgcagtgagccgagatcacgccactgcactccagcctgggtaacagagaaagactccatctcaaaaaacaaaacaaaacaaaacacaaaacaaaaaattattaaagttttgtttggtttttatccctatttttgtgccataattttcatcgtttatgtataaacatataaacatttaaaatacatttttgatttttttaaaaagaacaatttgattccttgtgtagaaacattggtatttctatctgtgataaattaattttctaatctaataaatagtgtgggtaattggttaagaatattaacataatggcctattccctcagtcattttatttatctagaaactttacacactatatcagatatcatgagaaaaaagttgccgactatatcatgacctttgcactcaacactgcctatatgttttctactaaaaatgcctctttgagaggcaactgaaaaccacagaagttctttatgagtttattctctcattttataattctaggtccaa

SEQ ID NO: 131622 - DNA, 125 bp, Homo sapiens
gggcatgcagatatctctgacatagtaattttatggaaactatgttaggtaatgcatgttgtaattagctagatttaaccatcccataatgtttgcatacttttaaatgtgattttgtacctgat

SEQ ID NO: 131623 - DNA, 421 bp, Homo sapiens
ccatatctttcctgatgttataaactcttaaagactctgacaagtaacaatagggtgcataaacattgaagttctaagcactaaaaaagaaagctattttaaacaaggcgttaaagatgtttatatgtgttaaattttatgggagctgtataaggttaatatgaaaacgattttttttaatggctaaaaatactgatgaacgaatcatcccctttaatgcataagccatttgtcttgatgcataaaatatgttaataatacaaaaagatgtagagttggcatttggcatgattcctttggttgtttgttttccttatgtttttttaacaagaaagttttctctctctttcccaggtgaagttataaaaggtgactccatatttcatatcaatgtgacctcaaagcaaatctacaaaaaaga

SEQ ID NO: 131624 - DNA, 381 bp, Homo sapiens
caggaatacaatcaggaatacatacacacacatacacacacacacacacacagctgaaataaaaacatttcccattaagattcaacgaggtctcacagggcctacttcttggtcatataagggctggcaggtcctctctgtgggctggagaaaagttttgtttccccagctgcactcacgggggaatactctgcaggcactgcattgtgaacctgtttggcttggctcagaggcctgtcagcacattcaggaagtgaagtcagaaagaggcaggatttcaaacagagccagctgcacacaaatgcccaggcagtgaaatgccttattcgagcagggtgcctatcagcctggcttgccctaggtgctgtcaaagaagcctct

SEQ ID NO: 131625 - DNA, 738 bp, Homo sapiens
tcttgcatggtcttggaagagactgagctataacagcagagaagctaggaaggaaatgggaatctgaggtctggggcagaaaatccttacctaaaagaacagaagaaaaatggctaaagctggaggtgaagccaaaaaccatgcaggtcccaagtgccaataagaatagcaggtctgagcctcagacaagacacagcattgcttaaatatcctgtggcaagggagtcactccacaggcccagcctgaagacattaccgctgacatttcccattaacgtcacaattttcctctatgaggtggtgaggtggagtgggaagggctgttagctggcacttgcaactttattgcgccagcaagaacatgcatacagcccagtctaacgtacaggatcaaaaaggtaatgacagtgtgactttgagtcagtttgagtcagccccagtttattcatctataaaacaagattaaaactaatgcttggccaggtgcagtggctcacacctacaatcccagcactttgggaggctgaggtgggaggatggcttgagctcaggagtttgagaccaccctgggcatcacagggaaccccgtctctacaaaaaataaaaaaactagccaggcatggtagtacaagcctgtagtcatcacagctactcaggaggctgaggcaggaggatctcttgagcaggaggttcttcaaaaggtgactgtgagggcagggtacagtggctcatacctgt

SEQ ID NO: 131626 - DNA, 537 bp, Homo sapiens
tttactcctccttcacactgcagagtttatatcctccggggactctcttctttctaccacctcccacagatgaaatccttcccctacctctgctgaactgatatcccccagctggagaaagcaggcaataccactgacagcaggggagaagcacggctgtaaaaactttgcatgtcagcatgattataaaggaaaacccttgcttggccaggacgatcatattttgacttcatgtggtatttttctctgaattggttggaatacttcaaccatggaaatagtcttccctttccttgcccagagttaaagagccattcaagaatgccgatttcatatatttccttgccagtttaataacctcaggggtgagagtagacagatcaaacttggatggggaagaagaatgtagccttccatcatggcacccagacaacgagacaggccctgcgctacaaaccaccagcaacacaaggagggggatggctagaaagcagcaagagaatagaacagttacaccggacccagactggagaggag

SEQ ID NO: 131627 - DNA, 532 bp, Homo sapiens
tgtccagaatgagtgctatgacagccccaaagcattctggtgggtaagtgtaggttttgaacttgtccttgaaagatggggctttggataagcaaaggagagcagcaagggcattctaggtaggaggaatgatatggggaaaggtttggggataagaaaatacaaaatatttaggaaagatagcagatcacttttgacatagaagaacggaaaataggtcagaactttaatgcttctgatcaaagataattgacaatcttctagaattaaaatagaccatggtgtgattagcgggaaagaagtgactatggaactaatgaatgttaggaccagattgtggagagttttgagtgtcaggtttttgggattcatccacgttgttgtgtatgacctcctcccttgctgaggagtattctattgtaatacacacaatttatccatctgctctcctgttaattaattaacaagggtcatttccaggttagaggtattacacataataaagttactctaaatattcttgtataggtca

SEQ ID NO: 131628 - DNA, 222 bp, Homo sapiens
  misc_feature (20)..(20): n is a, c, g, or t
  misc_feature (22)..(22): n is a, c, g, or t
gacggattttcactcttttntncaggctggagtgaaggggcaagatctcaatcacttgaacccaggaggcagaggttgcggtgagcggagatcttgcattgcactccagcctgggcaacaagagtgaaactctgtgtcaaataaaaaaagaaaaggaatatggcaggaaattatgaaatggaacactgtataataggaagctagcaaacttaaagtactttg

SEQ ID NO: 131629 - DNA, 719 bp, Homo sapiens
actttttacaaatttttgtatatttctttgttatgtacttcatagaacacatacacaaaatagaaaaatttgaaaaatgagataaaggtacatagatcactactttaaaggacaggtgaaactgaagggaaagtgatataacatttatgaagtccctcctgtgtgccagacttttgatatatattatgcctttgaatcttcaaatagctctgtaaagaagctgtcatgagttttccattttgcagatgagaaactaaatggcaagacaaataaaatcatttccccacagtcttgccacctgtagctgccacggctggaatctggacccaagtaagctggctccggagcccactgcccaccctgaccactcctatgtcatacaggaagcatggagctggggaaagacccatttggtttttgggggcaacaggctgagtggaggggctgcacgatttgtcaagagccctgaatgacggccttgaagccaagcagcaggtatgattctcaaaccacaggcacagttgggccagatgtggccatttctttcctttaaatcttcactgctcagagtgcagtccagggaccagcagcttcaacctcacctggaagtttatcagaaatgcagaatcttggccccgctacaaacctactaagtcagaatctgcatttagcaagaataaagtttgagaagcctcaaattacttaaactcatctggtct

SEQ ID NO: 131630 - DNA, 471 bp, Homo sapiens
gcatcaagctgttcgttgagtgtgtcgtggtcttctgtctactaatagatgacaactctggaagcctagtaccactcttaacagatgaataagtacagcatggactagactgccacaggccatgctttcttttaataattctagcaccagtgattgatttaggaaaaacaaaatactgatgattacttttaggctaaagcctgctgacacttctgtcttaaagatactgaaagagtagttgtatttgttaagtctggacgtgaggtaaacatggactttagaattgaattgagactagtatcatttaacgccagctggcaggctgcttatcaagcttataatttggtagccagaggtaaacggaacttgagccactgaccaaagagagccctggaatggttttcctctgtgttttcctaatagatgatatctctggttaactaatagatactaatttctatagccattgtc

SEQ ID NO: 131631 - DNA, 508 bp, Homo sapiens
aaagttggcgtgtttgtttcctgcaggggagaaaaagaaaacttaaaaagttggtgtgaagaacattttagggactactaaggaacttttgagtatggactaattgttggattttgttattattgttaattttctggttaatcatatgggaaagtgtttttgtttgggggaggtggttttgaagtatttaaaagtaaaagggccaaattgattttagcctctctaaacaaaagaaaaatgtgtatattaaggtataaagatggagaaacagagtgggtttggttagatgttaacagttgatgagtctaggtgaggaatatattgatattctgtgtactccttcaattttaacataggtttgacatttttcataattaaaaattaattccttttagacttactttaggtgaaatagtgtaactttggtccataaatttccaaatccagtagtaagatcaatgttatttattcatgttaaatcaagatatactgtatgttaactgtaact

SEQ ID NO: 131632 - DNA, 132 bp, Homo sapiens
tcaacttattccttctttattgctgatggtatgatcttatagctagaaaattccaaagattccttcaaaaatctcttaaatttgataaatgaattcagtaaagagaagattccaaattggaaggaaaataag

SEQ ID NO: 131633 - DNA, 753 bp, Homo sapiens
ggggagctgaagagggagaactgcttgagtccagaagtcaagtatacagtgagccaaatggtgccactgcactccagcctgggcgacagagcgagactctgtctcaaaaaacaaaaaccaaaaataaagaaaatccattgtctacctatattttatttttcacacctaactttggtggttaaacttattgaaggccatggcaaggactttactgcattcctcacaacaccaccattgagctcttaatcctcagaatgtgcattaatttggcaaaatatttatgatgttgcatttttctcagtttttcagagtatctcatctactcagtaaagacattggttcattcataagaacgaacaagtccaaacataagtggaaaaaatgtatgaactgaaaaaaaaatctatatcaggtatatcctcacttagaaatgattgtcagtgaagctgggtgctgtggctgagggctgttaatcccagcactttgggaggccgaggcaggtggatcacttgaggccaggagttcaagaccagcctggccaacatggtgaaaccctgtctctactaaaaatacaaatgttagctgggcatggtgacgcacacctgtaatcccagctactcgggaggctgaggtgggagaagctcttgaacccaggaagtagaggttgcagtgaggcgagattgtgccattgcactccagcctgggcaacagagcgagacccctgcctcaaaacaaaaaagaaaaaaaaagaaa

SEQ ID NO: 131634 - DNA, 359 bp, Homo sapiens
gaaacttcaaaaggtatagatcacctgattgaagcatttctgatttatttaatattttttcattatatttctgtcctcctacaagggaaagtcatgattacactaaccgagctaaaatgtttactagcagacacccagtcatcttatcacatcttaaaatcatggtaggatgtcttctggtattacatcatgctgatcatgtggacatgctggctggagctctccagctgacacagagcagggttctgtgctgtcttcttacaaagtggaatttgacaatcattgcaccatgccttggaacatcctgaaagccagcataaacacatcctctaatcccgggacatcagtttccgatccca

SEQ ID NO: 131635 - DNA, 496 bp, Homo sapiens
gactgcaacagatctgagaagactaagcagaaatgacaagtaaatgcaatgcaggcgcctggacaggatcccggaacaggaaaaggacattagtggaaaaactgcagcaattatttgaataaggtctgtaagtcagttaacagtgctgtgccagtgcaaacctcctggttttgatcatcgcattacgagttatgcaagatgtcaacattaagggaaacagggttacagtataggggaactcttgtagtatttttgcaactttttttaaagtctaaaatttgttcaaaatacagtgtttttgaattctgcttattatatgcctagatttcaatctggaatgcatcgtttcaatattaagagtctcatctgtcaaaaagagaacacacaatttgaggtagcacaactagtaagtaaaatcggaacaggctcaatacctgaaaagtgtattattctaaacacacgggctgggcgcgatggctcacgcctataatctcag

SEQ ID NO: 131636 - DNA, 134 bp, Homo sapiens
gtagtaaaaaagactgtctcgctcttctgctgatttactaaatcactggatctccttcagtccaaatcaccaccaagggtcctggtgttttcataaagatcagccatctcattgatctgagacgccatcctacc

SEQ ID NO: 131637 - DNA, 474 bp, Homo sapiens
gaaattatgccaaagacaataaagaataaagaagataattgagcttgccctttaagaatgtgcattaaaaaatactcttactggtagagaaatatacaggattatatgcattctggaaattataaaaacatagagataaataaggcacaaaagagactcaagaaattatgttgcatttgtttgaaatttattgtggtgctgggccgggtgcggtggctcacgcctgtaatcccagcactttgggaggccaaggcgggcagatcacgaggtcaggagatcgagaccatcctggctaacacagtgaaaccctgtctctactaaaaatacgaaaaattagccgggcgtggtggcgggcacctgtaatcccagctactcgggaggctgaggcaggagaatggcgtgaacctgggaggcggaatttgcagtgagccgagatcgcaccactgcactccagcctgggcgagactctgtctc

SEQ ID NO: 131638 - DNA, 181 bp, Homo sapiens
tagaacagggtctgaaatgctcaataaatatttattgagtgcgtgtatgtggacccaggggtgtgtgtccatatgaccagtgtacactaagccataggacgtacccgtgccgcctccttggctatcactaactataaatacttggagacagactacagttttatggcctttctgcatgggg

SEQ ID NO: 131639 - DNA, 596 bp, Homo sapiens
ggggaggtgaacccagaaccaattccttcaccaaagctgtggaaaaacaagaagccttggcgatccatgcactgttcagccagtttacaaatttggtccaaaacgaggtcagtgatctcctggccaatggtgtagtgccttcaggcatagttactggaagcatcttccttgcctgtgatgagctgctcagggtggaagagctggttgtaggtgccagtgcaaacttcatcatcaattaccatgggtttcaggtctagaaacactgccctgggcacatgcttgccggagcccgtctcactgaagaagctgttgaaggagtcatctcctccccgagtgttcttgtcacttggcatctggccattgggctggatgccatgttccaggcagtagggctcccagcaggcattgccaacctggacaccagcctggccaatgagatggagatgcggtcacgcatgattactgcttcacggctgccgaggcgatggtggagacaaggagagattgttgcttcttacagtgcgactcttaggtgattgatataagagaacctgcctattattttctttccttcttctaaggcaagagtgacactt

SEQ ID NO: 131640 - DNA, 621 bp, Homo sapiens
cagcattcctacttggtactgtaatgtgaaacattttaggtataacaagacttccagaccattataatgtacattattggataatgtaaatatgttgatatgattatatttaaaataaaagaaaacatttatttgttattaggaaccaagactttcacagtgagagaaaagaggtacaaacaaaaaacaaaagaacaaactgtgtacaatacatctgaattagaaataatatgaactacatcatttctgaagatatgacagtaatagaaaatcaccactttgtaatcccaatgtctcactgatttacacaagcatcttcaatgaacactaaaaccactagatgaaatgctgttaggaaacagaatattcatagtctcaaaatatcaccccacagttttgttactaattgcaaacaggaaatgtatctttacattggagagatcttatagcccctacctttaccaagtaacttggtatctattgaatctagaagctaggtactaatggataccacttctctctaaacaaaccaagtatagtatgattccactgacatgaaatatgcagaatgggcaaatctataaagctagaaggtagattactagttgcctaggtacaggg

SEQ ID NO: 131641 - DNA, 442 bp, Homo sapiens
gacagggttgaagttgagagagaaaaacgagatcatttaggaacagctgaagaatcaaaaacagcaaagcacaatgggtagaaattccactagaatttgaagtggtgaagtatatgaaaagaaaatattttaagcaagaatcctaatataagctgcagataaattaaatgtgataaagaatatgctctagaattttatcttccatcattacacagaagaaccttaagagcatctgatatttattgaacaaagaaagcatggacttcaataatctataaggctttaaaaattcaaccaaaatttgataattttaagttacattttttccctagagcactatataatagcatgtcctaggaaagacagatgtgggcaagtttcttttctaccaagagtgtagaatagtttacatttctgatttaaaaagcagttccgttaacac

SEQ ID NO: 131642 - DNA, 980 bp, Homo sapiens
caacagttgcacgggcctcaagggtgtcacgcgacatgaaagacactcatctcaggccacacaggattccatctattgaacattcctgagacaacggaattctggcgatggagcacagcccagtaaaggcgccattccccattttacagctggggaaactgagttacagagcttgtctgcactgagtcatcaggagcaaatgctagatcagtagggtctctctctctgccacccaggccagagtgcagttgacgcagggcaggggagccccgaagtggagcatagtgtgtccggaactggtgggttcttggtctcactgacttcaagaaagaagccgcggaccctcgcgaaactcctgggagggcagaggcatgcctgccatcttcatcattgcattaccaccacccaacactatcaggggacctgccctgataatcagtctacaggtgtatccagcagctccagagagacagcgaccagcgagaaggggccatgatgatggaggtggttttgtcaaaacgaaaatggggatatgtagggaaaagaaagagagatcagactgttactgtgtctacatagaaagggaagacataagagactccattttgaaaaagacctgtactttaaacaattgctttgctgagatgttgttaatctgtagctttgccccagccactttgccccaaccactttgacccaatctggagctcataaaaacatgtgttgtatgaaatcaaggtttaaggcatgtagggctgtgcaggacgtgccttgttaaccaaatgtttgcaagcagtatacttggtaaaagtcatcaccattctctcatctcaataaaccaggggcacaatgcactgtggaaagccgcagggacctctgcccttgaaagctgggtattgtccaaagtttctccccatgtgatagtctgaaatatggcctcgtgggatgagaaagacctgacggtcccccagcgcgacacc

SEQ ID NO: 131643 - DNA, 275 bp, Homo sapiens
ggtcggttcagcagaagattaaactgagcacagcatcctgttccctcaaactgtctgtagggtctctctctctgccacccaggccagagtgcagttgacgcagggcaggggagccccgaagtggagcatagtgtgtccggaactggtgggttcttggtctcactgacttcaagaaagaagccgcggaccctcgcgagacggggtcttgctctgttgctcaagctggagtgcagtagtgcaatcacagcttagtgcaggattgacctcctgggttc

SEQ ID NO: 131644 - DNA, 731 bp, Homo sapiens
  misc_feature (474)..(474): n is a, c, g, or t
caacagttgcacgggcctcaagggtgtcacgcgacatgaaagacactcatctcaggccacacaggattccatctattgaacattcctgagacaacggaattctggcgatggagcacagcccagtaaaggcgccattccccattttacagctggggaaactgagttacagagcttgtctgcactgagtcatcaggagcaaatgctagatcagtagggtctctctctctgccacccaggccagagtgcagttgacgcagggcaggggagccccgaagtggagcatagtgtgtccggaactggtgggttcttggtctcactgacttcaagaaagaagccgcggaccctcgcgaaactcctgggagggcagaggcatgcctgccatcttcatcattgcattaccaccacccaacactatcaggggacctgccctgataatcaggtaggttcttttctattttcctaagcgtcgactgncttgagaaataaaaggacagagtacaaaagagagaaattttaaagttgggtatccgggggagacaatacacattggtaggatccgtgatgccccacaagccacaaaaaccagcaagttttcattagggagtttcaaaaggggagagagtgtatgaataggagtgggtgacagacatcaagtacttaacagggtaatagaatatcacaaggcatgttgggactgggtgagatcacagtaccacaggatggatgtgaat

SEQ ID NO: 131645 - DNA, 710 bp, Homo sapiens
  misc_feature (453)..(453): n is a, c, g, or t
cctaaccagggatgggtctgggtgattaaggaaggttggcttcagaactgggccaggggcactgctttgcttttgctgttttgatcagctctctgcctgaaggagacaagaaaaaccaacgggaacagctggggaaactgagttacagagcttgtctgcactgagtcatcaggagcaaatgctagatcagtagggtctctctctctgccacccaggccagagtgcagttgacgcagggcaggggagccccgaagtggagcatagtgtgtccggaactggtgggttcttggtctcactgacttcaagaaagaagccgcggaccctcgcgaaactcctgggagggcagaggcatgcctgccatcttcatcattgcattaccaccacccaacactatcaggggacctgccctgataatcaggtaggttcttttctattttcctaagcgtcgactgncttgagaaataaaaggacagagtacaaaagagagaaattttaaagttgggtatccgggggagacaatacacattggtaggatccgtgatgccccacaagccacaaaaaccagcaagttttcattagggagtttcaaaaggggagagagtgtatgaataggagtgggtgacagacatcaagtacttaacagggtaatagaatatcacaaggcatgttgggactgggtgagatcacagtaccacaggatggatgtgaat

SEQ ID NO: 131646 - DNA, 662 bp, Homo sapiens
tggatacagcatagacaccttcccggcatgtaaactcctgggagggcagaggcatgcctgccatcttcatcattgcattaccaccacccaacactatcaggggacctgccctgataatcagtctacaggtgtatccagcagctccagagagacagcgaccagcgagaaggggccatgatgatggaggtggttttgtcaaaacgaaaatggggatatgtagggaaaagaaagagagatcagactgttactgtgtctacatagaaagggaagacataagagactccattttgaaaaagacctgtactttaaacaattgctttgctgagatgttgttaatctgtagctttgccccagccactttgccccaaccactttgacccaatctggagctcataaaaacatgtgttgtatgaaatcaaggtttaaggcatgtagggctgtgcaggacgtgccttgttaaccaaatgtttgcaagcagtatacttggtaaaagtcatcaccattctctcatctcaataaaccaggggcacaatgcactgtggaaagccgcagggacctctgcccttgaaagctgggtattgtccaaagtttctccccatgtgatagtctgaaatatggcctcgtgggatgagaaagacctgacggtcccccagcgcgacacc

SEQ ID NO: 131647 - DNA, 172 bp, Homo sapiens
actgtgtgacttgatggaattacttaaattctctattcatatataaaatatacagcatcaaaactactatgctatatatctatatagtactaagcaaattgaccaaaacgatactgcttttaaattacgtgtgttgggccgggtgcggtggctcacgcctataatcccagca

SEQ ID NO: 131648 - DNA, 705 bp, Homo sapiens
attgggagcgaagaaaatgacaagattaaaagagtaaccagagactttgtggagttgtaaatgctgatttttaaaaattgacttaaaggccttaagtgtaataaatggtaaaagaagatttaaacaggagtagaaggaaaagtaaagaatatatctccattctcaatggggggaaaaagccttgctataaactgtattacaggaatactttcattatgtaaaaacctattttgttttcatgtcattcttagattacatcatagagtggctgcagccatctcacactatattataaataaatcactggcttaatcatagaatgagccagggcctcagatttaaaaggaaaacattagatcatttttaataactgatataactcaaaccagttggcattgaaccacggtgaggtgatctcatcctgaagaagtccaaaaaggacccaaagcaggtcagagctgagcaggtcccagagacacttccatttacagatgaagaggttgctaatggcacctgagtagaattcacccctggactagtcttgccattaaaatcaacacttactttccagtagtgatgcccaataagccttccccatgaaacacagtggataaaggttttgttcctagagccactatatttccaggtatcagaaaacatgagcacattatgatgtttgtagttaggccttgggagtcattatgc

SEQ ID NO: 131649 - DNA, 307 bp, Homo sapiens
ccatttctccaaaaaaacccacaaactgtgtagtaactgagtctctcagcaatatactcaaagctaagaggatttttttttaaagtcctcagatgcagttaaggaaagccctgctacatacaggttaatcaatatcagtaataccccttgactctaggaggctggaagatatcctagtaaccccactcacatcaattgtttcaagtagcctttttccagtttccaactcatgagtaaagataatattttgtggctaggtgtggtggctcacacctgtcatcttagcactttgggaggtgaaagtggg

SEQ ID NO: 131650 - DNA, 297 bp, Homo sapiens
ctcccaggttcaagcgattcttctgcctcagcctcccgagtagctgggactataggtgcacaccaccacacctgactaatttttgtatttttagtagagacggggttttaccatattgaccaggctggtctcgaactcctggcatcgtgatccactcaccttggcctcccaaagtgctgggattacaggcgtgagccacagagcccactcttaatgatggcatcagttgttgtggtcagctcgccccaacttttatggttttagttcttcaatttgattttgttatcaacactctag

SEQ ID NO: 131651 - DNA, 839 bp, Homo sapiens
tcagtggaaacaacatatttacatccagagaaagttgttattgcagacgtgaatttggtttagtgaaagcctttgctttgctaaaaaataaaaattttaaaaattagaaaaaaattctaagtaaggaaaataagttcttaaaaaatgatgctctatgtaatgaagatacctgttttaggctttgcttgtgtatttagcaactaggaagttagagaagcaattaaagccactttcttaaaataggaaagtgttaaacatacagaaaagatcaaagaatagtacagtgaacacggagatatactcctgctgcctatagttaacgataaatattttgccaaatttgcttcacttgtttgtgggttttgtttgtttttgttttttactgaatcatttcagtgtgaatgggcatcatttcacttcacatctgaggctttgcaggttgtgtctcctaaaaataagaatattagagtctggggttaactgttgtaggttaagaagtcaacttcttcttaagtgatgccacagctgatcctttttcacagctgtttcacctgtggtttcttttaatttcagcaaaaaaaaaaaaaaaaaaaaaaaaaaaacacttgtgttggggcgcgtcgtgggcctgagaaaagttttctgaaccaccatcccttggggcgcgcggggcccgaggggatatggtaactgcggcaacaaacggtccccaggaaaaccgggccgaacaacgggggtggtgttcccacaaaaaaaaaggcgcgggaacgagcggttgcgcacaatccacaagggttccgaggcacagacgaccaccagggacccagggatgaatatat

SEQ ID NO: 131652 - DNA, 755 bp, Homo sapiens
  misc_feature (3)..(4): n is a, c, g, or t
  misc_feature (6)..(8): n is a, c, g, or t
ggnncnnnggctcaggcctgtaatgccagcacttcggtaggcggaagcgggcagactgctcgaactcctgacctcaagtgatccacccgccttggcctcccaaagtgctgggataataggtgtcagccaccgcacccagcctggagtggccttttatgagaggggacccgtcaaatctgtgccttatggaggggtccggcagcggccacaattgtcttgtcccctcaccccccaactccccctggaacacctctcccaggcaagacattttcacagcaccattcacaacggttgggccaaaaagaaacttttccttcatcatttcctgcactcgctgaccacaactttggacaccccaggctgccacccctccccacccgttcacccccaggatgctgttgctgtaggacgcctgctgccctggagccctccccaggatgtgagccagtcccctcgctggtacggaatgccgctgggtgcccggaggcggccatggtgtctcgatggacggcagccaggatggagcacccatgggtctcacggccatgcttcagggtcttcaggtcctgcccccggccagtctgccaagaggcacccccttccccagcctctcgcctgcactgatgcagacaaaatctcacctggcaggcccaacccccaccccacccctcccccgccgtgtgtggcccctcgccgcatcgttggggttttgttacgtgaaaatatcctggaaataaatacatgtttctgcactt

SEQ ID NO: 131653 - DNA, 664 bp, Homo sapiens
cagttaaaaatatataatttgctaataagaagtgtcatataaaaataacctatttgcttgattgcaaggcttagtataattgttatttcagaaataagtaaatggaatataaatacatttattatagtttcttattgtaataagtgataattaatatttattatttgagacttgctacatgctttaaaaattatattctctaattctcacaacattgtgaggtaagttttttgttactgatttcttatagatcaggaaatcaaagatgggattgttcatatgacttgctcaggttgactcaacttgtttaaattgtggatttgggaagtgactgtgatctttatgttcttaactggcaaactaacatgcccgtcccttttatcctttaacagaggtattaagtagtcaaggtgctaaattcttattaatggaaaaaaaatagatgaaagtgattgtcatcattagggccttggagaaattgctaagtatacagaggttctttggtattctttcactttctttttacgcctttcccttttgttttccttcaggcatatagcgatcttgtacagtctttggttgttcaaagcctcccactttttcactctgctgagattatatcttactgctctaataaaaattctgatcttcttcatggatgatc

SEQ ID NO: 131654 - DNA, 314 bp, Homo sapiens
gctaggaagaacaaaaacaaatgattagagtcttcatgattacggatttgtttggactttgattactaactaaattaataatttatttttataagctaacttcagcttaaaatcatttgagcttatgtgcaaggtaaatatgtttgaatttttaacactttctatgtaatactagggaaccccatttgacaaatttagtagaaccatcattaatctacatagattattttattgaactaaaagcaattattaatattcgttaagtgccaggcagtttacacacacacacacacaatttatccctctaaccttat

SEQ ID NO: 131655 - DNA, 296 bp, Homo sapiens
caaaaaacttgttatatcctgagttgggtcgaaaagtcaagaggtggctaaattcctaaaaataaaactggtgtggtaactgctaatagctcaattccaaaaggtaaaatggatgattatgtaagtgcctggcaaataaaaattacgtatctggttcaagaagaattgtcttctaaagttagtaccacattttaaaaatgtggtgaccagaaagaaattttaatccacacctcttgctcttccttatcccaatgtgctttggctaaaatcacttcactttcaacttgctgtttaag

SEQ ID NO: 131656 - DNA, 424 bp, Homo sapiens
tcagtgtcatcccccttcgtggccttggtttattcaccaacccaacattcttgaaacattctcctctcccttgcctctttaccaaaaactgaaactgtcgagggtggactcaggtctctgatcctttcctcaccattgctgataaaagtagtagtagtagaaggtacccttacccttgatccagcacagataatatgccaggaaccatgttaagcattttacaaacctggttgcaaactatctggggctatttagttaggattttcctcctctcttccatcactcaaacaggtaggtatataggaccctctttgtctctgaactctaggaggaaaaggaatagagttagtggagggatgaagccaagcatggcagaaagacaattctgtctgtaagaagcttttgcttttccaaaagctggttg

SEQ ID NO: 131657 - DNA, 434 bp, Homo sapiens
ccatcatgactgtccccagtgagtgtcctttactattcttgggagtgactcctgtctaacttttcatactggcgagaagaaaagaagcctattttaacactttagtggtgttgaaacacattacttactttctgaagatgtcccagtgaatcctctgtcaattcactgccatatgtaatctatatgataaggaatgcatcttccttctaagtactgcccaaacccttgccagctcctctcccattgtcccttcatgtgaatatttcttggctaccttagtggaaatatagatcagtcttctccccatccatcctctcaaacataatgagattgtttactttttagatttatgcagtgaaaatgcccagtcaggtctgaatcgtcagtgcattatattgactctgagcactttagaatttagagttgcaattgaa

SEQ ID NO: 131658 - DNA, 620 bp, Homo sapiens
aggggaaatttaatttacaaattaattaaacaaattattattttttaaaagcatcagcaatatcagacttgacaaaaaaattaccaaagataatgaaagatatgaaactgaccagaaataagattgccatcattttcccaaaagtccacataaccaacagatcatattcacattacagggtagttctcagagatcatattctttatgtataaaatgtggaaaataacataataacataatctactacctaaggtaataacgtgcaaacccactttataaactgttaaacaccacaaaatgtgagttactatgaggaaactatgagggaggcggtagagctactaaagaaaaattctgattaagtctagatgcttttcaaattagaacacaattgaataaaatggaataggaagctattttgtgatgctatgtaagaggaaaggagataaagaaaatagaaatttattgaatacctaccatatacaagacagcgtgttgatggcttacatagattttatttaaacttaaaaataaactgatacttatatgacacctacattaaacatactttttaatgaaagcttagcattgtgagcagtaaaacacatatatattatgtg

SEQ ID NO: 131659 - DNA, 860 bp, Homo sapiens
caagcgattctcctgcctcagcctcctgggtagaggggattacaggcacccgtcaccacacccagctaagttttgtattttttcagtagagacagagtttcacctggtctcgaattcctgacttcaagtgatccaccccgctcggcctcccaaagtgctgggattacaggcatgagccaccgtgcccagccagaaaaaaatcattctttatagtcaaagcttaaatgcttcatgacccatcttcataggagagtattctttttatgctctgttccctgatttggtgactgtgagaactcttatataacatttatgaagtgcttacacagcattaagagataggcatgaaaagatgactacatcttgcctcagccctgcaagtacctatgggagagtgacatttaaatgtatacatgtagctaggtgtggtggctcatgcctataatcctagcactttgtgaggctgagacaggaggatcgcttgaggccaggagttcagaccactgtgggcaacatagggatctcatctctacaaaaaataaaaaaaaaaaaaaaaaatttttgcgggcgccgggcctgaaaagtctttagaccaatcgtgtggggggggcccagtagtttaatggacctgggcaaagctgcccaaggaaacccggctcagacggggtttgtttcccccataaaaagcgcggggacccggttgttgacacccaagggcgtccgcgctcactggtttcacgggcccgcgtcgatacccgctcccgcccctcgtgggcaacacacccacgaacaaaagaatataatcaacacacaaacagaccatctaatacataacacaacaagagccaaacatcgtatga

SEQ ID NO: 131660 - DNA, 670 bp, Homo sapiens
ggcgatctagaggatcctctctggatgaaagtgtcatgatatggcacatcaaaagatgaccccaaaagccctgcccatttttaagagagggattttaaacccattagtgataaattatctagtctctttattttatgtaaaggaaccatctgtgaaatatttccaaaagctgaaaaataaatataaagccccctctacttaagaaaccacatgaattgccatttagcaattatgttttagagatttatttaaaacaaagagagaaaaagatgtttcttaatttattttaaaatatttttagaaaatttggcataagaaatgaataatatagtgacatctaaactagttttaatttctcttgtctctttccactgcagtctacacttcacactgccaacaaagtgatcttcctaataaagtgtagacctctcagaagagtcttcaaaggctttccaagtccagtgtcaagctataggcatacttttgtccagcaccttgtatcccaaccttctgttatcatgatttctgtttctggcctctgcaatttccaagcttttccatcaatttcaaatgcttgttttctctacatccatcccacttcttggcctaaatctttctccacaatgagagtccaattcagatacttccttctttattaaatcttcctttt

SEQ ID NO: 131661 - DNA, 267 bp, Homo sapiens
atgttttacatcctcctcccatgaccctacaagaaaggtattacagccgccaccgtacggacaggacaccgaggcccagcgaggctaagacgcttcctcctgaagggacatagcaatcctgttattcaccaaaggtagagaaggcaaaacctaaatgcttcctctaaatcccacttccgaggtatactttccagatctccaccccccaaaaactgacattgccacacacattcataggggcctctgactctcctttgaaaatgcaag

SEQ ID NO: 131662 - DNA, 348 bp, Homo sapiens
tccaagaggctttagcttttcccattaggatacttattccaggagcctttatgctgggctaggaacttaatgagtaaaagacaaatagtggttccttcccactaagattccatctctcagtgtggtaaaggaacaaatgtcccaggtgtagaaaacaccaaactaactccacttcaaaccatgctccatcctatgcctagtgccattccctggctctctgtctgtctccacccctgacatcctcggccttcattctgggggccatccatgctgcctctctcctagtctgtggtgactttggaggctcagttgtcttgaatctctgtcttcccaaattcactgccttat

SEQ ID NO: 131663 - DNA, 259 bp, Homo sapiens
aaatgacttgtctggagtaacaggagtttagtctggagtggccttgctcctgaaagacccagtttcctgaggtcatccctgaggcctgccaggtgatataatagctttctttatggtttgagctgagttcctgtgaggccttggatgggcagagactctcactccaggaccctcatgctgatctttccctgacatggtctccatttcctgcacccaagggagcctctcgcctttggaaacacggtacccagccacagat

SEQ ID NO: 131664 - DNA, 423 bp, Homo sapiens
atttccttatctaaaatagtggtttgtttaaatgatgaagcaaagatggcattggagctgttggctgactgtccctttttttctgctaactgcagaagcacggaatctgatgccctactttgtggggtaatggtgtgcttatctccccctcctcaaacagagtttggcacgttgctaataacagccagcctactgctaaaatatcaatgacagaacagaagaaatagatatttaggaaaacataaatcaaagctgaggaagtaggcaaaaaaaaagcactgatagaaagcaaataaagaaagatctataatattgggacaggcagcatctccctgctcacatggtaattttctttagccagtaaccaacgaggatgcctgccatgggaagaaggtgtgattttgtgatttaatgatccaaagc

SEQ ID NO: 131665 - DNA, 653 bp, Homo sapiens
cattttgtagatgtaggttgggaaaacctgggttccaaatttcctgttgaaaggcaaaataaggctgtgagatggtgtgtaatgagtcaagactcagagggccaaacctggaagtcttttttatattacgtaggcttatattctgccaatcagaattcattcctttggtctacaatctgtgagaaagatttagaagttcaacttttgttcccaagaaaatagccagtgttttgaacatctcatattatctttaatagagccttttggtcaccagaccattttattctatgttcacacattgaaaactctcacccttccctgacagagataatataaagtcacacctggtcactgattgtcgctcagagtccaagttctgtacgtaccatcagatccagatgtgaccctctgtagttaggagacctataaatttaaaaggtagattatctgcctctctctagcacgaggactgaatatgcaatgatggagaaggcatagaatacacataatgaatgcccccattcattatattgtataattctggacagcaatttaaatctcaataggaaggaattttaataaagttcccaagcacatgctgggagtgcagtaagcaccttcgctggatgaattctgcccactagacagaaccc

SEQ ID NO: 131666 - DNA, 383 bp, Homo sapiens
gtgaagagaaagcctgattcagaagatggaaaaatcgttctgaaaaaaaagagatatacccatgtgcaatatttaaaacagggagttaggtagggtggaacacacctgtagtcccagctactaaggagggtgagatgggaggattcattgagctcaggagtttgagaccagcctgggcaatatagtgagaccccatctctaaaaacaaatagtaatacaataaaattgtgatatacttattttttaattaaaaaaaattcaaggcaggcatggtggcatgcatccgtagtcccagctatgtgggaggctgaggcaagaggattacttgaggccaagagtttaaggctgcagtgagctgtgatcataccactgcatcccagcct

SEQ ID NO: 131667 - DNA, 669 bp, Homo sapiens
atatggtttctttttaaaaaatttaaggctgggtgcagtggctcacgtctataatcccagcactttgggagaccaatgtgggaagattgcttgagcccaggagtttgggaccagctgggaaacatggtgaaaccctgtctctaaaaaaagttaaaaaattagctgggcgtggtggcacacctacagtcccagctacttgggaggctgaggtgggaggactgcttgagcccaggaggtttcggctacagtgagccaagatcacaccactgcactccagcctgggagacagggcaagactctgaataaaaaaaaataataataaaaagtttttaagtgaaattcacataagatgaaactaatcattttaaagtgtatcattaacagacaacctataggatgggagaaaatacttgcaaactatgcatctgacaaaggtctaatatccagcatctataaggaacttaaacaaatgtgtaagaaaaaaacaatcccatcaagtgggcaaaggacatgaacagacacttttcaaaagaagacatacatgtggccaacaagcatatgaaaaaaagctcagtatcactgatcaatagagaaatccaagtcaaaaccacaatgagataccatctcacactagtcaggatagctattattaaaaagtcaaaaaataac

SEQ ID NO: 131668 - DNA, 462 bp, Homo sapiens
tgcccactgcaactgcagaccatggatgccacaaatcatttatatggacctcccaacactggtaggactgtatttgtgttgggggaggaggtggcactcaaatcctgaacaaccattcaccagaatccatctgattgtccaggtccctgaatcctagagtggtgccgatgtcttacaatttatgaatgaatgtattagacaagaggtaatctttaagttccttttaaggcctaatccattaagctatatttagaccatcagactaatcatctggtttttatgacattattttgttaccaactttagatccaggtttgttctgcttgcatgcagtaaaccaatcactgtgatacgggttttgcaaaagagaaaagatttattcacaaggctgccaagcaagaaagcaggagaacagtgctcaaatccaccttcccaaagataagccttagctatatttacggg

SEQ ID NO: 131669 - DNA, 296 bp, Homo sapiens
ccgtgagggttaaacgacagagctctaggaatatacctcactctagctgttgttgctggtcctgggagcgtaagtcgggcggggaagggaaatggggcatcaccaaggggtcctctagcagtgccttaggatcgggagaggctgctgtggctgggacccagtctcagacatccagagccttcagaacttaggggccccaaggaagtcactgaagcttcgtttgtgggggatgttgctgtttccagaacactctcccacctcctggattccgtcgggtgaggttttaaagtcatact

SEQ ID NO: 131670 - DNA, 493 bp, Homo sapiens
cagagtcaaacagtgcctgcacagtacccaataaaggcttgttgaaagaatgaaacaatctgtaaactaaaatcaaatttaaattttttttttttggagaaggagtcttactctgtcgcccaggctggagtgcagtggcacgatctcggctcactgcaacgtctgcctccctggttcaagcgattctgtaacctcagcctcccgagtagctgggattacaggcgcccaccaccccacccagctaaatttttttttttttaagtagagagggggtttcatcatgttggccatggttggtctcaaactcctgacctcaggtgatccgcccatcttggcctctcgaagtgctgggattacaggcatgagctaccgcgcctggcctcctgtaaaatagtatgatgaaatttgcttttaattttaaatgaacacacagctccaagtcaatgttaggttctgggccaatatttggtttatgttacacctttcctattaa

SEQ ID NO: 131671 - DNA, 441 bp, Homo sapiens
ctggagaagcatctctaggctgtgtctcataatatttgatgtccattcctcatctgtcgctggctttgcgaatccaactatagtgaatacttcattgtgccgcttttcaaggaatgggacttctgtcttgcatccctgagcgtaagctcttgccttggtaacctgccagggaccctagcccctctgggctggaagcttgccttgcagttactagtccctccccttcaggataaagggccatacctatgcaagcatggtaaacaatatgcaaacactcaagtctctatcccctgttaacttggtccctggagagcacataactaggggaagtccttgttctgggagagactccatttggaagcagctcacatgataaagctccagaaattttaatggaccacaatcttaaaagtgagctaacgcagggcgtggtggctcacg

SEQ ID NO: 131672 - DNA, 598 bp, Homo sapiens
cagagtgagaccctgtctcaaaaaaacgttaagctcttactgggggagaagacaaaaaacagagggtactatttaattagctaccagattaatgccaaagaggcaagaataatttcacagaggagtaggctttttcgtgacgggattggtgaaaccctctgatactgctactgctggttggtggtacacaccttgagcaagggttttgattttggggctttgagtggtaatcagtatccgtaatactctgcttcctcagcaggttcctttgatcccctcctgtgggcttcgtcttacccttacacagtttcctaaactttggcgcacattggaattgcctggggagatttaaaaattcttcatgtccaggtcacatcccacaccaattatataacaatgtccaggattaagaaccaggcatcagtattcttaaaagatctccagccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcaggcgc

SEQ ID NO: 131673 - DNA, 515 bp, Homo sapiens
tcagaggatctccgtccagtaaggtgtgcccagttgcaatggatttggctaggggaggcataggttaaactggaatttctcttggccagcgacaacggagctctccctcaggtactgggcagcatgtgagtcttggcaaagagaggtgatttcttttttcttaagtgcattttactcagccgttgccagtccgttaataagtcaccagaggaaggcaggacctgggaactacatcagcaaaccgcagcaagcaccataaagacaaaagttcttatagaacaaaaagaaaaacttgaacttgacgtgaaagatggaggaagcagttctacctctcttctatcacttttttcagcgccctgtaaaactgtttttttctatccttccttccctctcaaggccctaccttctcagcataattgatcgcagcaagctctttccaacttgacactgaagagcagcgacccctttggcttaccctccccatttcttttcctggttcgcttcagtgccctgga

SEQ ID NO: 131674 - DNA, 819 bp, Homo sapiens
cattcttttacaagtcacaagttacactttatatattggacccaaagactttgtttgaattaagtcaaccttctaataaggcagaccattatcaccttaatccaatttacaaaatattatgaggctgggtgggcgaggtggctcacacctgtaatcccagcacttttgggaggccagggtgggcagatcacttgaggacaggagttggataccagcctggccaacatagcaaaaccctgtctctactaaaaaatacaaaaacttatcagggcatggtggtacacgcctgtagtcccagctacttggaggcacgagagtcacttgaacctgagaggcagaggttgcaatgagctgagattgagccactgcaatccatcctgggcgacagagtgagactctgtctcaaaaataaaatcaaataaaataatttttaaaaataaaacaataacaaaacataatgctaaggcatcagaatagttgttttgccaaagtcacacaatcatgataaagactaaaactaaaaatcctaaataacaactgccactttctccctagggattgagtttctctacaatttttatatagggtacaaatctaccttcaacctcatttacttttaataggaggcacccttacaaattactccaaattgctatcacctggtttcttggaagctataaaaatgtaatttcttttgaaaatggctttaggtgtatatcctgaactacctttttccctacaattatgcagtttcttttcttatttctgtatgttctaattttcttgttcaaacaacattaatagagcacaaaatatgtg

SEQ ID NO: 131675 - DNA, 300 bp, Homo sapiens
gtagagagcctcttgctgcttgctggtagagagaaacagtttttaaatcattttgtggccagtttgctttttgtcctatctaagctttactgatacctttagtcagaactgttactcatcttgaagcccagggctaatggaaagaatttttttttttttttttttttttttttaacaattgtactgtacgtggtaaggacaaagaaaagcttatgtcagctagtaaacactgttggctttttaattttttatttctttaaatacttatcctacaatagtactccaaacctcaccatcaca

SEQ ID NO: 131676 - DNA, 268 bp, Homo sapiens
taataatattcctgatctttaaaaaatatatcaaggtatagagctcttagaatcagtgtagaaaagcctgttagactggattttcaaataatagagttctcttcccttttagacaaagctatattaatccatcctttcattcattatcatgcattcacacaatgattcaacaagtacttactcagtacaatgtgccaggccctgttctagatattaagcatataacagagaacaaaacaaaggtctttcccttgtagagcttactttc

SEQ ID NO: 131677 - DNA, 442 bp, Homo sapiens
cttgcctctgttgcggcatagatgtcttgcttgccagggcaccgtgcccagtgctaggtcagatatgaatgcttacaggacgaggccctcttcttgaggacttccctctccttccctcccctctactctgctgcctctccgagtagctgtcaggtcactggtaggtaccagttgtgttgggttacatggtggatacacgatggagtgctgtggctaacagggtggccaaaggcaagacgtttcccctttctgacctttcctttggcagcctctgggtggtggtgggcaggaggtgtgagggagacattgagtttgaggtatggaatgaccgtgcgtggctctcggagccagcccgatctgcgcctgcctacgctgccacacccacaggctgtctacatgttactggaaacccaagcatgagtttcttctgcaaaatggaaga

SEQ ID NO: 131678 - DNA, 791 bp, Homo sapiens
gtatttaaaacggacttttatttttaaagtatttgttgtttatctgaaattcacgttcacctgggcatccagtattttatctggctctccctgcagcctctctgtggagcagctcggctgccccctggcggccatatggcctcatgacgcccaccggacagccctgggtggagggggcagcgcaccaggcaggcttctcagggggcttctcctctcagtagacacctggggaagcagaggccaaggaggagcagtagcctggcaggagcctggggatccaggcctgggggagatcggtgggggccaggcccctcgccctaaactcgtggatcccaaagtgaggtccacagaccagcggcatcagcatccgcggagcctgttagaaatacagattctcaggctcctccccgacctcctgaggctgaggcttcggggtggggcccggccccaagcgctgctgatgcccatccagacgtcagaactgctcacaactctgccagcacaggtgcctttattatcccatttcacagatgagaagccaagggtcagaggagtgaaggagctgcgcccgtggccaccctgcgaccctcaggtcagagctcctggcggctgggaagaaaaacaaatctggggcctcagcctcctgcacctgcccggagggacaccagcattcatgtcagaatgccacagacccccccgccctgagaactgggaaccaccttgtgcggcttccctcactcctcaggaaactgaggccagagaaggaaatggcttgcttgacgctgcagagt

SEQ ID NO: 131679 - DNA, 431 bp, Homo sapiens
cacattatcctctcaagtagctgctactatggggactacaggcatggcaggtgccaccacgcccagctaaatttttttgtattttttttgtagagctggggtttcaccatgtcacccaggctgatctcaaactcctgggttcaagcaatatgctcacctcggccttccaaagtgctaggattgcagacccgttgtcagtttttttagtcttagcctatctgataggtgaaaatttctatcttatttgaagatttgtttctttaattattaagatttagtatattttaatgtttgtatttttaaaatgtttatatgccatttgcttttattgttttgtttagtaattttcatttattgcttattctatcctccactggtttttctgttggtacctatattgaatatgtgaactctttatatattaatggtat

SEQ ID NO: 131680 - DNA, 343 bp, Homo sapiens
ccacagccaccttttctaaaacccttccaaatgcctggcttttgctaggaactctacaagcgttccttcaggtaatcctcctaacaacttttgctattacccgtagtccttctctccattatatggtgaggaaactgagactttgcttcatatgactccattttccccaacacttcctgctagcctgttttgctcctttgggagtatgagagtcagtgtttgctggactgtgaggctgaagatgataacatttcttcaaattggcctgtttttttttttttttttttttttttgaggaaaaaaaagatattcaggggccaaattttccccaaaaggggggaca

SEQ ID NO: 131681 - DNA, 426 bp, Homo sapiens
ttgaaaatctctacccaaagtagcaggtgcttaagatacttttttcaaaaccttaatctgaagattcacaatagagccctcttaccttttagagaatgatgcattttgaaaactagatctccacttctaatgcattttgttaccttggtgggctcctggggattcaaattttgttaccatattaacttctcttttacagtaaaatcactgtttaaagtatgggagtggaattctatgttgaggaacactcccaaaatgtagaactagtcatggagaaggctctgaagagttttcagatagatcttgcaatttgaatctcaacttgaataagaaagatactggtatccaatttcggaatgtttcccaagacttttttttcttttaaaggatactctcttgaaagataaaaagaaaatttcatttcat

SEQ ID NO: 131682 - DNA, 454 bp, Homo sapiens
cagtgtctttgggtggggattcagtacagcccgggctgggacctctgtgtggggactcacgggccgccagcagaatgctgttcgtgtggccgcaggacagaggctccgtgtccttgctggctgatgctgtggccgctgccacacctcaaggcaccaagtcccagccccgtggcccctccaacctggcagccgacctcagggtggcagaagaatcttctggtatggagaacctctttttaaagatgtcatttgactccatcaggcctgcccaggtaatctgcctgttgttaaaagtcaaatattacaataacaactgccaagcctcatcacaggtgatggccccaggtgtgtgtgaacatgagcacatgctggaggggaggccatgacactggcgaggctaggacactggcgaggctaggacactggcgaggctaggacactggcgaggctagga

SEQ ID NO: 131683 - DNA, 239 bp, Homo sapiens
tccagactttcttttctgtacacacacacacatacacactcactctctctctttctcactctctctcttaaacacacgctctctctcactactccctctctctctctacccccctccatccccctctattttctaaacaaaacaatctccactgcgttggctccataagtaccactatctctgtttgttagtttgtttgtttgtctgtaagtacgatagtatatgagacagcataatca

SEQ ID NO: 131684 - DNA, 443 bp, Homo sapiens
cacggttgcctttcacatggacttcctactcttctttcctcttcctcttgcccctaccctgctgtcctcccaatttagtccctctttatccctaaggaagtcaagagttggtcttcaccaacacttagcctcctgcaactgcctcctaaggctcatgggacactaaagcaagcatagttaagtactctaattataaacagcttgagcttgacttacccagataatgaagccattttgtatgattttccctgattgatttctctaaaagatttcctgttctccatcacactttgttatataaatgaagaaccatcatagaatgtaaatacaaaatctggagagccacagcaggaggtagagctaggagaaggaggaggcaatggtgggtcttgagacaagatagttacgaacatgagaatcaaacctggtaatcatgatgcctg

SEQ ID NO: 131685 - DNA, 301 bp, Homo sapiens
atagctcactgcaacctggaaccctggcctcaagcaatcctcctgccttgacctctcaaaatgctaggcttacagccatgagccactatgcctggactgtctttttactcagagtaagcagggacagggaagaccagagggagagccctaggacaggcaatgttggcgtcttcccctaccctagctgccctgagcctcttgctgtgcaggtccctccttagggagaggcctgatcccattttgtcattagtcacaaacaccacttactggccatttgcgctgggccctgcactgttccctc

SEQ ID NO: 131686 - DNA, 494 bp, Homo sapiens
attatgtcttttttgtttaacaagttacttatttacttctcaaggctagctaggggcctggaatttcccttgaaggaactcagaaatttcctttgtttccatgcttggggtctcgtaaaaaaggggatccctgctctgtctcagggtcttactgaccctcactccagcccattctcaaacaccctaccctctttaaaaatttctctggggttaggccgggcgcagtggctcacgcctgtaatcccagcactttgggaggccgagacgggcggatcacgaggtcaggagatggagaccatcttggctaacatggtgaaaccccgtttctactaaaaatacaaaaaattagccgggtgttgtggcgggcgcctgtagtcccagttactcgggaggctgaggcaggagaatggcgtgaacccgggaggcggagcctgcagtgagccgagatcatgccactgcactccagcccaggcaacagagcgagactccgtctc

SEQ ID NO: 131687 - DNA, 370 bp, Homo sapiens
gatctggtctcttgtctcctgatctaatgctctttgccctgtacaaggatgaccctgaaatcatctcatctaaaagcaatgcaagcagacttaccctggcaattgagggttagtcttttctttgtacacagatagtttttggttaagggaagagatatttgtctgtgtttcttaccccatttgagtttattctcagctgagctgccaaaatgatccttgtaaaagctcagccagagagtgatacccctatactcagatccctgcattgttccccatttcactcagagaaaaagccagagtaggtacaggtccagaggcccagcatggtttggatgttcatttcccagctgccctcctctccttctttctg

SEQ ID NO: 131688 - DNA, 548 bp, Homo sapiens
ccccctctccctgccgctgtccgcacacgggaagaggaccccactgatgtgtgtagtgtggcaggctcaggggctgcctggcgggcccctttactctagcctgctttccctctttgtaaagtgggaccagtcgtgctagccccacacagggctgagggaggagacggccgggtagggagatgctttgcgcacagcccttttcctggtcactgggccttctctgcttcccccagacatccttggggatcgctccaccctgtcctctgttccgaggtcaccatccaccaggccttctctgactcccctgtttgaaattgcacccataaccctcgagcaccctgcccttctgactttttctccccagcactccttacctccccacccactacgttgtgtcccatttgggtttcctctctgcttccctgctatttccccagaacccaaaacagctcctggtgcctggtaggtgctaagtgagtgagtggcgagtgacggggaggcatccgcgcaggggtcggcctctgcgttcacaagggccttcctgcgtg

SEQ ID NO: 131689 - DNA, 437 bp, Homo sapiens
catgtcatggccacgttactatggctggtcttctctgcttggctaccttaaagcaaaggtgtatttttggttctgcggtactgccggagagaccaactgtcatgggaattctggaggaaacttagaaatgaatctataaggccccatcttataacatgacatgattaattggaagttttctggatcgtctgcatgttaagagggagcataggatagcagatttgctgggttcatatctacttcttagttgtttgaccttggctggtctcatccctttgtcccagagctgtcatctgtaaactggggatgataatagaagcagaagggcttgtttccaaggcaggttgttaagaactttttataacttacaaggtcggccatgaaccctttttgctcttaagagtccaataaaaatgagaattttctaccccagagat

SEQ ID NO: 131690 - DNA, 375 bp, Homo sapiens
gcctgctgtgtattttcagcctcttcattactttcctcgggaggcccggctacagccagcttatgctatctttactgtaaaataggtgcctgtttattttcccatcatacacacgcaaagataacaatgatatattgccggttccttaatctcttctcttttcctttatagaaccttaggggatacaaaattatgcatacaaaggatcataaaataccaagtgcaatgtaaacacagttgccacttacttcatctgttatcatagatcaaagactgcttctacagtaagagaagcgcatttccaattcaggtgggactcaccttaaaatatgcgagtggagggagtccccttattagaaacatttggttcacaag

SEQ ID NO: 131691 - DNA, 251 bp, Homo sapiens
caagtgcaaaactccttctcagataaataaataaataaaacatctcttttgatgtcattctctgtagttgagctggtaaggcagaggatttggatcagatctctttaattggcctttatttatttatttattttttgagacagagttttgctcttgttgcccaggctggagtgtagtggtgcgatctcggctcactgcaacttacgcctcctgagttcaagtgattctcctgcctcagactccctagtagc

SEQ ID NO: 131692 - DNA, 389 bp, Homo sapiens
ccgggttcaagtgattctcctgcctcagcctcctgagtagctgggattacaggcatgcaccaccacagccggctaattttgtatttttagtagagatggagtttatccatgttggtcaggctggtctcgaacctccgaccacaggtgatccgcctgcctcagcctcccgcagtgctgggattacaggcacaagccgccgcgcccggccatgtatgctgttcttaagtgtgaagctggaagagttagttgttctccaaatcaatgcttccttactttttttcaaggcattagtagaaactgatgttttcctggtacataaggaagaggaggctcacaactggagggtatcagagatctttcattgctctaggcctaccaggctggtccaa

SEQ ID NO: 131693 - DNA, 250 bp, Homo sapiens
gaggagagatcatgagctgcaagtcaggagggaagaggaggtcctggaggtttgagcagagagaagaaaatgtgaaccagttctgacagtgggggattactgcctagagaaatgttacagatcaccaggaatcccagggacctactagaacacaacgtggacagctgattccagccacgttctccggctcaaccagaatcagaggtgcttgttcccaacaaaacaacactgggttctgcccagagtgtga

SEQ ID NO: 131694 - DNA, 706 bp, Homo sapiens
gaatcctgaggctcctgattccaggcctttgctcctaagctacatttccagacctaccctgcgccagaagggaatccactgctctgatgggtcagatttatcctggcaggattccccacctgctgactaaagtgcccttgggctttgagtaaatatcagtggtagctaagcagttctggccacaggccttgggcaggatccaatactgtactggtctgcaaagcttcaggtgtgacccagtgcactgccatctgtggtggccatgggagtgctcatgtcacccttccccccaactccagacagcccagtggggagagagattcctgactgggggaaagagaagagacaaagtgagagatgttgcctgggtaaccggggaattttcccttatcttacccaaggccaccaaagatacaggagtatccaggagttggcaacagttgcaggggtcataggcttagggcaccccctggtatacatcagctgcagagaccgtaggcttaagtcacagcacttaatcccctttgaatatatagaaagccttctcaaggaggatgggtacaaataagtccagactgtaaagacttggaataaatacctaactcttcaatgtccagacattgatgaccatccacaagcatcaagaacatccaggaaaacattatttcaccaaatggactaaataaggcaccagtgaccaatccag

SEQ ID NO: 131695 - DNA, 270 bp, Homo sapiens
ctcagggaaatctattttgctaatattacgggggcagatgtcaaacaatagtgacctaaaatgtcaatacgagagtaaagaatgaaacaagtgaggtaccacaaataagacttagcagatgtttggctgaagtgagcagttaagagtatacggtcaagaaagggttttctggtggtaggatttattatgtttaaagatcagtggaaataatccagatgaaagagagtttgaatatacaaaggaagggataattgataatataaggtgaac

SEQ ID NO: 131696 - DNA, 511 bp, Homo sapiens
cagctttgctccactcctgagttctcttccccctctgcagcctttcctccctgctggctggctggctggctggctcttgatgctgtctctctcttcctcccacgcattctcctctccctctccctgatccccagcccaggccgctggggcctgatcagtcctttccctcatcagtcctctccctccatcagccagctcccctttcccatgttccctcttgcctattcatcttcaccttccctcttttcctcctcccctctctcatcctcttgggttcgcacctctgccatatcttctttctatccccctctgccccctccatcatcccccaccacctgtttccctttctcctctctgctcacagcgtcctcctctctccagtcccgggaggcctggtttctgggaccttccattctccagtccactttccatcttccccttcctccatctcctcttctggggacacaggatggggaggactggagagcaccaggcaagctgtgagattgag

SEQ ID NO: 131697 - DNA, 502 bp, Homo sapiens
ccatcagccctcatacagatttaaaacacacacacacacacacacaaaagataaggttatgggctgcactgcgtcccccaaattcacagagtgaagtcccgacttcaggatccgcctgtattcagacacagggtctttacagaggcgacaaaggtgaaacaaggttaccagggtgggctctgacctgacctaccggcgtccttaaaagaggaggacacagacacgcaggaggggcggccacgcaaggacacagggaggtggtgccgcctgcctgcaaggagaggcctcgtaacagccacgccgcacctcaacccgggacgcccccaggactggagagaacccacatctgctgtgggagcacctggccacggtgtgtgcgaggcggccccggcaaactcacgtagacaggacccagctcccccaggccatctttcaatgggagagggtgacccagtgttttcccaaaacccagcacggtccccaggacgcgttccccaccagg

SEQ ID NO: 131698 - DNA, 273 bp, Homo sapiens
tagcaaaatcacttttgaacctgatttctagagacaaaaagtgtgattaagattcagagggaagaccaaccatagacacaagataagttcatcataagataataaaactgcaattctctggtaacttgcaaaacctagatgaaatgaatgatatcctaataaaatataaattattaaaacttgattaatagttacaaaatttgaatgtcattaccgtaatagaaattagaaggtaactgaccctgaccaaatggatttgcagttatctaattc

SEQ ID NO: 131699 - DNA, 455 bp, Homo sapiens
aagtggatctcaaggaagtaaaaagtagaatgagagttatcagaggctaagaaaggggtgggagtcaggtgccgtggttcatgcctataatcccagcactttgggaggccgaggtgggcggatcacgaggtcaagagatcgagacaatcctggccaacatggtgaaaccccatctctactaaaaatacaaaaattagctgggcatggtagcacatatggtagctactcgggaggttgaggcaggagaatcacttgaacccaggaggcggaggttgcagtgagccaagatcacaccactgcactccagcctggtgacagagcgagactctgtctcaaaaaaggaatagataagagtttaaattgggagatgagacagagatttcctggtaacctatttaaaataacatagtcaatgaaagcctctcctaaagaggtaacatttaaactgagcccag

SEQ ID NO: 131700 - DNA, 131 bp, Homo sapiens
aacattctgacccattcagagataatttattatttaaaatgaaatggaaactttttactggttttgatttctgtttaaaatatagggtactgaagagccgggcttagtggcttaggcctgtaatcccagca

SEQ ID NO: 131701 - DNA, 659 bp, Homo sapiens
aaggatcccgcgaccaggcgcacttctgactcccaggtcacgcttcatctcgatgatgtagcccctagttacaatacattgtgattgtcgttgattaccagtctcagacctggtcagttgggctggtgttcactcaacacccaagtcattggccatcggtgctcggtaaccccatgcccttcgtaatcgtggatcatacccttgtgccctgtttgacacaggcgcacttctcaccgcagtttctaatttttctaacgatggaacaggctgttctttttatgtaaaggggaatcctacttatctgaccacagctttctcctggtgaagatggatgtgctagaaagctatcgacattctctgattggtgcctccctgaactcacggacaaaaatcagggtaatgatgaggtagaaagtgtcctggggtcatggagcaggttaaaactaaatggcctgcagaaatactaagcccctaatgctgacctaattgccccaggattccagccaaatgaacaaactgcccacctgccttaacagacacaaaatacacccaaatctaactaaaatacacttggagtaagtagggtccatgtaactatagttatgtttaatggttcctcttacatttccttattactcattaaattcttgttacttttc

SEQ ID NO: 131702 - DNA, 490 bp, Homo sapiens
atttcgacggggaagtgacttagaattgctgactcttctcctccagcaagaagctcctattcctttatttatttatttatttatttttttgagactgagtctcactctgtcgcccagcctggagtgcaatggcgcgatcttgactgacagcacctctgccttccgggttcaagtgattctcccatctcagcctcccaagtagctgggatcacaggcacccaccatcatgcccggctaatttttgtatttttgtagagatggggttttaccacattggccagggtggtcttgaactcctgacctcaggcgatccgcccgcctcggcctcacaaagtgctgggattacaggtgtgagccactgcgcctggcctcctgttcctttaaagaagagctgaggggaaagaggtaacatttaggaagcctgtattagtccgttttcatgctactaataaagacatacccgagactgggtaatttataaaaaaagaaa

SEQ ID NO: 131703 - DNA, 417 bp, Homo sapiens
atttcgacggggaagtgacttagaattgctgactcttctcctccagcaagaagctcctattcctttatttatttatttatttatttttttgagactgagtctcactctgtcgcccagcctggagtgcaatggcgcgatcttgactgacagcacctctgccttccgggttcaagtgattctcccatctcagcctcccaagtagctgggatcacaggcacccaccatcatgcccggctaatttttgtatttttgtagagatggggttttaccacattggccaggagttcgagaccagcccgaccaacatggagaaaccccgtctctactgaaaatacaaaattagccgggtgtggtagcgcatgcctgtaatcccagctacttgggaggctgaggcaggagaattgcttgaacctggga

SEQ ID NO: 131704 - DNA, 213 bp, Homo sapiens
aaggagttccccacagagcggacacagggacatctgacctgataaaacaacatccttgccacaagctgagaaacatacaagaatgttagagaacttaaaaaaaaattgtccgtataggctgctaattatcagtataggccatgtataaatacagccacagttgcagcaccgttttgctaatttgtccatttttaaattacatttaaacgaaag

SEQ ID NO: 131705 - DNA, 397 bp, Homo sapiens
ctcctgcctcagcctgctgagtagctgggattacaggcctgtgccaccatgcctaactgatttttgtatttttagtagagatggggcttcaccatgttggccaggctggtcttgaactcctgacctcaagtgatccgcccattttggcctcccaaagtgctgggattacaggcatgagccacagtgccctgcccagtactacactgttttaatcgctgtaatctttttttttttttttttctggagacagggtctcactctgtctcagagtctagcgagtatagagtgtatggcctgcctgctgggccaccgcagccttctggtcttctggcctttgcctggactgactgccctgactgccagctgtgtctctgggaggaagggagcaacatagatg

SEQ ID NO: 131706 - DNA, 2843 bp, Homo sapiens
acgcatttcaacacccaagcaaaaccgagcagtgacgccagccctgccagggaattgcaagaaataaagaccagatcaccaacatcttttccgggtttgcgggactcctcgccatcctcctggtcgttgcggttttctgcatcttgtggaattggaataaacggaagaagcgacaagttccttacctccgagttaccgtcatgcccttgctgactttgccacaaaccagacaaagagccaaaaatatttatgacatcttgccttggcgacaggaagacctggggagacatgagtcgaggagtatgcgcattttcagtactgagagcctcctctccagaaattctgagagcccggagcatgtgccctcccaagcaggcaatgccttccaggagcatacagcccacatccatgccacagagtacgcggcgggtatctatgacaacgccatggtcccccagatgtgtgggaacctcactccctcggcacactgcatcaatgtcagagcttccagagactgcgcaagcgtttcttcagaggattcgcatgattatgtcaatgtccccacagcagaagagattgctgagactctagcttctaccaaaagcccttccagaaatctctttgttcttcccagtacccagaagctggagtttactgaggaaagagatgagggctgtggagatgctggtgactgcaccagtttgtattctccaggagctgaggacagtgattcactcagcaatggagaaggttcttctcagatctcaaatgactatgtcaacatgacagggttggatctcagtgccatccaggaaaggcagctctgggtggcttttcagtgctgcagagactatgaaaatgttccagcagcagatcccagtggaagccagcagcaggctgagaaagatgtgccatcctcaaacataggtcatgtcgaggacaagacagatgatcccgggacccatgtccaatgtgtcaaaaggacattccttgcttcaggggattatgcagactttcagccattcacacagagtgaggacagtcagatgaaacatagagaagagatgtcaaatgaggactccagtgactatgaaaatgtgctaactgccaagttaggaggcagggactctgagcaggggcctggcactcagctccttcctgatgaatgaagacccaggtacccagccataaagccacattgagtagtctatcccataggattgactactgcagagtctagtgcagacccgtgatcaccttagtgcttcagtggattcactggttagattaaaaagaggctgagatgagcagtgaactaagaggccacacaaaagcagaggtttgggaattccagaagggaattcttctcaagcagagtgtggttatctcctgtaccagcctaagaatgtttgctgaaactgcttcctagaactgtgaagagagcaggaaagtagtgcacagtagtctaagattattaccttcattaataccaacaggctgcaaagcaagagtatagattattgtataatccagtcagaggtcaaaaggaaggaagaagttggagtggagtggggtgggcaatttccattttaaagagtgtaggcaggccaggtgcagtggctcatgcctgtaatcccagcattttggtaggccgaggagggcagatcacttggtgccaggagttctagaccagcctggccaacatgacccatctttactaaaaatacaaaaattagccaggcgtggtggtgtgcccctgtaatcccagctactcaggaggctgaagcaggagaatcgcttgaacccgggaggtggaggttgcagcaagccgagattgtgccactgtactccagcctggtgacagagcgagactccctctcaaaaaaacaaaacaaacaaaaaagaagtgtgggcaaccaaatgtaggtaaggatgaagaagaacaggaactctcactggtggctgatgggattgcaaagcgtcagggcagctttgaaaaacttttcagcagtttcttataagcataacttatcatatggcccagccatttcactactagaaattgacccaagtgaactgaaaacttatgttcacacaaaaactcgcacatgactgtttatagcagcttcattcataattaccaaaaactagaaataacccagatatccttcaacaggtgattggataagctgttgatatccattccttgagtttatccatactcaacagtaaaaaatgaactcttggttcacacaataatatagacatatcttaaatccattttgctaagtgaaagaagctaggcctaaaagtctacatgttggggcgattctatttatatgacattctggaaaaggcaaaactatagggatgaagaacagatcagttgttgtcaggtttgagaaaaggagggaagtttgctacaaaggggctgcaaagggaataggctgatggagctgttctgtatggtactgtgtggtggatacatgacaatatccatttgcaaacacaagaactatacacatggccaggcgcggtggctcacacccgtaatcccagcactttgcggggccgaggcaggggaacacaaggtcaggagatcaagactgtcctggacaacatggtgaaaccctgtctctactgtctctaacatttgtaaacctgtctctaatttgtaattttgtaaaccctgtctctcatattttgtaaaaataccaaaattagcttggcatggtggtgtgcgcctgtagtcccagctactaggaggctgaggcaggagaatcacttgaaccaggaaggcggactgcattccagcctgggcaacagagaaagactctgtctca

SEQ ID NO: 131707 - DNA, 3263 bp, Homo sapiens
gctcttttcactctgctttgggtgttgaaggaagacgagcttctcacggagcctctcttgagcctcttggcagtttccccctctgtgcccctcacgtttccaccagaaacgtgaaggcagaggccacagattctccctgagccacctcacttggaagcaccatgtccggatgagatcgcacttcctgcagtgggcattagccacgtccaggtagaaccaaacctgttgcttttgtatgttgggtcaacttggcctgacgtttcagaggtagacacgagatagggagtttgttgcgggggtggggagaagtggtagacatgctggctaactgattatgattaagagaaacttagaagctgaagccagagagcatctcaaaggttcctgatacaatggatggtgtcactccaaccctttcgacaatcagagggaggaccttggagtccagcactctgcatgtgactccccgcagcctggacagaaataaagaccagatcaccaacatcttttccgggtttgcgggactcctcgccatcctcctggtcgttgcggttttctgcatcttgtggaattggaataaacggaagaagcgacaagttccttacctccgagttaccgtcatgcccttgctgactttgccacaaaccagacaaagagccaaaaatatttatgacatcttgccttggcgacaggaagacctggggagacatgagtcgaggagtatgcgcattttcagtactgagagcctcctctccagaaattctgagagcccggagcatgtgccctcccaagcaggcaatgccttccaggagcatacagcccacatccatgccacagagtacgcggcgggtatctatgacaacgccatggtcccccagatgtgtgggaacctcactccctcggcacactgcatcaatgtcagagcttccagagactgcgcaagcgtttcttcagaggattcgcatgattatgtcaatgtccccacagcagaagagattgctgagactctagcttctaccaaaagcccttccagaaatctctttgttcttcccagtacccagaagctggagtttactgaggaaagagatgagggctgtggagatgctggtgactgcaccagtttgtattctccaggagctgaggacagtgattcactcagcaatggagaaggttcttctcagatctcaaatgactatgtcaacatgacagggttggatctcagtgccatccaggaaaggcagctctgggtggcttttcagtgctgcagagactatgaaaatgttccagcagcagatcccagtggaagccagcagcaggctgagaaagatgtgccatcctcaaacataggtcatgtcgaggacaagacagatgatcccgggacccatgtccaatgtgtcaaaaggacattccttgcttcaggggattatgcagactttcagccattcacacagagtgaggacagtcagatgaaacatagagaagagatgtcaaatgaggactccagtgactatgaaaatgtgctaactgccaagttaggaggcagggactctgagcaggggcctggcactcagctccttcctgatgaatgaagacccaggtacccagccataaagccacattgagtagtctatcccataggattgactactgcagagtctagtgcagacccgtgatcaccttagtgcttcagtggattcactggttagattaaaaagaggctgagatgagcagtgaactaagaggccacacaaaagcagaggtttgggaattccagaagggaattcttctcaagcagagtgtggttatctcctgtaccagcctaagaatgtttgctgaaactgcttcctagaactgtgaagagagcaggaaagtagtgcacagtagtctaagattattaccttcattaataccaacaggctgcaaagcaagagtatagattattgtataatccagtcagaggtcaaaaggaaggaagaagttggagtggagtggggtgggcaatttccattttaaagagtgtaggcaggccaggtgcagtggctcatgcctgtaatcccagcattttggtaggccgaggagggcagatcacttggtgccaggagttctagaccagcctggccaacatgacccatctttactaaaaatacaaaaattagccaggcgtggtggtgtgcccctgtaatcccagctactcaggaggctgaagcaggagaatcgcttgaacccgggaggtggaggttgcagcaagccgagattgtgccactgtactccagcctggtgacagagcgagactccctctcaaaaaaacaaaacaaacaaaaaagaagtgtgggcaaccaaatgtaggtaaggatgaagaagaacaggaactctcactggtggctgatgggattgcaaagcgtcagggcagctttgaaaaacttttcagcagtttcttataagcataacttatcatatggcccagccatttcactactagaaattgacccaagtgaactgaaaacttatgttcacacaaaaactcgcacatgactgtttatagcagcttcattcataattaccaaaaactagaaataacccagatatccttcaacaggtgattggataagctgttgatatccattccttgagtttatccatactcaacagtaaaaaatgaactcttggttcacacaataatatagacatatcttaaatccattttgctaagtgaaagaagctaggcctaaaagtctacatgttggggcgattctatttatatgacattctggaaaaggcaaaactatagggatgaagaacagatcagttgttgtcaggtttgagaaaaggagggaagtttgctacaaaggggctgcaaagggaataggctgatggagctgttctgtatggtactgtgtggtggatacatgacaatatccatttgcaaacacaagaactatacacatggccaggcgcggtggctcacacccgtaatcccagcactttgcggggccgaggcaggggaacacaaggtcaggagatcaagactgtcctggacaacatggtgaaaccctgtctctactgtctctaacatttgtaaacctgtctctaatttgtaattttgtaaaccctgtctctcatattttgtaaaaataccaaaattagcttggcatggtggtgtgcgcctgtagtcccagctactaggaggctgaggcaggagaatcacttgaaccaggaaggcggactgcattccagcctgggcaacagagaaagactctgtctca

SEQ ID NO: 131708 - DNA, 785 bp, Homo sapiens
ggtctttaaaaacttgtcaaaatgccatttttaaaactgctttttggggtgaccatgtcttgctcctgtgccagaagtagaacagataagtggcctttccattcttggagcgccttccttccttttagaattcaggttgcattgtgacctcagttctgatgctccccccacccaccgcacaacagtttaggattttgtagatttttcagcctttcctcttgtatgacaataacgatctcctatggttttctatgtcctaatgagcaactgaaacgatacatatctaaatgcctttattttgtcctcatatttcattgatggtttgactgagggtagaattcgagcctggaagatatttccattcaaaattttaaaggtatctatctattgtcccagaagctagagcttccagtattgctgttgagaaatctgaaaccattctgaatcctgtttatttatacaggaactgtttctctctatggaagtgtgtaggatcagtggctctagcattctgaaatttcacagttttgataggagtctattttcatccttgtgctgggcacttgctggacctcctgtgcaatctggaaatcatgttcttcagttctgggaaattttctagaatattctgtggattatttcgtccctttctgttttctgttctttttttagatattgaacttcctggactttcttgaaagcatcttttctctcctaaggattttctatgattttggattgagtttttttttttaaatgtcccctttgtgtgtgtgtgtgtgtgt

SEQ ID NO: 131709 - DNA, 1186 bp, Homo sapiens
ctgggcatcagctcctaagagtgctgcagtccacaaagcccattgctgaggatgccagatggcagaagctggagcctcagcctgccacttgttgcctctaattaagccagaattcccaccttaccagatagttcctgcttctctagcagagacttaaggtgcagagctggtgacagagatgccactggccagccattttggctgcagcccccagctactgtgcactgctggtgagtgaaacagaagctggattttggctcacacttacccctcacgcagagcaggacccacacagctgtacctgatagccctgattcatgggggaggagggagcacaaaactatgtccttttatgtgcttttggaaatcctggaattggtctgagcctagagctggcactagcgtttccaaggcaaccccccagctaagtgaagggccctattcatttcagatacaccatcctcaggacagacatggaccagatactgtgccacccagggtaacaggtcaaaggactttgacttattggtgttcttcagatattagaaactgccatcatcaggccctctttgccatgaaactgaactcaaagatctgtcacctcaccctgaaagtgtgggggacatgcaattccttgttgaaaggaccatcagcctataagcaacatgctatctatctcccctggccatgacaccttccaagccccttgggatgagctctgtaagagccctgagacttgaagaaaaatgcaatccaggcctaactccgcagcatttcaagcagttctgctattcattttaaaacaatggttcaatttggatagatgaaatttaaaatatatcctctacttcaaatcagttttaaagatgcttgaaaaataacaagaggaataattatattttcctatcagctattttcaaacttttagcaaaaaaaagtaactcttttagcgtgaagagttctaaaggctgatacattcaaattctagagaatcaaaactgatgatttgtcacacaagaaataatacaactttcacattgaaacatgaggcacatcaagcttatgtttctacaagaatgcagctgagcagatgttactttaaacttacttacttacctttaaaaagtacatgtactgatttagctttggagaatgctttcccattgtgtgcttgcctcgcgcctca

SEQ ID NO: 131710 - DNA, 283 bp, Homo sapiens
ggaattcgagattacagtgagctatggattgcaccactgcactccaacctgggcaacagaacactttaaaaaaaagcgagggagggttcctttcacatagcccatgacctaggattctgtgaacatcctcatgaatgtggaaactccctgagttcctcagaggctttggatttcgctttgtaaaggaagccaacctgagcaaaatgtccctgtgattcaaaagccaacaggaggctgatcatcccatcccttcagggtcacatgacatgtcatccaaaagaca

SEQ ID NO: 131711 - DNA, 636 bp, Homo sapiens
actcaccagtagccccaagacccttggccaggtcatactcaacccctaatctaacttcacaaggctgtctaaatgtcagctactcagacacagcctctggcattagcaaaatcccccagaggaaaagcagccccatagaactggacaagtaatacttaactatcttgttgactctggggtccttcaagcaaattttaaaaatatttttaccagatttccaagttgtccttagcttgagggttggtcctccattactgtcattggactatccctcatgggtagtgcagttcaacttctaaaccacctcagtacctgaatgtggtccgaggtgaaaccagattactgatgccttcaggtgcccaattgaagcaaatggcaaattctgtggaggaagtaaacataacccaaggcctcaaattatttctgcagtgttgcaatcagaaatacccaggtatgggagaagaccagacaacattaattacttgaattaaaaccattagaggaaaacacagacaatagaaatatccaaacagactccagataaagttgtcgcagaatttaaaacagctatggttactgtgttcaaaaaaatgagacgcatggtcaagaatttcaacagagagttagaaactgtaa

SEQ ID NO: 131712 - DNA, 169 bp, Homo sapiens
tgcctttttaaagtgaggaaatggagattcattaagtatgtttaaaataagcactgcatgtgtaactattcagtgaagactcctagcaacactgcatgggcttgctgctaattcctagaatggcgtttagcaactcactttagcactttttttttttttttttttgaga

SEQ ID NO: 131713 - DNA, 290 bp, Homo sapiens
gcactagagatgttcattattacagagtgaagttgcttttaggctacttcaatggacacagctagaaaaaaaatgtatacatatttatgacacacagactctagagtggcactcatgatccctgcctcctgctgttcatgctcccgtgtgatcccctcctcttgaaagtgggaggaaccatgacttgcttctgatcagtaatatatgtctaaggtgacaggatgtacatggttacatatacatgagtacattacgttcagaatgattacatgatgattgtaatgcccctc

SEQ ID NO: 131714 - DNA, 376 bp, Homo sapiens
gttcactctgactccagagcacctttgaccctccagcacacgttatgctgttacaactatattactctccattgcacagtgtgttttacagtaagtacatgcccaaaccgtggccagatgttaccaacatcagaaataagagaaccataataaagtaattagaatggcatcagtccagtcaacatttacaaatgaatattagcctcccagggagacagtagactccatggtttatattcctaattaagcctctaaggccatctttcttttttgttttttgaaatggagtttcgctcttgttgccccaggctgatgtccaatggtgcaatctcggctcaccacaacctctgcctcctgggttcaagtgattctcctg

SEQ ID NO: 131715 - DNA, 316 bp, Homo sapiens
  misc_feature (290)..(290): n is a, c, g, or t
  misc_feature (302)..(302): n is a, c, g, or t
ctatgaatcaattaaatctcttttcttcataaattactcagtctcaagtcattctttatatcattgtgaaaactgactactacggttagcaatcttaaagaatacttgtgattttgagaatcaggcacatattttttaataatcggactgcttacaattgtttaactccttgcaacttatagttagtgcctaaaactttgatgactttcattacatttcaatggctctgttcccttatagcaaactaccttttttactgtacttactgtaactacagtaagtacagtaanaaaggtagtttntagggggaacagga

SEQ ID NO: 131716 - DNA, 429 bp, Homo sapiens
ctcatcctatactaggtgctgctaatgatgaaattacttacgactatggagtcctgttgcttacgttttaattacatttacagcacaattagaaaacatttataaaatctcttttcatgaccattaggaaatgaaaatgataactggtttagccatgatgtatttcactgaagaatatattattaagaaagtggtgcaaggggagatgaagtctttccaaaatgatgctaagagattctgtcatgtttacaaatagtcttggtttaatgtttcaaagtaggttttcaattcttgccagtgaaatcagcttatcccaggtgaaatcttcaatcagaaaataattaccaagtaatagggccaatctcagtaaaataaacaaagcaaattataagtcaaccaaatctgttagggcacagtggcattctgcct

SEQ ID NO: 131717 - DNA, 578 bp, Homo sapiens
atactggactggggttgatggcgggtgactgaaattgcagaaatcgaaactatggaaaaaggggggatgattatacttgttccaaaacgaggcccatcacctaaggcttggaaatcactctttccccatttgtttccctttagattctgacatgtaatgaaattcaagtgggaattttatcagttaacccaatgcctcaaactgacactggagtaagtagtcaagcctcttgaagcactcggagcacagaccccaagggtgcagggctgaggatcccacactcacagtatttacatgtctatgttctgacaatcagtcacgtgatgggagggcccttcgttggaaccatggcaaccagttcttgtctgttacgtcgagaaatgcttcctcggctgggcgctgtggctcacacctgtaatcccagcactttgggaggtcaaggtgggcagatcacaaggtcaggagatcaagaccatcctggctaacacggtgaaaccccgtctctactaaaaataccaaaaaaaattagccaggcgtggtggcgggcgcctgtagtcccagctactcgggaggctgag

SEQ ID NO: 131718 - DNA, 587 bp, Homo sapiens
gggttttgatgttagtttaaattaaataataacttagtttttggctttgaatactttacctctgtcagtttccttactctaaaatgaggaaaataatccctccaagacagattattgtaaggatgtatggaatgaagtatatataaatatgagactgaagaatgaatgaacggttgagctgatggatgcagcagtgtagaggagggcctggcccctcgctcgttctcccagccccaactagaagaacatctcagggcccagaccctgccacatgtgccatggtaaatcagggtggccatgcttctgtgttcttcctgcaaccaacatcggtatagccgtggcaagcactgtagagggcaggcagaggtgagtggcctcagggggcttcacagccaggatgggttataactgtgacatagggtaggatgcagcctatgctctgggagaggcatgtggtcagtgcccagtgagtatttgttgagtcactgcaacacaagatacaagagagagaatcagtgggtcatgggagctcgaagggaaaagattatttctagctgctgcttcaaataattcacgtttttgtgtac

SEQ ID NO: 131719 - DNA, 427 bp, Homo sapiens
actgttctctgctctgttaaagtatctctgggaccctaggatcagggcttggggccacactatacaaagaacactaacaaataagcatggccataagacagcaggccataagagagcagctaggattataataaaaggcctggaaaccaaatcacataaggaacaactgaagacaccaggatattaagcctggagaagactacaagaaggcttcagataaatgatatctgaagagtcatccagaggcccaataaacagacatattcagtgtagtttctatgacctagtgagacactacacattactggacactctacaaggcagaaacacggttggagttgtttccctcctatcacacctacacatagtaatccttaccacataagtcaggccactccaatacgaatatatttgctagacagctctt

SEQ ID NO: 131720 - DNA, 439 bp, Homo sapiens
ggcgagattacggactcaaggtcactcagggatctgagtacacgagtgattacagtctgaccaaactgctttctgaagtctactcggttcatcatgctggtgatgatttcgtgcagctcggggacaaactccaccgggctgaggataaagcaaatctgcggtgacttagtcctcctgtcatttcccatcagttccccgactctcctcctctgcccctccacacccaggtaacttttggtattttcagtagaggtggggtttcaccatgttggccgggatggtctcgaactattaaccttgtgatctgcccacctcggcctcccaaagtgctgggattacaggcgtgagccactgtgcccggccgatattcctgtttttatggttgcaattgtatgctatggcaccggtactatgtgggaagaatgatgctaggtactct

SEQ ID NO: 131721 - DNA, 518 bp, Homo sapiens
ttcaagccattctcctgcctcagcctcccgagtagctgggattacaggcatgcaccaccaagcctggctaatttttgtatttttagtagagatggggttttgccatgttggcccagctggtctcaaactcctgacttcaggtgatccgcccgcctcggcctcccaaagtcctgggattacaggcgcgggccaccgcgccaggccctaaatgtgctttggatacaacggaatacacagcctgttgtggatttggtgccttttaaccatgcgcagattcagaagttagatctcatcatggaagaggacagcagcaacagccccatagaggtgcagtcccctgtggatggtgcccctcacaggcattctgtcctgtgctaatgagcacagtgggggactcaaaggcctaactgtcccaatgctatggtagtgattaggacctcagaacagttttcgttaaattaaaaaaagtcaatttttcctgacagagccttactacatgtctctttggggggactgag

SEQ ID NO: 131722 - DNA, 515 bp, Homo sapiens
aattctcacacaccacatccgactcgcactcacatccagctcaacatcgctacctttagatctttccgattgatttgagatttagcggagtgcagcggctgtgtgtcagtcagagagagccccaggttggctgctggggggccgggcctctgtgccagccctgccactaactcgctgtgtgatccttggcgagtccctatcccaatcctgggcccactttctcgcccctctcgagggaggggtttgaacaccgaccaccatggtcctctctggctctaaaactctgaattaggaacgagggggtatgaaccaaaacacttcctgaccccaacaattgggatctgatgaagacgaattctcatcctgggatccgaaaggttttggcctatcctggatgaacgcttgatgttgaaatttatcctaactgtgtttctcaaagtggggagcctcctggcccacttcccttttgggaaaaaatagcccctttgagtcataatgtgccatctggagttgcc

SEQ ID NO: 131723 - DNA, 909 bp, Homo sapiens
  misc_feature (909)..(909): n is a, c, g, or t
gagaagagcgggctaagacgccggaggaggtggcggcggctgggagaggcgagggttctggccgattttagcatcgaaactaggagaaataagaatggctgtagaggaacttcagtctataataaagagatgtcaaatcctagaagagcaagactttaaagaagaggatttggcctatttcagttagctgggcaaagatgcatagaagaagggcacacagaccagctattagaaattattcaaaatgaaaagaataaggtcatcatcaagaatatgggctggaatctcgttggtcctgttgttcgatgccttctgtgtaaagataaagaggataatgacactttgccccattgagacactgaggaaaaagagtttagctatgcttcagctgtatattaacaagttggattcacaaggcaaatatacattatttaggtgcttattgaatacaagtaatcactcaggtgtggaggcttttattattcaaaatatcaaaaatcaaattgacatgtcattaaagagaacacgtaacaacaaatggtttacaggaccacagttgatttcccttcttgatttggtactttttctcccagagggtgcagaaacagatttactgcaaaactcagatggattatggttcattaattatgaggtaatggtatcaagatatgaaatgaaatcaaatggatatggacgaatgggaatttgagatattctaaggcactcattgacctaattgtcaaagcttgagcaataaatagcaaggcgaatttaatttggcatcggggggaaaacaaatgcgaagggaggcgattctatgatggaagggcggagatgaaagcgcgaaagggggagtgaaaaaaaaaaagggatggaagagtagcagaaggagacggatctagcgctgcn

SEQ ID NO: 131724 - DNA, 123 bp, Homo sapiens
agcacttagaatattctctggcattggcaggtgcttgttacatgttgattaaatgaatgaatctaccatgctataagactaccaaacaaaagaatctttatacacatgaaatgacaaaaaggt

SEQ ID NO: 131725 - DNA, 182 bp, Homo sapiens
tcatcattcattcagggaaacgtaggagagaaaatggcttccaccaagtaacagatttatacatgtcaccatcacttaattttttttccttttgctccttatttctaaaaccatttccccagatgctttactggggcaattatgctttctttacctcaaatttattttctgtgttttcatcc

SEQ ID NO: 131726 - DNA, 246 bp, Homo sapiens
tttaggagggaaggaaacacactgggggttcagcttgtccctctggctgagggcctcaagtcctaaaaaatccacaccccttaccttaccctatcccctcaaacttctgcttcattagaaacatcatgctgtcaaccacaccagtggctggcagcacggactaaaaccacttcgactccttctctctggttttcaaatatggaaactcacagcactttccccagacaagaagaagttagcctccct

SEQ ID NO: 131727 - DNA, 305 bp, Homo sapiens
taaagaatattatttagaattccctttaatgttgttccattgctaagaagttctcagcttgtctaaatatgcatttaatatactttcattcttcaatgatatattttaataggttcagaattattgactggcattttctattagcaatttaaaaatattacttctttgtctatcaacttccgttacttctattaagaagctagcaatcaggccgggcacggtggctcacgcctgtaatcccagcactttgcgaggccgaggcgggcggatcatgaggtcaggagatcgagaccatcttggctaac

SEQ ID NO: 131728 - DNA, 291 bp, Homo sapiens
tctgattgtcctttccttgctcttctctgtggttttatatcctaagtatgcattcttcaacaaggtaggttagtgttgcctgtcatttgaagttataggaatggaatcattaagcatgtccgtgttgtcccttgcttctttccctcgatgttatctttgtaagattcgcgcctattattccatggaggagtactttgtacttttccgttgctgaaatagtattccattgtattaacataccacaatgtattcattccgtcccatggaagttgtgattttcattgtttccca

SEQ ID NO: 131729 - DNA, 595 bp, Homo sapiens
actctctgcttctataagttcaactttctaagattccacatatgagtgaaatcacatagtatttgtctttctgtttctggcttatttctcaagattcatatgttgaaacttaatcaccaatgtgatagtatgaggaggtgggttatttgggaagtaagtagatcatgagatcagagccttcaaaaatggaagtagtggttcccttataaaagaggcctgaagaaaaccccttttcccttccacatgtgagaatacagcaaaaaaaaaaaaaaaaaaaaaaaaaaatttgtgggcggccttgggccccggaaaaagtttttaaaaccttcggtgggggcgcggcggggcgcgcagtaggctgtaggtgagacacgtgggcacatagggttgtcccaaaggggaaacccgggcgccacgagactaggtcgctgggagttcccctccccaatttaaaaaaaacgcgccgcgggggggacaccgcggacgcggtcctgggaaccaattctccaaagggggaggtccaggaggagccatacagggggcgcctacctacccgggagcgcccaagaggagggcccggatctacaattaacgg

SEQ ID NO: 131730 - DNA, 435 bp, Homo sapiens
gccttgtacaacaatccaaatcaggccaaaagtaggaggagagctattttcttcctgcctgctttccctctgagcatacaaatttggaggccccataacaactgctcccctcttcatgctggcagagcctaattatttctcaacttatccctaaacaaagaatagatcaccaaaatacttcagatgaaacgtagagcagacaggtcctgggctgggaatccaggagactgatgcaacaaatgcaacaaagagcattaagagactagcaatgtccatgaagaagggaacctaataagtaagctgccacagctcaagtcctcctggccaaagccaggtcatgtccctctataaccagccagtgagaagggaatgaggtccctaaacgggttcgggggattcatgattctctctggggactggagagagagcctggag

SEQ ID NO: 131731 - DNA, 243 bp, Homo sapiens
tgataattttaattttttttccttttgctttcataatttttcttttggctttcttttattttgtattatttttacttttatttattttcttccctccctccttctctcctgtattcattccttccttccttccttcttccttccttccctccttcctctcctttccttttctttctttctttttctttctttctttctctttctttctttttctttctttctttctctctctctctctttctt

SEQ ID NO: 131732 - DNA, 396 bp, Homo sapiens
ggcggttgcagtcagccgagatcgcaccactgcactccagcctgggcaacaagagcgaaactccacctcaaaaaataaaaaataaagcaagcccaatgcggtggctaatgtatgtaatcctagtgagacagccaaataaaaagggctcccaagaaaatctacgagtggcctgcgcactgggatgaggatggggtggagccgcgaagtttgcgccatttgccggggggaagaacctgacccctcctgttcccatttgcagcggggaagagcctgacccctcctgttccgggatagtaacctggaattcaattggtgagatgggcagcctgttagcaggactccatctcactttgctgtgttgttcttttcgccggctaagttcataaccccttacct

SEQ ID NO: 131733 - DNA, 461 bp, Homo sapiens
gatggctgcctctagaggatccactctccctactggatcctacatactcatcctctggcataccccgatccctaacagccagacagactacatttaaactgtcttccttaccatctccccctgctctcacagatgagagattagagggtttacccctgggaaaatttcccagtctaggagaaaatacctacatcaactggcatttggaagcctccaaccaaaaggttgagtttctacatggtcaacaaatcacacccacttacttgcccaggactttcttttagtgtatcactgcatcattttggaatatgaacggagatccagaataatgcaacatgttttaaagtctccaacatgaaagacaaagatcaaaggagatagaaaaggaactcagagaaaatgagaccattaagagaggaagtgaaagctaaaaaaacaaatgagcaaatgcaaaagaacaa

SEQ ID NO: 131734 - DNA, 319 bp, Homo sapiens
ggccaaacctccctggggatttaagagctgcattccactccacttacaggttttacacaaagacaagagaaccatgggccaccccagttcaagcgcatctgactgggctgggcaacacacccacatcccccagtcctgggctacctcacaaagagggggaacaagacctctcctgagggctaccccagaaccctgaagtccaccagggtggatctgctgacgtccccacccagggcacaccatgggggtgggtgtggggagaggggcaggtctggacgaggccggtgattcagaccgagcagggctccaggagagctgc

SEQ ID NO: 131735 - DNA, 467 bp, Homo sapiens
tgtggaaggatagagtccaaagaaacaacagctcctgggggccagttttcttaaaaagctgcttttctctgagccctggggtgaaagctgagcctgagaaaggaagtagggccccaggatgatgtcattgcccacatcattcagtgcaaggtgggaaagggaagcttcagcatagctctacaatcacctgacagctcagggtatctggagggggatgccgaatctccaaataagtcttctcactgtgcatcagtgggagacagaagtgtggagagaaagggtggtttgtctggtccttacatgtgctgctaatgaaggttcagcaactttgccaaaggccgttaggaaatcagggtatgtgattattttaggaacctgtcttgactctaaatgggtgagattagaaatgtgtaaccatcattatatttgtctcctgaagtcacacaggtctgtgtaccagctgggcc

SEQ ID NO: 131736 - DNA, 653 bp, Homo sapiens
ctaatgaaaggaaccagctctgctaaaagtggttgattacaggactgggtcagggcaaattcaggataagcctggaagtctagtggtgccagacaagacatgttgaaataatgcaagagccaacctgaaggaacacctactggctaaagctgaagcaatttgagtaagaaaataatgatagtattggattagaacccatagattaaaatctttacaaatccttattgatataaagatatatttatttcattaactaaccagaggggaagagaaagctcttccttccaatggaattccaattaataaatctgagagaaaagaaaaaaaaatagagaattactggccatgctcagtggttcatgcctataatcccagcactttgggaggctgaggcaggtggatggcttgagcccaggagttcgagaccagcctgggcaacatggcaaaaccccatctctacaaaaaatagaaaaattaaccaggtttggaggtgtgcccctatggtcccagctattcgggaggctgaggtgggaggattgattgatcccaggaggttgaggctgcagtgagccgtgatcatgccactgcacttcagcctgggcaacagagtgagactctgtctcaagaaaaaaaaaaaatacaaaacacaaaaa

SEQ ID NO: 131737 - DNA, 421 bp, Homo sapiens
ccaagctccccgagtgagcaattcctgtcccttttaagggctcacaactctaagggggtgcacgtgagagggtcgtgatcaattgagcaagcagggggtacgtgactgggggctgcatgcaccagtaactagatcggaacaaaacaggaaaggcattgtcacagtgcttttctatacaatgtctgtaatctatagataacataccaatcaggtcaggggttgatttttaactaccaggcccagggtgtggcacctggggtgtctgcttgtggatgtcatttctgccctttagtttttactttttctttctttggaggcagaaattgggcataagacaatatgaggggtggtctcctcccttacaccatgttagccaggatggtctcgatctcctgacctcgtgatctgcctgcctcggccc

SEQ ID NO: 131738 - DNA, 414 bp, Homo sapiens
gtagctgggactacaggcatgtgccaccatgcccagctaatttttgtatttttagtagaaacggggtttcaccatgttggccaggatggtctcaatctcttgacctcgtggtcggcccacctcggcctcccaaagtgctgggattacaggcgtgagccaccgtgcctggccaactagtgggtcttaaaaaaaaagaaaaaagaaaaaaagtttgtatttatttacttgtggccctcagattgtattttttccattggcagcttagatttcctcatgctgctaagtatagctgtattttccctgaactctttctctgatggtcagaaaactgaggctgtttggcttgtgctttcagctggtggaggatgggcttggaattaggggttacacatgtttttcttaaataaagaagag

SEQ ID NO: 131739 - DNA, 402 bp, Homo sapiens
caaatctcatgtccttctcattttgcaaaatacagtgatgccttacttacaattccccaagccactatgctttttttttacagcctgcagaaccatcagccgattaaacccctttttgttatgatcatacagaaaattagtactgtgaagtgaagctatgaaatgccttcaatgacttttccccatcgtcttggctaagacctccaaggtcttaactcattccagcatttacttcaatatctgaagcccaaagtctcatctgagacaaagatgcagtcccttctgttcctgagcctctgaaatacaaagcaagttaactatttccaaggtatgattgtccaggcattgagtaagaattcccaccctaaaggaagatttttgccagagagaacaacgaaacac

SEQ ID NO: 131740 - DNA, 380 bp, Homo sapiens
tgctgggattacaggcgtgagccaccgcgcccagtcaaaattactatttctaagaaagcgtatgaactgatctttgggaatttcagacttaaaactttatgtgtgtgtgtgtgtgtgtgtgtgtgtgagagagagagagagagagagagactgtaaacatatatctctgtgaaacttcattttccatatgtgaatttttggaaccgagacatatggcacttagctaaaagatgggaaaggtagactgactctgacttaatctacttaacctaccaggcaatttataacttgatggcctaatttttgcagcacccagaagcaagcctgtttcagcacggcaaaggctcagctgctaagtgcgcagcattgttggaggtgag

SEQ ID NO: 131741 - DNA, 314 bp, Homo sapiens
atctcctcacctcgtgatccacccatctcagcctcccaaagtgctgggattacaggcgtgagccaccgtgcccagccgcaagggacattttaaaaagaaacagtaaatgggtttgtaaggcacttaggaggcagcatcagtaggatctggtgacagattgtctatggcaaagaaggaggagtcaaggatgcctttcaggtttatcaatagtgccatttaacaaaatcaggtgcaccgaaagaaaagcgggcttgggagtggtagggaggaggaatcatgagtctgatttgggcatgttcagtgcctggttctca

SEQ ID NO: 131742 - DNA, 357 bp, Homo sapiens
  misc_feature (54)..(54): n is a, c, g, or t
ctaataaatgaagaggtggacagaattacaacagcacaatttttgtacaccccnaaatgaaataatggctctgagcaatggtccttcaagggcacattaacaccaatacagaaaggggcccccagctttacatccctaacggatacacagcaacacctaggaggacggctagccctgcctgccaaaaaagaaacagtgtgtgtgtgtgtgtgtgtgtgtgtgtgaattggtttcatttaattgcagaattttgtagctaaattcagtgagggtaaagtttctttttttttttttttccgagtcatttcaacagtgtctcattcttgcatagttagcctgcagctgggtttttggcaa

SEQ ID NO: 131743 - DNA, 478 bp, Homo sapiens
tttcaaacaaggaagctctggcttagtgcttggtgggtgttaagactgactcatggtcacatctcttgagtagcaaagccaaaactgaacctatttctgtttaactccaaatgcattcccttaaccaactatgtgtatttccaagcttttggatagagttctttggcaaagattttgccttaaataccacttagtacaaaaaccctttctgtatttgcaaacaatatcctggcaacttggcttttggtgagcattcaaaaactagtctccttttcacatgtctacaaagttaagaggatcacctgccctttcaggtacttgggagaagaaaagttgacagcagaagagccgtggaggtgccagcatgctgtcctcagcgtaactctgcagtagaaagggaatgcaggctggacctgggaagctatactgactctgctcatctgcttcaattaacgttcttgacaaagcagcatttcgg

SEQ ID NO: 131744 - DNA, 828 bp, Homo sapiens
gagttcgaaagttatagttctataaacaaaactatactcacggatagggattaaatggtggaattctttagaaacaccagattcagttttgtttccatgagacttaaagttcttcaatctttcataaacttgtatgtactgttttactctttgatcttttaaagattgttataaatgaagaagtcttgatttctgctaataaaaacagagtaaaatttaaatcatggaatagaaaggtggagctgtggttgagatattatattttattaattgtaatgacattttgagatccagtgctgctcactgaatttccctgtgaggagagtttgtggtgatgacccagcaacagacaagctactatccaaaaaaagctactcacatcaaatcaatttccagtttcttccaagttgcaggagaatgcgtagaccataattttaatctcttctgtgacctaagtattacaaaaagaagaaaatcactacaattttcatgtcaggtgtgctaaaaatttacaaaaactattttttaagaagttggtgttataaatactttgtttagtttctccattaaaaaatgatttatagcaagagaataaaagttcatttctacccctaaaacaataagataaaaaagagtaatgaatattgagaatccaatagacagagttgagaaccagttaaacataagaaagaattagtgaattggaagataactgcccagaatgaagcataaagagaccaagaggtagaaaatataaggctagagggtcagagacattgaagctacaatcagaacaactaacatacttctgcagttccagaagattag

SEQ ID NO: 131745 - DNA, 527 bp, Homo sapiens
ttccatctcaaaaaaaaaaaaaaaaaaaaaaaaaagagtcccattcttttcatttataaagaataatctgaccacatgcagactgacatggaaaattaatttcagttagggccgatttatatagatttcccttaaatataggaattctaaaagttagcagaaggaggcagaagggacaaggatcagaaaaacctcaacacagaaggttctctttaaaaattatgatcttctctccactttaaaggcaattatctcaggcaagcaaatataaagatcctagggttttagaggacaaattagctattatttcacagatgaagaaacaaaggcccagagaaatcaagtcatttattcacaatcaagtaattgctttgcaatgtgagataacatctcctatctcattatgaaagtattctaaaaagaaaggagaattttggtgaagttgttactctttgcttggcgtttggactctgggcactgtttggactctgggcactgtttggactctgggcactgtttggactctg

SEQ ID NO: 131746 - DNA, 235 bp, Homo sapiens
ctctaatatctttcccaccagaatgattgaaccccaacacacctccctctctcagcagggtctgcctgttcagagaacacaacttctccttctcgccttacacacaggggcaagaatagattcactcttgcagagagcacatccctttctgttactgaaaatcactttccaaaaaaaaaaaggggttaccgggccccgaattacgactcctggctctcgctttttccttgttttg

SEQ ID NO: 131747 - DNA, 840 bp, Homo sapiens
tcctatctctttcatgtactctgatatggtttggctgtgtccctgtccaaatctcatcttgaattcccatgtgttgtgggagggacctggtgggaggtaaccgaatcatgagggcaggtctttctcgtgctgttctcgtgatagtgaataagtcttatgagatctgatggttttaaaaagaggggttccactgaacaagctctctctctttgcctgctccatccatgtaagccatgacttgctcctccttgccttccaccatgattgtgaggcttctccacccacatggaactgtgagttgaattaaacctctttcttttggaaattacccagtctctgttatgtctttatcagcagtgtgaaaacgaactaatacatactctttacacaatagtcagcctgatcttagtaaaatataaatctcagagctcttcattgctcccccttgcccacataattaagcccaaagttgttcacatggcctataagctctgaatgagctgctgcatgccttcctttccagctttatctcattccatttttcccctaatcccctttatcccagccatgctagaaactactcctaaacctcagcaccttggcaaatgctggtttcactgcctgaaacagtcttctccttcctctcttcttaaccagttctaatctcaatgccatttctctggaaaaggctgctgtaatataccagacaaggcccctttatttcctgagccacctctcacacctggacaccttatactctatcctttgccttttcagcatttgtctttgtcatcacctaattaagcatttaatgttaatgattaactgaaggtcagattc

SEQ ID NO: 131748 - DNA, 337 bp, Homo sapiens
  misc_feature (21)..(21): n is a, c, g, or t
  misc_feature (25)..(25): n is a, c, g, or t
  misc_feature (30)..(30): n is a, c, g, or t
  misc_feature (40)..(40): n is a, c, g, or t
  misc_feature (43)..(43): n is a, c, g, or t
  misc_feature (57)..(57): n is a, c, g, or t
  misc_feature (60)..(60): n is a, c, g, or t
taagggaagaacgacattgancacngtggntcatgcctgnaancccagcactttggnagncgaggagggaggagcacctgaggtcaggggtttgagaccagcctgaccaacatggagaaaccccgtctctacgaaaaatacaaaattagccaggcatagtggtgcatgcctgaagaggcctcattcctgccatctggagaatgagaagggcccgttcaagagatgggagaggaaacaggcctgaagagcccgagggataggaagtggggaagccggaaggttagaaaggtaggtggggatagatcatactcagcctttcaggccatagtcaggagtt

SEQ ID NO: 131749 - DNA, 394 bp, Homo sapiens
agttttctcatgttacattcagataaaaaaagtgagacgtctcagaggaatgctggactacaaagaatttgtctttcaaaggtaattaaagtataatttaaacttattgctgctgtgtgtaccactttcccttttgaattatgagtctataaagacatggaagtttgcaactttaaatcactctgcagttgtcaattaaatgtcatactttggggcagaatataaatggagtatagcctgttaacaattattaatatagtatcagtgcaaattcatacatcaaaagagtcagtgataatcctaaccacctgtgctgatacatagtgtgaaatgtacaactactctttctcgtagtctcctagtctcccagaaaaatgaatgcgttgttgaacag

SEQ ID NO: 131750 - DNA, 617 bp, Homo sapiens
cagcctacctccacactggctctacagggcttgaggccagccaggctgagccaggcaaccaagcggctgaaatttaatcccagtggtggctcagatgtaaccacagttcttgcctcagggaaacctggctgtgaccagagaaggcagagaaagtgaccttccttaccacctctcctcatgaccagaaggattggcactcacttcggtgccctgggggaatccacccttgactgaggccagcagcacctgggtctggacaagggctggtaccagacagtctgttccaaaaagcagatccctggtgggagaccagacgtggtgagagaacagacagctgctgttgcgcagacgaggactctggcatcacaggcactgaggtcaaattcctgttttgtcatttgcagtggcaaacctcagaaagggccccgttcctcctctgaaactctctcttctgaacagtgggctgaataatatctactgcactgggcaatatctactgtacctgttctaggcaagggaaacccctggcccatgactcgggcttagcaaaatctagttcttttcctttcccagtcacacacacttgcgcacacacacagcaacctaatctgcccaga

SEQ ID NO: 131751 - DNA, 398 bp, Homo sapiens
cagtctgaattgctgaaatcatctccttggagtagtttaataggcttctctgtcctctgtattgtctataaattggtagctagatttagaaatttaatcagattcaggtgtcttaaggtagcattttattttttcatcaggaagcacataatgagtggtttatttgggattttgtttggttcggtttgtgatgttagcagccaatccattaattcactgggagccataaaaatggtggtattttaattccataatatttttctttagtagctggaataattttctaaggagaaacgtacctgtttggttttccagtgtagcaacagttttaacattgtaatcccttcggctgtggacatgaagagaacagccacatctttctagaccatattaaccca

SEQ ID NO: 131752 - DNA, 644 bp, Homo sapiens
ggaagcggaggctgcagtgagatgagattgcgccactgcactctggcctggcgacagagtaagatgccgtctcaaaaaaaaaaaaaattggtgttttcttggtttgttttgtgttttagtttaaggagacacatttcctcatcttaaggacttttttgctgctctgatgctggtcatctagtccattcttttgctctaaactgagccttgcctcccagttcttcattgcacttcagattgtgtcttactacaaagagaaaattagtctgtgatcagtttggatcagaagaactgaaattgtacatttagaatagaagccagggatgtgatgcacacccgtgatcccagctactcaggaggctgagatgggaggatcacttgagcctgggagttagaggctgcagtgagccgagatcgtgccactgcattccggcctgggtgacagaacaagaccctgtctctaaaaaataaaaagaagaaaagaaagaaatttaaagtaggaagggctaccgtttgcttctggccaagcttcacctctaaccataggatcttttaaaagactagttctgaggtcctttactctgagtaggtatttatggaataagccattatgtattgacattagaatcagttaaacataaatt

SEQ ID NO: 131753 - DNA, 202 bp, Homo sapiens
taggtttctgctcgtaagatgacaaagttgtgactgtatgctgacatgattattttattaatgattgttgctcagctgaactgtcagctctgaaagaacagtgacatgtggtctttccattgtatcatcttcactgaaaggaaataaataaacaaatgaagagttctaatatatttggcttaaaatcatattacttcaggcc

SEQ ID NO: 131754 - DNA, 755 bp, Homo sapiens
tgagaccagcctggccaacatggtgaaaccttgtccctaccaaaaatacaaaaatcagctgggcatggtggtgcttgactgtaatcccagctacttgggaggctgaggcaggagaatcacttgaatctaggaggcagaggttacagtgagccaagactgcgctattgcactccagcctgggcgacagagtgagactccgtctcggggtgggtagggggtggaatgtcttcctcattattatagtaataagtgtccctgcctgtcatgggtgagattgggatttgtggggtatgattccccaacagggaggttgaaaaggtaccttttggctaggtgtggtggctaatgtctgtaataccagtattttgggaggctgaggcaaaaggagttcgaggccagcctggacatcatagtgacatagtgacaactgatttctacaaagaaaataataataggccgggcgcggtggctcacgcctgtaatcccagcactttgggagactgaggcgtgtggatcacctgaggttaagagttcgagaccagcttcaccagcatggtgaaactccgtctctaccaaaaatacaaaagattagccaggggtggtggtgcatgtctataatcccagctacttgggaggctgagacaggagaattgcttgaacccaggagttggaggttgtagtgagccaagctcgtgccactgcactccagcctgggcaacagagcgagactgtctcaaaaaaaaaaaaaaaaaaat

SEQ ID NO: 131755 - DNA, 384 bp, Homo sapiens
ggttacacagctggtagatagcagagcacatgcccttacccttttaatagaccgcccaactggaagaacaaaacgaagttcagtgtgaccatagagaagaggatgaatttaagagctatttttgaaagagcatggtgaccggttgggcatggagtggagaacagagtcggggtgagagacagggtgtgtgtggaaccgttcacagagcgatcagcaaaaccaggatgtagatgatgcacagggttagtgtcaaaaaggggttattatgttaatgtatcacagagcaattttaactctgaatctctaaaaataaccatgtttctatactcttgaagcacccagggtaaattccttaaagatttcacaggacactaaatttgtaca

SEQ ID NO: 131756 - DNA, 268 bp, Homo sapiens
tcataaaggtgtcaggttaggataaactccaacttgctctccagggaagaagccgccagcctggaagcaaatggttactcttctgtaattctttcactagctttgcatacttgatgtaggtagagtctatctagcttgtttatacagcatgtagacaaccttcagcaaatgattttgattaactaatatgcgttctcccaaatacgcagcaaagtaagttgtggcactatttctgttctatttgtttgcttgtttgtttgtttataga

SEQ ID NO: 131757 - DNA, 106 bp, Homo sapiens
acagaggggtacgtttcaggacatcattccaagggtttctgttcacgtttgtttaacgaggaaggggaagttgttctcccataataccagtggtatttctagtgca

SEQ ID NO: 131758 - DNA, 328 bp, Homo sapiens
actggctcacttacccccaaacgctaccacaaaactggtgagtgctggaagccactgctcagcttcacaggtagacaatccatttttctatctgtgaaatgatcatcccaacacagcttctatctcagggtttcagactcactgggctccaagtatttttgtccaaataccaaagcaataattttcttttactatgtcaaacttagtgctctaccattaccctcaaaacaaagctctcacagcaaagggcaacacggctgtatgttcgccataagcctgaacgttcaccacgcacacctcccatcccccagacacaccctgttgttcc

SEQ ID NO: 131759 - DNA, 409 bp, Homo sapiens
cttcacttttcctagccctcactcaagatggagtcactctggttcaaatgcctctgacaatactgtgactacagttttacaagatgttacccttaggggaaactgggtaaagggtacacagaatctccctgtattactacttctcatattccatatgaatctacaattgtctcaaaatagtttaattttaaaaatctaatcaggtggcacaggcttctctttacctcttgtttaaaaccaatagtttcccgctggtcacagtggctcacgcctgtaatcccagcactttgggaggccgaggcaggcagatcacctgagatcaggagttcgagaccaaccccaacagggagaaaccacgtctctactaaaaatacaaaattagtcgggcatggtggtgtgtgcctgtaat

SEQ ID NO: 131760 - DNA, 907 bp, Homo sapiens
gtggctgccccaggatggggcagggtgaggggatgaaaagaccaaggaagcatgtgccaggctgctgttccagtggagcacctggagcatccgtgagcccctctcactggcagagcgaaagtggggctgggggctgtcagggatgcttgcagtgggatcagggcttggtctgcgaggattccccggcctttcactttgaaggaggatctgcttgggacagcaaacaggctagcaggggaatgttcacatctcacccacccacccacagacagcccagttttcagtgcacgtgcccacaggagggtgcgagtcctctagttatctgttagagaggcaccgccagcctcaccctcagcaagacacccaccattggtgaaccgtcactcagtctccttgtccttggagtcccagaggtgcctgcctccctcacaaccctgtgtttttgagggctggtgccgaccaagtgggatgtctaggaaaagggtctggcagggtgtgaagatgcccctggctggccaggtgcccacccagccctgctcctctgacagccaaattccacccgcgctgcagggcttgtgccaaggccccagctgctccacacttcggactggcagaaggcgccttcgtacccagcatcacccctgcccagggcccacttgggaggtgcagacccagtcctgagccgcacgcccgcccaatgctgtctgtctgtgtctgctctctgccgcccagcttgggatctgcaccacgctgaggcagccgccctcctgcctcccgctccccggaacatgcccattctgcttctccatcctgccctcgctgttgttcgttgtctgggcggggaggtggaggggcctgggggagcccaggcccagctccccgtgtctgtgcttgtgtcgaagccctc

SEQ ID NO: 131761 - DNA, 153 bp, Homo sapiens
tctcatctccacctcccaaagcactgggactgcaggtgtgcgccaccatgcttggtcttgttctgccttttggatattgtttaaacctttttttgtgagagtaggcatctactcagcgatttgaagaagtgatttactgatgactaaagatat

SEQ ID NO: 131762 - DNA, 440 bp, Homo sapiens
cgccagatcctgtaccagacgccggtgaaggagctggcgagcctcaagtggaagcggcacgggcggccgtacttctgcatgctgggtgccatatatctgctgtacatcatctggttcaccatgtgctgcatctactgcccgtgcctgccaggtcctgaccacagactatcagatgtgaactctgggagcccccaaccagactccgccccggcatttatctcccaaacctgggcaatgccgagaacaaatcggaacaatgctaataaccaggttggagaaacaggtgtccatctgggctgcacaacagaccctgagcaagagtgaccacctcacccacatgaacagcagtcacttatagcacgcccacgagtaccatatgccacacagggcacttccctacccactgtctcgaagcatcgccatgaccccagaacaagggt

SEQ ID NO: 131763 - DNA, 494 bp, Homo sapiens
ctgcctcaccattttccactgccccaaggcaaccactttcagcagtcttaaatgtttcatttttattctatttaaagcctttgctcatttttaaattgggttttgtccgcattattgagtggtaagggtgctttacatattccacagccagttgtggtagtataggcctatggtcccagctactcagaaggctgaggcaggaggatcacctgagcccagaagttcaacactagtctaggcaacatagcaagaccctatctctaaatgaatttttgaaatatatattctagataattgacctttatcatgcatatactttgcaaatatttcctctcaatctgttatctttgtgctttcttgatagtctcctttttaatcttgagaaaacataattaatttttcctctggttggtgtgctttagggtgtatgtaagaaaccattgcctaatctatagtcatgcagatagatatatccctatggtttttttttgttg

SEQ ID NO: 131764 - DNA, 119 bp, Homo sapiens
ggtctgctgcagaggaaggtgggctgttcagtaaagtagaaaatgattgtcaaggaacactttggagctactggttggctgtcatcctgagcatagatgaactttatgtctaaagtgct

SEQ ID NO: 131765 - DNA, 410 bp, Homo sapiens
gttgctgggattacaggcgcccaccaccatgcccagccaatttttgtatctttagtagagatggggttttgccatgttggccaggctggtctccaactcctgacttcaggtgatccacccaccttggcctcccaaagtgctgagattacaggcgtgagccaccacacctggacaaacctcagtttttattgtgtcagttccttaaatttcttaaaagctcttctcagtttctcagcctctcagttgccttttccagtaatagcattcacctctagggaaaacgcagcttcaaatactgggctcacctctttagctttcttttttttcacctagatcttggctctttaattctttgccaacctatttgtcctctgatatcttcagaaatgtgttttgcacatcgagtccag

SEQ ID NO: 131766 - DNA, 375 bp, Homo sapiens
tcccataccattccctttaccattcttaccatgaattttcacaaaattgccttacactttgctaattagggacattgcctataaatgggcctatacaatatgtggcctttggttcgttttgcattcttttgcctgaaaatttatcgtgttttcatgatgcgttcatgttatagcctgtcagtggtacttcattcctttttatggctgagtaacattccactgaataaatataccacgttttgtttatcaattaatcaatgatgaacattaaggttattccaaccttttgtctattaggaattatgctaaccatgagcattcatgtacaagtttttgtgtggccataggttttcaagtttcttgggaatatacctt

SEQ ID NO: 131767 - DNA, 764 bp, Homo sapiens
tattcaaccagggaaaatttggcagggatgtcatactgattgttctcacctgtggtaaaggatttgtggattgagtcctctacttaggtaccatttaatgattaaccccaaagtgggcaaagaaccagaaacctggaagaatccttaagcgatcatctgctaaaatcttcgcttccaggtaggcgaatccctaagtcatctagaaaagagtatttcagttctcttcctgagtatcaacaaatatttattgcaatgagactctacagcctttcctatctgcttacaatgtttatctctgaaatatttaaaatcctcagtgaaaatgccccttgcttggatataatctttttttggtcattcctaccccaacatgtagcaaaaggtaaccagcatttctctcatttgttgtgcctgaataacaatcctatttgtatcagtcaggatctcagcacattacctttcaaagcgataatgaagactccaaagaagacatacacatgaccaacaagtatgtgccagcatcattcatctttagggaaatgcaaatcaaagctgcagtgagataccacctcacacccattaggttagctactatcaaaatagaaaataacaagtgttagtgaggatgtagagaaactggaaactttgtgcaccattgataggaatataaaatgctaccactggcgtagctgctaggaaaaacaatatggcaatcgttcaaaaattaaaaatagaattccctatgacccagcaaattctacttc

SEQ ID NO: 131768 - DNA, 527 bp, Homo sapiens
ttttagtgattgtaagtgtagagttttatcagaggaaaatgggccagcattgtccagtagaaataaaatgtgaaccatatatataattttcttattttcttcttttttttgagatgaggtctggctttgttgcccaatttggatttcagcagcgtgatttttgctcattacaacctctgctttctgggctcaatgaattcttcagcctcagccttccgagtagttgagactacaggcatgcaccaccatgcctagctaatttttgtattttttttgtaaaaaagaggttttgccatattgcccaggctggtctggaactcctgagttcaaaagtgatctagctacctcagcctcccaaaatgctggattacggggatgagccaccatgcctggctgtttctttttcttttcttttcttttttttttttaagacaaggtctccctctgtcacccaggcttgagtgcagtggcgtgatcatgttttattgcagcctcaacctctcaggctcaagtgattctcctgcctc

SEQ ID NO: 131769 - DNA, 156 bp, Homo sapiens
gagctgcactccctctagagattctagggggagacttcattctttccccatgtgcgacaaggaagggagggatgccaggcacagacctatgcacctaatgagagaaacagatacaggatgcagtgggatgaatggtggcccccaaaagacatgccc

SEQ ID NO: 131770 - DNA, 644 bp, Homo sapiens
cagagtccaaacagtgccacagacatgctaaagttgatggcacaatgtggataggttgggaaaaacatgaattaggtgctggatttagtgaagaaatcgaactgtgccatatttggcaaatgatggtgatgagaaagtagagagaaccttggatttgttttctgttttagccaaatagaattaaattctgaatttttggaaattaatttacttgactcttataaactcttacaaatactcaaatatatattctccattttatttccttgatccactaatgctgtaatcctatttccaattaataaacaacatatttagtactgatgcccatttaagtgtgttgttactctgtaatcactatccctctcataaaactatctggggatagattggttcatataatctttagagagaagatttttctcatttctgtaaaagtgtagagaaaatctcaagtactttagaaatgcctattgttaaacagtatccataattattttgtgttctgtttccttgacctcactcaagaaaaaaacaaaatatctcccagaattatggcatactgaaaactgcagtatgacataaaagaaaagactacaggctccttgaggttgggtcttttccatactcataaacctgcttat

SEQ ID NO: 131771 - DNA, 349 bp, Homo sapiens
gtagacatttgccatgtaacggggagggtggggaaaaatggcaccatgcagtattccacagcactaactggaccatcgtgctctaggagatgggtccagatagactttagcgatgggacaggataatctcaagagctggtctttataaaactggaatcacaaagtcttgcgtacttaccttgcacttaaaaagaagatcaggcagtgaatattacaggtgaataaatatgttcctcactggttctcttctttatagggatgagcttgaaaacagtctatattattataacatggctcatctgtaactagatgctctgtcataagaaataccagtgttttgctttacaag

SEQ ID NO: 131772 - DNA, 804 bp, Homo sapiens
gccaaaagataatggccatttgtgcagaagatatacttctgtatccctttgtacacaagtatttaaaataactttttttatttttaaatagagatggggtcttgctttgttgaccaggctggtttcaaactcctggcctcaagtgatcctctcctctcagcctcccaaagtgctgggattacaggcgtgagccaccgtgtccatacagtctaaatatactgaggtgtagtgaaggcaatagaactgagagtttatttaagttttccttctgtgaaagagaattattaagaatttagatttatacttatatataaccaagtatatgaaatctggaattgcattggccaagagggtaaccattgccttttttggctatttaaatttaagttaactaaaattggaagttcatttcattagtagtcacatgtggctgttggctaccatattggacaaaacagaacatttgcatcatcacaaagttgtatagcactgcagtgtattaggagatacaaaaagtgtgtggttattgtttttcataacatgctgttgtagcttgtctaccaagaaagctctttgaaaacatattataaagaactctttattcaaagaatgacttgtggctaatctgttgttattcttgcttggtcttcgtcaacattcattttttcactgttaatttatttccttttgtcttacaataatgaaaaaagattgccttctgagtcgctaatatttgtgttctttgagtgaagcttttaaattttaaattatggcaattagacttaccaaaagtcagttaagaca

SEQ ID NO: 131773 - DNA, 219 bp, Homo sapiens
agatcaaaactgcctgcaaagttacttgtgtgcatctctgctaaaatacagaagttggaaacgcatctgaaacacggggtctagaagggaaagggaatactactaatgataacgacacaaatatttactgtatgttcacccggtaccagcccttgtgctatgtgctctctctcatccaagtactgaccaggcctgaccctacttagcttctgggatcag

SEQ ID NO: 131774 - DNA, 193 bp, Homo sapiens
atttacaagcaacagataccaaccaacacagggctatgatctttgggagaaaagggcagatgaatcaagtctcacgctggctttctccttgggggcacctgccaaaccatactgtggagaaacaaagcccaagcagacagtggtagtcctgctaggataagaaaactaaaattaatgtttggggttgctatgg

SEQ ID NO: 131775 - DNA, 142 bp, Homo sapiens
tgatcagagcagacaaactaattatgccttttaatctgcttattactaaaatagaagagaatataactttcagtaaaacattcaaataaagcaaagggctgcagtcagcttaagtcagggcaagatggtcctgaaggaaggc

SEQ ID NO: 131776 - DNA, 573 bp, Homo sapiens
taagatgtcccctgggaaagaatgaaactctcacatttacatgaatatggaatcactgaatcctcagggttagcctactattttatcactgaatggtccaaatctagagagaaactcagtcacatgagaggttctatcttgccagaccaccatttaaatttgaatttaaatttatttaaaactcaccaaaaggatttaaggcagctgataaatgtatacatttagtactttaacaacaggtgaagaaattaaggcaaaagacaaagaaaaataaaataataaaatgggccaggcatggtggctcacacctataattccagcactttcacaggtcaaggcaggcagatggctgaagcccaaaaattcaagaacagcctgggcaacatggcaaaatcctgtctctactaaaaaaaaacaaaaagttagtgggcatggtggctcttgcctgtagtcgcagctacccaggaggcggaggtgggaggattgcctgagcccaggaagttgaagctgcaatgagccgtgattgcaccactgcactccagcctgggcaacagaggaggcactgtctcaaaa

SEQ ID NO: 131777 - DNA, 182 bp, Homo sapiens
ttgagggcctctgggccccaggtgaggtgggactgggctgcaagatctggtgccgcttttctccactgtgcagcctgtcccttctcctgctggcgggtggggccagaatcaactgtgttcagcgtgagggacacacggtcccagtgtgagggacggtggcttttcaggagcacggtgctcat

SEQ ID NO: 131778 - DNA, 370 bp, Homo sapiens
cctcctttaatcttcatcaaatccctgcaaggtccatttcattattacttttactttacattcaaggaagctgaggcccaggagaggcaagtacctcacttcaggtcacacaaccaggagggggtacaggtgggattcgagctttgaatgctgggccacagtgtccccctttagacaaatgatggaataaagtgtgtgtgcactgggcgagattatagggagtgggacacacagtcaactgctgaaggatttcactttagtccaaagggtagccagtaacaaaaccaatgcgtttatgtccctgtggacattcagagagactgaagtgtgggctggccaggtattgtggctcatgcctataatcccagca

SEQ ID NO: 131779 - DNA, 411 bp, Homo sapiens
atcacctgaggtcgggaattcaagaccagcctggccaacatgacgaaatgccatctctactaaaaaatgcaaaaattagccgggcttggaggtgcatgccctgtaatcccagcactttgggaggccgaggcaggtggatcacctgaggtcaggagttcgcgaccagtctaacatggtgaaaccccgtctgtactaaataaaaaaaaaaatagctgggcatggtggtgtatacctgtaatccgagctacttgggaggctgagacaggagaattgcttgtacctggcaggcggaggttgcagtgagctgaaatcgttctattgcactccagcttgggcaacaaagcggaactccaccaaaaaaatacatattttttaaaatttatatacaataaaattattatggggtacagt

SEQ ID NO: 131780 - DNA, 555 bp, Homo sapiens
tgactgtgggacttgagtatgcatggatttaggtatactgaggaggcctggaaccaatccctcccgcatgtactgagggtcactgtattagtattgtttattaacagttaagatttcttcagtgtctgctgtgtactagaattctttacatgtggtatctcaaaatctcctaacccttaggagctcagtattactctgttttgcagattagcaaactgagatgcagagaaattaggaaacttgtcaagagactcagaattgacagaaccaaggcataagtccaagtgtgaagaatagaaacaccatgtttcccctctgtgctatgctgctccttattcctaaagtaaaattgtagttgatttcacaacgttttaggaagagaagttaaaaaaaaagtttatatgacagaaagagatatatttaagaatattagctaggtgtggcggcccacacctgtaatctcaccatctcaccgctttgggaggccgaggcgggcagattgcctgaggtcaggggtttgagaccagcctggccaaggtggtaaaaccctgtctg

SEQ ID NO: 131781 - DNA, 976 bp, Homo sapiens
gccggcgcgcgtgcccgcgcctgggaggcgcgcggccccgcccctcccggagccctccagcgcgcccgggccagatggacgcccgagattagaggcgcagaagtgcgctccacgacgggcccacccgtcccgcggacatcagacctacttcggggaggcgccttttgttgtggtggccgtggcggtgtttgtgtctttccgggagcacagggtgagcttggccttcaggaatgactcagaatgaatccgcctataagagccaaactaaagacgaccccccgccccagccccccaaccataacccaacgcctgccatgagaaaccttcggactttccaaggggtcagtgcctcagccacgaggggcagccctgacccgcgcggttcacgcacacgcagggcccatctgcttcccctactccggcttttcttctctgatgacttaaaagagagtgagtgagggagagagggagagagagagagaggtctaagtgtttcttgggcactgctggattcagggcaactagagatggggagaacaagccccgccagctaaaagcagccctgctgaaaccacacagcccgcgagggtcgcagcagaggcgcccacccagcaggagtggctgcacgaagggtgacccgggcgaggcccttctcgcttcgaggccatttcggctcttgtcaattattgggtgtttgtcccaatataagtagaatggcgatctcaaaccctttcagcactagcctttgcttccaacaatgcaccactagaagcttagaaaagagtagagcagggcccagagagacggaaaaagagcttctagagatcatgtgggtggtttgtagcaatttcagtggtgaagttaagagcaaaacctgagtctcttcatttcttgccagtatgtattttttcctcatgtatttgaacatgaaaagcttcctaaagattttggcaaataaaacaaatagtggacccta

SEQ ID NO: 131782 - DNA, 885 bp, Homo sapiens
gccggcgcgcgtgcccgcgcctgggaggcgcgcggccccgcccctcccggagccctccagcgcgcccgggccagatggacgcccgagattagaggcgcagaagtgcgctccacgacgggcccacccgtcccgcggacatcagacctacttcggggaggcgccttttgttgtggtggccgtggcggtgtttgtgtctttccgggagcacagggtgagcttggccttcaggaatgactcagaatgaatccgcctataagagccaaactaaagacgaccccccgccccagccccccaaccataacccaacgcctgccatgagaaaccttcggactttccaaggggtcagtgcctcagccacgaggggcagccctgacccgcgcggttcacgcacacgcagggcccatctgcttcccctactccggcttttcttctctgatgacttaaaagagagtgagtgagggagagagggagagagagagagaggtctaagtgtttcttgggcactgctggattcagggcaactagagatggggagaacaagccccgccagctaaaagcagccctgctgaaaccacacagcccgcgagggtcgcagcagaggcgcccacccagcaggagtggctgcacgaagggtgacccgggcgaggcccttctcgcttcgaggccatttcggctcttgtcaattattgggtgtttgtcccaatataagtagaatggcgatctcaaaccctttcagcactagcctttgcttccaacaatgcaccactagaagcttagaaaagaagcagtttttgtgaatttcaagaagcagaaagctttggtttaatcagagagagaaggaaaaaagaggaagaggaggaggagggggaagaggaggagaagaag

SEQ ID NO: 131783 - DNA, 573 bp, Homo sapiens
agtagagacggggtttcaccatgttggtgaggctggtctcgaactcctgacctcagatgatccacctgcctcggactaccaaagtgctggaattacaggcataagccactgcgcccggcccatggctcctttcttaacattgtggctttgtagattctggctttccagtttaatgatttaggtggatcttttggggaaaccgatttttgactaggtgacacacctggtacagaatttaaaagatacaaaagggaatagaatacaaaggtcttcttcccagtggtgacttcccaggcccttgtcctgcttcccacaggcaaccactgttagcagcttggtgagttacttatacaaaaagaatgtagctatgcaagcagttagcacatccatatgacgatacagacatacacgtgctacatatttgctatggaaatggttgtatactaatcaaccattctgcaacctgcttttctgatttaatctagaacaacctcattcttgtgtatagtacacctcacaccactatattggcttggtataataactttccaactggcttttgtctcagccatg

SEQ ID NO: 131784 - DNA, 739 bp, Homo sapiens
tgtggtagccagtgaatatctttcatactgtggcttccctggagagatcagagaagtgcgcctgggtgcgcacccaggcgcacttctggcattgcagaggccgtacaattacacagctaggctggggcgggccagagtctggagggggaagagtggggtcgccagcggcgcagagcggggtcctatgtttagaggaaggaagagcgtgttggaaacagagcaaatctgtttccccaatatggatactacgggcgaaatttatcatctgtgagaggagccgtggggactgaggacagcaaggccagatcaagggacaaatggactgactgaaggaggaggctccctgaggaggggaagggaaaaggagaaggaaaaaaaaagtgggggttcataaatgtgtgtgttggcgggcgggggccgagtgaataaatgatcacaggaaagaggtggggagggacaaaaagacattttaaaaagagaagcgaacgagcatccaaggccgccgaccttgaccgagagcggaggagagtagagtaagcgaggaagcccaagccagcccagagagggcgggctaggaggcgccggctgccagcaaggcgctgcgccaagcaggcttgcgggcgggggccgcggtgctgcactgcccaggaggactcgagcgcttacagtgttcacagcttggagttggctttggacacgagcgagccctggggcggggacgccatggtccagtctctgc

SEQ ID NO: 131785 - DNA, 831 bp, Homo sapiens
cttatttgctgcttttggtcgggcggcagccctgaggttgctgggactgcccgcaggtaggtgaactcctagagcgttgtgatccccacgggcagagcaggcgctggtggctttgggaacaccgcgggacccttttcactcctaagaatccgagggtcagatgcgtttggcaacattctcacaggaggagtcagaggaggctctcctgcatgatgggtgagccggcataggaattgtgccaagggccattagattttgtagagactctgaaccccctgtccagaggacaggagctgaggacaacagcaggcgaaaaacacaaacctcaaagtgcgtgcactggaaagagaccagaaagccagattgaaaatgtggaggtgttgcaggagtaaatcaccggtttcccttacatcatcctctttactttatttacttatttacagacagggtctcgaactcctgggttcagcgatcttcctgcctcggtttcctgagtagctgagattgcaggtgcctttttacttacaaaaatttttttaattgagagatagaaattgtatatatttatggtgtacagcatggtgttttgaaatatgtatacattatggaatggctaaaatgagctaattaacatatgcattatctctcatgactttttttgtagcgagaacacctaaaatctactcttaacaattttcaaggacacaatccattgttgttgacactatttattcatttattatagaaatggggtcttactatgttgcccagtctgatcttgaactcctggcctcaaacgattctcctgccttggctttccaaagcctctgt

SEQ ID NO: 131786 - DNA, 392 bp, Homo sapiens
gagtcctcctgactttccccagcacccatcgtggctgcagccaggacacaggtaaatgtaatttccctccccttccatcctcgctttcacatcggtgtgattgactgacgggcctgcagactctctccacgtgcgggtgccctgcagcctgacacacaaatgcgttcatccttcccctttatcctgaccccgaactaatgacgcagcttcctgagacacagaggatgcttctcctcgtcccccctcgcgctctgaagtgggaaaagatgtgttccatctgttctggaattttcactgtaaagaagagaatgaattttaactgtgtttttgacatatccctaaacaagaagtggtttatagagtgaaaccattttcccttcatctaaaattta

SEQ ID NO: 131787 - DNA, 738 bp, Homo sapiens
tattccaaaaaacacaaccacttttatatcaaaatattattctatcacagatgcatacataaaaatgcatagtcatagattaaacaaaactcacaaactttgggctcttggcatagcatgttttcataaaaggccagacatttttatatataaattaatatttgttttcattggcctttccatctattcctgtctgtataccagggtggcattttagtacatattagaaatctatgccaaccagcatgtcatggaacacattaactggattcatgcctattctattcaataaagttatctctttagactgacatcttcttcatctattataattattactctcagtaaagagtgctagaatgtgcttcaattttacacattttaatgcactatcagatcttactaccagacccagtcttttctcttttaataagggaagttttatggtgattctagacagtaactaacatgaaagagccaaaatgaacaaaatcaaatgaaggatacaagaaaatagaaataaatttgaaataatgtgttccttgtttatgaaaactagtctgtatatttttaataaacaatgaattattcctttccttttaggggtaattttgagaaaaatgttggagtagatcactggacaagccattaataatgtaaattgaatcaataatgatagacactcattacagggaaactgaaaaataacttttaaacgccatttttcttttttcccaa

SEQ ID NO: 131788 - DNA, 639 bp, Homo sapiens
cacgatctcggctcactacaacctccacctcctgggttcaagtgattcttctgcctcagcctcctgagtagctgggattacaggcacctgccaacacgcccgactaatttttgtatttttagtagagacggggtttcaccatgttggccaggctagtctccaactcctgacctcaggtgatccacctgcctcagcttcccaaagtgttgggattacaggtgtgagccaccgtgcccggcctttaaatttttttattggaaaaaattttttgcccatgacacagccctcaggaaaccctgagaacatgtgccctaattcatttttttatatgaagtagaggtgaaaattcttttatattttttctatatggatatcgaatggttccagcatcattttgttaaaaaattctctttctccattgcattgacctggtacctttgtgaaaaataagtggattcaatatgtatgggtctattcctgtattctattctgttccattgatcggtttgtctatccttacgttgagtccttgtcttttaattggagattattgatgcagtttgttgactccttctgtatatcctaatttctctaatcaggccaaatctttctcagtaacagcaagggataaagaaagca

SEQ ID NO: 131789 - DNA, 177 bp, Homo sapiens
ttcttccttcttccactttagtcccctgtggtagcttgtttccaaagatgactgccatcaattcctccttccctataggtttctgtcacttccctactgagaaggagagtccagccttccaccgccttcaatctggggctgacctatgactatctgattgatgaaatatggtagaag

SEQ ID NO: 131790 - DNA, 552 bp, Homo sapiens
gtggtgatgatttctacatgtattgctctgttccagggtctaatttaagcattttccatagataagccattttaccttcacaggtactttgggggtcatgtggctacactgtccattgcctccccaaatagtactctcctcttactaacatgactctgccactgttcagtttgcaatacacccaatgtaccactcagtgttggactgagaataccctgataaccttactcctctctgctggacacttgtttcctagccttcccagtggccagcaatgaccatgtgacttgaattctggccagtgagatgcaaggggaagtatgctgggaagcagggactctgggaaaacatttgcatcttcaggatcagacatgagaggagagcttgttggttctccctttttcttcctgactgtgggccatctggtgaagagccagaaggcacatctgaaagacagacctgggatctttgatgacagcattaagctgtagaagaaccttgagattgttgcctctgacttctttttgagaataataaatgtacttataatat

SEQ ID NO: 131791 - DNA, 456 bp, Homo sapiens
tcatttgatctggtttctggtattttggaccatatagaagttttatattacagtcatctcttttatagtcaccaataaaatctagattaattctctgaacataaatagaggctaacttcttattaggagaagtaaaattgaacagaaaattcatgagtcaccaaaaatccttcccgattttgtaaaatctggaaaagccaacagttgatcaccaaaccactgccagctcccaaatgacagaactcatccacagagcacccccacagcccaggatggcccattttctcctggagtctgaaaagtccattcgcttgtcagttttccagagtctgggaaccctttttgcctctagcgctggcttagctgtttcaacacagaagtgatcacagatgaagatgtcggcccctgcccacagcagagactcctcaacacgacagacagagagcaacaggctga

SEQ ID NO: 131792 - DNA, 380 bp, Homo sapiens
cagaagaacaacaaaaccagtccctgtgccaaaaatgttgaggacagctgtactgtactatttggtgtggcattgtttacctgcttttttctgaagggggagggttaagactgcaattcataaattgtgccctttatcattacatcatattcccctttgatatgatttcaacagagcttgaaatttgtttctatttcccctggtgtctcttttccactcctttgttttcaagttttctttgtaattttgtgttaagtgtgtttcttaaaaacaacatataggtgtatttttaaaaatcacaatctatatgttttttttcctttgaactttcattttagtctcaaggagtacatgtacaggtttgttgcataagtacgttg

SEQ ID NO: 131793 - DNA, 306 bp, Homo sapiens
tggctaatttttgtatgtttagtaaagatggggtttcaccatgttggccaggctggtgttgaacttctcacctcaggtgatctgcccaccttgacctcccaaagtgctgggattacagacactaagtcaccacgtctggcctaaagcactttttctgaattccaccccagtctgcccttcctgagtgcctgggcagggcccttggggagctgctggtggggctctgaatgtgccaggggtatccgggacatcttgcaggctagtgggactgccaaaaacgattctcaaagatgagtggggagttgg

SEQ ID NO: 131794 - DNA, 835 bp, Homo sapiens
accacgcgtcggaccacgcgtcggtaaatacctatgcaaacatgcagacatgggcattggaattgccttttgtgggaggagaatactcagcatctagatataccaattattaatattttgctccattttcctctctctctctcacatatcaaaaataatttgcaagtaaattgtagacattatgacactttatccttcagttcttcagcagatattatccaagaataaagacattctcctacataaccccagtgtcataatcacccacaggaaattaatactaacttgttaacatccccagagcatacagtccatagttaagatgtaccctctgttttaggccaaaggtggcaattttctcaactttagactcaacagaagtttggagaagggaaaaatctgtatgagttgaatagaaaggaaaatacttcatggaggaaagaggataagaattgggctgtgaaggattgacattagaaagaaggggtggagcaaatgctcagatagaagcaggtaaatacctatgcaaacatgcagacatgggcattggaattgccttttgtgggaggagaagactgagcagaatttgtggactaggataggtaggctgtgcagctggacaggcctcatgcaatctgagtacagagaaattgccaatccaagcaatcaaaaaaacagtggccacacaccaagaaacgttaaaggtgactgcacttaggagagtggcatcagatttgtgggacacattcaggtgaattctagtcaggaccatggcaaagcatttggggtcagaattaaactggggagttaattactgattgaaattcatttattc

SEQ ID NO: 131795 - DNA, 459 bp, Homo sapiens
ggagaagtgaaaaattgatcagatttatgtcttcataaacatctgataatgagaattttgaagaaaagtttgtgtgttttgagaaaaatgggcaacagtgtgggagattgaaatagttaaaaatctaggacttgacaaagccaggacgttttactaagttatgtgatcagcctattgtatttcctgtaggcccaacctggtcttaagaaaaaaaaaaaagaaaagaaaaaaaaaaaaaaaaaaaaaaaaaacccgagggcatcctattctggggggcgcggcaacaacaagagggacagcaaaggggcccaggggctcataagcggttctccggacccaagattttggtgaccaaggggggaaaattcggcgcggtaccccccaataaagggagggccggtaataaatttcgcaaaaaaccccaggggattacccgcgggattaagaaaaacccgaaaa

SEQ ID NO: 131796 - DNA, 616 bp, Homo sapiens
tggtccccgctccgggaggtcacatattgatgccgaacttagtgcggacaccctgatcggcatagcgcactacagcccagaactcctggcttcaagcaattcttttgccttagcctcccgagtagctgggactacaggcatgcaccactacgcacagctaatttttgagtttttagtggagatggggtttcaccatgttgtccagcctggtgtcgaatttctgacctcaggtgatccacccgcctcggcctcccaaagtgctgggattacaggcatgagccaccgtgcccagcccacaagaattctaaatctaagaaattatctttcccaaactcacaggagagctttatgcagatgcattttgacaatcttcaacaactactagaacatgaggagccactctcccattcctgttcttcgtctacagaatgtagataatgtcattaataatgtctggcacatttcctcccagggcaggaaagaccgtagggtcttatatctaaaaacaccagaaagactgtgtttcgggtaagatgccacaaaggatgttttgaccttgtgagagaaggctggtgctaactagcacccccacccacagtgggatgcaccttccatg

SEQ ID NO: 131797 - DNA, 531 bp, Homo sapiens
gtgacacgaagtatggccgtactaactacctgcagcactgttctcccctctcagagaagtctaccccccagaggcagaatgcacctcctcacagtgagaatgggctaccagagaaaagcctgaaatttacatgactaatctttgaagtgctttaagtactttttttccattgctgaaggaaaggaatatagaggtacacgtgcacttaaccaaagtcaataccatacaaaaaccattagacaatttctaaaaatcatttagcagtgaaaatgggataggggctgggtgcagtggctcactcctgtaatcctggcactttgggaggccaagatgggtggatcacttgacagcaggagttggagaccaggctggccaacatggtgaaaaccccatctctactaaaaacacaaaaattagccgggcgtagtcccagctactcaggaggctgaggcgggagaatggcgtgaacctgggaggcggaacttgcagtaagctgagatcgcgccactgcactccagcctgggtgacata

SEQ ID NO: 131798 - DNA, 724 bp, Homo sapiens
tagaacgtcctgcagaaggttgggcttgggtgacttcctggccagccttctcaggcagtcatctttgaaaaccttgaagagactcacagaggccattcactggtatttcatgactgcaagtggggtttctggatccttgagtttacttggaatatttgaatggctctgaatggccaagaaaccctccctggtcttagaagctgccaaaagctattactgggcctctgaagagactttaaaatttttccaagtacatttgggcataggaaacttttccaggtctagctgagccagctcaggtcgagtcctgaaaaactggtgggtactgggggatctcatcttatgaaagagcaattggtggcaaagctgggtctccaggacagctgtgtgtgtatatgtctgtagaacatgccttgtagtcatctttggtaactgaacaccatttgtgaatggataaactatattcattgctgtacaataatgaaaaatccatattaacaatggcagtaataaaaatattgatggatattaacaggaataatgatcatcatgatactagtactaatggttttaatagtgataataatactaaccctatggacttgggacatataagttttccataagtggataataggcataaatatttggctgtgtacggttatttcaagtcccaaaaagcaaggatgaacatctagaacgagaagaaaaacaatctggaggt

SEQ ID NO: 131799 - DNA, 320 bp, Homo sapiens
aagattcagtgatataatggctgtaaagcacttagcacagtgcctggcacaacttataactcaataacaagaagacaaggaatctaattttaaaatgacaaaacagtctgggcaacatggtgaaaccccaactgtacaaaaaaaatgcaaaaattggctgggcgtggtggcaagtggctgtagtcccagctactcaggatgctgaggtggaaggatgctttgagcctgggaggttgaggctgcagtgagccaagattgcaccactgcactccagtctgggagacagagtaagactcagtgtcaaaaaaaaaaaaaaaaaa

SEQ ID NO: 131800 - DNA, 452 bp, Homo sapiens
tgtaccgtgtgcctggggcacagggagtggcgtggcacagatgtgctgcgtacctgagcacagggagtggtggagcaggacagggccgggtaggcagtggcctggttgacagaggctaggtgacattcagaggctgtcgggggccacagagcgcttttaaactggggagggggcccagcgcagtggctcatgcctggaatcccggcacttcgggaggccgaggcgggtggatcatgaggtcaggagttcaagaccagcctggccaatatggtgaaaccccgtctctactgaaaatataaaaaattagccaggcacggtgacatatgcctgttgtcccagttactcgggaggctggggcaggagaatcgcttgaacccgggaggcagaggttgcagtgagctgagatcacaccactgcactccagcctgggcaacagagtgagactccgtctc

SEQ ID NO: 131801 - DNA, 613 bp, Homo sapiens
gtagtttttcttttttggctctttatatgatgtattatattaattgatttttgaatgttgaaccagccttgcatgactgagataaatcccacttggtcttcatgtaaaattctttttacacattgtgtgttttgatttgctgatgtttctgttgaggattttcacatatatgtttattagagatattgatgtgtaattttcttgtagtgtttttgtgtagtttggtgttacagaaatgcctcacagaatgaattcgaaagtagttccttcttgtctcttttttggaagattgatgttaattctttttaaaccatgtttggtataattaagcagtaaggccatctggtcctgggcttttcttcctggggagatttttgataactgattcagtgtctcgttatagttcttttcacattttttgtgttttttgagccagttttgacgatttgtgcatttctaggaatttgtccatttaatatgttactaaatttgtggacatatgttgtttaccgtattcttttgccccttctctctttttttcaaaagtcattttatttaaagatatgtcaattttgtttaccttttccaacaacaaacttgtggttttattgat

SEQ ID NO: 131802 - DNA, 364 bp, Homo sapiens
ctgctgtcgtagcttgcctagacaagacaagcttgcctagaatgtctggtcttacccctctctaattcattctctatactgccactagtactttgttaaaatacaggtgtaactttcactcccttacttaaatccttctctagttttctgttgccctcaggatgaagtccaaattccctaacctgatttataaggccatctgtcatctagcctcttgcttaattatatatctagtcttatctcttgctattcttcctcttgtattctatgttccaaacattgtgatttttcctctcagttcctcaaacatctgtgttctttctctgcatctttgtgcatgtttattttattctcctgtggagca

SEQ ID NO: 131803 - DNA, 515 bp, Homo sapiens
tccacagtctcaagttaaaaaaaaaaaaagacctcaaagcatcaatacaaatagatatttggacaatggacctcacctgaatattctaatcaagccacatctattattgctcatgtgtcttcctgataagccccctacccctacccccataaagtggtgattcaggtccttcctgttttgttttcaaggtcattactgctctgcatcaatccagtagaaagccaaagaatatagaggattttgcaagagagatttttttatgaatcaagtctggtattactgcacctcatttccccccacatcatattggcttagaacttgtcacataacagcacccaacaccccaagggaggcagggggaatatagaagagctacttgtctaggaagatagcactttgtgaacagctctctagtctgtttctctcccttccttcaccttacaaaatttccttatcctttgagacccagcataaacaccattatttatccctaaccctggaacagtatttgtcac

SEQ ID NO: 131804 - DNA, 364 bp, Homo sapiens
acaaatatttattaagtatcaactatgttgtcagctctcgggatgtagtggtgaaccaaaaaacaagacttgctcttgtgcaatttacattctagtgcagagaaacagaaaacagacaaaagacagaacattttagtcaataaataatgcgtaaaattaaactgggccacatgatagagtgattgtagagttggaaaaagattacttgaggagatgactttaagcttgaatttaaataaggaaccaggctgggtgcagtggctcaggcctgtaatctcaacactttgggagacaaggcaggagaactgcttgaggccaggagttcgagaccagcctgggcaacacagtgagacccagtctccac

SEQ ID NO: 131805 - DNA, 387 bp, Homo sapiens
aaagggtggccagggaggccacaggtaaggtagaggaagccagttggaagttgtaaatagccatttataccatgcaaaagggttagaacttcatcccgagggcagagaggagccatggatgggcattaagcaggagagtaacgcgattagaactacattttagaaagatctttctggggatcgcttctcagccttttggctaagatcaagtgtagaaagatctctctggggcagcagaaggcatgcattctcaaacttcagctgcattagactcacctgggaggttcatggagcctcagaatactgagtcccgccccatgagtttcttattcagcaggtctgaggcaaggtctctttttttttttgagacggagtctcgctctgttg

SEQ ID NO: 131806 - DNA, 531 bp, Homo sapiens
cccaagtagctgggactgcagatgcctgccactacacgtggataatatttgtatttttaatagagacagggtttcaccattttggccgtgctggtcttgaactcctgacctcaggtgatccgcctaccttggtctcccaaagtgctgggattactaactttttaaaaagtagagaaatacactgagcttcctggaggccaaatgagattggagatgaaaagatgcaaatgacttggaacattgttgcttaactaagagtatcggatctcccacaccaccatcttagtgtgtttactgtgaggggttacttagtaaatttggaagcttaatttgctctattttattataatttccattgtgtctattctgtaatgagctacataaaactaatttgttggaccagttctggaaactggcaggtctcagcaagaaaagcattgactcgaaaagtgattagctgcttggttttggctgttgaattgcacatacagatgagagtgatagtaatgatcatctattgagtgggcacta

SEQ ID NO: 131807 - DNA, 324 bp, Homo sapiens
ctcaaatctagtaaacgcagtggaaagataacttttataggatgatcattgaaaggcatataggggtccatgaatagtgtgaattgaacaaacaggcatcctctatcaaccagagagactaataaggcctcctttaaaaggtagaaacggaagactgaaatccaagttgaccagaggaaatctaccagcgcattatattatcagaaagagttcatgaaagctttctgcagtaactcccaaaatacatgttcactctgttcttggggacataccttttctctggtgagattcatgtttctaactcgtataatatggaaattaccc

SEQ ID NO: 131808 - DNA, 315 bp, Homo sapiens
atagccgtgagccactgcacctggccggtattttctttttaaaaaagtatacaagcagcccatgattatatgcttgagataaaatagtacagaagtagtagttctaaataatgtcaaaagtgaatatatttcctttagtctcttctgatactctcctccccagacgtaatcaaagttaatgttttaatgtatatccagacctcttcctttacagttacaaatgcatatttatatttatgtctatgtctatctgtgttttttttttttttttttttgagacagggtctcacgcccatggcccaggctaaagtgcag

SEQ ID NO: 131809 - DNA, 672 bp, Homo sapiens
caccgtggctcacacttgtaatcccagcactttgggaggccaaggtgggcagatcacctgaggtcaggagttcgagaccagcctggtcaaacatggtgaaaccccatctctatgaaaaatacaaaaattagccgggcatggtggtgggtgcctgtaatcccagctactttggaaactgaggcaggagaactgtttgaacctgggaggcggaggttgcagtgagccaagttcgtgccactgtactccagcctgactgacagagcgagattccatttcaaaaatatatatatatgtatatatatgaaaaaatcaatagacttggtcttagaataaatattaaaatctaaaataataagtttatataaaaaattagcaaagtggaattacttcttatgtttacatttaagaccaagaaaaacttcaagatttcaaaataataaattattagacaataatgaaattacaaacattataacaagtatactgatagttaggaaaaataatagagttctgagaacaaactgcgttaatctccaaaaatgtacacttatactttaaacctactaatttagaaaattctacacaaatataaattccattagaatgattacatcatcacatgtcatgtagtctctggagaactctgctgcaatctgtgagagaatgagaatg

SEQ ID NO: 131810 - DNA, 227 bp, Homo sapiens
aaaatacaaaaattagctgggtgtggtggcatacacctgtagtcctagctattcatacttggaaggctgaggtgggaggattgcttgagcccaggaggtcaaggctgcggttgattgccccactgtcttcattctgggtgacagagcaagactctgtatcaaaaaagaaagaaagaaagagagacataatatatgtggagtaactggaacctttatacacttctggt

SEQ ID NO: 131811 - DNA, 624 bp, Homo sapiens
ttagtggctgtctcaggaccacaccagtcggaccccaaaaccccatttgccagggtatcactaccgatcacctccttcccgtacacctcaaccaacactgtcatggaatgaggatggctgtgaacacgccccaaagcctcctgccctaaaatgtacccattggtggctcttccattggtcttagatctccatcactagagatttctctgcggggtgaggcattgaagaccactgtcgactacgcaaaatgagtgattcctcaaatcccaacgagccacacaagtgccaagggagcccaggagggtaaagagcaagggggtccaggccaagccctctcagcagtggttttggatggcaagagttggatcagggacggatttgtttcttaggacaaagaagacatttttctcagctttcttgttttagaggaaagagtggctgtccccagtttgctcaggaggtcgagagtaacctgaaatgacaatgttagagctgccgagagcagtctctaggcagtggctgagcaggaagatgggtgagtgatcttctgaaacgtgctaggccagcgagagatggctggaatgcctgcctggaacagctcaccctcctgcctgtgataggcct

SEQ ID NO: 131812 - DNA, 426 bp, Homo sapiens
tgctacttagaggaccttgatagagcatacccctagtgtgaatggtaggacatttaggggagattaaggtaaaaggagttcatataggtggatcctgatctgatttagttactggccttaaagaaaagaaggagaaagagatctctcaccacgcacgtgcaccaaggagaggacatatgaggacacagcgaaaagacagctgtctgcaagccgggggcaaagccttcaccaggaagcaggcgttgtcaccctaaccttgagactgctcagcctccataatcgaatggaccagttatttagcgcgtgcgcctgtgtgtgtgcacgcacgcttgtgcgtacacacgttgctcttgcatacacacacgcataatactggtttggtttttctggagaaccctgactaatacaggattttggaccccggaa

SEQ ID NO: 131813 - DNA, 280 bp, Homo sapiens
attccccctaaatgaatccacagaaagatctctggaagggtctttgctaatttgcggttagaacacaacacactcaagaaaatgatgctcacagcaggacactaatactaagtaatttctgagattatgtctgcatttgtgctaaataatttatgctaggagcagaaataaaagcagagatgaagttaagctattgattgaagactgtgctaaccccattaaaaataaagagaggtatgaatgtgtgccttcacaactcagctcaggatatacttgccaa

SEQ ID NO: 131814 - DNA, 264 bp, Homo sapiens
tcaaccttcaaagcaaaaacaagagggactgcgtttggttggtgacatatctgaacctttgctgactggggtactttcccattcttattcactgacccagctccttctgatctgaggacacaagtgggaggagggggctagcaataagggtcttgaatctaatttggtccaaaaggcaagtaagagaaagtttgagagtcaacctataaaacattttgttcagaagaagacagctcagagaagaccaaaaacagcagcaactga

SEQ ID NO: 131815 - DNA, 207 bp, Homo sapiens
gaagagaattaccagggcaacagtgttgccaaggagacccagggttcggacaatccaagggagaggaggaaggagatatctgcaaaaataatgaggctgtagaaaagtgtgttcactgtggaacggaaacattcatgcacaattaactgagcagctattatagaggaagggctacaatggtaagcaaaaacagatcagatctctgcc

SEQ ID NO: 131816 - DNA, 120 bp, Homo sapiens
catgagatttggaggggacatccaaactatatcattccacccctggcctccaaatttcatgtccttctcacatgttaaaatataatcatcccttctcaatagtcccccaaagtcttaact

SEQ ID NO: 131817 - DNA, 389 bp, Homo sapiens
caggtaagcagtgtgatctgtgaacagaaacttgtcctttggaagtggggctgtggcaaaacaaaagccttaggagacgtaatcagcaaccgttcactgcagcagggcgggtggcgcggtgtctgtgtttgtgcctgtgtgcaagggcatgtgcgatattttctgctgttgctaagatgggttcccccttcactggcctctcgcccaatcgaaaggtagctgctcctcattggctgcctggctttatcgaatgaccatgacgagctggagcgaagcccacctcattggcttattcctatggccattgtcaggggagagcaaatcagacacctaatcaatattttgtgaagtggcactagactcttggctaaatttgcattaaatttctc

SEQ ID NO: 131818 - DNA, 427 bp, Homo sapiens
ttcttttaattcttttaacatggtctcctttagtaacttgaatatgtttctgtggctgttttgacactggctgtctttgtctgttaatccgatgtctggaatttgtcatagtttctgttgccttctgttttcctgagcatgggtctcactttcctgttttcttgcatttttgtggaaactggcattttaggtaatatatcatagcaaatctggattctgaccccgacccgcaggggctgctatttctgtttgattgcttgtttatttgattagggacgtagctctgatattgctcctcagagggcacagccttggactagcacacagtctctccgaccacctgtggtatctgtggttttctctgggctctctgttaagcttctgctggtctgtctctctttggtgtcacacacagctgttaacatcc

SEQ ID NO: 131819 - DNA, 698 bp, Homo sapiens
ggagaatagtccaataaacaaatggaaaggtttttaacttcatcagggaaaaataaaaccacaaaattgacacagcaagtgttggcaagcatctcataaattgctggtagaagtgcacaactgcttttatcattaaccaagtagaaggacttgctttaacagacatgaaatcattgtattcgtcaatatagtgcgtaatcagacaggcagagacaaataaatgaagagagacagagatacaaaaataaacttgatatgacggagggcagaaactggtgaacttttcaataaatggtacaggaacaattggtattcacatggaaaaacatgaaattggggttatataagaattaatttcagatggattacaaatctaaacataaaagacaaaattataaagctttgaaaagataatatacaaaaatacatcttcgtgaccttggggtaggagagaatttaagaactgaaaaagcattaagcataaaggaaaaaacatacattgaaaacatctgttcatcaaaacacactgtcaaaaaagtgagaagataggccatacagagaaggctctgtaacatatgtaatgataaagaactagtgtcctgaatatataaaaactctacttgccattttttctcattgaaacttctctttcaatgagaaaaaggtaaacaatcccattttaaaatggacaaaagatt

SEQ ID NO: 131820 - DNA, 124 bp, Homo sapiens
accatggagagggaacccagcatttcaaatagctgctgctgctccggtgaacttggggaaagggagctgaggggtgtctaccctctgcaccagactcaagtctccctcctagaataggagcgag

SEQ ID NO: 131821 - DNA, 472 bp, Homo sapiens
tggcccaagacaatttttcttcttccaatatggcccagggaagctaaaagattggacacccttggtaaggtctaatccctgttataaatccatgtgtgagtgtatgtctgtgtgtaagagagaaaaagagagggagagacagacacacacctcctagtggtcttgcttctctgactgaagtcagtcaggtgcaatgcctagggcacggttctttctctctgcacctttctctactttggacgatacgtcttctccctggctttaacttgtacccatttagctgacttcaaaatgtccattcaaagtctggttcaagtcttcatatcaggtctgctttccaagaacctgtaggacattcctgctcaggcaaaacaccattccatcaaaagcactgtgtctaaaacttaactccctcactcccggccagattctgtcagaatttctcccatctcctaagctgaagacaggtagg

SEQ ID NO: 131822 - DNA, 214 bp, Homo sapiens
tatgtgttggagcaggcaggaagatctcaggtttctgggaccagggaatgaagtgaggtgggcaaagacagtgggatatgatcattccggagagcagggtctttttgtgatagccctggatccttgccaccttgggtgagaggaaggagaaagtagaggagtgacatgatgatactctcagagtgccttttttgagagggcatccaggataggc

SEQ ID NO: 131823 - DNA, 255 bp, Homo sapiens
tcccaaagtgctgggattatggatgcgggccaccatgcctggtctctaaattcttactgtgtgattcaaaatcctttttgacctatcttgccccactttttcactatagcactcatcacacctgtgccattctccttcgctctagccccgttggcctcttccccaaacgtgtccccattctcctttctccttagtcttgttcaaacaaaccctttgtctggagtgcacttttctttagtcattcttacccatctt

SEQ ID NO: 131824 - DNA, 483 bp, Homo sapiens
cagacccccgcttctcaccaaatatttggtcttcagtccatccatccaaacaatgggagggaaagagaaactgaagtctggaggtgggagcatgggatcccaccagtgtcctgatacccagaggacagagaggttgggggagccagaagctctgagccttggagcagtactcaccctgtgaaatattaacctaggagctggggggaaaacccaaacaaatgccctatttacagaggctagacgctttccaggaggcagcagatcaagggccagagactgggggtgtgaggggagtcacagcaagtgtggggatctccaggtggtcgggaaacaggtgaaaaccagacgccacctggctctgaaaagtctgcagagattaaatctatgagttgggttatgtcagaaagatgcagacacacaataattggggagtgtgcctcacagctaggtggctgctcatgatgctggagacagagaggcctt

SEQ ID NO: 131825 - DNA, 899 bp, Homo sapiens
gagctgtgttgctttgggcaaccatttccctattctgagcctcagtctatcctgaagagggagcaatgctgatagacttgttgtgaagattaagcaagataattaacgtagagtaaatgatagtatgttctcaataaagagtaagatactcttatagagaaggcagaaatagggaagtatccccctgctccctttctttctttctttttaactttcaataacaaactctacagagcacttacaacataccagattttgggttggatgttaggtatttataaatgaagcaaacagccacatatgtgggaagcacagatcttgaatgagtaattactcagtgatgaggcagttttaggatggggaggagtatgatgaatatacaggaggaagatttgttggtgcctgggtggcatggggtcgtcagacagacttgtcttggggtaatatttaccatgatgatctttagagaatacccctaatgcccagagtattctcccacactctgtacagccttagccaaggttctgagagactctttccatgcctttgagcttttctcctttgtggatgttcttcctttctgggatgagattgaatgagtagatgagaagaaaaagaggcaaaaaaaacaaacaaccaaaaaaatttggccctgcccctaagaaagaactctcctccagaacccctctcggtgtggcggccccgagccccatattgtgatcggcacaactgggcccaacagcgtggtcccaaagagaaaccctgggacagagaaactctcggtgtggtccacacaataaaaaaaagcgccgcggggcaccagccgtctctgaaaaaccacaagagggctcccggcgggcaacggagcgttccacacgaggtgccacgggagccaataa

SEQ ID NO: 131826 - DNA, 248 bp, Homo sapiens
cattattcacatgtagtgacataacttctctctgttagtctagaacaggacaagttatgaaccaccactgaagaactgagaacatagtcactctattttctgtcttctgtggttcagagaagggatcctgattgaaaaagtcatcagctctgggatggtgcctaaactgatgataatgtttgttttcaaccttatttctaaagtagcgaaatagccactgctccccaaacaggaacaaagataggctg

SEQ ID NO: 131827 - DNA, 780 bp, Homo sapiens
ggctctggaggcggatttgcaaaagcaccaggcgtgggtggagcagtgtcagctctttggttggtaatagcatctctctgcctggaattatctttccaagtctatttctctcaaaattcttttcatctttcaaggtccatataaatgccacgtttcccatgatccccttcttgatctttcaagttagaggatctcacttctctgaaagtactacagggtaggttcagcatttcgtttgtaactcttatgatgctgctctttgcctacttcaaactgttgctaatcccttaaaaactcagcttcttttcagtgcatgccatcaggatattgtaataatctactgaactcctgggtcacttcccccacattctctgaaaatttagaagcctgattcattctcttggttttcaccattcctactgtcatcagtcctggctattccatgatgtatggagacaactggccctcagtttcttgtccactcatttccaatcatcttgttttccagtccacctcagtcatttattcccatggttaataccctagccctggtcatgtataataaatgggctccttgcaaaacctgtatattttgcacctcacattgactatcacttcctttccaaaatttatttcctttttttttttattttttgagacagcggagtcttgctctgtcacccaggttggagtgcagtggcaccatcttggctcatcgcaaccactgcctcctgggttcaagtgattctcctgcctcagcctcctgagtagctgggatta

SEQ ID NO: 131828 - DNA, 465 bp, Homo sapiens
taaatagagaaaggtggattacttgaatacactataggtataggtttttacttcaataaatactgttttatcttcagattttctttattccttttactttccataataataaatgatttactaacttcaataacgcatataaataggaaccttaaaaagtgatagtgtcttggtaatttctcacacattgaggcaggtttgacagataatagattagtttaaactaaagtttttattaccatcttagagactgtaaaagaagagtaaaacacactgcacatcaaggggctatgagaaagttgcaggtaatctcttttcaacttatgaaagcaatgggagttcaaatgcatgtaagacactgagccttgcacaataaatatggaacaaagtaataattagtttctctgatcacttgaaaataggttatcaaccacaataaataacttattttgaaaaaaatagttt

SEQ ID NO: 131829 - DNA, 756 bp, Homo sapiens
gaatgactataatacgttgtctttcttccatgaaagcatataatgttctcctacaagcttataaaaatgtctctatttcacatgtttttaatgactggtatatagtacaatggacacaataaatatttttagctgatttctatttcatatccatgctattgccccctctgagggagttttgtcagctttccaccagccacaccccttaattctttcagaactccagtgctgcttgagatttcctggtttaatcaggccagtagcctattcatttgcccacatgcttcctactttccaatcacttagtgcagttttgtcacagttgtgttaatcccatttctcctttattgagcgtgcttctccaggaaatattgccatcatcactccccacaaaatctagaaggtcactccacacaccgtcaggacatgttgactgagtaatgctgctgaatacctacaaaaagaataatttttcaattcattaactttttgactcagtataatgaaagacattaatttgaaacatctacaattgcaattgcctctagtaaactttaataacaatgtatttatcaaagtgcgattcaatcaccttggggagaaagaaagcaggaaatgaagttgaaacaagtaagtacccttcagagaaaacaagcacttgttgacagctgactaattgaagagaaagaaggcattcttttttcaggaacacaggagacaaagatgaacaaaagactgtctcagagacaggaaaaa

SEQ ID NO: 131830 - DNA, 140 bp, Homo sapiens
ttctgggattacaggcgtgagccactgtgcccggccagtattatactcttaagggaccataatcatatatgtggtccactgtgtatgaaaggttgttatggggatgcatggctgtattgtcatacatggtgctggtaaga

SEQ ID NO: 131831 - DNA, 452 bp, Homo sapiens
tatgaccatgtgcctcttctcagtctctcagcacgttaggcctaacacagtgttaatgagcgaatgcacagtgagtgaaccaaccatgtgggtgaaacgtcctctccttttcatggtcgttagttggacacaataggattgtcccaatctgcccactcacttaggtacttacctttgctgttctttttgctggggtcatttgcataaaaagggcagagtgacatggctgagctgttggaagctccattgttctgtagtgacttaattgttggcttgccctggacaaggctttatgctgatttggttctaagcgtgctcctgcttacccaggatgtggcacaaatagaacatccactggcttccaccagtctgctgaaactgctctctaagtgtcactggtgtccttctaatcaccagagcttgacttctgctccagcactgccgaccatact

SEQ ID NO: 131832 - DNA, 141 bp, Homo sapiens
tcatcaatgcatgcccaaactaggaggtgaaaatttgatgagtcaaaagatatgaatatagtccgaaaaaatcgccccacaattacttgttcatttcaaaggaaatagagcaacctacggtgggaaaaccttacagatgcc

SEQ ID NO: 131833 - DNA, 530 bp, Homo sapiens
ccccgccgtggacgaccgcgatgaggcccagcccgaggtgatcgtcctgagtcgcttggaccccggcgatctctccgtgcaccgggagaccacgtggaagacacggctgcggcggaactcctacgggaactgcttcctggtgtgcggcatcctgtatgccgtggacacgtacaaccagcaggaaggccaggtcgcctacgctttcgacacgcacacgggcaccgacgcacgcccccagctgccgttcctcaacgagcacgcctacaccacccagatcgactacaaccccaaggagcgggtgctgtacgcctgggacaatggccaccagctcacctacaccctccacttcgtggtctgagtggagacctgtgctccccggagaggggcagcagtgcgggaggggctttgcacagcagctcctgcaactgacccagtccgcaaatatttattgggggccagcccagggctgggactgggcatgaggtggtcaccaggattgagcttcctcagcacccagtgggtaatacttg

SEQ ID NO: 131834 - DNA, 458 bp, Homo sapiens
tgtgtgtgtccaggagtgtgtgtctaggtgtgtgtgtctaggtgtgctcgttgggaactgcttcctggtgtgcggcatcctgtatgccgtggacacgtacaaccagcaggaaggccaggtcgcctacgctttcgacacgcacacgggcaccgacgcacgcccccagctgccgttcctcaacgagcacgcctacaccacccagatcgactacaaccccaaggagcgggtgctgtacgcctgggacaatggccaccagctcacctacaccctccacttcgtggtctgagtggagacctgtgctccccggagaggggcagcagtgcgggaggggctttgcacagcagctcctgcaactgacccagtccgcaaatatttattgggggccagcccagggctgggactgggcatgaggtggtcaccaggattgagcttcctcagcacccagtgggtaatacttg

SEQ ID NO: 131835 - DNA, 628 bp, Homo sapiens
gggataattcttgatctcttaaaattggcattgtcttgtgtgtcccttaatttttaaccttattctatgctatgtgaaggcgtgaattaaatcatatttctctcctacatccaatatctcttaaatcccaattttgtttctcttcatctgaactcttagagtacttatttgacaacaatcatagtcagtctgtgtttctaattactttttatatgtttatatagtatataagaagattagatcatatgctgtataatttgtgtaaatttgtacacaataggcacttaataaattgtgctttattgaaattaaaaataaaattgacacttattaatgataagaaccttagagatcaaatggcccattttccagatgaccaaactgaggcccagtttctttaatgattctgccaaggtcaatctactagttacggacataactcagatttcaaaccatttcagtgacctatccaagaagaaatattttagaattgctgtcattagatttttagttagtactccattttaatgtgtcattaaacaaattttaataaagttgattgaaattagagaatagacttttgtttccgaaaggctataaatcacatagtaatttagcttcaagctca

SEQ ID NO: 131836 - DNA, 566 bp, Homo sapiens
ctaagatctctgatcccccctgcctccaagctgcccttttaaggacgatgtgattatggttgggccaaggggacatgagcaaagggacttgtatggctggcaggtggagcacgaaaggacggggtgcatctccccctcctcaggccaggctggaacagatggagactgcacaccagccacagctgagcaccaaataaaaatcagcaggtctctgggaacgctgcaccccaacaccagcccaggactcccgaggtgggcttttagataggagagagaattatctcctctttaagccactgtcactttatgttcctcaaaataagacctcttaacacctcccaaatctgcaccgaactaggctgcatggctggcaagctgagtccaagcacatcagttccaaatatgttagtgccagttgatcggtctgttctcatacaggctggcaaaaacaagatttaagcagcaatttaagaaacagtttttttgaaagaggactctagaatattctgggaacactgaatcatatgattttagagctcacatgagtcttaagatcatgttatcta

SEQ ID NO: 131837 - DNA, 355 bp, Homo sapiens
ccagaaacagtttagattgtttaaaacagcagcattagtcatccagcaaaatttcagagcatggactgcaggaaggaagcaatgtatggagtatattgaactccgtcatgcggtactggtgcttcaatctatgtggaagggaaaaacactgagaagacagcttcaaaggcaacataaatgtgctatcatcatacagtcatactatagaatgcatgtgcaacaaaagaagtggaaaatcatgaaaaaagctgctcttctgattcaaaagtattatagggcttacagtattggaagagaacagaatcatttatatttgaaaacaaaagcagctgtagtaactttacagtcagcttat

SEQ ID NO: 131838 - DNA, 422 bp, Homo sapiens
tgtgggagttaaaaaagcgatctcatgaagatagagagtagattggtggttaacaaaggctagaaagggttagtaggaaggggaggatgaagagagattgattaatgagtataaacatacacttagaaggaaaaagacctcgtgttcaatagatcactgaggtgactatagttaactaatcaattgtacatttcaaaatagctagaataattttaatgttgctagtataatgaaaagatcaatatgtaaagtgatagatatcccaattgccttaatttgattatatgaatgtatcaaattaacacatatacccccaaaatatgcactaatagatctaatacatatcataaaattaaataaaaaataagacgtgaaaaaataaaaaaataaaattgccaccttaccaccactaaaatctactc

SEQ ID NO: 131839 - DNA, 195 bp, Homo sapiens
tgttccataaatgttactatatgttggtgaggaggagctttgacttttatttttatttatttattttttgagatggtgtctcactctgtctcaaagagcttcagtgcagtggcatgatcacatctcactgcagcctcaaacccctgtactcaagcgatccttccatctcagccacctgagtggctaggactacag

SEQ ID NO: 131840 - DNA, 465 bp, Homo sapiens
gactctgtctcaaaaaaaaaaaagagtctctttttttaaaatatttaatatttcatttcaaaataatactatgagttttaattatgcgttctacaaggaaaaaataaaagtccaaattttcactggagaaacattaaacaccaactactgtaactaatttatgcctggctttccccccaaatgctcattgtcagaaaccaaagagaaaacttcccaaattgctgtgactaaatgggcgggcatgcagaaatcccacacaggaagcccctcaacaacagaacagaagaatctcagctttagttctttagtttaaaaaaagtttattcttaaaaaaggcagaggctggcgagcatctgcagtactttcaatatgaacaatggtggaaagccagaagtatttaaacaaaaccaccattccaatgacatcttttgctcttttcttgatggatatccaactgtttaagcc

SEQ ID NO: 131841 - DNA, 771 bp, Homo sapiens
tatttgttagtatcattatagtcatacaaaagggttattttgggggtttttttggtcctctttaatatacgtattagtaggatagactttatgagtcacagctcaactgagaagatataatgtgattttaaaatatagatttttcttctgagactgtgaaaggtcagggtttgtgaagctagagtcctggaaagagaatgagtgatttataatactcttcagagtgcctaaagagatttttaaatttcttcatggtcttagtccctaagagctttccttgaaatagctttttagtttctgtgaagcctgtagtctttcaactgaaagcctgattgaagccatcacactcttactaggatacagaagagaaagggtgggattttgaggatgataaaaatggataaacttagaataaagggattggtgtgacgcctaagggtttgattatagtcactctttttaaaaaacactactctttcaggaggaaaaggaaagtaagattactatctaaaatacaaaagaaaaaaaaaactaacctgcaaagatgaaacacagggaaccttcaaataaaatgctctttatggtgcctcctgaattatgattttttttcatatttgagatctatttctatactatattcaaatggcttaaatatcctagacaaaaacttgtagttgttcttgaatggattattttatgttacagaattatgaggatttatctcctggttactaattgttatgcagttgacaatatttttataagtgaagc

SEQ ID NO: 131842 - DNA, 733 bp, Homo sapiens
attttgattgggattggcccgaatctatagatttgcagagcaataccttaccctctgttattttaaatctaatttctctcaatgctccagcttgcaaagaggctttttttttttctcatcatgaatgggtgctgagtgtgtatcaaatactttttctcctttacttcatatatggagttaaattgcatttgttgactttcgtagtgttagccaaagtttacattcctgaaataaatccaacttggtcatgatttattatcctttttatagattgctagatttgacttaccatatttaagacttatgtgtctgtctttatgagcatttggcctataattttcttgtaatatccttatcaatttttagtaacaagattgtgctggcctcataaatgcaaccggaaagtggttcctctttaattttcttaaatgtttggaagtttcactagtaaagccatctgggcctgaaaattttgctatggaaaggtttttaactacaaattcaatgtttttggtagatataggactactcattttttctagtttttgtgtctttggtaatatattttattggaaaaacctgtcaatttcatctgaattttcaaatgtattaccatgaaatcgttcataacatcttaagagcttctgtctgtgggatatgtgatagtagttcatttttcttccctgacactaataacatcatctaccactaaggttcatttctattcgcaaaa

SEQ ID NO: 131843 - DNA, 382 bp, Homo sapiens
gcaaatagttgaataactttgttcctagttactgacatacaattcttaaaggaccatttagcattttggccaacaatgagtaattaggattagtacctttttgttttacagagtaactgagagttttgtaacatccagagatggtactagagccaatgagagatctgttcctagatgcactatttctttgaggaagagagagaagagaagtgtctggttgggggtgagggggtgcagacttttttgtttctatgtacagagcaaagagatagagtcacaaggaaagacaattaatgactttgagctcaaccaactgaactgcctttcttggagctgcacctggaccaagtttattttttaacaattataataacgatgattt

SEQ ID NO: 131844 - DNA, 333 bp, Homo sapiens
cgtcgcctctctctgatggcaatgtagagtggattagaaacaacaagaatagcagcgggattgtgccattgcactctagcctgggagacagagaccctgtctcaaaaaaagacagataagcagtgataagatcctgtaccttctaaaatctttatcttaagcgggggtagagtgttacatgataagataggcattttgaaagcatctctctggtggcaatgtagagtcgattagaaacaacaagaatagcggcaggaagacaaatttggaagctgttgtagtagtttagctgagaggagatgatggcaaggactatggtagtccctccgatga

SEQ ID NO: 131845 - DNA, 471 bp, Homo sapiens
agggcactggggagaagcatttatgaaggtcaaagcccaggagcacagactaactaaaacattgagaacaaagcataaggctatcccacaccttacactcaaattagtaggggtcttgtataataacaggttaatggaatttaaaggactgcacatctaagactttatttaggaagaagtccttaaggaaacccaaaaacaacagtgaatacaaaaacaaggaccacagaagaaatgttagcctctgatatctacagttacatcaaactgtaaacatgtcacataagcaaacttggttgtttcagctacaattgtaaacaaatgaatttgctctgttgctcattgaaaatcaacataggacttgcaaggacaaacatttgaaagattacctctttttctggcttagcatcaccccaaaagcttctgaatttcaagaatgataaagcttacatttagctgctcattccagat

SEQ ID NO: 131846 - DNA, 270 bp, Homo sapiens
taaaaggtcaggggtctatggctagttttttatcaaaaaagttggtaccaacgtggcacaatatacatatccagataggtggagatattattgaaattctagttatgtaatttttttccctataactatttgcagaacgtggttcaagtggaggcggcttagcccagtggttagttaagaatgctgaggttttttttttttttttttgagacaatttcactcctgtcgcccaccagccttgtccctaataaatttaggtggtttctttcc

SEQ ID NO: 131847 - DNA, 515 bp, Homo sapiens
tagagcacatatgcaccgagaactctactagatgctaatgaaacaatggtgacaaaacaggctgtccccgatccagctcacagcgtactctggtactctctgcctggtgagttgatttcatgaaaatttcttttgagtggtttctttgagcagagcttaaagaggatgaaaggaggacagttgtcatgagtaataggtgaggaacatttacaggaacagaaaattgtctgaagactttagggacatgtcaacacttagctgagaaaatcatgatgcttgcatgcctaactccttctacctggaaatcggatgtgagcatgttagagatttcaggaagagtatggtgtttaggaacagaggcacttgccacacagcaaacgtcagccagcaggaataagcacatagtagcttcaggtgtgatcaccagccatagattctctgttccccaccccactaatactgggactttttacacacctatatttgcccatattttcagcagaatatcctgtagt

SEQ ID NO: 131848 - DNA, 272 bp, Homo sapiens
tcccagctcttagggaggctgaggcaggagaatggcttgaacccgggaggcggagcttacagtgagccgagatcgcaccactgcactccagcctgggtgacagagcgagactccgtctcaaaaaaaaaaaaagtgttataacaaatcctaaaagtacaaaaatgtaaaattttaaatgacctgaaatttacacattttaatagtggaagctcctaaattctttcttttaaaagccccaaagtgtattggccgagtattaaaagtcaaggttt

SEQ ID NO: 131849 - DNA, 211 bp, Homo sapiens
ctgtggagacactgccctctgtgtgcctccgtgcctgagcatgagctttatcactagccgaagccttcccgacaggctggcatcactcacctggatgcagggcagatgctgaggggtctgttttcccttcatcagtttttccctcccagcatcaatttctccttttctagtatcaatttccccttcccattatcaatttccctttcccatt

SEQ ID NO: 131850 - DNA, 815 bp, Homo sapiens
aggatccgaaaaaatctcccaaaactcccactctgaaaacttaatgcatatgaattgtaatgcagagtatgtgttgtagtagaaactgtgctatgatgtgcagtcttactagatggtctccaagaatagatatgcatagtagcgagtcatcaagattttcaacaagaatacataggcattgatttgtcacttgcaattctagattgtggtctatgtccaaatgtcttcctgtgattgtctctaatcatatagtctgtcactccaggactcagcgcttcgcgtctccttcgtacgtaatgcttcttcttatgcaccctacttgctgtttgatcgcgtcgaggctccagatacctatacctgatacaatcggtctaggataggtctgttacctacggaagatccttcggatctatctgaagcctacgtgcattgtacttctttctacgaaatacacatagatgccctcgcgagaggaagctctagcagttctttgaagctagaatcactacattaggagttcgttgagggtctattacgtggtagtctatcgaacaatggagatccacatgcagacgctctaagtagtcttagattaagctccgtccttatgttcagaaggtcttgtgggcagacattatgtctagcacagagcttggcatggaggagacatacggtgcatgtgtgtttggggtagccaagtcattagagagtaacttagttcactagctcacagcccttgagctgaagctatatgctgacatggctactgatgattatgacagagaatggtggagctttgtgtggaggagtccctg

SEQ ID NO: 131851 - DNA, 624 bp, Homo sapiens
tggtatgcaaaagtaaggtgtgccatatgctgtgtggtgaaggtatgtgtgtgtatgtatgcgagcgtgtcacgtgtatgtaagtgtgcgtgtgactgtgtgtatgagtgtgtgtgtgtgagtctgtttgaacactattccttttagagctgatcaaatagtcaattacagcattatagggaggtagcagaatcacagagttcctacaaatacactgtgatgtagcgttggatctttagatgcctcttgtctccgaggacttgcgcaaggaggcttggctttataaggatattattaggttgatgcctcattctctcaatttacctgccaggcaagagacagcactcactgggagcagtctggccagaactagccactgggaggtgcactgaagaccatgctgcaggcttgactttgggcatacgctactctgagcctcagtctctttatctatgcagtggcaacagttaattcagctctactttctaaagaccagagaggggaagtttactgagctcaggctctcaaccttctgcaccaaaacttccaatcatatgaaagcctggcatgccagcaggcctgatttattacatggtgagatgtggccctttaacttttagaggg

SEQ ID NO: 131852 - DNA, 504 bp, Homo sapiens
tccataatgtgtgcccacccccacggtgtatctggctgacagcagttccagcattatagggaggtagcagaatcacagagttcctacaaatacactgtgatgtagcgttggatctttagatgcctcttgtctccgaggacttgcgcaaggaggcttggctttataaggatattattaggttgatgcctcattctctcaatttacctgccaggcaagagacagcactcactgggagcagtctggccagaactagccactgggaggtgcactgaagaccatgctgcaggcttgactttgggcatacgctactctgagcctcagtctctttatctatgcagtggcaacagttaattcagctctactttctaaagaccagagaggggaagtttactgagctcaggctctcaaccttctgcaccaaaacttccaatcatatgaaagcctggcatgccagcaggcctgatttattacatggtgagatgtggccctttaacttttagaggg

SEQ ID NO: 131853 - DNA, 791 bp, Homo sapiens
agggcaactgccctaattcagatagatttacagtaacctacgtacagtagatgcacatacacacagacacccctttgctggagaaacttaggaccctgtcagccttttaaaggaaacagcaggagtggtgtcctaaatgatgttcatgcagctgctttaccatgttcacagtcaagcccatgcatgccaggttaaaactgtggaaatcaaaagtaaattcactcatattttaatcattttaactgagatttaaaattagaagtttaaaccactatatataaagaactaatcttttcttaataccagttctttccatagcatatgctttgcaaaggcagcatgcataaaatatttaaaatgagaggacagaatgttttcacatttgattcaattttaatataattcctaattgtggtaacacagttgagatatgtattatgagttatgggaactaattgagaaaaggaagttactctaatccacgtatgttaagagaatattgagttttcttagttgtaaagttggggagatggcaccttctcagaggattgtgaaaatatgaggaagaaacaaaacagtgcatgtaggagcacagggccacacaaaggcattctattgttatgctcattctgcttctgtaatgacttttcataggtcattcttgtgaaccattttgttttgcaagcaaccaaggaaagaacatcttaagtgggaaaatcagtggtggttgtgaacacttaggagaatagccaatccacaggcaagaataatggtattgttttgtagagctt

SEQ ID NO: 131854 - DNA, 762 bp, Homo sapiens
tctcacttggctgcttctagcaaagggtagagttctcgaccttccattcgcattgtaacttttaattttatcatgtgctttgccatctagagatatgagtgattaatctagttagattttaaataatgttaactctagattttcattggacttttgcattttagcagtgctacttttttttgagatgttccttctgaatatctacttgaattttcattgtttgacttgaacttctgaagagtgtgcatttaaaattctgttcttttagttgtaaaggaaagcattattatcctttcttctgctattgattactaaaaatgatttggctgcaggaaatttagcactgtagaagatttcatttcatagtctttaaccaaaaatatactagagagatttcttttcaagatatgatgtctgcaagagctaaatcagaagccctccctgcataggtcagatttttccatttctaagttacttaggtcttttcctttttggaggtcttctcttctgcaaagaaaccaatagttgtttgtgcttttacattacagaagacatgtaactaatgtggctaatctgaacattttgggggcatggtaattacaaagatttatcttgctactgaaatctcagaagttgaacataatgaaagcccagaactaactggcacagctatcctggcacatagaataagtttggttgaaaagaaaatcaacagggagaaaacctgagccgagagacagaaaatgaggtagatctctaatg

SEQ ID NO: 131855 - DNA, 763 bp, Homo sapiens
attttagttttgttatgcacactgtctttagaggaggccaggagaatagatctaacttacttttcttctcagttaaactcattgtcattgtgttagtaaccagagtttggcatgtgactcagtggaaatatcaagatatcatttttcttcataagggcacaattacatttacacttgtgatgaaaacttctaacttagaacagttcaaacaccaaagccttgcttttgaggaactatttaattgatattatgatgtagagttttgacataattttcctttgcgtgatacttagataaacattttccctaaaaataagattaaagatagaagagatttgatttttaattttattcgatcatttaattaatactaaaatgcaaataaagtacatttagaaaaaagtaactggtatttcacttccttgtgccaacatttttctcattcctttatctgtagcaggagtcattactttgtgagatactatgttgaatagagctgtggcctaagtcaggtattatactgcaagtcagagggtctgaattctattcttggctctgacatatctctaagttactctaatttctctatgtgtatgccagtcctaaaattagaattaaccccctacaattagaattaatcccctaaaattagaattaactttccttctagctcaactactggggatgttgggaggactcgtgaaagaaaccaaataccgttacttgatgagagaaaaggaaaagggtagttaagggagatctc

SEQ ID NO: 131856 - DNA, 339 bp, Homo sapiens
tacacctgagctgcctgcctgtttctggtattctgtgggagggagtcgtgagtaacagccctctctccccatcactagcccaaccaggaggatgctcaggtcccaaccacacgccctcatcagatatagatcagaacattctctctcccctcccttccaagatggggtgaagttttgggccaaggagattgctaagatttttattttagaagttccctgattggagatgggcaagactggctcatgaactctctgtggttttgaagatagggtggcatgagaacgtctaaagcctatgtctggagttacgtcgtactgttaggatggaaaacaggctct

SEQ ID NO: 131857 - DNA, 150 bp, Homo sapiens
ggcagttatggtccttcatttgttgatcatctgctgtggcagcaagtgcctcatgcccttccattgcaatgcaagccttccaccctcccctcagaacagaatgctgatgtcagcagcagcctggtgctaaatccaatttggaaaaaaaaa

SEQ ID NO: 131858 - DNA, 984 bp, Homo sapiens
gcttccagaaaagaaaagagcctcagatgggcatgtgtataactccataaacacactgcctgtgctcagttctccaggtaaggagggcaccgtgcttgcagaaatcccaccctaagggaagagtcatgggaaagaagtgagcctataaagtccaaggtggcccaatgtaatcacaagggtttcttaaactcagaagagggaggaagaaaagtcagggtcagagtgatgtgatgaccaagacttcacaactactgctggttttgatgacagaagagcaccatgagccaaggaatgcaggcaacttcaagaagctggcagaaggaaacacctgtctaaagaacaacgtagagctcatcacacagaagtgagccagctatctctgccaggcagagtagagttctagcatctgtgtcatcaggccaaatgatgtatgatccagtttgatttaatttacttatcattcacattggagagaattcaaaatatgaagacagaacagatcctgattaaagaaaggaagatgcagagtgccctgcactgaatttgtcaccagccagcagagggagtgtctgaagcttcagtgcacgcaaagaataactgtggcaggagaacctcttgacttgcacggaatatttacctacaatggcactggcaaattcacactcagaagacactaacattactccggattgcgaaaatggcccagtagagtgtcacgggagtggcccatccctggatgtatgtgaactgagttgagaagcatggacatacaattggctcaccaacctaaatagccgaaacaatcagtccaggacgcgcacgaccaccacacaccgagagcgagggccctgcaacgacggcggaacaaggaaagggacaaccaggcaacgcgaaccacccaaacggaccgcccaaaagccaacacagcctgcaactcacacaacaacacaggacacaagcgacagaaacgaacccggaaaacac

SEQ ID NO: 131859 - DNA, 349 bp, Homo sapiens
  misc_feature (77)..(77): n is a, c, g, or t
cccactagatgggattgtctagttgcaggaaaacaagctcagggctcccactgattccacatgatgatgtgcctgcntccccattcgccttctgctctgccatgattgtaagtttcctgaggcctccccagccatgcttcctaaacagcctgcagaacttgagacgtcttcagtgtcaaagcagtaccagcatattctcctcacggaatatttggagagaagccaattcctgttcgaggagcagctgcaactaaggacgtgacatggcttaccgtcaatgcttaccagatgctatgatacagcatctatgtttctgtcatgtgatacaggaaacatccacagactcctt

SEQ ID NO: 131860 - DNA, 174 bp, Homo sapiens
ctctgcgaggacgctgcaaccacaatcttactccttttctctcctgttttatactcttcgtcccgaaatctgtgtaaacagggtcacattttcagcgcagtaactccatgttttgagctatctacgttgtatttggtaaattgcctggttatgttaataaaattattttctacc

SEQ ID NO: 131861 - DNA, 232 bp, Homo sapiens
ctctctcacccttggtcccacgcgtgttgagagtggtcctgactctgggattcacctccaggctgaggatgagaataaagtttggcagctgtttagagcaagttcctgacacattgttcccttctcaaacttgttctgcccctctggccccatctgcactttctgcctccttgactatagaaggaagaagactggaattttccaaccctgatgggggttgggggagggggtg

SEQ ID NO: 131862 - DNA, 318 bp, Homo sapiens
catctcctctgccacttcagctcttcacatccttggatgccagtgggaatattgctattctctatgcagcatccctgtgcaacgccgtcctcccctcctcagtacccttgccagtgggcacccttctgatgcatctctgtatggtatctccctcctcccctcagtgccccgtgctggcgagcatgccaaccatgcacctctgtgaaattcaccctcactccacagacattttctgtagtggcctgtgattgactgctctgcgccaggaacagaaaaggagaaggaactataatttcttttataggtaattaggaattc

SEQ ID NO: 131863 - DNA, 950 bp, Homo sapiens
actatgtcaatttgataatttatctcacttaaaccctgaagcaaacaagtgtttgcctccataaatgcttataaggcctgttggatggcaggggttggccattcaattcaacaaaaattgatgaagaacttttcatacctaaggcactgtgctggaggcagccatggttctattcctagctttgtaatgggagcattagtcttatacttaaccttccctttttacaactgagccttaaaaatctagagcctttcaaaaacacctgtgattacattaattaaagccatttcagagtttttagcaagcagaatgtcagaaccccaaaattcattattagctttgtctgacataaaccaaggccaagtgtaactgaaactgttaattagtaactttacttcttgctttgtttttactctgctttttaaagagactcgggttttaataagcaggttttaagcaaacaggttacttgactctcctgtctttattaataataattactgttatctattgaccatgccacacactgagataagtactttaccaacattaaggtaaatcttacagctgccttgtgagttaaggactgttatatccatttgctaaaaaataagacaactgagacatgggaagattaaataacttgcccagaattgcctttctttttttctttttcccccttattgtggagaacggggtctcgctgtattgcccaggcaggtcccagaattgcctttcaagtaggagacctgccatagactcagagtcccaaaccctctgaccccaaaactcagatttgcaatcattatattgtgctattatttagactgggaatcagcaaacttctgtaaagggccagatagtgaacattttaggctttgtgggccacactgtctctgtcgcaactatttaactctcttgttgtagcttagaagcagtcgtaggctggg

SEQ ID NO: 131864 - DNA, 473 bp, Homo sapiens
tgagagtctccttccggcctggatactgaggaaggtgacttagactttctctccgtcctctgagtcgtaacggacggacacgcaagggccgaggacgggtacaagcagcagcgactagaactgatctgggtgagatctaggcctcagcaacaactgacgcaaaaagattttgttctaggattggctacagctgaaactaccgcgcttgattcaaagctcggggcttgcagcgggaggcagctggctcctccctctgaacccgccccctttggctggcccaatccgctgatcccatcctcttaggccctgcccagactccaaatctaccagaattaatgctcccagcgctgtttgtccactcctgcctatgatttgctgtgtgactactactcgtgggggtaccgtgattagacgctttaaagctattagctatcttgtttaatattaacaatgctactagtgaaaaaaaaaaa

SEQ ID NO: 131865 - DNA, 396 bp, Homo sapiens
ctgctgtcttttctgggtgagtcttttgactgggaaagcctgagaagcagctgacatgggatctttgtgaagggcagcatccatgactccctaatggggtcaaccacacgtctgcgtatcctcaccctccacagcagcatccctgcttgagctaaaaaagtgggcagactgtcaacttgggccttatttttatagctcctctatgataacaattaaacaacaaaattaacatttcaaaacagtcaagtcaaggtaccaggaagtcagtcctatcagaaaaaagtcaagatgcaaggtacaaagggctgagtgccccttccatttatcttgtcattttaattttgtttggtcttagtctttgttctgtgtttggctctctatgctagaaacgatggc

SEQ ID NO: 131866 - DNA, 447 bp, Homo sapiens
ctgtcagatgggtgacccctgtgggtctccttaaatacatatttagtggcctaaatcacataattcatgacctcctcagtcagagtctcatggggataattgttatgaatgacattcctgggctcctgcctccaccataatttgaggtgggatctgagaatctgttatttaaagttccttctgacacaaaagtgtgaggcagcaggaagtgcagcatctggcagatgtttatgatatgccagtttattccgtttatttctggcctttgttgcttctcagaaaacctcaaagatacctgatgctaagggtcttgtagcagttacagtctgagcttgggagttggtaagtttgatgttactttctgactctgggacttagaagtggtgtggctccgtaacctaacaaatcccctggaaatgaagacaacaggacccacctccatgggaa

SEQ ID NO: 131867 - DNA, 172 bp, Homo sapiens
catacctatattttccagagaaacaatggaaagataagtcaaaaattactaaaatgatgcccatagcagaagggagaagagaggataaaatggacaatgatagaaactagacttttcgtcgttttagctttggaactacatgaatgtttcataaaaacaaataaaatttaat

SEQ ID NO: 131868 - DNA, 538 bp, Homo sapiens
ttgggtggcaagggagagaggaaaagcacaggcaatgccaggtgcctgagattcaggacgcgctcagagaactctgtgacaggggtgcagtgactctactgagatcaccctgctggtcaatagaagaacctggactagaacccaggtcttgtaactctaaatctactagccacctcccaaccccactcaatgcacccatgagcctgttagtaccgtaccatatggtctccaatgggagcgggggtcccaaattagttctctactctgaaactcatggcttgggaaggtaccttcaaagatcctctttctttgaaaaaacactacctttgagtttaaaaagattattgccaaacaaataaaaagatgaaaaacctcactcataacttaaaaaaaaaagcaattcaaaacaacgagatcccatttttcatcgaatagactagccaagcaaacttcaatgttgcccacggttgtctagggtgcggcacggtaggcagtctgatattctgtggtaggaatctaaataagagcagccttttgg

SEQ ID NO: 131869 - DNA, 298 bp, Homo sapiens
ccagaatctagtgctaacagatactttcctgtatctttctttagcatctacattaagtcacacacctgttggggttcagtgagcacaagcaactataagcatgatgaggaaggactactgacacaaaccatggcaacacgaacatatttcaagcttgagtggcatagcctgctttaacaatgagcacagaatagtaacatgaaatttccaaggatgggaaaggagggtaactttttttattttgcttctaagagtactgggtggccgggcatggtggcttacacctgtaatcccagca

SEQ ID NO: 131870 - DNA, 593 bp, Homo sapiens
gtcagactccatagctggcaccaagccccctcatctctggctgcctgatgtatctttccaacccagctgcaattcacccgccctcagctgtgagtctcctaaatcatcttcagtaagactggctgctctgtgctcacccaccctgctgcccttactcactcctctttcccaccatcgtctgcctggtgggagtgtcctccctcagcactcagcttagatgctacttcctacttagacccccagacagaggagaccatttcctcctttgtgcctcagtgtagtttaccctatatggatggcaccaatacaaatgtgtgcctgcctccttagaaactgagcccctgaagaacggacccacctttcactcaacttcctggaacctgacaaatagccaacttagaaactatttcttggtctcaatcgagttgagttaaacctaactgaattgaaatatgggaggggcgtggctttgccaagagaaggttaaaaaatctacccctcttgtatatctttataattgacaaatctaaatattgacatatgctaatagcattgtatattacacttcaaaataaagtttttaatatgctgta

SEQ ID NO: 131871 - DNA, 498 bp, Homo sapiens
aaacaccgcaatctcaacaccgcaatcttcaacggacagatcatccagacaacaaaacatcatcagttaaactgtactctataccgaatagacctagcatttacacagctttccattccacaactgcgcaatgcacattccactgaatagcatacggattattctccacaacagactatgcgttaggccaaaaaaacaagtcacaacacatttttaaaaactgaaatcatggccagattgcggtgtttgaaacccgcaatctcaggtagggacttgggaggaaaaagaaaaaaagcagggcctgaatggtcatcatccatgaatctacccttggagactggttggctgtttcatctctgcttaatccagaataacactttcatgtgggactgtggtgtacccaatctcccagtgactccaagtgtatggagaagttaagattttcctggatagcttttctgcatttgactgatccaggtgtggtctggtgttggcagg

SEQ ID NO: 131872 - DNA, 372 bp, Homo sapiens
tcaggactcttatatgctgtatcactgtcttaaagaaccctacaccttctgctaaaagctctcatgaaaaagaaaaaatgtcacaggatacataactcagtaccttaaagaacacaataaaaaatcaactctctttcagacagatttaatggaggggaaaaaaaaatgtttttaacagaggagagagggccgggtgtggtggctcatgcctgtaatcccagcactttaggaggccgaggcgggctggtcacttgaggtcaggagttcgagacaagcctggccaacatggcgaaaccccatctctactaaaaatactaaaagaattagcggggtgttgcagtgcatgcctgtaatcccagctactcaggaggc

SEQ ID NO: 131873 - DNA, 961 bp, Homo sapiens
taataaaaaaaagagggaaaaataaaactgagtacacaatagagaatttgtatctatataaaatgcaatcagatattctcagaaagtttaagttattgaaaattttagcaaattaaaaataagttgtaaaatatttgttttggaaaaagctaatgcagaaattatgaatgaatttctaattttcaccatacatagtggtttatcctaaaattaccactgctataaatttaacattttttgtaaatgcttattatgataagtttaaatacagtaaacatgcatgccaatatttacttggaaaactgcagttattctctatatttttatatctatttattttgaagtaaatacatagacaaacaggaagacaaagagggtggcaactcttatgctttgaataaaagaactgaagaccaaaagacagaactgaaaacgagaatgagacatacaaaagaacaagagtgacaaccgcaggaaaactgaacacgagcttgcacaaccgacctacgaacgaaaccgacccccaacgaacgaccggaacggaactacacatacgtagcggactaacactacaaacacaccgaactgccccccggcgcacgaccaacgacaccgacacgacccaccccacacggccgcaccaacacgaggccccaagctcgccttacccacgcacacgaccccacccgcccgaagactacgaaacgccacgctgaccacgactgacccaccgcacgctctggagccgcccgccacccgcaagacgacacacgaccccgggcccacaacagggggacactgcaccacgacccaacgggacgctaccacaacagcgacacccaccacaactaaacgaacaccacacaacaggccccacacggacaaaccacacaccagcaacttcacaagacaatacccccggcagaccctaaccccaacgcccccaaacgcccaccaccca

SEQ ID NO: 131874 - DNA, 798 bp, Homo sapiens
gtgatcattattattattatttcaaacattaaaggcagacctgagatttttaagtttctttaaggtggtgtgaacttttgaaaacattcagaaattaccagctgctattgggaggaattaaaaataaaaaaggaaaaaacattgggaaacagtatttcattatttatttgtttacttattcatttatttattttggaggcggaggttgcagtgagctgagatcacaccactgcactccagcctgggcgacagagcaagactccatctcaaaaaaaaaaagtcaacatcattccttgatacattaagttttttcagagaaagtccagctatgctaatgagactcactaacatttttcaagtgtattctatgtattacctcatgtagtactgaagacagtcattggaagtatgcagatagggttttacagggaaggatatggagacacagaggatcatagtagcttgccctagggcactcaggtataataattggcagagccagcagccaggcacggtggctcatgcctgtaatcccagcactttaagaggctgaggcaggcggattacttgtggtcaggtgttcaagaccagcctggccaacatggtaaaaccttgtctctactaaaaatacaaaaaattagccgagtatggtggcacatgcctttaatcccagctactagggaagctgaggaacaagaatcttttgaaccagagaggcagaggttgcagtgagccaagatcatgccactgtactccagcctgggtgacggagcaagactctgtctcaaaaaaaaaaaa

SEQ ID NO: 131875 - DNA, 759 bp, Homo sapiens
atctgggtaatgatagaagtgtctttttgtatgctgacaagatgaatggagacttacagtccctagatagctccaggatggagccggttgccagagaaaccaaccacgtgaatagaggattggaactttcagctccacaccgggacttctggagtggggagggaggacagagaccgacttaacagtggccaatgacttaataaccatacctacttaatggagcctcctccataaaaaccctaaataatgggatttgcaggacttctgggttagtgaatatatccacatgctgagaggatagtgcagccaaattctatggggacaagcttctgcacttggaacccttctggaccttgaagaacatatatataccttttcatttggctattcatttctatcctttgtaatatcctttataataaatgggtaaatgtgtttccctgagttttgtgagccattagagcaaattgaacctgaggagggcatttgtgggaacccttgattgatcacaagtacaaataataacctgagatttgcaattgtcacctgaattggaagtcagtcttatggaactaatgccataacctggtagcatctgccctaagtccaggtagcatcaaaattgaattgtaggatacccaattggtgtccagagagttggagaattggttggtgtaggaaaaccctcacatttggtgtctgaagtgatgaaggtagaagagacagtttttcactttttacaaatgatcaaggctggga

SEQ ID NO: 131876 - DNA, 372 bp, Homo sapiens
agaagataggaaaagaaatatcccaataatgggatgatagattgcagaaagattagctcttcgttctattctcaaatggtttgaactctgaggggatgaaggagataaataatacccccaacccttaaaaacatttgtgtagaaaaagtaaaagaaaacagaaggagagttacagaaaaagaaatgtttctacaagcatacaccccaaacttttccaggataagaaaattagaccaggaatttggacatggttttttttgtttgtttgtttttgttttggtttgtttgtttgttttgagacagggtctttactctgtctcccaggctaaaatacagtggcgtgatcacggctccctggctcaaagcgatcct

SEQ ID NO: 131877 - DNA, 190 bp, Homo sapiens
ctcagcaattcccaaactaaaattcattcttctgcttcctccaaactgggtccctcctcagctttgctagctctaaatgaagagtgggatcagtcactcaagctcagtttcagaaatagcctctacttctttctcttcaagaagtcctattgatttttttccttcaaatcttctcttaaatacaatcttt

SEQ ID NO: 131878 - DNA, 467 bp, Homo sapiens
tccaaatttgctgaaataatctcatctgtttaatgacattgtttaaacaaaattacctctgaatttgaagttgccattttctcagatcagtgtggaattgtagtaattttaaaattctagaagtttcttttgtaacctttattatttgatatgtattggatttatttgtaagatgtcaatagattccatttcttaaatatccaactagaaagcatttaattgttcttttaacatttgcgagtgtggtgggcataatttttaagagactcacctattgaggagtcatcgtacccaaacactgatgaccaggcctttacaaagcattttggcctttatttacattctgggtacaagatttttcactgcaattaaaactataaccccaacttcactgaattatctttctgttaccaagactttttattcagagccacaacgggattaaatgaaaatgaccgaagcctcca

SEQ ID NO: 131879 - DNA, 1598 bp, Homo sapiens
tgctgggattacaggcatgagccacgacgcctggacaactttgtcatttttagtgatactcagatatgttccattgcagaaaattgtattttattagttattattgtgttttttggactcatctacatgggatgagtcctaagagattcagtttaaaaaagtttttttaggtacattaaggacattatttatcttttgtaacctgttcatgtctatgtctgttacttgcatcaggcagtgactcaaacaattctcaaaaaacagaaagtatatttctcttaaagttggcttattaagggactatgaggtgatccaattcaataagaaccaaactagacctactaagattagtcaggactatcagagaatttttcaaatacattcaccattaatccagagataattgtgaatcccaacttttaccctaagaaaaattattgcaatgtagtaaagttgattctgtctttaaaaagaaagaggagcacaatgagatttcctgtggccagttgaagttcatgaagtttgtcaaagaatttcacatacatagtaaatcttctgatagcatttagttccaatcacaataaattatacttgtctctgtcttctataattaatctcttctctctttaaaaaactctgtattttctgtataaaaatagtgattattggctgtgcacggtggctcacgcctgtaatcccagcactttggcaggccaaggtgggtggattacgaggtcaagagtttgagaccagcctgaccaacatggtgaaaccccatctctactaaaaatacaaaaattagccaggcatggtggcacgcacctatgatcccagctactcaggaagctgagacaggggaattgcttgaactcgggaggcggaggttgcagtgagccaaaatcattccactgcacttcagcctggtgacagagcaagactctgtctcaatataatataattatacaattataacatcctaagtatgtatttgttgggtacactgtcatatttttatgtttatgctgtaaaatgtttaaatcaagctaagtaacaaattcagcacctcacatacttattatacttttgtggcaaaaacatttaaaatatttttataccaattttgaaatatacactgcattattatttattatagtcaatattctgtgcaattaatcactaaatcttatttctcctaagtgaaacgtggtacacttccatcaacattttttctttcttcaaccacttcttccccagcctctgttacgtttttacttacactaagttacattagggccattaatgtaattaaagaaattaaatcttttggtatgcaataatgatatgaacataaataatgttaaataactttattagaaagtttgactaattaggcatataaataaatgggcagcacttttggctagtaaactaaaaatacccattattttcaaacaccagacaattattttaaatggaaaggttttgggcctaatatatgtcactgaatttatgaaagcacaaacccaggagggtagtattttctgagcattgtaagtaacaatgaaaattattgactaaagtgaattcaagtaatatgt

SEQ ID NO: 131880 - DNA, 856 bp, Homo sapiens
gctggcatcctctgtgggccatactcttgagagttctctccctgtccactgggctctgctgctcctccaaggggcagggggctggggcctccgtgagggcacctctcagcagccgtgggcactgggcctgtgggcgcctgcggagcacgagtgttcccacctgtccctccccaggctgcctaagcatccacgcctctgcagccacgctggcccagatgggcaggaggtgcacccagagggccaaggaacacacgatgtcacccagctgccccaataacaacaagttaatgatgccccatctgcattgtctcctgtgataaacgccctctgtctccatgctgtctggggctgggctgctcccggcctggtttggtcttcgtgcccagagccctctcatgcacctgtgtccagccaggcaccctccccgagaggcaccagacacactgaagatggggagtggggctctgaaggtccaggtcctgccctgtggtggtgggcagaggacagtgtggcctgtgcccagagctagggtggctcccgggtgagacttaaaatggaacggcctgccacctgaaaggcagggacttcctgatggcactcccctcatgagcacacacacattcacacacgtgcatactcaaacacgggcacggacacgctcacatggaccctcgcacccattcatgcgcatgcaaacaccacgtgctcacacagatgctttggcatgcacacccatgcagaactgctcccgtgcacacacccatcgctgcccttgcacacacccatgcatgctcccatgcacacacacccatacaggctcagttgcacacacccatacacgctcccgtgcacacac

SEQ ID NO: 131881 - DNA, 398 bp, Homo sapiens
ttccctacccagctgacaaaccatctttctaaaatataactatgatcatgccacaccctgtttaaaaacatttgatggcttctttattgcctagaggaagaagtctcagctccaaacatcacaatccaactctaattaccactgaggccttatcttctgccactatcccctaccttccctgctttctggataaatttcttgccatgccccaagtgattaatgctctttctcgttgccatattaatgcatgatgctgtctatccagaatgatatttcatacctggtaaacgtatacctattcaagaaccagttcaaagatcagcagctgaaataccactaattctgtaaaatcttttctaattccccagtgtagattttattatttcctccttagtgct

SEQ ID NO: 131882 - DNA, 318 bp, Homo sapiens
acaggtgtgcaccaccacatctggctgattttgtgtttttagtagagacgggatttcaccatgttgattaggctggtctcgaactcttgacctcaagtgatccacccgccttagcctcccaaagtgcttaggattacaggcatgagccactgtgcccagccgatacttagctcttattggccatagttctcttggagaatttggggaaaagtatgggcctctccacaccataagtatacatgatgtacttaccaaacacgtgcatgcaagtttaggggttcacaggccctggaggtttgtctgcacatctgcactgtg

SEQ ID NO: 131883 - DNA, 684 bp, Homo sapiens
taaattctctttgttcatttaactcaaagccaatttgagttaaattttccatcagttgcaaccaaaatgttgcaaactgatacagaaggtaccttcattttacagaagaagaaactgaaatccagaaaggtttaaacattctccaaatcacataggtagtgagaggtgaagccaagattcagatccaagtgtttctgaccagtgttttttcaagatgactgtggcattctagaagttccagggaggtagcagatgaaatgatgagcttaatctcaagggtatactgtgccttattagcttacaacaatggcaagtgtgtgtgtgtgtgtgtgtgtgtgtgtattcgacagttttactgtaactcaaaaaaaaaaaaaaaaaaaaaaaaaaaaatgttgggggggcggcggcgggggcccaggaaaaggttttaaaaaccaactcgggtgggggcgcggggggccatggctgatagagaacaccgtggggccaaaacaggggactaaaagaaaaacccggggataaagaagcgggggtggggggttcccacacaatataaaaagagccgcgccgggagaaaacggcggtgttgagaaaaaccccaaggagggtcagaagacaaagggggtcatcacagacaagacaagcggggagcagatataattcgcccgcggtgtgagaaag

SEQ ID NO: 131884 - DNA, 263 bp, Homo sapiens
ggctctcaaacttgaatgaacatcagaaccacttagagggctcattaaaacccagattgctaagccccagcccaagtttctcatccagtaggtcttggtcaaggcctgagaatttgtatttctaccacatccaggaaatgcctctgttgctggtcccagggccacattttgagaatcgctggtttagacttcctaccgctagtggagatggagctaatattgatactgtcagatgtcagggttgccaagggccaggcacacct

SEQ ID NO: 131885 - DNA, 445 bp, Homo sapiens
atctctactaaaaattaaaaaaaattagctgggtgcagtggcgtgcacctgtaatcccaactactccagaggcagaggcagaattgcttgaacctggcaggtggaggtttcggtgagctgatatcacgccactgcactccagcctgggtgacagagcgagactccatctgaaaaaaacaaaacaaaaaaattttattgtatatttggtagagatgggggtggggtgtggctcaccatgttgcctaggctggtctcgaactcctgaactcaagcaatctgcccgcctcaccctcccacagtgctcagattacaggtgtgaaccacacgcctggccaatttatagtaattatcttctataaaatcaccacacaccctgaattattgaatatcaagccgttgctcccaggggaaatacattcttgggtcctgtagtcccagctactgg

SEQ ID NO: 131886 - DNA, 404 bp, Homo sapiens
tcacagcagtgtcaaactactataataaaagtttctaaacactctatcttaaccctgtgtttatactgtgcagaccagtgttcccaaaccatacctcatactttgaatagcactggtttacagaatcagtaacattaagcacgtaaacagttatttcccaactcccaaaactgagcatttagactacagaagcaaacacttcttaatttatgtcacgaagtctctcaaaatacgtgaccacaatagacatgagctccaaactgtgtagctaccaagcacttatgtaactgtaagcccagtggcataagactgtggcagtagttgagaagagcaagaaatgaatagttttctctgccactccttgctgcttctacaggagatgacaggcatactcctccactgag

SEQ ID NO: 131887 - DNA, 700 bp, Homo sapiens
tatctcagtttaaccttttcttttttttctacacttgtatcaaagattaataggagaaaataatattttctcttgttagtcaattggcagaggaaatgttccatgttaatactcattcgtttaggaagactcctagtataagtgtcattttaaaagttgaccaagataataaataaactgcaataggggataagtttcacttcagatacattactttactatccttaattgttactttagaatggtcgccgttaacctgtgtctccagtgttaaggtgattttaactccagtcaactcaagcctgaatcaggttgtaggcacagcaagaagaatgagcaacaagaggtttttaccacaaaggaataacttgagaaatgggccagaactgctaatatctcttcctactctacaaaataaaagttgttaacaaaaaatatggaatcttcttcttttgggaaagtaaaaagaaagaatagatgcaaagaagggagagaattaggaaagaaaatatataaggaaaattttagtcacaatgggctcatctacaattttggtaaaataaaacgtatttcccaatcctgaaaaaataggagatgattatcaagtcattgatatgaatcaccatggtggccacttctatttaggtaaagtaaatttgagtgtgtgtgtatgagtgtgtatgcatgtgcgcatgtgaat

SEQ ID NO: 131888 - DNA, 156 bp, Homo sapiens
gaaggctgtcaggcaggggaaggctgatggtggagagcctttatgggaattgtgattttaatttaatttgagacatgatgggggccacagccaggttgaggaggtaactccatgaaaattacatttgaggttgatgacttctgtgtgcttgttcag

SEQ ID NO: 131889 - DNA, 282 bp, Homo sapiens
gtctaagtgttcattcttattagtccaataccctttattattatatcatttattaaatagtttttggttcctactcatataattaatatttggcttggccatgatgaggaaacatattctaagaaacatgagtcagtcctatgttagtctccacatagaaccttaatatagttaatatctataaatagttcgcaaatcaccagtactatctgaaagttataaaaggggaataataattgcggcacagaactgagcacgttggaacaatgagagtgtatagcc

SEQ ID NO: 131890 - DNA, 237 bp, Homo sapiens
tcccttactgctcggtgcacaccacgcagcagccaagctgaactttcacaccaggcatcatgagagcctgcagcgcctgcttctaccctcaggaattcccccaaccctgcccatgacggtgtccacactttcctcccaatcctaatggctgccactcccagcaccatctggccagccctcaccttcccttcctgggcatacattccccaaattcacagtgctctcacgagcagcact

SEQ ID NO: 131891 - DNA, 369 bp, Homo sapiens
gtgtagtgtgtctagacaaggtggccggaacagagaggaatatgcataccaggcttaaagatgggttaaatcagagcttttcattccacagaagagcaattttaataaggtcagaacatggatgttctaatagttgaaagcctgttaactaggagagagagagagtaaagtgatttgttgtaggaggacacacccggctctgacggtttaaagcgtcatgaatgcaaatttgaactccagaaaagcagagcttcctaacaatgggacttccacagcaatgggatttccttccgcattcagtttatgcctttcccatgagcgagagactcctaggagagccgcagcccgttaggaagccatgtgggaact

SEQ ID NO: 131892 - DNA, 598 bp, Homo sapiens
gttagtgctacacattccctatagtatcatttgcttggtgcctataatttcaagataagatccagtaatatagggagacaggctgctctgtattcagccaaagtagaaaatctctaacaaagatctcactagtattttatatatattttttccatacccagaaaccttcttgaattcctttacccaataaatatttattgagtcaatttgtacctatattccttttgaagactttgatgtgaaaaacatgtaattagtggcaaccacaaaagactctgcagcagcaagcatgctattgtaaacatcttttgattcaagggaaagcgggttatgtttttacctccactgttgacttgaatgaattaccattttacttctaaatattagatttgaaaatcagaaaaaacttagaatcctttcaaagactagccaatttaatttcatctcatgtatctttcacatgaagagaaacctcaaatatcggacatctccttgtagcctaattagaagctgaaaatacagtttttggttttataaattggctaacttgttaatttttcttaaactgttattaaataaaaatataatttccttacat

SEQ ID NO: 131893 - DNA, 491 bp, Homo sapiens
aggcggaggtgggcagataacctgaggtcgggagttcgagaccaacctggccaacatggtgaaaccccatctctactaaaaatacaaaatgccgggtgtggtagcaggggcctgtggtcccagctactcgggaggctgaggcaggagaattgcttgggcccaggaggcagaggtggcagtgaagcgagatcgcgccattgcactctagcctggacaacaagcgaaactccatcccaaaaaaaaaaaaaagtaacctgaccaaaaatggttaagtagtaatgttattattgattcattagcctggatggcctattttctaaactccacaaatgggttgggaatataccaagtgttaataatcacatctgagctagtctccatctttggagttcacaaccccagaataccctagataaactgaagcataattccggaagaagttctaagaactctgtcatcactgccgaactacataactacattgttagtta

SEQ ID NO: 131894 - DNA, 518 bp, Homo sapiens
tcagtctttgccccctccctcctttctctctctggtaatccccagtgtctaatattgccatctttgtgtccatgtgtatccagtgtttagttcccacttgtaagtgagaacatgtggtgtttggttttctgtttctgcattaattcacttaggatagtggtctccaggtgcatccatgatttcattctttttttatggctgtgtagtattccatggtgtatatataccatgttttctttttttctgagttttaattttttttccttcttttaacaaatttttatttccataggtttttggggaacagatggtatttgattacatgggtaagttccttagtggtgatttgtgagatgttggtgtacccatcacctgagcagtatacactgaacccaatttgtagtcttgtattcctcacccacttcccactctttccccccaagtccccaaagttcatcgaatccttcttatccctttgcatcctcatagtttagctcccgcttatgagtgagaacata

SEQ ID NO: 131895 - DNA, 308 bp, Homo sapiens
gtgaaagacactgttgagtgagaaaaaaaaaaaaaagccactgactgggagaaaaaaaatcacctatgaaaagatttctttcatccagaactcaaaactcaacaataagaacaaaacccaattatgaaacagatttcaacagatacttcaccacagaagatttaatcattacaaaaatgcaaattaaaaccacaatgagatggcactattctccattagaataactgtaatttagaaaaatcactaagtgctgggaactatgtagagcagctgaaactctgatacagtcctggtaggagtgcaaaatg

SEQ ID NO: 131896 - DNA, 160 bp, Homo sapiens
tgagaggcaagctggagaacttgttcctgcagtgcctgaaacccacactacagcagattagccacattgcccagcagatcagccacatcagccagtgcgcccacaaacccacactgcagcagatctccaggttgggctggagaggatgtggccccagtgt

SEQ ID NO: 131897 - DNA, 794 bp, Homo sapiens
gaaagtggcgaaatgtatgaattcatgagatgagagccaatttaaaaaagcatagtggacaccattgttctgaaactgaaagccaaagaaatttatggtcacattacccaggggcaggaaaatggtaaacccagttcttggttagtgtttcgttataaagattattatgtgattatttgtaagaaatatatattaagtgaggtatttttaaacagaaacacagaaaacaattatttgatcatttgacaaaaatgttgcaacaagaggctcctaggaactgaatcctgtattttccttaggagcagtggctcagtattcggtaaatcaatatttatgacaacttgatagaatataactgtgaatgatgagaattgactgcacttagggataaatctaagaaaagatgtggaagacctttatgcagaaacttataaaaacattgctgagagaaattgaggacctaaatatgtggagagagacaccatgttcatggatcagaaaactcaacagtgatgtgaattctaccaaaatctgtaaattcagtacaataccaatcaaaatcccagcagacttttttaagagaaattaataaactgattctaaatttcatttgaaaatgtgaaaaacctaaaattgccaaaactgctttgaaacataagaacagaattggagtactcccagtgacttcaagactttattttaaagctacagtaattaagacagtgtggtattggtgtaaagatagataaatagatcatcacagtggagcccagaaatagacccatatatatatg

SEQ ID NO: 131898 - DNA, 544 bp, Homo sapiens
acagaacatttgtaaaacttagtaagttccctgcttaccaaatcactgatatccctcgccctcccttcccaaagctgaccattattttaactttgtgggcaatgatgtctttgctttgctttatactttaacagttatgtatacatccctaaacaaaatataataatcttgcctgtttgggaactataaacagaaacgtatgttacatatccttttgtctgattctttaatgtttttaccaatgttttttccatataaaggtatcttttctccttgtatttctttttatgaatatactgctgtcaacttgtctatttatgtttaagatttagaatggctggatataggaatatgtatattgtcagttgcactaactaatgccaaagttttccatagtggtttttaccagcaatatatgggagctcatttatgcataccttctccaattagccaatctggtggacagtatgttcattttcatgtatttatttgccatttgggtttttcttctgttaagggctaataaaaatattttgttttccta

SEQ ID NO: 131899 - DNA, 880 bp, Homo sapiens
cataattactgttaagatctatcaaaatgtaccgagacagctctccttgctgaaatctgatgaacaaaaaggcaagcaacgtccaggaagactgtaaaagaatggatcaaattaagagcaagaacaaatgcaaccaagagatggggtttcagcacattagccagtatcgtctcgatctcttcacctcgtgatccgcccacctcggcctccccaagtgctgggattacaggcgtgagccactgcgttttgccagttctcttcctttattaaaactacatcagatggtctccatcaatgacacgtaaggctatgtgaggacacagcagcaagaagatgccatgtgaaagctgagaaatgaggcctcgccggaaagcagccctgctggcaccttgatcttggacttctgtcctccagaactgtgagaaaataaatttctgttgctttgtggtaaaaaaaaaaaaaaaaaagaaataaaaaaaaaagaaaaaaagcaagaagaaaaccatccaaaataaacagaaacaaaaaaaaaaacaagaaaggaaaaagaaaaagaacaaagaggggggggtgcactcagatctatatatacacaaggccgagcagccgaaaggtgccctgctacagccgctaatgtaaatgaaaaggagacggactacctggacgtcgagagtttgataaagcacgacggcgcgcggtggtattcaataagacgtgtatgggaaagaagcaatgcactactgccacttgatggagaaaaccccattttgtgagggcgaaaataacgaaagaccacaaacaggataatccactcgtgtcacaaacaacgtgggtgttaggtgaatccagcttttccttcgagcgaactaatcgctacaat

SEQ ID NO: 131900 - DNA, 704 bp, Homo sapiens
gtgtgaccatcttgttaaagtttattttttcctggctggatttaaagaactacactgccatgttgtaggctgcatgttgggtgaccattgtgacaaggaacttagggtggcccctaggagctgaggatggtctccagttgaacatcaacaagacactgaaattctctgtcctttaactgcaaggaactaaattttgccaacgaaaatgaatctttctccagttgagtttcagatgagactgtacttccaggcaaatcctttttgcaatcttgttcaccccaaacagaggactcagctaagctcttcccagattccagatacacagaaattttaagatgagaattgtgcatcaatgttcaagtcccaagagacgttatcagtctgaacagcccagtgaacaagtatttgtgactctccttccaaatgaaatgttctacagaaaggtggaagtgtgttgattagtggcaggcttctttggtcatctttctccctccacttctatcaacatggagttttgtactcagcaaaataaaaatctttcaaaattgagccccaaaccaaaacaaaccaaaagatatttttatattaaaaacccgagagactttgttggtagcaaattaaaactccaataaatggttaaatgaaggaatatggtatcaattggaaatgtggatttccccaaaggaattgaggacatttgatat

SEQ ID NO: 131901 - DNA, 888 bp, Homo sapiens
acctcaggctttccaaagtgctgggattacaggtgtgagccaccacgcctggcctccaaacattttaaaaagaaataatatcactactgtattccataaaatagaagagaaagaaacactacctattttatgggaccagcattaccttcatattcaaccagacaaagacagtatagaaaaagaaaactacacaacaatattcttcatatagaagtggaaaaaaaaagccttaacaatatccattcaaatccaacaatacaccaaaaaatgaatacaccgtgactagggtttattctaaaaatgtaagcctggttcaacattaagaaaccaatcaatgcccaccatatcaacagtctaaagaagaaaaaaatacatgattgttcaattaatacaaaaaaagcttttgacaagattcaaaattcattcatgattttttaaaaacactctcagtgactaggaatagaaagggacttcctcagctccctataatttggtagatgataaagttcatcatttttaaaaatcccataaataaaatcataacagtgaaagactgaatgttttcctcctgtaatgggaaaacaaagcaaggacaaacacattcaccaaattattcatcatcatactggaagtcctagctaatttaataaagcaagagaaagagataggaacgaactaaattgtctctgtttgcagatggcatgattgtccatgaggaaaatcccaagaaatctacaccaaactgctacaatatctgaatatagcatgaggacacaatacaaccaacatgaaaaattgaccatatttcaatatactatgaatctacagttggaaagcaaacttttttaagaagtaccaaacatctccagaaaatactgaaatactaat

SEQ ID NO: 131902 - DNA, 197 bp, Homo sapiens
caaccaatttactatgtgccaggtaagtgattggtatggagttattaatatctcatttaattctcataacgaattctagatttactgttttttatcctgtttctcaaaggaggaaactgaagcacagtttcagagtgatttgcccagggttgagtaggtcagcaagtggccgagctaataattgaacctggtttgtc

SEQ ID NO: 131903 - DNA, 440 bp, Homo sapiens
tgccttccccctctctaccaggctcactccttggtttagtccctcatgggggtagctgcctgggacaaggacacaggaagtgaatttccgggatataacatgtttgcacatatctgtgtcatacacacccaactgacgggtccccaaaggtgcacgtctgtgagtctgtcctggtctggccagtttccccagatgggatgaacacagccaaggggcagccagagttcggaagaaggggctggagggccagtctgtaggctgcaaactccctcgccccacgccactttgggaacaggcctgaccctgactcttggctgtggcttcggctgctcaacccagggcctccttccctgagcttctgacttggtggggagacaggggagacaaactccttagagggactgtgaggcggcctccagccctgccatctgcagggctct

SEQ ID NO: 131904 - DNA, 621 bp, Homo sapiens
ggccatagattgtgatggcatttataagtgttccactataaaaaccaactttacacagctaactttgtttttttttctctcaatgtataactttaattggaccttttgatttttacaaaaataattgaagacatataatatggatttctaaaacatttaacatttctttgtaaaaatcacatggaactttttacccaagtattagtttcccttgtcatttagaaataaatcttcaatttttaaaaagtggcttacttgcaattatatatagaaacgttttactacaggttgagtgtcccttatttgtaatgcttgggaccagaagtgtttcagattttgaatttttttttggagttttgtaatatttgtattatacttactgttcccagtctaaaagtacaaaatccaaaatgattgaatgagcatttcctttgagcatcatttcggtgctcaaaattctttttaactttggagcattttggattttaaattttcagatcgggtattctaaacctgtatccataatatttctagaatgaagatgtgataatttaataatgttttcattagatacattcatgataattgtttacaaaccacacagtaggttaactcagaatt

SEQ ID NO: 131905 - DNA, 168 bp, Homo sapiens
tataaagctgactcttcggcactctctcttccattttaacgatgagaaggctgaggactcagagaggctacctgactcaccccaggtcacacagctaataagcgtagagccaaagctgcccggagatgggctttaaggatctgggttgggagaggcatcctccctctt

SEQ ID NO: 131906 - DNA, 322 bp, Homo sapiens
tttgagggtaagagatagagccccagatgttctttttttaccacaaaggttttcttctaccctccattcttcttgacctttctgtaacatctgacctgctggcctcttcttcctgaactgttcttcagaacactcatctgtcctaatttcccttctgttgcatttggagccagtctgatgtgggttcgattggtggctctaccagttgccactgtatgctctctgtgcctgttccttgtgtaggagagggaacgccattccctcacagtggattaaataggatacgaaggtgtgtactgtactaagcacagacccttccaca

SEQ ID NO: 131907 - DNA, 760 bp, Homo sapiens
aaatgtatatatttatgtagaaaacattaaagtgttactaagaaagccaaagactagaataaatggaaaagcaatctctgttcttgaatgtcaatgctccacaaattaatttataagtttaaagtgaccccaataaactaaaaacaagcaacacagtggagaaagtataatcttttcgatgaacaaacctggggaagcaataaatcttaactcttacttcacaccatatgcaaaaataacctctagatggattgcaaatgtaaatgtgaaagagaaaactgtaaagttatcaaattaaaaacatagataagcacatcatgacatttgagtaggtatgcaaaaatttctgaaatggtatacaattcatgctaaccaaaaagtaaaacattgttcaatttaataattcaaccttaagattgatccgtcagaatacaccaatgaaattcagaaaaaggcaaatgatagaaaggaaaaaatgtgcaatacacacacaaaaacacatattcaactataatcaataaagggttcaaatccagaatagataaaacacttctataaaccagtaagaaaaaaagaaaacccagcgataataggcaaaagatttcagcaaccagttcacaatagatgtcaataaacatgaaagctatgcagcttcaattagtcatcatagaaattgcaaatttaaattaccttgcaaatcaccatgcctcttccacaatagccaaaatactgtaccaaaaaaaaaaatacacatgtaggt

SEQ ID NO: 131908 - DNA, 655 bp, Homo sapiens
attcagaatcactcaaagaaaaatatttactttttataagctaccatggccttcaaaagcattttatttacttataaaattagctttgcttgaacccttgaacaatagataagctagagttgtatttattttttaaccaatagaagataagggaacttttctgaaaatttgccttggaatttgaggctcaggatctaatcatatgttgctaggctactgtttattttgtaggtattttgcttttctgagaatatcgagggaagcactattagtttcggttgagaaatgccatcctagaatttttgtaagaggtattaatgtacctataaactactaatttacttttagaatctgttctctcagaattatagccaaatactttacgtatctaaaaaaaaaataagctttgtgacaagtccaaattgcctatggagtttaattgtaataatttcatttgcttcatctaaagtatgttttccttcttaactcttggaaatgggtaacttaacagagtctgagaaattttagaatcttatatgtggtagaaacaaaaataattatgagttaatagtttttattccatggacccaattgaaattaactcctagagttcagattttgaagtagaatggcccagtttgaaaattttctccca

SEQ ID NO: 131909 - DNA, 335 bp, Homo sapiens
ggaatttgcttgctggttgtgagagagaattccatgtggagggaacagacagcttaagcaaaggcctggagatgtcaaacaggtcaggtggcatggtcatggggctgaaagccattcgtgagagccagagcagagttccaggccaggcccggagccgatgagatccgagaggtcggtggagggggcgaatcttggagggccttgcttaggacccaggctccattctgacagtgatggggaagggtttgaagcaataaggtgatgtgacaggtgtgtttgcggagtgtctctgtggcagcggaggtggcaggtgggttggcctagcgtgtgtctaa

SEQ ID NO: 131910 - DNA, 222 bp, Homo sapiens
catggctgttttcacactatcagggtacaacagagtagttgcaacagaaaccacagaagctagaatgtcccgtcctctcacctggcctaactgggccttcaggtacaaatgctttgttaccaagtagaagtagcaggccagtaagtgtgtacatttctaatcctaccccatatgaatgaaaataaatcatgagagaggcactggcacgattcttatttccag

SEQ ID NO: 131911 - DNA, 566 bp, Homo sapiens
tttgatagagtctgttaccacttagcagtgtgagtcttaactatgtgtagagggtgtgggaaatgatatcttttgatagcttctttaatcccttggctcctctatctgtaattttcaatccatcaagacagcccatgaatatcaaaagtgttcatctaaagctattagaaaattcagattacaacaatgagttggaatacgtttttcaagaattagcctgtttaaaagattgtgttctatgaaaagcttgggaaaagtatcccatctccaatcgtactttccatttttgccattttaggctaagatgtttaccaggtcaggatcattctatgtaggacatgtgaacttataaagtgcatggatatttgtagagtaaagtggatgaagatgggggtaggcagttgaagatacagattaagggttttctatgtttcatttttttaggaaaaattgtattatctaattcctaacgtataagaactaactatatatcatttctgaaatggagttttggaaagtagttaaaatgatgagtttggacttcctttcattgcttgtaatccctg

SEQ ID NO: 131912 - DNA, 587 bp, Homo sapiens
gctcacagagctgcatacatgggctctctcaaaactcccattgtggtggagcacctgtttcctccctgctgcaaccaaaagagacagaaagagactgactcgggattttttgtgatgctatgatcataagcattttctcatattattacaattcttcaaaaatgtgattttaatgactgcataatatgcagttgcatggattcacataatttattcctttattattcatcaagttgctgctatttttttcctctagcaaatggtgctgtgataaatgtctacatttctgggtactttttccataatacatttttagtagtgggattcttcagttattgccgaatacaggagtcagcaaaatcactgccgccctccccaccccacagtggcttgcaacagtggctgcaggtctgctcatctggttttctttggaatgtcttagaaaatataagtttgagaaattatttagaaatttaaagataacgttggaaattgagtgtgtaacttccaggagaggggaaaaagaaaaagaaggaacaaagttgagaaggcaagaaaagaggtaggaaaaaaaagcaaagaaaaac

SEQ ID NO: 131913 - DNA, 707 bp, Homo sapiens
ggttgtgagaaggccagggaggaaaggtcaagaaagagggcatggttggcacccaagagggcccaggatgcaagaactgaacccaacctgtgggtttggagctgagatgtcactgctggccttactgggagcagtgccagttgagtgcttggtctgacagatgtggctgaggagtgaataagaggtgagaagtgactagacctcccacccttttgagaagcatgaaagagcaagaaaggaatgagcatagacagcttgacagtaatgtgagtggagccaagaggtttttttgtaagaggcttctgtgttcttgttttttcatgtcaggaagtcaattgtttgtcattctgtcttcacagaattaacagttgcccccacccccatttttaaacatgtttaatacttcttacagctgcatagtttccagatattcaaagaggtttcacctgcatgatctcattgatcttcctgagaggatggtaccaaatattatgcctgtttatttcttagaggaaggcctcaaagctcagagattgtggcttagaaatcaccctgctaacaagttgttttgtcacatactctacctagcccagagtttgtgaacctatattcacagcattaactaatcatgattcgccccatatttcactggttatgctttggttatcttagaaaagaacccagggcatttatgaggtaaaacttgc

SEQ ID NO: 131914 - DNA, 409 bp, Homo sapiens
cactgctcccataccctcttagtggaggagctgggaaatatatgtgcatatacgtacatatatgttatttctaaatctttgtacagatgtatgtatgaaaaccatgggatcgcactgatagctccaattccagttcagccaccacggggttcattctcatttccttcctttccatatttgtaattcccttctccaactggctccattctccttaatatattgacttatttaatcagttccgctgtatgtgaccaatttcctatgactgccacccctcatgcatcatggatgctcccctcaccttacctgggctctggtaccccacaccaggtccccctctgcaggctcaccctcttcattgtgctcaagctgtgacatgctctgccatcactcttgcagcctctctgca

SEQ ID NO: 131915 - DNA, 639 bp, Homo sapiens
cgtcatttcgcaggagggaatgtgatgtcctggcttggctcacaccctctgtgggtttaggcagggttcctgctggatccctcactgtggccagagagggagggctctgcttcaccacagggaaccagaagaggactggtgtgtgggaagaccaggtaatcataatactattaataatagcagtaatcatactgttttatacattgtacatgtcataaggattttaattttcatgtaacataattgttgtaaaaattttcccagtttgttttgtgctatttacctggtgttgaaatgggcacagaaattacattttaggtacgttaggtttattcctttttataaggtttctgtttgaaattttgattttagaagacattcattctcaaggacgtaaaacacacatacatctaattttttttctctctctctctcttttttaacatttaatactggaattaacttttatgcaaggtgtgggaccatgattcaattctatcattttatattctcaaatcattacccagtattttaataccataaatggaacaatccctcttgttttgtgaatttaaaacgttaccctgttactagataaaattacactcaatttctgtgcccatttcaaggggatcctct

SEQ ID NO: 131916 - DNA, 427 bp, Homo sapiens
ggcaaagttaggagaacagagatcttacagcaagcagttgaggggcaaaccagaggacaagatgtcttttttctccctacccccttattagggctgagagagagactaagacaaggcctcctgttgccacagcagcagctggggaattgaagaagttccagggataaataaacacatacgggaaggaggttttgcctcgactcaatgagtagctgtcaatggccctactgtgataggaaactatggcagagaagcaggtttgggggatcagtgttattacagtaatcagcagaacaggttaaccaaatcttcatttgaaaagtttacataagtaatacgagatgacatcatcaatctcccataatctcacttctatcattttaggcacacttcctttcggtctttcctcagagttgagatcatatca

SEQ ID NO: 131917 - DNA, 369 bp, Homo sapiens
gatgaggaaaccgagactcaggttaagtaacttgccatggtcacacagttagtaaagcagcctggttccagagcccatgggtttttgttgttgttgttgttgttgttgtttttgaaacggagtcttgctctgttgcccaggctggagtgcagtggcgcgatctcggctcactgcacgctccacctccagggttcatgccattcttctgcctcagcctcctgagtagctgcacccgacaccacacctggctacttttgtttttgtatttttaatagagacggggtttcaccgtgttagccaggatggtctcgatctcctgacctcgtgatccaacggccttggcctcccaaagtgctgggattacaggtg

SEQ ID NO: 131918 - DNA, 335 bp, Homo sapiens
aatataaagaatgttaaaatgagatttgaatacatacgaattcccaaaggacacataagaatttcttaaactatatgacaattaggcatgagggtattttggggggctgaatttacaattgtattgccagatatctgattaggttttagaaaaacctattaaacagaaataaaactccattagagcgtcacatttttagctggtatataaaagacattttttaaaaaaatagcaagagattgataatgaaggaagggaatttaagtggcagacatggcttttcttctgaagagctactgctcagaactgatgcattttagttaaaaatataccta

SEQ ID NO: 131919 - DNA, 234 bp, Homo sapiens
gttctgaataagagagcacttcacatccagtggacatgaaagcattctacaccttgaggtaagcaagaaaacaagcagggccatagcctctagttctagtttccaaaataaataaaatcttcaagtctcctccataagttactgactctgtcatgcaaacaactgcactctgactttgccaatggcaatctctgaaggtgggtaataatctttgaggatatgagaaccatatac

SEQ ID NO: 131920 - DNA, 512 bp, Homo sapiens
acaatagcatcaaaaagaacataatgcttaggaataaatttaaccaaggaggtgaaatatctgcctgctgaaaacttttaagaaattgaaaaaaattgtagaagacaaaaataaatgggaagatatcccatattcgtggactggaagacttaatgttaaaattcatactactcaaaacagtttacagattcagtgcaatctgtatcaaaattccaatggcatttttcacagaaatagaaataactgtctcatggagctacaaaagaccccaagtagcttgagcagttttaagaaagaagaacaaagctggagacattacattccctgatttcaaagtacagcacaaagctatagtaatcaaaatagtatgttagtagcataaaaagagacacatagaccaatgaaacagaagaaagcccagaaataaacccatgtatatggtcaagtaatctttgacaaaggcaccaagaatatataatagggaaaggaaatctctttaataagtggttctg

SEQ ID NO: 131921 - DNA, 241 bp, Homo sapiens
aaggatatgaaaacactttatgaaaatgaaattcattaaagcccttaataatcaggtagggaaggcaggtgctcacaattgtcacctgttggtgagtgaacaccttaggctcggggaggacaatgactcaagaacaaggtcgaattgcaggtggggggtgaagctgatccctaacagtgtcctccagcccctggcactgaggaaggacatggagggcttgcatcgacttttcctggcaggc

SEQ ID NO: 131922 - DNA, 395 bp, Homo sapiens
ggggaccccagagtgggaacagctagtctgttgcatgagttgctctgatgctcactgaaatctggaactggctctccagaaccaggccttctagggtacatgcacaatggtctagagcagctctcactgttcaatagaaatgtaacatgagccacatatctcattaaacattttctagcagtgacatcttaagtttgaaagagacaaatgaaattaattttaaagcatagtttagttaactcatttagaaacattaaaaaaatttagttaacccattatatccaaaatattgtcattttaacaggtaatcaatattaaaaactctcagtgaggtattttccttttctaccaagtctctaaattcttttctttctttctttttttttttttttttt

SEQ ID NO: 131923 - DNA, 436 bp, Homo sapiens
ctctgggcaactctgggtgtacattttcctctgttcctcaagagctattatgaatttcatcatccattatgctgataggcctggggactgacacatagtaagcccataacaattataatttaaaactaatttgttatatagcataattgatatattttaaaatgcaaaactataattcaactaaaatatacaaggcactcaagtcataccatgttttaagtagcttacaaggtgatcagcaagtgtcttatacaacaagcaaatttgttcaaagagaagcattgcaaataagtatttataattgtatagttttatattttagccagaagagtggaatcctttagcaatgggggaaataaaagaatgtttaattacagttgcagataattgccttttccaaagacaatgtatgtaggcagaactcatacctgttaat

SEQ ID NO: 131924 - DNA, 301 bp, Homo sapiens
tagtgaactctgggattctcatgaggaggcccagtgaagaaatggcctttcttcctaattaaagacttggggaagcaccctctagaagagcagtccccgacctttttgtcaccggggaccagttttgtggaagacagcttttccatggactagggaagggttgggggatggtttccagatgaaactcttccacctcagatcatcaggcattagttagattctcgtaaggaacatgcaacctagatccctcgcatgcacagttcgccatagggttgtgatcctatgagaatctcatgccccc

SEQ ID NO: 131925 - DNA, 1626 bp, Homo sapiens
ctaggttaacttgagcaagatgaatattttcctcagatctctgctagtcctggtgttttctcttaaaactagctgtatcttgtcggaggtccctgaaagtgaattaactttggatctcttaggtatctgtgtttggaatagagtttattccaaatctatcttattatggagtgaatgcgagcactcaaataagaaggacatattgtcttatgctagattgggcaatagtctaatagtcttagggctgtgtctcactaatgtttacgatgtttttaacattttatttctttttcttttctttctttctttctttttttttttttttttgagatggagtctcactctgtcgcccaggctggagtgcagtggcgcgatctcggctcgctgcaagctctgcctcccgggttcacgccattctcctgcctcagcctaccgagtagctgggactacaggcgcccgccaccacgcctggccagttttttgtattttttttagtagagacggggtttcaccgtgttagccaggatggtctcgatctcctgacctcgtgatccgtccgcctcggcctcccaaagtgctgggattacaagcgtgagctactgcgcccggccttaacattttatttcttaattttaaattttatttctttaaaaaactaatacagtctcacagtgcaaaagtttaaaggtacaaaagggtaagcattttgaaaatctctttctcatcccagtccctggccgcccagtttcctcacggaggccagcaatgttgctagtttcctgtgtctctttccagatagtgcacatttcagcaaatacaccatattctatgcaaattgtggaataacatatgagctcttccttttcctagtatttcttggtgattgcttccttgttctttttcagctgcttcagaattctattgtaaggatgtctcaaattacttaacctgtctcctactgaggcagtaatgtttccaagcttttgctatttcagcattatagctaatgaccctgtacatgcatcattttgcatatatgcaagtattttagagaacttcccagaagtggaattgctgggtcagagggcatgtgcacttgtaattttgatggctgtcaccatattgcatgcagctccttagggttctaacaatttatactcccaccagcaatgtgtatgactgcctgctttgccacactcttgcgaagaatattttatgaaactttttgatcctgcaaatctgataggtgaaaaagactatcccaaaatgattttattttgccgctctggattgagcactttatcttatgtttaagaactaccacatttaccatttatcagcattgtttgtttataaataacctttgtctattttttcaagtaggccagtgttcttttccttattgatttataggagctgtttttatattaaagactttagcctaatttctgtaacatgagttgcaaactttttttctatgatgttttctttaatgacacctattgaaaataatgtttttgcataaaataattgaaaggcatatttgatagtatccaggggtgttttcttccatccattttatttatactgatggagaggaaaacattggccagccattcagcctag

SEQ ID NO: 131926 - DNA, 285 bp, Homo sapiens
atcaaaaacagcatcataccaaagcttacttgtattggaatactattttagaaatactctgtgtatggaatttagttaaaagattgtcagcatataaattggataattattggatagaaaattattggttagaaaaacttaaaactacttcccttattctgattcaactattcttaacttgagaattgaggctcatatttgactctctgaatctcaccatatttaaacttgatttcctttaacaaatatttattgaacagccagtacatacaactttgcttaagg

SEQ ID NO: 131927 - DNA, 427 bp, Homo sapiens
aaaatggtcagtgaaattgaatttcagatgcacagcaaatagttttttagtataaatattggagcatacatatactaaaaaaactatgtgttgcttatctggaactcaaatttaactaggtatctggtattgtttgcaaatatgaaaatcctacttattcaaaattgtcaaagttctatgaccaatactacttcttgctcccttgaactctaaactaagaaaataaatattcatgtgcagttctattagtgctctcaaaggatgctataacctatatctatctagaaaaacagaaaacatatagctataattctttaggccttactgccagtttcttgttcatttgattttgcctagttagttttgccttgaagggaagtaagatcaccaaacagaaaggaataatatatgtgccaggcaatttgta

SEQ ID NO: 131928 - DNA, 244 bp, Homo sapiens
taggtagcaagatattgtgtttgcagtaagcctcttctttgaaaatctgatttgaacctttaaaattattaccaactttcttttaatcagattatgtgcatcttgaaatcattcaaattacacagtataattacgcagtaattttaaatgcatgtctatatttaagtcactaacctttgtccttgtaataaccaatcagtgattttgatcccttttcctcccccttgaaagcccagatcctttc

SEQ ID NO: 131929 - DNA, 676 bp, Homo sapiens
ctgaagacataaattggtaaccaatggaattatctggcctcagactttatttattttcatcatttatttcactgatgtgcaaatttattccgtaccagcaaatgtcaatttaattatattctacagtacacagtgaatcatgtatacttagttaagttgtaaatacactaaaccatataaactcacaacagtatatcagctcatgatgggtaaatgacttttccctgagaaagagtatctgtttaacctgcatgatctcactctttagtatttgcttctttagtctacgtttgtttcctagttttgaatataatcatgatatggagagacaagtgaaatcaccacaattttgttttccaaaatgtgagactatgcaaatgctgaaatgagaattaatacatccaaaatatcgaaccacaattatggctttgctttactttttgcccgtaagagacatgtggcctaaaataggtggcaggtattcctaccacaaccttgcttagcatagtggttgactaaatataaattttagagatgaaggttgttctatacccagatttcaatgtgattgctatgcccacttcactttctctaaaatacatatttttcttacttctcactttctttttcttcttggttgacattttttggctcagggatttttttttccttatga

SEQ ID NO: 131930 - DNA, 415 bp, Homo sapiens
tccacctcctaggttcaaatgatgctcatgcctcagcctcccaagtagctgggattacaggcatgagccaccacacctggctaatttttgtatttttagtagagacagggtttcaccctgttgaccgggctgatcttgaactcctgacctcaagagatctgcctgccttggccccccaaagtgctggaattacatgcgtgagccaccatgtctggcctagagttgggtatttttgtgagtgaacttgagaggaagagtttggaactgatatggtagacagttagggactacagtttcctaagcagtggagtgccaccatgaaggctgagtttgcttctgtgtggaactttacaccttataaaacccctcgatacttttacttcataatacgaccctgaaaagagaaggaacaaaa

SEQ ID NO: 131931 - DNA, 768 bp, Homo sapiens
gtcagcataaaatctcgtgaagtttaacacatttgttctgaaaattaagctgatctactaccagaaaagtagattttttgatatgtataatttgactctatttaaattcttcagaaaaattaaactgacaacattatttacaagttttttggaaattaaaaatgcttaagaaacatttataaaaactaaaagtaaaaataatttcagattcttaacatctctaaaatacttcaagttatcatcctctgacagtagatagatagatagatagatagatagatagatagatattttttctttttttgagacagagtttcactcttgctcaggctggagtgcaatggcacaatcttggctcactgcaacctccacatccctggttaaagcgattctgctgcttcagcctccccagtacctggtattacaggcacccacaaccaagcctggctaatttatgtatttttagtagagatagggtttcactgtattggccagactggtctcaaattcctgacatcaaatgatctgcctgactcggcctcccaaattgctgggattacagacatgagccaccggcccagctcagtgttcaacttttctgaatcaattaactcagcttagataatttaaatcagccaattaggggattccaagcagcccattagcacatcccaggagaatccaatcagcaaattagctcagcccggctgattagcccaggtgatttctaacagccaactatcttattctaggtgataccaatcagcc

SEQ ID NO: 131932 - DNA, 229 bp, Homo sapiens
gtacatgaattcctacaggagctagccagctggttctctatccctgggaaattcccaagtcaccaccgatagctttgccctaggtcatgaggacagaggggttcccaacagtttggtggtcagcagattgtcagaggggtgaagggagcagagcagcattcccaccttttttttttgaacggagtatcgctcttgttgcccaggctggattgcaatggcatgatcttgg

SEQ ID NO: 131933 - DNA, 725 bp, Homo sapiens
gtggtggagatagagaagaggacatgtcacaaggacacagaagccaggctgaggggaactcccactggtcaaatctgggacaatttgagcactgaaataagtatagtaatgtgtataaattattgaaaaggccggcacagtggctcattcattccaggtgttctctgatttttccactgtatagttaccactttttccattaacaactatgaaggaatctgtgagaatatgctttaagacctgcagatagaccaggtacaatgtctcacgcctgtaatcccagcactttgggaggatgaggtggatggattgcttaaatccaggagtacgagaccagcctgggcaacatggtgagaccccatccgtctctgcaaatttttttttgtaattaactgggcacggtggttggtgagacaggtggatattttgtgtctcgcaatatgactggaaaaggactcaacaccactcatgcaacattccagccaggcatggataacccaaatctaataatgagtaaacattagacaaaccccaaatgagaaatggtctattaaagatgtcaatattataaaagacaaagaaaaactatggaaatgttcctccaagaatagagactaaagagacatgacaattaaatacaatacttcgtattagactagatcctttactggaggaaacaaaaatgctatacaggacatgattgagcagactgacaaaattagaag

SEQ ID NO: 131934 - DNA, 867 bp, Homo sapiens
gaaaaatactagaattaacaagtgagtttagcaacattgcagtctaaaaaatatacaaaaatccattgtatctacatactagcaatgaacaattgaaatcaaaataaagaagaatactatttacaatagcatacaaaatgggaattatttagggataaatctgacaaaaatcagcaagatctgtacactgaaaactacaaaacactgctgagaaaaattgaagaagatcaagataaatggagagacatactgtgttcatggattggaagactcattactgttaaaaatattagttctccccaaattaatctatagattcaatgtaatcccaatagaaatctcagcatgcttcttctttttggtagaaattgctaattgtaaaatttgtatggaaatgtaaagtacctagaatggtcaaaacaactttgaaaaggaagaataaacttggaggactaacacaacatgacttcaatttcgatttcactacatgactacaagatttcaattgtccattgctagtttatagatacaatggatttttgtatattgatgtttctatactgcagtgtttctaaactcacttggtaatgctagtagcttttttgtagattccattgagttttgtacatagatcatcatatgatcagtaaactaaaagttttagtttttcaaagttatagcttcaaaacattaaaaagctacaataatcaatacagtgtgtttttgtgtgaacatagagagatagatcactggaagaggagagacaatccaaaaatggacccccacttatatggacaaatgatttcaacagggttgcaaaggcaattcagtgaagaaagaataaatagtcttttaaacaaatggtgc

SEQ ID NO: 131935 - DNA, 621 bp, Homo sapiens
tatttatagtgaaatttggaagattttcagctattaatttttctctttttttctctcttctgaaattcctacaatgagacaatgagtatgttggttctcacgatcgtattccataggtttcttaggctctgctcactttccttcattttttccccttctgttccttggatttcaatattatattaaataatatattatcaaccttcaggttaatcgattctctcttctgcctgctcaaatatgcctagtacattttttcattttatttcatttattgtgatttttagctccagagtttctgttttcatttttttaggttttctatctttttattagaatttccattttattcgtatatcattttcttgactgtctccacatctttctttagttatttcagcatcttttagaaagttgttgaaagtctttctctagtaggcctgtcatcagatctttttccagaaatagtttttattgattttttccttttatgagccctactttcctgtttctttcacgccttttgtttttcttttaaaaaactgtgcatttgagtctaatgggtggcaaatcttgaaatcagatttttccactttccccaggttttctgttttttttttt

SEQ ID NO: 131936 - DNA, 484 bp, Homo sapiens
tcaaccacgaacaacagctgtcaatatgtggtcgcccctcccacacacaccgttcaaggagcccccgtgaaagcacaggccaagcacctgggcacagactctcctccgcaggtcatgagggaggaggaagctcatcccctcccctggaagtaccctcagatttgacacacccgggtctgcagctctcccactgcctcgagttctggtagagtaaataacctcaaagacagaccaacccaaaaaaggatgactggattaagcacccaaagcaatacttcaacttctggcgagaattcaatcgggagctgcaagacatttatcactgtatctgcaaataccaatcatgacttgattatcttcgtgaaacctcatttcttcgtgtcctgggggacatttttctccagaaaagtgcagtataaacaaacaacatgctgattcttcaggacactgctgacagctctgagcaacccaacagccagcactc

SEQ ID NO: 131937 - DNA, 267 bp, Homo sapiens
attttaaattttccgttgcctcattccgagaacccaagttcttccaggatctgctgtcttatcagtttacattcctgaagaatattcatgataaaggtattggctgtttgatcagccatttcttacccgggaatgattggaaatgaaagaattacaccatttcttagcatttctgattacattttactttttattttgttttcataacttgctacaaaaggcacaggagtaggaaatttactcatttttctacttcttaataattga

SEQ ID NO: 131938 - DNA, 323 bp, Homo sapiens
taaatttttgtgtggaagaagtcagagaaaaaaattgaatgaatgtgtatcacaatattcaagattaagtttgtgtgagataggacttgagctgattttgaatacaagtaaatgagggaagagaaaccatcaaaaggaagaaataccctgcaaatgtttctgtgagagagtctaccagaaggaagaggaagattctttccctgaggaaagacaggaatcacaattctcctggctgaggtcaacatccagaacagagaaagcacatcttcccagaatatcattaaaatcctttcccttttgcgccgagaatacatgctagcggt

SEQ ID NO: 131939 - DNA, 301 bp, Homo sapiens
gactaaggtggccagagtccacagcatggagccctgaagatgagagagctgcagagagagagagaacccagagatctcagaggggctcctcgaggaccgttcagcatgtgtgcggtggggagagcacatgaggccagagaaagaaccacctgtgaggaccacagggagctttcacagggcagggacacgcctatgcccaccagccagccctaaaagccccacaggtcacggggcattgcgttgaatactcagagggtcttgcttcaggaatgatggataattagccctgcagtgatcactg

SEQ ID NO: 131940 - DNA, 663 bp, Homo sapiens
aagtacgtttcacaaactgaatctcactggagcagtgccctgagaccccactccaaatctcccatcagtatgatcaatatcccacgctccacaattatcttctcccaccctatagcagcctttgaagccaggattctatgacaatgcttaaaacaacaaatgtttttggcaaatgaccctaacaaacatataaacttttttttttttttttttaaaagactgggtctcactttgtcacccagactggagtggagtggtgcagtcacagcttactgcaacctcaaactcctcagcgaagaagattgcttaagcaatcttcttcgctggactttttttgtttgtttgtttgttttttgattaacagtaatacatcttgaggcatcacttagctgtctccttgtcaatagtaaacactcattgttttacccagcagaaaatgtagccacattcagctgcaatatacagtagacaacaggtgattcttaccatcaaatcaaattaacagaagctggaaaggagaacgagatttcatcaaatccatgccagagagaataatcctcaaaatatcccgccaataggtagtcccttatttaatcccttggacaatcaaatccttgtctcaacactcacagtgatttattttatatataaccgaatccttcc

SEQ ID NO: 131941 - DNA, 311 bp, Homo sapiens
taaggggcttagtgctccctcttcaggatgccagggaggtaggtattaaaggttttcagcgggggagcaggtggtcagaaccatgctttagaaatgtcactctggctccttgaggagactggattagagaggagaaattgaggcagggagaccatttaaaaggccagcaaccaagtgaaaggtggcagtgggaacagaggggacagacttgggaaacgtgaaggaggtgaggacagcagagtccgggcttaagcccacttggggagaggtaagggtggctctgcagttgctggctgaagagggaggcaggg

SEQ ID NO: 131942 - DNA, 648 bp, Homo sapiens
gaggggctcaggggcctttctgatcccttccaggtctgagattctgtggttctcagcaatttgccagtgcctgactggaagatggaggctggtttcgtaacctggggctttcaaagttctgaattctgggtggagttgtctcaaacggtaggctctcaaagaacacctgcatgcagcctaaccagtccccaactcagtgactttcagactgaacctcactgctacttccaagctcctctgaagcttgccacattccatcggtattatcctaattcatacgagcctctcatcctgccatctaaagtataagttacttgagagtagggactatgtctgtaaaaatacatagtacgtggcattctaaggaaaggtgtagtgagcgagggctgccctttagagtcacctgctcttcctgtttccctggttgtgtgtcttctcacctgccttcctgcatccagccatgccccactgtggccggagtagtcgtgttctacaatttgaatctaatatattgcttccctccttaaaactctttggtgcctctcctttaccttcaggaaaatacccagactccttagtctggcccagaagaccgttcatgacttggttcctactgatctctccagtctttttgtgccacctccattg

SEQ ID NO: 131943 - DNA, 470 bp, Homo sapiens
gaggcacctagcacattgcctgctttctggcaagagctaatacatgatagatttccttgtcctaccacattttaatacctagaaaagtataagtatgggcacgagctttcttctgttagtgccacagcatggcacaaaaaaaaacgtacactaaaacaggccttgggtgtctaggttcaaagccaggcccaagactcctactacacgacttcacctatgccttaattcttactaaggattaaataaggttatttttacaaaagcacacagtagtgcttggtgactgatagattttagatttttggttaaatctgaatcaatctcactgataaagatccctttgggaagaataaaaaagcaggatagatttagagttaagagtttggtttttctgcgcgttaggaatcaacaacacagaagaaaccaggataagccaagaatatacatacacacatacacgcacgcacaca

SEQ ID NO: 131944 - DNA, 445 bp, Homo sapiens
tattgctcaaagggagattctggagttcctgagccactgcagaagtcacccaacagtggtgacactgaacaaaaatattcaagtggccacttgtcttccactgtggaaagccgtttgtcatgtcaagggtcagagaccccagtaaacttacttgagcaaggcaactctctgggctagtgaagatggttaactctagaattgatggggtgcttttttggtctctcaccagggacaattaagatattctcatcgtcagtagccctctggcttacagtagtaggcatactgattctggcccatgggctggcaagtcagggcctcttctgggcatctcactgattccacaatactttctcaaaatgggtagacctgagagggcagggggcttgaagtattggctaatatttgcaccttttggctatttgttttatcaacccttttgccc

SEQ ID NO: 131945 - DNA, 855 bp, Homo sapiens
atgaaaagatgcaatgatgaaatgaaatgacgaaaagatgaaataaaatgagatgaaatgaaatgatgagatgaagtgaaatgatgaaatgttgagatgaaatgatgaaatgaaatgaaagaatgaaatgaaatgatgagatgaaatgatgcaataaaatgatgaaaggatgaaataatgaaatgagatgaaaagatgaaatgagatgaaaagatgaaatgagatgaaatgaaatcatgagatgaaatgatgaaatgatgagatgaagtgaaatgatgaaatgaaatgttgagatgaaatgatgaaatgaaagaatgaaatgaaatgatgagatgaaatgatgaaatgaaatgatgcaacgaaatgatgaaaggatgaaatgaaatgaggaaaagatgaaataaaatgagatgaaatgaaatgatgagatgaagtgaaatgatgaaatgttgagatgaaatgatgaaatgaaatgaaagaatgaaatgaaatgatgagatgaaatgctgcataaatgatgacgggtgaaatatgacatgatgacttgatgagatgatgagatgcaaagaatgacatgatgaaattgagatggaaagatgacatgggatgactgaatcctgaggttggaatgacatcttgagatgatattttgaattgtgatggagttgaatggtggattgggaatgccattgtgaatgttgatctggactatggatgaggtgtaagtgcgttatggggacgcggctgaacggagcggggctcggggatgtactggagaggatgtgtacaatgtgagagctcaggcgaagatggatattgtggggtttaaaacaaaaaaaaagtggggcgcgaaat

SEQ ID NO: 131946 - DNA, 496 bp, Homo sapiens
atgaaaagatgcaatgatgaaatgaaatgacgaaaagatgaaataaaatgagatgaaatgaaatgatgagatgaagtgaaatgatgaaatgttgagatgaaatgatgaaatgaaatgaaagaatgaaatgaaatgatgagatgaaatgatgcaataaaatgatgaaaggatgaaataatgaaatgagatgaaaagatgaaatgagatgaaaagatgaaatgagatgaaatgaaatcatgagatgaaatgatgaaatgatgagatgaagtgaaatgatgaaatgaaatgttgagatgaaatgatgaaatgaaagaatgaaatgaaatgatgagatgaaatgatgaaatgaaatgatgcaacgaaatgatgaaaggatgaaatgaaatgaggaaattaaatgaaatgatgaaatagatgaaccaaaaatacttattcattttttttcttggcatccttctaagagtattttagtgaggttaatttctaaaactaaatt

SEQ ID NO: 131947 - DNA, 273 bp, Homo sapiens
tgttgtgttcactgtagtagcactttcaatttccttcaaggactttgcattcataacttggttaacagtttggttcaagaggcccagctttcagcctatcttagtttttaacatgccttcctcactaatcttaatcatttctagttttttatttaaattgagagatttaagactcttctttcacctgagcacttaggggccattgtaaggttaattggcctgatttcagtatggatgtgtctctgagaatagggaggccagaggagaggtaga

SEQ ID NO: 131948 - DNA, 302 bp, Homo sapiens
gggatgtgctgcctgtctgtggcttccttgggttttctcaatctacttcctacacctttgatagcccctttttgcctcattgtcctactccgaccatttctgtcttcttttctgtttctcttttcacctacatgcttaatgtcggtaattctttctcagagcagagaagcttctttttcttcctgcactcttcatgagtgagctcatcccctctcaagtcttttttttttttttttttataacagagtctcactctgttgcttgggctggagtgcagtggcacaatctcggctcactgcaac

SEQ ID NO: 131949 - DNA, 516 bp, Homo sapiens
caggtgtctgaatacacgtgtgggttcttcttcccctcccatcactaccaggtttgcgggcttgggaggcacagggtcatggctgtactggtgaactctaagtgcagtacattcttccctgccagcccatcctgtcccaggggcagaagcctctagctgtgtccatgtcagcccttcacagtattgtgcagggtttacattatttccattggaactgaacgtagaataagtcaggagtcatttctagacgcaaccagagggctctatctgaggctgtctggaaggagcctatatttgatcattcttgcactgctataaagaaatagctgagactgggtaatttataaaaaaatgaggtttaattggctcgagttctgcaggctatatgggaagcatgatgttggcttctgcttggcttctggagaagcctcaagaaactttcagtgatcaccaaagggggagcaagagggagtcgggggaggtaccacagtctatttaaacaacctgatctcatga

SEQ ID NO: 131950 - DNA, 165 bp, Homo sapiens
gccaaatcagtagagaggaagtcagactgtcactgtctgctgataatatgattatttaccttgaaaactctaaagactcctccagaaagctcctagaactgataaaagaatttagcaaagtttccagatacaagattaacgtacacaagtcagtagctcctctgt

SEQ ID NO: 131951 - DNA, 758 bp, Homo sapiens
  misc_feature (558)..(558): n is a, c, g, or t
  misc_feature (568)..(568): n is a, c, g, or t
  misc_feature (575)..(575): n is a, c, g, or t
  misc_feature (593)..(594): n is a, c, g, or t
  misc_feature (597)..(597): n is a, c, g, or t
  misc_feature (608)..(609): n is a, c, g, or t
  misc_feature (635)..(635): n is a, c, g, or t
  misc_feature (643)..(643): n is a, c, g, or t
  misc_feature (705)..(705): n is a, c, g, or t
  misc_feature (707)..(707): n is a, c, g, or t
  misc_feature (718)..(718): n is a, c, g, or t
  misc_feature (726)..(727): n is a, c, g, or t
  misc_feature (732)..(732): n is a, c, g, or t
  misc_feature (747)..(747): n is a, c, g, or t
  misc_feature (751)..(751): n is a, c, g, or t
aggcaagcgcgctctgcggcgcggtccgctgtggaggcggcgcgaacggtcagggggcggccgatggctttgaggggccctgcgggcttggggcccggctctcgaaggccgttggacgaagcggtggcaggggccgagggccgcgaggcgccggcccttgtggcggcgggaggcgcgccagaggacgatgaagaggacgatggccgtggccggggcctgctgcgctgggacagcttctccgcctggctgcactgcgtgtgtgtggtgggcttcgacctggagctgggccaggccgtggaggctcactttgcccaacttcatcagtgaagcaacaagtggaccaattgatgtggaaggtacaccctcatgttatggaacgcagaaactgaggcatagaactgcgctaactgatttcccacaaggacaccatctaattaggaaccaaaacatggtttgggtaccaagtactgtactttccatccttccccagtgcctcttaagagttggacagaatgcagagctgtatcattcattttggcccaaagtcaagggtaattnatcctcagantccaaanttactgacagagaaaaanncantatttgctatnngtcttttccagattcaaattcaggtngtcttggnagatacccagtatcgtcatcagatttcgaccagtcttctggggaggagggtgtcgctgcatngnctcctggatcnatttgacnnagatntaccagtttacttanaganaggatcc

SEQ ID NO: 131952 - DNA, 506 bp, Homo sapiens
  misc_feature (306)..(306): n is a, c, g, or t
  misc_feature (316)..(316): n is a, c, g, or t
  misc_feature (323)..(323): n is a, c, g, or t
  misc_feature (341)..(342): n is a, c, g, or t
  misc_feature (345)..(345): n is a, c, g, or t
  misc_feature (356)..(357): n is a, c, g, or t
  misc_feature (383)..(383): n is a, c, g, or t
  misc_feature (391)..(391): n is a, c, g, or t
  misc_feature (453)..(453): n is a, c, g, or t
  misc_feature (455)..(455): n is a, c, g, or t
  misc_feature (466)..(466): n is a, c, g, or t
  misc_feature (474)..(475): n is a, c, g, or t
  misc_feature (480)..(480): n is a, c, g, or t
  misc_feature (495)..(495): n is a, c, g, or t
  misc_feature (499)..(499): n is a, c, g, or t
aggcaagcgcgctctgcggcgcggtccgctgtggaggcggcgcgaacggtcagggggcggccgatggctttgaggggccctgcgggcttggggcccggctctcgaaggccgttggacgaagcggtggcaggggccgagggccgcgaggcgccggcccttgtggcggcgggaggcgcgccagaggacgatgaagaggacgatggccgtggccggggcctgctgcgctgggacagcttctccgcctggctgcactgcgtgtgtgtggtgggcttcgacctggagctgggccaggccgtggaggaattnatcctcagantccaaanttactgacagagaaaaanncantatttgctatnngtcttttccagattcaaattcaggtngtcttggnagatacccagtatcgtcatcagatttcgaccagtcttctggggaggagggtgtcgctgcatngnctcctggatcnatttgacnnagatntaccagtttacttanaganaggatcc

SEQ ID NO: 131953 - DNA, 390 bp, Homo sapiens
gtggcaattaaagaagagactgaagaacatcacctaagagattcattttgaacagtatggaaaaattgaagtgacaaacccacgatcaccatataatattattcagcaatgaaaaggaatgaaccattgatacacatagccacttaaatgaacttcaggaaaataatgctgagtggaaaaagtccatctcaaaaggtctcattctgtatgattccattatataacattatgatgaaggaaagtttcatggttgccaaagactagggattaggggaatggggaatagctgcatgtggctaaaaggggctaacatgaggaagccttgaaataatgaaacagttatatatcttgattgtggtggtaattacataaagttatacatgtgataaa

SEQ ID NO: 131954 - DNA, 709 bp, Homo sapiens
cagagatggggtttcactgtgttagccaggatggtcttgacctcctgacctcgtgatctgcccgcctcggcctcccaaagtgctgggattacaggcgttagccaccgtgcccggccttagatttacatttcttatggcaaaatcatttgcaaggaaagtatgaacgctgacaaactaccttaaagcaaccttgcattcacacatgatgtaattcattcttttttaaaaagtcagcaaaagtgtattaaagtgtttatgtgccagatataaaaggcatggtcgttgacctcaatgagtttacagtctattgagaaaagaaacttgcaaacaagttagaaaagtatatttaactgctatgataaaagtacaacttctattggaggcataggcaaataaatataaaatcttcccagggtaatctgggatgataccccagaaaagggaggagttgaattctgtgtaacaccataaggatgtgatgtcaattaagtaagttattatttccacgtctgttcatctacttatctaaggaagatacacatatactactgtgtggatggaaacatttgcacctgttgcaagcacttgcaaatacgaaagtttacctagtaagtgtttataaatactaagctcagttagaaaccaagaaagggtaattcccaggtcccaacaataaagaggcagctcatggtcagagtagaggaagagt

SEQ ID NO: 131955 - DNA, 642 bp, Homo sapiens
cattctatgatttgaatctaactttaacactgaaaaaaaacaaagccaggcttcccccctcaaatatacgcaacttcacttaggaataggttacataatttctcggtcaaatatttgtaaattaaatctagtgatgaattaaaaagtatcacagaaatagtaggcagtatttatcaagcgcttcatgtttagaacaatatttatgttcatgtttagagcaatatttatcaagtactttatgtttagaacattttatgtttagaacaattctatacagtagtttctaatattatcccagttagactgatgagaaaagctaggtctagagaggtaagtaacctttctatcaacacacatgtagtaagtggtaaagctacaatttaaacccctccagtatgactcctgaactcatagtcatagcaccatattatgctgtttcactgaattttagtcaataataaagtttgaataaacctgtcactataattcatggcaatagtaaactaaagataacaactacaggttgtttccatagacctagtagagatgatgttatcatcaatgacaaaccattaactttatatgaaatggcccacaaaactttgttttattttcaaaatatgcatatttactaaaaatggt

SEQ ID NO: 131956 - DNA, 738 bp, Homo sapiens
cacgtttctgcatgcgacaaacaagccccttcacgtgtggctttgtacacctctttatcccctttgcccaccgcctcagctctcccagcccctcaaatcctgcttcagccatgatgacctgcttccctccattcaagcaaactttgctctgttgagcctcagtgcctttgctgttggctgcattctcttcatggagagctctctgcctactgaatttgtatttattctccaacactcagcttaaacatttctttctatggcctctgaagttaatcactcctgcctcagtctccttatagcatactgctactgtggtccttatgttcactgggcagaaatttgtttgacttcatcatctgctaagtctttccacatttattaagcaactaccacgtgctggggctgcgacacggtgaagagacagatgcagtctttgtcctcttggatgtccccaagcagtgagggggctggagatatgcagaagcaattatagaatgtgtcacagtgctgtgatgggggtgtgcctggaggggcccagtctcagaggggccctgggggatcagagagggcttcctaggagaaacgatgcttgttttttgttttttaaagacagagtcttgctctttcgctcaggctggagtgaagtgactctatctcagctcactgcaacctcagctccccaccccaggttgaagcatttctcctgcctcagcctccccagtacctgggattataggc

SEQ ID NO: 131957 - DNA, 140 bp, Homo sapiens
aacctgcaagtgccttactgagtctgtgttgatttacagtaaacatgaattctatttcaaaactggcagtatttccaatttttctttttcttttcttcttcttcttctttttttttttttgagatggcactgtcgcccag

SEQ ID NO: 131958 - DNA, 464 bp, Homo sapiens
agccagagagagagtgatgtgatggaggcatgtagaggatcgagcaggagaatgtgggcctggtcggcatgagaaaaggccagaatcagagagcagctaggagacaagagcagtagatgagtccccccacttcccctccacccctcctggtctttattggcttttcaaagagcatgaactctttccctaacaattcctgaatctcaggtggttttaggctctcagtatggccaccagtggttttattgtctgttggcatttgccatccatttcagctgcagttatgttctccacctcctcccatccccatattgcacagttcagaaggctaagactaggttcttaaaagcatttttctctcacttgtggagagttttgatcttagactatttccaagggtcaacttgtaaatgccattcattctctctttttcttttctgtgctattttttaatgccttgacca

SEQ ID NO: 131959 - DNA, 642 bp, Homo sapiens
ggtgaaatagccctggtcctctacccagtcatttgttcattcagcagaaacttcactgggttcctcttgggtgtcagggcagggctggggccccggaggctcaggacgagtcagtctctatccctgccctccttagttgaatatggaagactcataaaggaacttgcagtgtgaaggaaaaagagtacagtggagagttgaggaagatgcatgggaattggtcaggaactccctcaaacttttccactgaaaggcactaagcaaacatcactgtctgctgataggaagggtacttgggtactgagattaaaaaaaaaatgacaggccaaccttcagaaaatccagaaattggcaatgagtatttatgggtcactgaagtctatggcttcaggtgcagttggatctaggggctcatacagtgttgtcaggaatccttcattggggaagatggcccccagtggctccaggcaagtaaaacaccagcttggcacccctggtgagcaaacacacccggtccgactctcactggcccaggttcacccacgtggtattcacctctgcctagggcccaggaatttgctgattgattggatctggatcatggacaccaccctggggctgggcactgagggtggaggtggg

SEQ ID NO: 131960 - DNA, 159 bp, Homo sapiens
agccactgcgcccagcccctttactttcttaataaatttgctttcattaaagaaaaaaaaaaaaagaacagacagttccaccaagccttttcccaatgattcctctccccctaggaaattgatcatcatacattagttttgcctgtactagaattttgt

SEQ ID NO: 131961 - DNA, 394 bp, Homo sapiens
catgtgtgtgcctatgtgcatactatacagaaaataataaagtaaatatggtaaaatattaacaagtggggaatctgaatgaaggaatatggtaattctttgtattatttttgtaacttgtaaaaaacaagaatcaggccaggcgcagtggctcacatctgtaatcctagcactctgggaggccaaggcaggtggatcacttgaggtcaggacttccagaccagcctggccaacatggcaaaataccatctctactaaaaatacaaaaattagctgggtgtggtggcgtgcacctgtagtctcagctactagggaggctgaggcaagagaatcgcttgcacccgggaggcagaggctgtagtgagccaagatagcaccactgtactccagccag

SEQ ID NO: 131962 - DNA, 369 bp, Homo sapiens
gacaaggggagagagggagaggaaatgcctgtgagaatgctggagagcaggctcctacacctctctgtgctgttaatgggggtcatgggcacccctcagtgtcttgggctcagccttgggggttgccaaaacctataggagcaaccaggaacattcatggtttgggggtaggggtgacatggcaaagactagctttgtggtgagatgaaactggtaacatctggaggagttcagcggctcagtccttgtcgctgaggagagagccaagaggcaggggtatggctgctggacaagaaggtgcaaggtggctgagtaaagaaagcccagactagggtggtcacagctaaaatggaacagcaaattcaggag

SEQ ID NO: 131963 - DNA, 338 bp, Homo sapiens
ggaggctgaggcaggaagatagtttgagcctgggagttcaaggttgtggtgagccttgatgatgccactacactccagcctgagtgacacagtgagactttgcatcaaaaaaaagagaaaacagacaataatacattaaaaatgaaacctctgtaatttatcaatctataactattttctcatcacttaccgcataccaaactctactgcacttgtgtccagtataaagttggtgagtcttctgttgtatttaggatagagttgaggcccttcccttcgtttcaaattatttaagcttttattttattatatcttcctgagtgaggttcttgctctgc

SEQ ID NO: 131964 - DNA, 397 bp, Homo sapiens
gccataccaaccttttctcctggctgtggccttggtggataccatttcccccataggcagcccaccagcccgaccccttagagcttcatagcctgctgtgctctgccgtcctatgggcaactaagcctttttgctggattgggtccctcccctcccttcctggcccaaggccctgggtccagggacagctgagcctgatgcagcccctaccccaccccaaatcaccagcacctggttctctggctacttccttaggggtacacaaaaatcctcatgcctgttggatctccttgggtttcaaggaccttctctctaggaagtatggcctccagggtctcctgagcctaaacgcaggcagtgaaagggaaggagccgtggacttattagggctacaagt

SEQ ID NO: 131965 - DNA, 663 bp, Homo sapiens
caagcaatgatcttcccacctcgacctcccaaaagtgctgagattataggcctgagccactgtgcttgtgctcagcctccaaggattttgtttttgtttttgtttttttgagacagactggctctatagcccaggctggagtgcagtggcatgatcgcgactcactgcaacctctgcctcccagactcaagccatcctcccacctcagcctcctgagtagctgggactacaggcatgcaccaccactcccagctgatttttgtatttttttaaatacagacgaggtttcatcatgttgcccatgctaagtcttgaactcctgacctcaagtgatctgcctgccctggcctcccagagtgctgggattacaggcctgagccaccacgcctagccttacaaaggacttttttgttgttgttttgcatcttacttgccccttcccccaaaactagtaatttttggtaattcccttagtttttcagacttcctttttactcaccttgggtaattctgaaaagatatgatatattttgttttttaagatgtggtcttgctctgtcacccaggctggagttcagtggcacaatcctggctcactgcaacctctacctcctgggctaaagggatccttctgcctcagtctgctaagtaactgggattata

SEQ ID NO: 131966 - DNA, 171 bp, Homo sapiens
gaaaaagaaaaagaaaaaaaaagccaccgaccaggaaggtaaaatattttacggaaccaggcaggggcctcattttgccttttgcccctctgctggtatgagaaaagcaccctttcacaactagtagagtaccagatactggtctcatttcacaaacagtagagtaccaga

SEQ ID NO: 131967 - DNA, 555 bp, Homo sapiens
atagaatcgagctcggtaccgaatccgggcaggcacaaggtgacattagacagaagcttcagaagttggaaggttttgaggctatgaatattacccagctcattcaagtagctactaaggtgtttgttaatccagaggaggaagccaagaaagaggcaaagcacaaagccaaggaaaaggctgatttgttggctgctgctctggttgagagactggttttgtgagaggacgcggacttggtcgtggtcacagtagaggacaagctaggccagggtttgaaggccagcctaggcttgagagggatcagtgtgcaagaatgcaaacagaaagggcattggaaggttgaatgtccagaaagagaaaaggaagaaagtagcagccagggacctgatgcccgcccaaggcctgcagccactagccattgttctaaagctggatgccgatctggtcagcttagcaggagttgaggtagtcggcggagagcagaaggtcgacgcagagcagaaggtcgacgcggagcagaaggtcgacgcagagcagaaggtcgacgcggta

SEQ ID NO: 131968 - DNA, 589 bp, Homo sapiens
atagaatcgagctcggtaccgaatccgggcaggcacaaggtgacattagacagaagcttcagaagttggaaggttttgaggctatgaatattacccagctcattcaagtagctactaaggtgtttgttaatccagaggaggaagccaagaaagaggcaaagcacaaagccaaggaaaaggctgatttgttggctgctgctctggttgagagactggttttgtgagaggacgcggacttggtcgtggtcacagtagaggacaagctaggccagggtttgaaggccagcctaggcttgagagggatcagtgtgcaagaatgcaaacagaaagggcattggaaggttgaatgtccagaaagagaaaaggaagaaagtagcagccagggacctgatgcccgcccaaggcctgcagccactagccattgttctaaagctggatgccgatctggtcagcttagcaggagttgaggaatataaggactgagacagactgggctccatctctctaggcctccaggagcccctggtctctatgaaagtgggagccaaaagatggactttattgtgcccctgttagggagagacttgct

SEQ ID NO: 131969 - DNA, 583 bp, Homo sapiens
cagaacctccttgctgacaataatgggcttgttacccaagtagcgcttcggttcccctttgctagtctcactgcacaagtgaagcctgtttccctgacaagcgcatccactagaatgctgttctcaagactggctgcacaatggaatctgttcgggagccttagacattcctgaggctcggatctcatcataggacttcttcatcgcatgccctgtggcctgggtgttaggagtttgaacactctcctaggtggatgtaataagcacttgaggcccactggtctaaacctggtgctgacacctactgtggcttaggatcacctggagagcttggtaaaacagattgctggggccccagccccagaagttctgattcagtagggctggggtggagctcaagaatttgtatttctaacaagttctcaggtgatgccggttctgggaccagattttgagaaccattgcatttatggcactgagctgaatctttgatctccccagtgggagagaaggtcgatggatgctgcatctttgatctcctcagtgggagagaaggttgatggatgctgctgactactgcagg

SEQ ID NO: 131970 - DNA, 733 bp, Homo sapiens
cagttatatatgtaatgagagagatacatgtatatgtaatgagatacaaaagttatatatataataacaattttgtgtatcatatatgcttatttacatttgtatctcatatatgtttatatatgcttatatatggcttatatatatgcttatatatatatataatgagaaagataaaatgaatggaaacacatgggagggtctcctgaaattattaggatcgggatcaattacaagcatcaattccagtaggagctgacagctaaactgactttggaggacgaatagagaatggcttgaaggatgtgaattagagaggagtttggggacaagggagtgtgaaataagtaccaagaagagaaacgagccatgggcaagaaaaaaataataataaagcttttcaaaaaatgaaagacaacctatatgactaggagtagaggtaaggagtgtaggagatgaaactggagaaagccaagttgcaaagggtcattttatcccatgtcaaagaagttgttccttatcttaagagcaatggaaaggccaatatggggtctttgagcaaaaagtgacaccttcggattgacatttcagaaccattactctgcctgggaaaatgagttgggatgtatcaggaagaccattaggagacagttatgagtccaagtagcctgtaatcccagcactttgggaggccgaagtgggtggatcatctgaggtcaggagttcaagacca

SEQ ID NO: 131971 - DNA, 138 bp, Homo sapiens
ctattattattctgtggtttctgcttttgatcaagataagaatagccgaagcacccacccaggtcactctcatggaatggggttttctgattaaagattggcaagcaactgacaagcttgtagcacatcctttaagct

SEQ ID NO: 131972 - DNA, 356 bp, Homo sapiens
cttactcatgctgttccctcaactggctttgaacacatttattagtaatcatattatcccagcaacaatagtttggcttagaaacacctttgggaaatttgactcattttcagttttctcattttcccataatggctaagctatgcaactttgaatgactatataaagcctagcatcatatttatgtaaaatgaacaaacaaaaaacaaacaaaccttgcagatccctctatgagtgtatttaattttcctttcatccagacatatctgattttcagttgcattttagaaagtaaatgtgttgatttaccatgtgcatttgtcacctactcctgggattttagttcaaaattattt

SEQ ID NO: 131973 - DNA, 411 bp, Homo sapiens
ccccactgcaccccttttaatttgctggagtagtttaaatcaaattatgaacagcttattatactcaggtatttcagtatatatgtccaactgataatcttctttttaatataaccaccatgctgttacttaacagtgattctttttatttttaattgtgacagggtgtcactctgttgcccaggttggagtgtactggcttgattacagctcacctgcaacctcaacagtgattcttaatgtcaacgtgtgctagtctgtgtttgaatttccctaattgtttcaagattcgtttgttaaattgacttgttcaaatgaggggcctaacaaggttcacactttgcattgttaatgtgtcttgagtcgttttttctaatagccattagaaaaaacttacatgtttctaaaatc

SEQ ID NO: 131974 - DNA, 287 bp, Homo sapiens
tcatctactacatcagtggagaacccagcgaaagggtcacctgagaaaagttacctgtttaatcaagcaagtctggggtaccccaggtcgctacagccagctccttaatgaaagctcaccagggccagctgtctctcgtgcggctgcagcgtgtttaatttgcaggtggactccgcgggctgctcctccacaggtgaagtgaaaacagtggaggtcctgggtgaaaatgcgggttctgttcatcctcagaaggtggtaagtgggcagactagagcgtgaagccagag

SEQ ID NO: 131975 - DNA, 183 bp, Homo sapiens
aaaactataaactagtaacaatcatgagcacagataaaataattataataaaaattttagcaaatcaaatcccataataaataaaaaggattatatattataaccaagcagagttcatcccaggaatgcaaagattggtttaacataagaaaatcaatgtaattcactatattaacaaactat

SEQ ID NO: 131976 - DNA, 385 bp, Homo sapiens
aaaaaattggacattataaataatttccttttaattttagctcgatcaaacataaaattcctttcacaagattcatcttccacaaaccttttaccattttctgatcgattctgttttgtcctctaatgtttctctttctcgttttggaagaaccgtcactctactgtagaaagaaaaaattactttctttttcccttaacaaagtctcattctttataacttcctatttagaaagtatcttatttccctcacatacagagttatttccttctagttttaatggtcatccattaattagactttttaactcttggtaaccttaatttctagtgaaaactagggagtgagcaaatttaaactgttttatatcagcactttgtacatg

SEQ ID NO: 131977 - DNA, 494 bp, Homo sapiens
gcctggacaggaagaaggaactctgtctaagcacatttttggttttgtccagtcatgttgtttacacggccattgttacaaagcagaaaagccaccaggcatctctttacctctgaagcaagcattctaaatagttgagagtttgtggtacataaaaagaagccttctctcatgctaatgttttcaaaacaagttgtgacttctgaaagtagagaccaaagaaagaataacttgaacaagatttcagtgggtagaaaataaacactaactttatatgtatttcaagaacgtaaaagaaacaggtgggaaatgaatcctcctcgataagagagaaatgcttagtagggtggaaaaaaaaaaaagacaacattcagcagtttttggaactgtgcgagtccagagagtttctttctttctttctttcttttttttttttctggttagctctcatagccacaaatatgtatattatttccttcttgcccacaatttac

SEQ ID NO: 131978 - DNA, 176 bp, Homo sapiens
gggcattggtcctgcatcattgaaggagccacttgagatcacagaacagtgagaagacaccagcatgccaccactgctgtcgatgcactgcggggggtaacatttgagctcaaagggattgggagagggatattccacccaggctctgggcgccagctgtgtgcccaccaccactg

SEQ ID NO: 131979 - DNA, 240 bp, Homo sapiens
ggttggtctcaaactcctagactcaagcaattttcccacctcagcctctcaaagtgttgggattacaggcatgagccactatgcccagcaaaaactttatctctaatacttatttttcctcctaactgcaaacctgtatacagatgtcttccatgtatcttatctttttaactttttgttatggaagtattcaaacataatgaaagtagagatggtaacataactgacttgatatatcca

SEQ ID NO: 131980 - DNA, 1533 bp, Homo sapiens
tggcgtcacttcccttcccgcgatggcggcacagggagctgctgcggcggttgcggcggggacttcaggggtcgcgggggagggcgagcccgggcccggggagaatgcggccgctgaggggaccgccccatccccgggccgcgtctctccgccgaccccggcgcgcggcgagccggaagtcacggtggagatcggagaaacgtacctgtgccggcgaccggatagcacctggcattctgctgaagtgatccagtctcgagtgaacgaccaggagggccgagaggaattctatgtacactacgtgggctttaaccggcggctggacgagtgggtagacaagaaccggctggcgctgaccaagacagtgaaggatgctgtacagaagaactcagagaagtacctgagcgagctcgcagagcagcctgagcgcaagatcactcgcaaccaaaagcgcaagcatgatgagatcaaccatgtgcagaagacttatgcagagatggaccccaccacagcagccttggagaaggagcatgaggcgatcaccaaggtgaagtatgtggacaagatccacatcgggaactacgaaattgatgcctggtatttctcaccattccccgaagactatgggaaacagcccaagctctggctctgcgagtactgcctcaagtacatgaaatatgagaagagctaccgcttccacttgggtcagtgccagtggcggcagccccccgggaaagagatctaccgcaagagcaacatctccgtgtacgaagttgatggcaaagaccataagatttactgtcagaacctgtgtctgctggccaagcttttcctggaccataagacactgtactttgacgtggagccgttcgtcttttacatcctgactgaggtggaccggcagggggcccacattgttggctacttctccaaggagaaggagtccccggatggaaacaatgtggcctgcatcctgaccttgcccccctaccaacgccgcggctacgggaagttcctcatcgctttcagttatgagctctccaagctggagagcacagtcggctccccggagaagccgctgtctgacctgggcaagctcagctaccgcagctactggtcctgggtgctgctggagatcctgcgggacttccggggcacactgtccatcaaggacctcagccagatgaccagtatcacccaaaatgacatcatcagtaccctgcaatccctcaatatggtcaagtactggaagggccagcacgtgatctgtgtcacacccaagctggtggaggagcacctcaaaagtgcccagtataagaaaccacccatcacagtggactccgtctgcctcaagtgggcaccccccaagcacaagcaagtcaagctctccaagaagtgagcagcctggcccctgctgtcggacctgagcctcctggctcccagcctgtaaatatgtatagacctgttttgtcatttttttaataaagtcagttctggtggccctggactttggaggggaaggggaggccaaga

SEQ ID NO: 131981 - DNA, 1961 bp, Homo sapiens
  misc_feature (1245)..(1245): n is a, c, g, or t
tggcgtcacttcccttcccgcgatggcggcacagggagctgctgcggcggttgcggcggggacttcaggggtcgcgggggagggcgagcccgggcccggggagaatgcggccgctgaggggaccgccccatccccgggccgcgtctctccgccgaccccggcgcgcggcgagccggaagtcacggtggagatcggagaaacgtacctgtgccggcgaccggatagcacctggcattctgctgaagtgatccagtctcgagtgaacgaccaggagggccgagaggaattctatgtacactacgtgggctttaaccggcggctggacgagtgggtagacaagaaccggctggcgctgaccaagacagtgaaggatgctgtacagaagaactcagagaagtacctgagcgagctcgcagagcagcctgagcgcaagatcactcgcaaccaaaagcgcaagcatgatgagatcaaccatgtgcagaagacttatgcagagatggaccccaccacagcagccttggagaaggagcatgaggcgatcaccaaggtgaagtatgtggacaagatccacatcgggaactacgaaattgatgcctggtatttctcaccattccccgaagactatgggaaacagcccaagctctggctctgcgagtactgcctcaagtacatgaaatatgagaagagctaccgcttccacttgggtcagtgccagtggcggcagccccccgggaaagagatctaccgcaagagcaacatctccgtgtacgaagttgatggcaaagaccataagatttactgtcagaacctgtgtctgctggccaagcttttcctggaccataagacactgtactttgacgtggagccgttcgtcttttacatcctgactgaggtggaccggcagggggcccacattgttggctacttctccaaggagaaggagtccccggatggaaacaatgtggcctgcatcctgaccttgcccccctaccaacgccgcggctacgggaagttcctcatcgctttcagttatgagctctccaagctggagagcacagtcggctccccggagaagccgctgtctgacctgggcaagctcagctaccgcagctactggtcctgggtgctgctggagatcctgcgggacttccggggcacactgtccatcaaggacctcaggtgagggggcctcccgggccctgggggcaggacttgccctgagatgggccacgatcctgcttcctnataccctgtcaccatcctggccagatcccacaagggcaccaggtctggcatttgctctcatccctttttgcagccagatgaccagtatcacccaaaatgacatcatcagtaccctgcaatccctcaatatggtcaagtactggaagggccagcacgtgatctgtgtcacacccaagctggtggaggagcacctcaaaagtgcccagtataagaaaccacccatcacaggtgggtggggggctgctgtgtgtcgggggcggtgggggagtgtcagtatatggactggtaggagtcaaggcctccttattgctgtcacatgatcccaaaccagtcagaccagctcccaggatggagcccggggcaggcctctcattcctgggcttccctgcccctccccagcacagcctgcccttttgttctcacctggaggaggtgaaactggcctgagcccagaggagggcagccaggtgtgagctggcctggcccaggcccagccctgcctcccgccccttctccctggactccgtctgcctcaagtgggcaccccccaagcacaagcaagtcaagctctccaagaagtgagcagcctggcccctgctgtcggacctgagcctcctggctcccagcctgtaaatatgtatagacctgttttgtcatttttttaataaagtcagttctggtggccctggactttggaggggaaggggaggccaaga

SEQ ID NO: 131982 - DNA, 1696 bp, Homo sapiens
tggcgtcacttcccttcccgcgatggcggcacagggagctgctgcggcggttgcggcggggacttcaggggtcgcgggggagggcgagcccgggcccggggagaatgcggccgctgaggggaccgccccatccccgggccgcgtctctccgccgaccccggcgcgcggcgagccggaagtcacggtggagatcggagaaacgtacctgtgccggcgaccggatagcacctggcattctgctgaagtgatccagtctcgagtgaacgaccaggagggccgagaggaattctatgtacactacgtgggctttaaccggcggctggacgagtgggtagacaagaaccggctggcgctgaccaagacagtgaaggatgctgtacagaagaactcagagaagtacctgagcgagctcgcagagcagcctgagcgcaagatcactcgcaaccaaaagcgcaagcatgatgagatcaaccatgtgcagaagacttatgcagagatggaccccaccacagcagccttggagaaggagcatgaggcgatcaccaaggtgaagtatgtggacaagatccacatcgggaactacgaaattgatgcctggtatttctcaccattccccgaagactatgggaaacagcccaagctctggctctgcgagtactgcctcaagtacatgaaatatgagaagagctaccgcttccacttgggtcagtgccagtggcggcagccccccgggaaagagatctaccgcaagagcaacatctccgtgtacgaagttgatggcaaagaccataagatttactgtcagaacctgtgtctgctggccaagcttttcctggaccataagacactgtactttgacgtggagccgttcgtcttttacatcctgactgaggtggaccggcagggggcccacattgttggctacttctccaaggagaaggagtccccggatggaaacaatgtggcctgcatcctgaccttgcccccctaccaacgccgcggctacgggaagttcctcatcgctttcagttatgagctctccaagctggagagcacagtcggctccccggagaagccgctgtctgacctgggcaagctcagctaccgcagctactggtcctgggtgctgctggagatcctgcgggacttccggggcacactgtccatcaaggacctcagccagatgaccagtatcacccaaaatgacatcatcagtaccctgcaatccctcaatatggtcaagtactggaagggccagcacgtgatctgtgtcacacccaagctggtggaggagcacctcaaaagtgcccagtataagaaaccacccatcacaggtgggtggggggctgctgtgtgtcgggggcggtgggggagtgtcagtatatggactggtaggagtcaaggcctccttattgctgtcacatgatcccaaaccagtcagaccagctcccaggatggagcccggggcaggcctctcattcctgggcttccctgccctggactccgtctgcctcaagtgggcaccccccaagcacaagcaagtcaagctctccaagaagtgagcagcctggcccctgctgtcggacctgagcctcctggctcccagcctgtaaatatgtatagacctgttttgtcatttttttaataaagtcagttctggtggccctggactttggaggggaaggggaggccaaga

SEQ ID NO: 131983 - DNA, 1929 bp, Homo sapiens
  misc_feature (1245)..(1245): n is a, c, g, or t
tggcgtcacttcccttcccgcgatggcggcacagggagctgctgcggcggttgcggcggggacttcaggggtcgcgggggagggcgagcccgggcccggggagaatgcggccgctgaggggaccgccccatccccgggccgcgtctctccgccgaccccggcgcgcggcgagccggaagtcacggtggagatcggagaaacgtacctgtgccggcgaccggatagcacctggcattctgctgaagtgatccagtctcgagtgaacgaccaggagggccgagaggaattctatgtacactacgtgggctttaaccggcggctggacgagtgggtagacaagaaccggctggcgctgaccaagacagtgaaggatgctgtacagaagaactcagagaagtacctgagcgagctcgcagagcagcctgagcgcaagatcactcgcaaccaaaagcgcaagcatgatgagatcaaccatgtgcagaagacttatgcagagatggaccccaccacagcagccttggagaaggagcatgaggcgatcaccaaggtgaagtatgtggacaagatccacatcgggaactacgaaattgatgcctggtatttctcaccattccccgaagactatgggaaacagcccaagctctggctctgcgagtactgcctcaagtacatgaaatatgagaagagctaccgcttccacttgggtcagtgccagtggcggcagccccccgggaaagagatctaccgcaagagcaacatctccgtgtacgaagttgatggcaaagaccataagatttactgtcagaacctgtgtctgctggccaagcttttcctggaccataagacactgtactttgacgtggagccgttcgtcttttacatcctgactgaggtggaccggcagggggcccacattgttggctacttctccaaggagaaggagtccccggatggaaacaatgtggcctgcatcctgaccttgcccccctaccaacgccgcggctacgggaagttcctcatcgctttcagttatgagctctccaagctggagagcacagtcggctccccggagaagccgctgtctgacctgggcaagctcagctaccgcagctactggtcctgggtgctgctggagatcctgcgggacttccggggcacactgtccatcaaggacctcaggtgagggggcctcccgggccctgggggcaggacttgccctgagatgggccacgatcctgcttcctnataccctgtcaccatcctggccagatcccacaagggcaccaggtctggcatttgctctcatccctttttgcagccagatgaccagtatcacccaaaatgacatcatcagtaccctgcaatccctcaatatggtcaagtactggaagggccagcacgtgatctgtgtcacacccaagctggtggaggagcacctcaaaagtgcccagtataagaaaccacccatcacaggtgggtggggggctgctgtgtgtcgggggcggtgggggagtgtcagtatatggactggtaggagtcaaggcctccttattgctgtcacatgatcccaaaccagtcagaccagctcccaggatggagcccggggcaggcctctcattcctgggcttccctgcccctccccagcacagcctgcccttttgttctcacctggaggaggtgaaactggcctgagcccagaggagggcagccaggtgtgagctggcctggcccaggcccagccctgcctcccgccccttctccctggactccgtctgcctcaagtgggcaccccccaagcacaagcaagtcaagctctccaagaagtgagcagcctggcccctgctgtcggacctgagcctcctggctcccagcctgtaaatatgtatagacctgttttgtcatttttttaataaagtcagttctggtggc

SEQ ID NO: 131984 - DNA, 1654 bp, Homo sapiens
tggcgtcacttcccttcccgcgatggcggcacagggagctgctgcggcggttgcggcggggacttcaggggtcgcgggggagggcgagcccgggcccggggagaatgcggccgctgaggggaccgccccatccccgggccgcgtctctccgccgaccccggcgcgcggcgagccggaagtcacggtggagatcggagaaacgtacctgtgccggcgaccggatagcacctggcattctgctgaagtgatccagtctcgagtgaacgaccaggagggccgagaggaattctatgtacactacgtgggctttaaccggcggctggacgagtgggtagacaagaaccggctggcgctgaccaagacagtgaaggatgctgtacagaagaactcagagaagtacctgagcgagctcgcagagcagcctgagcgcaagatcactcgcaaccaaaagcgcaagcatgatgagatcaaccatgtgcagaaggtccggatcccttcccatccacgggcccaggaggcccagcttctctgccagttcccttgggtctctcgggccccagtgccaaaaccatagcaaatcccatttcttaagctcctgtagtgtgtcagggactttacctacttcctcttacttacttttcataggtaagaaaacagacagagggtaagggcttcgctgcagtctcacagcaaggaaatggcacagctgggactagaactcaggcctccggcactggtagcctcttttgtctcctagtagctgtgtcttagtagaaaaaatgacttgaagttcagtgggaaagacgagaatgttattcggcagttgctatagccaagcaccctgccaagtgctgtatatgtataagctcctcaaatccttcccaacaattcaacacacaggaatagttacttttttggtaggtgaggaagcaggctgagagagattaagtaacatgcccaaggtcacacagccagtaaaacggtgggctggaattagaataataatgccaaacacttgttagccggtgagcagaagtattcagctaaatggtttttgtgtgtgtgtgtgtgtgtgtgtgtgtgtgtgtgtgttttgttttttgtttttttttttgagacggagtcttgctctgtcgcccaggttggagtacagtggaatgatctcggctcactgtaaactccgccacctgggttcaagcaattttcctgtctcagcctcccaagtagctaggactacaggtacctgccaccacgcccggataatttttgtatttttagtagagacgaggtttcgccatattggtcaggctggtctcgaactcctgacctcaggtgatctgcccacctcggcctcccaaagtgctgggattacaggcgtgagctactgcgcccggcctaagctaagtgttttaatacatgacctcactgacatttcacagtaggcctgtgaagtaagcatgcagaagagctactcagcctcctgagtagctgggaccataggcacgtgccaccatgcccagctaattttttatttttttgtagagacgggatctgctatgttgcccacactagtctcaaactcctggtctcaagcgatcctcctgccttagcctcccaaagtgctgggattacaggtgtgagccactgcgcccga

SEQ ID NO: 131985 - DNA, 979 bp, Homo sapiens
tggcgtcacttcccttcccgcgatggcggcacagggagctgctgcggcggttgcggcggggacttcaggggtcgcgggggagggcgagcccgggcccggggagaatgcggccgctgaggggaccgccccatccccgggccgcgtctctccgccgaccccggcgcgcggcgagccggaagtcacggtggagatcggagaaacgtacctgtgccggcgaccggatagcacctggcattctgctgaagtgatccagtctcgagtgaacgaccaggagggccgagaggaattctatgtacactacgtgggctttaaccggcggctggacgagtgggtagacaagaaccggctggcgctgaccaagacagtgaaggatgctgtacagaagaactcagagaagtacctgagcgagctcgcagagcagcctgagcgcaagatcactcgcaaccaaaagcgcaagcatgatgagatcaaccatgtgcagaaggtccggatcccttcccatccacgggcccaggaggcccagcttctctgccagttcccttgggtctctcgggccccagtgccaaaaccatagcaaatcccatttcttaagctcctgtagtgtgtcagggactttacctacttcctcttacttacttttcataggtaagaaaacagacagagggtaagggcttcgctgcagtctcacagcaaggaaatggcacagctgggactagaactcaggcctccggcactggtagcctcttttgtctcctagtagctgtgtcttagtagaaaaaatgacttgaagttcagtgggaaagacgagaatgttattcggcagttgctatagccaagcaccctgccaagtgctgtatatgtataagctcctcaaatccttcccaacaattcaacacacaggaatagttacttttttggtaggtgaggaagtgtgggaggatcgcttgagcccaggagttcggggctgtagtgcgctatg

SEQ ID NO: 131986 - DNA, 1077 bp, Homo sapiens
  misc_feature (3)..(3): n is a, c, g, or t
  misc_feature (26)..(27): n is a, c, g, or t
  misc_feature (35)..(35): n is a, c, g, or t
  misc_feature (112)..(112): n is a, c, g, or t
  misc_feature (279)..(279): n is a, c, g, or t
  misc_feature (300)..(300): n is a, c, g, or t
  misc_feature (348)..(348): n is a, c, g, or t
gtnaattgccggggcaaccttcggtnnactgggtngccagagtgacaagggctgcctcggcaactagggcactgagttgtcggggcagcctgtggaaatgggccactagagntgcctgggccgctcatggcagctggggcactgagttctcggggcagtctggggcagctggagcactggagcttttggggcagcctctggcaacaggggtgctggagttgccagggcagcctggggcgccagagttgcctgggcagcctgtggcaactgtggcgctgnagatctctgttcagtctgtgntgacaacatcggagctgtcaacgatgaccgtgtcgcagtccctggagntgccctcgacgacagcgctggaatcctataatacggtagcacaggagctgcctactacattagtgggggagacttctgtaacagtaccagatgaccagtatcacccaaaatgacatcatcagtaccctgcaatccctcaatatggtcaagtactggaagggccagcacgtgatctgtgtcacacccaagctggtggaggagcacctcaaaagtgcccagtataagaaaccacccatcacaggtgggtggggggctgctgtgtgtcgggggcggtgggggagtgtcagtatatggactggtaggagtcaaggcctccttattgctgtcacatgatcccaaaccagtcagaccagctcccaggatggagcccggggcaggcctctcattcctgggcttccctgcccctccccagcacagcctgcccttttgttctcacctggaggaggtgaaactggcctgagcccagaggagggcagccaggtgtgagctggcctggcccaggcccagccctgcctcccgccccttctccctggactccgtctgcctcaagtgggcaccccccaagcacaagcaagtcaagctctccaagaagtgagcagcctggcccctgctgtcggacctgagcctcctggctcccagcctgtaaatatgtatagacctgttttgtcatttttttaataaagtcagttctggtggccctggactttggaggggaaggggaggccaaga

SEQ ID NO: 131987 - DNA, 501 bp, Homo sapiens
gttagccggtgagcagaagtattcagctaaatggtttttgtgtgtgtgtgtgtgtgtgtgtgtgtgtgtgtgtgttttgttttttgtttttttttttgagacggagtcttgctctgtcgcccaggttggagtacagtggaatgatctcggctcactgtaaactccgccacctgggttcaagcaattttcctgtctcagcctcccaagtagctaggactacaggtacctgccaccacgcccggataatttttgtatttttagtagagacgaggtttcgccatattggtcaggctggtctcgaactcctgacctcaggtgatctgcccacctcggcctcccaaagtgctgggattacaggcgtgagctactgcgcccggcctaagctaagtgttttaatacatgacctcactgacatttcacagtaggcctgtgaagtaagcatgcagaagagctacagataagtttagggacccagacaggaatttgatcaaccagctaaat

SEQ ID NO: 131988 - DNA, 1501 bp, Homo sapiens
tggcgtcacttcccttcccgcgatggcggcacagggagctgctgcggcggttgcggcggggacttcaggggtcgcgggggagggcgagcccgggcccggggagaatgcggccgctgaggggaccgccccatccccgggccgcgtctctccgccgaccccggcgcgcggcgagccggaagtcacggtggagatcggagaaacgtacctgtgccggcgaccggatagcacctggcattctgctgaagtgatccagtctcgagtgaacgaccaggagggccgagaggaattctatgtacactacgtgggctttaaccggcggctggacgagtgggtagacaagaaccggctggcgctgaccaagacagtgaaggatgctgtacagaagaactcagagaagtacctgagcgagctcgcagagcagcctgagcgcaagatcactcgcaaccaaaagcgcaagcatgatgagatcaaccatgtgcagaagacttatgcagagatggaccccaccacagcagccttggagaaggagcatgaggcgatcaccaaggtgaagtatgtggacaagatccacatcgggaactacgaaattgatgcctggtatttctcaccattccccgaagactatgggaaacagcccaagctctggctctgcgagtactgcctcaagtacatgaaatatgagaagagctaccgcttccacttgggtcagtgccagtggcggcagccccccgggaaagagatctaccgcaagagcaacatctccgtgtacgaagttgatggcaaagaccataagatttactgtcagaacctgtgtctgctggccaagcttttcctggaccataagacactgtactttgacgtggagccgttcgtcttttacatcctgactgaggtggaccggcagggggcccacattgttggctacttctccaaggagaaggagtccccggatggaaacaatgtggcctgcatcctgaccttgcccccctaccaacgccgcggctacgggaagttcctcatcgctttcagttatgagctctccaagctggagagcacagtcggctccccggagaagccgctgtctgacctgggcaagctcagctaccgcagctactggtcctgggtgctgctggagatcctgcgggacttccggggcacactgtccatcaaggacctcagccagatgaccagtatcacccaaaatgacatcatcagtaccctgcaatccctcaatatggtcaagtactggaagggccagcacgtgatctgtgtcacacccaagctggtggaggagcacctcaaaagtgcccagtataagaaaccacccatcacagtggactccgtctgcctcaagtgggcaccccccaagcacaagcaagtcaagctctccaagaagtgagcagcctggcccctgctgtcggacctgagcctcctggctcccagcctgtaaatatgtatagacctgttttgtcatttttttaataaagtcagttctggtggc

SEQ ID NO: 131989 - DNA, 1790 bp, Homo sapiens
tggcgtcacttcccttcccgcgatggcggcacagggagctgctgcggcggttgcggcggggacttcaggggtcgcgggggagggcgagcccgggcccggggagaatgcggccgctgaggggaccgccccatccccgggccgcgtctctccgccgaccccggcgcgcggcgagccggaagtcacggtggagatcggagaaacgtacctgtgccggcgaccggatagcacctggcattctgctgaagtgatccagtctcgagtgaacgaccaggagggccgagaggaattctatgtacactacgtgggctttaaccggcggctggacgagtgggtagacaagaaccggctggcgctgaccaagacagtgaaggatgctgtacagaagaactcagagaagtacctgagcgagctcgcagagcagcctgagcgcaagatcactcgcaaccaaaagcgcaagcatgatgagatcaaccatgtgcagaagacttatgcagagatggaccccaccacagcagccttggagaaggagcatgaggcgatcaccaaggtgaagtatgtggacaagatccacatcgggaactacgaaattgatgcctggtatttctcaccattccccgaagactatgggaaacagcccaagctctggctctgcgagtactgcctcaagtacatgaaatatgagaagagctaccgcttccacttgggtcagtgccagtggcggcagccccccgggaaagagatctaccgcaagagcaacatctccgtgtacgaagttgatggcaaagaccataagatttactgtcagaacctgtgtctgctggccaagcttttcctggaccataagacactgtactttgacgtggagccgttcgtcttttacatcctgactgaggtggaccggcagggggcccacattgttggctacttctccaaggagaaggagtccccggatggaaacaatgtggcctgcatcctgaccttgcccccctaccaacgccgcggctacgggaagttcctcatcgctttcagttatgagctctccaagctggagagcacagtcggctccccggagaagccgctgtctgacctgggcaagctcagctaccgcagctactggtcctgggtgctgctggagatcctgcgggacttccggggcacactgtccatcaaggacctcagccagatgaccagtatcacccaaaatgacatcatcagtaccctgcaatccctcaatatggtcaagtactggaagggccagcacgtgatctgtgtcacacccaagctggtggaggagcacctcaaaagtgcccagtataagaaaccacccatcacaggtgggtggggggctgctgtgtgtcgggggcggtgggggagtgtcagtatatggactggtaggagtcaaggcctccttattgctgtcacatgatcccaaaccagtcagaccagctcccaggatggagcccggggcaggcctctcattcctgggcttccctgcccctccccagcacagcctgcccttttgttctcacctggaggaggtgaaactggcctgagcccagaggagggcagccaggtgtgagctggcctggcccaggcccagccctgcctcccgccccttctccctggactccgtctgcctcaagtgggcaccccccaagcacaagcaagtcaagctctccaagaagtgagcagcctggcccctgctgtcggacctgagcctcctggctcccagcctgtaaatatgtatagacctgttttgtcatttttttaataaagtcagttctggtggc

SEQ ID NO: 131990 - DNA, 2031 bp, Homo sapiens
agctggagttgatataaagaccaccccatcactttccttcaacatcttttcaaccccgaaaaaataccttttttgtaggtgagaaagcaggctgaaagagatttagtaacatgcccaaggtcacacagccagtaaaacggtgggctggaattagaataataatgccaaacacttgttagccggtgagcagaagtattcagctaaatggtttttgtgtgtgtgtgtgtgtgtgtgtgtgtgtgtgtgtgttttgttttttgtttttttttttgagacggagtcttgctctgtcgcccaggttggagtacagtggaatgatcttggctcactgtaaactccgccacctgggttcaagcaattttcctgcctcagcctcccgagtagttgggattacaggtgtgtgccaccatgcctggcttttttttttttcgtctttttggtacagatggggttttgccatgttgaccaggctggtctcaaactcctggcctcaagtgatctgcccatctcggcctccagaagtactgggattacaggtgtgagccacacacccagccagttattttctcattcgtaaaatgagaataacagcctcaacctgatccacctcacagttgtggcagtgattgagtagaatggcagaggtggaccagtgaggttagctgatgtgtggccctgaactctggaaactgcttctcagtgtgcaggattccttttgttccagccttaccttcctgatgaccctagcctttttccatcacagattctgctgaagtgatccagtctcgagtgaacgaccaggagggccgagaggaattctatgtacactacgtgggctttaaccggcggctggacgagtgggtagacaagaaccggctggcgctgaccaagacagtgaaggatgctgtacagaagaactcagagaagtacctgagcgagctcgcagagcagcctgagcgcaagatcactcgcaaccaaaagcgcaagcatgatgagatcaaccatgtgcagaagacttatgcagagatggaccccaccacagcagccttggagaaggagcatgaggcgatcaccaaggtgaagtatgtggacaagatccacatcgggaactacgaaattgatgcctggtatttctcaccattccccgaagactatgggaaacagcccaagctctggctctgcgagtactgcctcaagtacatgaaatatgagaagagctaccgcttccacttgggtcagtgccagtggcggcagccccccgggaaagagatctaccgcaagagcaacatctccgtgtacgaagttgatggcaaagaccataagatttactgtcagaacctgtgtctgctggccaagcttttcctggaccataagacactgtactttgacgtggagccgttcgtcttttacatcctgactgaggtggaccggcagggggcccacattgttggctacttctccaaggagaaggagtccccggatggaaacaatgtggcctgcatcctgaccttgcccccctaccaacgccgcggctacgggaagttcctcatcgctttcagttatgagctctccaagctggagagcacagtcggctccccggagaagccgctgtctgacctgggcaagctcagctaccgcagctactggtcctgggtgctgctggagatcctgcgggacttccggggcacactgtccatcaaggacctcagccagatgaccagtatcacccaaaatgacatcatcagtaccctgcaatccctcaatatggtcaagtactggaagggccagcacgtgatctgtgtcacacccaagctggtggaggagcacctcaaaagtgcccagtataagaaaccacccatcacagtggactccgtctgcctcaagtgggcaccccccaagcacaagcaagtcaagctctccaagaagtgagcagcctggcccctgctgtcggacctgagcctcctggctcccagcctgtaaatatgtatagacctgttttgtcatttttttaataaagtcagttctggtggc

SEQ ID NO: 131991 - DNA, 1108 bp, Homo sapiens
  misc_feature (938)..(938): n is a, c, g, or t
  misc_feature (950)..(950): n is a, c, g, or t
  misc_feature (1040)..(1040): n is a, c, g, or t
  misc_feature (1105)..(1105): n is a, c, g, or t
tggcgtcacttcccttcccgcgatggcggcacagggagctgctgcggcggttgcggcggggacttcaggggtcgcgggggagggcgagcccgggcccggggagaatgcggccgctgaggggaccgccccatccccgggccgcgtctctccgccgaccccggcgcgcggcgagccggaagtcacggtggagatcggagaaacgtacctgtgccggcgaccggatagcacctggcattctgctgaagtgatccagtctcgagtgaacgaccaggagggccgagaggaattctatgtacactacgtgggctttaaccggcggctggacgagtgggtagacaagaaccggctggcgctgaccaagacagtgaaggatgctgtacagaagaactcagagaagtacctgagcgagctcgcagagcagcctgagcgcaagatcactcgcaaccaaaagcgcaagcatgatgagatcaaccatgtgcagaagacttatgcagagatggaccccaccacagcagccttggagaaggagcatgaggcgatcaccaaggtgaagtatgtggacaagatccacatcgggaactacgaaattgatgcctggtatttctcaccattccccgaagactatgggaaacagcccaagctctggctctgcgagtactgcctcaagtacatgaaatatgagaagagctaccgcttccacttgggtcagtgccagtggcggcagccccccgggaaagagatctaccgcaagagcaacatctccgtgtacgaagttgatggcaaagaccataagatttactgtcagaacctgtgtctgctggccaagcttttcctggaccataagacactgtactttgacgtggagccgttcgtcttttacatcctgactgaggtggaccggcagggggcccacattgttggctacttctccaaggagnaggagtccccgnatggaaacaatgtggctgcggtagctgagcttgcccaggtcagacagcggcttctccggggagccgactgtgtctccagcttggagagcncataactgaaagcgatgaggaacttcccgtagccgcggcgttggtacggggggcaaggtcaggantca

SEQ ID NO: 131992 - DNA, 965 bp, Homo sapiens
tggcgtcacttcccttcccgcgatggcggcacagggagctgctgcggcggttgcggcggggacttcaggggtcgcgggggagggcgagcccgggcccggggagaatgcggccgctgaggggaccgccccatccccgggccgcgtctctccgccgaccccggcgcgcggcgagccggaagtcacggtggagatcggagaaacgtacctgtgccggcgaccggatagcacctggcattctgctgaagtgatccagtctcgagtgaacgaccaggagggccgagaggaattctatgtacactacgtgggctttaaccggcggctggacgagtgggtagacaagaaccggctggcgctgaccaagacagtgaaggatgctgtacagaagaactcagagaagtacctgagcgagctcgcagagcagcctgagcgcaagatcactcgcaaccaaaagcgcaagcatgatgagatcaaccatgtgcagaaggtccggatcccttcccatccacgggcccaggaggcccagcttctctgccagttcccttgggtctctcgggccccagtgccaaaaccatagcaaatcccatttcttaagctcctgtagtgtgtcagggactttacctacttcctcttacttacttttcataggtaagaaaacagacagagggtaagggcttcgctgcagtctcacagcaaggaaatggcacagctgggactagaactcaggcctccggcactggtagcctcttttgtctcctagtagctgtgtcttagtagaaaaaatgacttgaagttcagtgggaaagacgagaatgttattcggcagttgctatagccaagcaccctgccaagtgctgtatatgtataagctcctcaaatccttcccaacaattcaacacacaggaatagttacttttttggtaggtgaggaagaaaggaattccggatcctctagagcgcctcccccc

SEQ ID NO: 131993 - DNA, 588 bp, Homo sapiens
cggcctgattatgggcaacttttagttcttcatacctcactagttactagtgagtagcccttagttttgttttgttttttaagtctatacgttagcatgtaatagttgtatgtaatacaggaaaggcattcttcaatctttttttttttttgagatggagtctcactctgttgctgaggctggagtgcagtggtgtgttcttggctcactgcaacctccacctcccaggtccaagcgattctcctgcctcagcctcccaagtacttgggactacaggtgcaccatgccatgcacagctaatttttgtattttcagtagagacggggtttcaccatgttggccaggctggtcttgaactgacctcaagtgattctccagcctcagcctcccaaagtgctgggattacagacatgcgacaccatactggctgtcttcaaaccttcaatcattcacaacccatgcaatggtccccagcctggcaaccacacggcacagcttctatggctcccttctgccttaactaggctggagggaatgagggcatagagggtgcaagagagtggacacaacagcctaataaccttttct

SEQ ID NO: 131994 - DNA, 493 bp, Homo sapiens
aataaaatcttaagaacattgtttgaaagagcattttctgtaagaaaattacaaggaaggcatttcctgcaagaaaattaacaagggacagggctactggcttcccagtcccccaaattgtaagaactgcagttataggaattttataacggtggctgattttgtgagtgtatgtttgtgtgtatgtggaaaaagtagaggatttgagaaaaaatactttaagctcttttatcagtggacatactctgggattggagaagaggaatcacgttggcttgattatgcttctaggatgatatcctacattaaccaataaaaactctttgagtgtgtgcctactgtggaattgaactgtgttaggtgctaaaggttgacgtaaaaattaaaacgaacaaacagcaaagccttgtcttcaaagactacatggcctaactgaggacaccacatgggtaggcagagcaaaagagttgtcaactattttgtcattaaatga

SEQ ID NO: 131995 - DNA, 150 bp, Homo sapiens
tgcagactgcacgctgtctcagcgcaccgttgttcgttcccaccgtgtgaattttcccataataaaaaaaagtgcctgctgtctgattctgtttacataaaattccagaaaattccggctaatctatattgacagaaaggaggcctgagg

SEQ ID NO: 131996 - DNA, 649 bp, Homo sapiens
gttcctgtgttggtttgctgaggataacggcttccaactccatccatgtccctgcaaaggacatgatctcattcctttttatcagctgccttttccaccccactttcctggcagaataagaaactgtaacccccagttttccctcctctttgcccttttttcctcacttggtccagggaggtaggaacaaatcttgtttgttttctgcccatgctatgactgtctgttctctgtgtaaacacttacttgttttgagggaaaagaaccagactgtacttctaacccctagaactagacagttgttatcagaccctatacatgaagctacattctaactgacagtttagcatcccagttaacttgatatggtagtaaatggataccctgagatattatcagcattctgatccctggaaaagggtatcaatcactgaacattaataaatttgcttactaattaattaggctacgatgagtttaaatagtctgggtgcactaaccaaatttaatatctggacatgcaaagctgaggactggatgctagaatgaggtagcctaccaagacacctgtgctgtgtgtgaagttccatgagggcaaccaacttgccttccacgctaacatttctatcttttctccctgtaactaaag

SEQ ID NO: 131997 - DNA, 398 bp, Homo sapiens
gtttcaggatatgcttctctttctcactaacacaaaaaaagaattgtcatcaaatacagatatatgaaattatatccatttcacaataacagaataaaatctatattttaaagaataggaacaacatatttctcctaaatataatcaatatatttcttcaaagccttatgaaaactattaactgacatattaatttaacattataaaagtttcaaacaggctgggcacggtggcttacgcctataatcccagcactttgggaggttgaggagggcagatcacgaggtcaagagatcgagaccatcctggccaatatggcgaaaccccatctctactaaaaatacaaaaattagctggtcatggtagagtgtgcctgtaatcccagctacttgggaggc

SEQ ID NO: 131998 - DNA, 508 bp, Homo sapiens
ttgtttccaggcattgccaggggaaagagctagaaaatgtaccatcacagggtcgtgcctaaccttagaaacttttacctgtttctcctttaaactacactaaaagtccaagtttccaatgatattatcttaaccagtcatttgctttatcccataaaatacacacaaaagccttagaataacaataccaacataacaagcataatacgattactctaacagttgaggattatacttttggagacgctttatccttcagttataatctattagggccatataatcaaacatctgacatttgaaatagtgcctctctgtatggttatgtaagcaaattgagagagagaaaaagagagagaaagaaatgaattagaatcacctgtctcgtttcaatctttagggctcttttacactttaattttgttttaaaattgtgcaagatatgtatattgtcccaaagtcaaagagacaaaacaagatatattcagaagtccagcttccagtttct

SEQ ID NO: 131999 - DNA, 379 bp, Homo sapiens
cttgaaagtaaattctactgcaaacccacataaccatttatacggcttttcctaataaaatgcctaatttcaaaaactggctgggcacggtgcctcatgcctgtaatcctgcaccttgggagaccacttgaggtcaggagttcaagaccagcaacaatatacttcgctatcaaccgataaggaaatgagatgttagagaagttaatcaatcaggaacaagattcctagatgtcaaggtttcatgataatccaaagtcctctgataacagagtttggtcttttccttttctgctaaagttctcagatgtttgtagctatttttcagctggtgacttagctttcctcgctgggttacaaattctataaagtttcactcagc

SEQ ID NO: 132000 - DNA, 387 bp, Homo sapiens
gaggtaaacatggagtgagtggtgtgggatgtgttgctcccctcgcccctgatgctgccctaagaagaggcagacaaccacagacccggggcctctgcaacaggcccagctggtgtctctcggaggctggctggttcctgactcacccccgggcttccccttccactgtggttttcctgtcagcagctgattcactgtgctgacatggacaggcagctgatggaggaaagagacctgtgttctggtccttggagttggctgctgctctgctgtgtgtatgttgtgtgaccttagataagttccttctctctgggattccttccctgacttgctgatgccccattctttccttggctctcggggagttctgggacctgggatctatcc

SEQ ID NO: 132001 - DNA, 547 bp, Homo sapiens
ggccaattgaaaatcttatttttgaaggaggtttaataacataagaagatttttaagataatattgggggaaggagagcaaattttatatgaaagcataattcatatgtaatatgcatagcaaacatttatagagaataatatcaaatattggtgaggagatggagaaaccatatttcatacacttagagttgcattttaaattgatgtagccatttgagaggaaaaatggcagtatcaaaatttaaaatcttttgacccaacaatttcacttcatggtatctttcttaaatgtttgcttgtgcatgggaggcaattcttaggatgatctttgaagcactgtgtataatgctttgaagcattttgaaacaatctaaatgttaatccgtttagaattaaataaattggaattaattaaatgattatgtccacattgtggtctattatatagcaaatgaaaagaatgaggtatagacatggaaaaaacggatcccaagacagtctacatgaaaaaaggaagttacagagaagaatatgtgtgatatgcc

SEQ ID NO: 132002 - DNA, 738 bp, Homo sapiens
actacaggtgcatgctaccacacctggctaattttttttgttgttttttgttgttgttgttgttttgttttttgtagaaacagggtgttactatgttgcccaggctggtctcaaactcctggcctcaagtgatactcctgcctcaatcgcccaaggtgctgagattacaagcatgaaccactgtgcttggcccactctgtctcttatagttgttataatattcagaatctgacaaaaacaatatttataggaacatatctgctttaatcttgtttataattctgatatcttcacatttattttaacagacagaaaacattatttatgcacttatagggttaatttttcttgtattctctgtgtaggagactgttgatccaaagtaaagacttaattaaatttgcctaacatttgttgaaaatttaggtgccaggtgtaatatggggttaaaaaaataagacatggctgtttctccaggatttaaaagctagttaggaaaacagactcatacataaatactaagtacagataaacttgatgtaatttcccaaaataatataatacttctcaaaagcaaatttcgacctttactgtaaagtgagagacacatgaaagattcctggtagaaaacaaaatagctactctctctaggtccacaactgatgtcaaagtgaacagcagcagctattggatgaggtgttggccatgtgcaacgtgttgaagtaataatattctatg

SEQ ID NO: 132003 - DNA, 494 bp, Homo sapiens
gaattccggctctctgggaggaacttagtttgtagtttagctttgaaacaaagacgtaacagtcctttgtctcatttgccattatacatgccatggtcagatcctctcacagtacaaggtgatctctggtgcccccacagccaaagaggtcaggtcacccaatacaggaaaacagagctttagacctaagaagaatctgcccatgactcttgaaactctgcaaagaaaacagaacaccccaactgcggtgagtggcacctttgttctgaattctttaaaggggttcaactcattataaacctctagactgtttttggtactgcagatggcaaagggggaagaaggaggtatagggtggaagagaagtaaatgaaagaacatttgtttgtttttttaagacaggaagcaaacagaaaccaagtgcatagttttttgtttgtttgtttatttttccctcttttgcagctgcgaggaattttagcgaaattagaaag

SEQ ID NO: 132004 - DNA, 1146 bp, Homo sapiens
ttgcatccctgtttttgtggctgtcagagctccatattatgcaaattgggcttaagcaattaaggcaataatgtttcccttgaagagtttgacaaggtggtgggagcttgggatgaattttgcagacaggagcttggatgcttatttacctacaaatagaagagaacaagaaaggggaaaacactgcagcatcaagcttacctgagcttgggctgctattttctcttgctttttgtttggttgcttcataggagaacaaagggtcactccatggcattagtgggtggtaaatttagaacaaatgaacacttttcacaagatgtagctttaacctgttgaagtcacagctgcagagatcactgaaccaagctcgctggcagggttttaaacggaactgggtgattttatgacaaagaatatttgaagcccctgggggctatgtgtctcctgtttggggtcatgagctgattgtctcgaagctagagagaagcaagtctggcaagctagactttgtctttgataaactgaattgcacagtaaatgagaatgtcacaactacctgactctgaaaaatccactgttattaggaaaacagataggatgtatcagactcttaattgggaatggcacattccacatttctatacttagggaacaatatccagatgataccatcctcaacctaagcatgtggctggacaaccacctcttatagcttgccagttattattcctcctctccctgtagtgtggttgaagcttcctgaaatctcagagtaaccacagaaaatggtgccctctcttctgctagcatttcgtatgaactgttcaacctcttattagttgatcaacaagttgttaggaaattcctgctatacatgtagctgtgtgtgtgtgtgtgtgtgtgtgtgtgtgtgtgtaaagtaagactgaaaaacagtaaaactgtaaggtacctttctccccattttttgattattctattaccatagccttcattcccagctccttctacattcatttccagtttacctcacctgcaaatatgtatcatttgtcaagcatttttaagtttctgtcttcctaaaatataagatctgccacccaatataaacatctatagattcacctttccttatttttctaa

SEQ ID NO: 132005 - DNA, 4059 bp, Homo sapiens
gcgacggagaggacccccgacggcgggtgtactagagaagagaacatactttggttgaggccttcgaatcactcttcagttctgaaatagacagacttgagcagtggagagacgtctttcctaaaactgagttaggtggatgtgaacttaagaactataacgtatgaggcagcccatcttggatcatctttgtcttttgggacctaatacttgggcaaataattgatgctgagttgaaaggtaaattattagttatcttccccacccctcgcatttcagaattataaaaattcggaggcaaattgaaaactaaaatgtttggtaggccctggagtcgccagattgtctttatcaccaggcctttggctttcttcagtttcactggtatcttttggttttgtttttgactttggtggctttttgtagttggagcatcagtagtctcttggaattgctcctaggacattgtggtttaggtttcttcctgggtacagtacattgtaaaatttagcagattaaaaaaagtacacagcattttttttctgtgcacgtcgcagagtcctgagcttgaggctgtgttactctactcattccaaacgaatgaaagatctctgttgccttactctaaggaagtgggatcgagtgcgttaggatctatggttgtcttggttttcaactctgggcagattcctgactggctgagtgtttctgaatgaagatgttttcctgtctgttttgtactgcttgagtgcagaggccagatcctctcagaaagataagattgtatgccagaaattcagattagcagtcagcttaagagagacttattgtcagaagtagtagaattgctttatttacttggttaatgaaggtggccttgggccctattgggttttagaagttttagaagctgctaaaaagttattaaagaatattgggaacatttattttttaaattacctaattctggtaataggcttcagcatttctggagtataataatggtggtttaaaaaactaatcaaacggctttagtaattttactactggtttcacagcttttcagttacagttggtctgtttagtgtgttaattattaggaatcgggtacatgcatccaacttcagtgataccttctagctaatggtttcaatttagacttcactgcctcagtctcactgggtacatgagaaggttggaatcaacatgcttagttgcctcagtgggcacttgaaaattccttcactggcagcccgagtggaggcccagtatgtctagtcctgggatgactgttgtcagcagctgttactctagtacaggtgctcctgtgaactctttattaggaactgaatgtgtcttaacctctgtgttacatcttggctggcagagatttatgttacatgagattgtcttggtagcttgtagtgtggtcaggagaaaggggatggagcagtggtgcatagctgcttactgctcttataaacggtatataaaggttttacggattttgaaaatatttttttttagaggtcaaaataaataccattttagtggcaacagctttgaactagagaggtagatgtattaaagcagcatagaaccataacttctagataatgtagttgccactaggagatattagaaagttagaatgtatgtgtgtatttagtttttcaataataatgaacatacactttcaggagcaaagtatggttgagaaattgtggcagaaagaattttaaatgttagtcgaagttgtctgtagtttctttattaagctctgaaaacacttccaatgccagtttgattctgagggcttgggaagtgggatctcccttgtggagcagctggagctggctgggagggagcctctccatgggtaatttattatgcctgccctgcttcccccagggagctgcttcagtgtgaaatgatgtgattgtcgggggtggggtgggaggagggccaccttcagtcggggagttgctcacatattacacaggtagcatcaggtggacttcagcgctgaactgtactagtagtgagtccctgtagtcaatgtgcaatttctctaattctgagaaactctgtagactctgcctgggttttactgggtcagcatagaatgctatcagtttacctctgtgaaatattcagtcagttgaaggaaacttggattcctagtcagaggtgactaaaagttaccctgaccaaaaggatctctgcggggggaagagaatggagcttcctgattttaatgtgttgcgtcagtggccctcttcgactcccgttttgggtagatgcgtagctcttcactttcttacctcaaggctctgtctagccatgttaaatctttagactcagtctgatgccgtttttctgttttgccattctcattattcacagctttcagaacaagtgttgctaaaactccggggcctttgacagttgttctgaggtgatttaataatggactttttataagttatgttttcctggctctaaagtaaatttttttttttttttttttgagacagagtcttgctttgttgcccaggctggagtgtggtggggcaatctcggctcactgcaacctccacctcccgggttcaagcgattctcctgcctcagcctcctgagtagctgggattacaggtgtgtgccaccatgcttggctaatttttgtatttttagtagagacggggtttcaccatgttagccaggctggtctcaaactcctgaccttgtgatctgcccgcctcagcctcccaaagtgctaggattacgggtgtgagcaaccctgcccggccagtaaattgtatttttttaatgacatcattgatttgaagatctagatggcataaattacgacgtctgccatcgcatattagaaaggggacagtcatatttgtaacgtggagagaacacggagcaccagtcaccacgtgcacttaggatgcagagcttaccgcacaccgctgatggggacctccggaaagagcggtgccttgtggttggcctggaagttctctcccaaggtgaaattcctttaaaacctcaggctctgacctatgtctttgaagcagctgctttgtagagtccctctctttactgtcctcgttaggactgttttgtggttccatgaaaatgtttagcatccttgcagaattacttgagaaggggctggtaccagtgtaaagaatctatttctgtaaaactacgaacttttgcatagggaatttattctaagcaggtcatagccgtgatccagagctgctgctgctcactgccagtccttgcggctggcggcgattgccggacagactctctgtggcctggctctcatccttggcgtgtcagcctgcggcaggctgccagccatccatgacaatcatgtgagctcagccacagacctcagctggcggtttgatccctggcaggtccctcgagcagtactggtaagaggcttcacacattttcccactcttacagttcatttttcatagtaggaagggcccttggcctccccagtgcctcttccagagcctccaccagcactaagctcagaggaaagaagaaaagggccaggagtcagacgtcacacccgggggctcccctttcccatgtagaagtgttggcatgcgtcagtctcctttacagaggggtggatgtatccgtggaggaggggccttctctctttctaattgcactatacttgttctagcttcagtctggagatacttaagacctccatggggtcgtgatccatagacttagcaagtcttgccttatctatggagctcgatggtgagaattgtgaccattgtctgatgtccatagttccttccccctagattgtttctttccacggattgtgttcatctgaaccattttattttttatttaccaaagtactgtacttggctatttgcagtgttttcaaaaccaaatgtttctttttttgtgtttttaatcttcgatacttggtgcaatagaagctgcaaagatgtgccactttatctatgaaatggagttttgtataccaataaattctagttt

SEQ ID NO: 132006 - DNA, 5652 bp, Homo sapiens
  misc_feature (2)..(3): n is a, c, g, or t
tnngattttaatttaatagtccagaacctggaagctgaaaattataatattgaatctgcaataattgccgtgcttcggatgaaccaagggaagagaaataatgcagaagagaatcttgagcccagtggtcgagtgctgaagcagtgtggccctttgtgggaggagggtggcagtggtgccagaatctttggaaatcagggcttaaatgaaggcaggaccgaaaacaataaggcacaggccagccctagtgaagaaaacaaagcaaataaaaaccagctcgcaaaggtcacaaacaaacagaggcgagaacagcagtggatggagaagaagaagcggcaggaggagaggcaccgccacaaagccctggagagcagaggtagccacagggacaataacagaagcgaagcagaggcgaacacgcaggtcaccttggtgaagaccttcgccgctctcaacatctgactctttggcctcttgggagttgtaagaagcggctggaaaaggattgctgtgtgctagactttccagtgaggccgtccttttataaaacgcaacacaaccaacgaagcccacacatgagctcacacactgagttagtttcgttcaagctgcctctttttttgttcgaagttttattagtgatatgttggtgttttatgaaaatgcagtgaggccattcatattctgtaatacaaaattaaaatactgagttttaggggcagatagttaggtcaggaaaaaccttttaagtggtggctttatttgccctgaaaatcagacttcagtgaccctaggatctttccttaacatttggggtgagttttgctgtaattgttcatgagtagtttagaataattgttagaaattcagaatgacaagtttccttagtttctctttcattctcaaacagatatatagggtagcttataaatgatctccaactcaggaatatgctttgatttacttctaatccaagttactcagaaaataattcaggaattgttttcccaaagttacgtgagggttgtggcctgcagtcaggatggaaattaaccgcatttctctccttcctgattctgatgttatttcagatgggatgcaggtgctgttagttcatttgcactcaagccatatgataaatgcagctgactgttaattaggcctggccttgttgggaagttgatagtggtgttgggtttttggtatttgtttcctgacagtggggagatggcatgttactgcttgtgatacagttctggaattctgatagtgtgtagagcagggtctatagttgtaacaggagacgaactcctggggttttgcctaagaggagtctaaagaattatgtttttataggagaagcctggaagaataaggtttttcatgttcgcattttaaataacgattttcttcccttctgttgtagacttagatgccttcagagagatacgtggtaacttgaccttataggtcgctaaacttagtattgtggaaattaaatcttataaaatgctacatttatttctttttatttaagccctgtttggcatttcaaagttgggaaaactccagcatctgctggaagttgttggaccagcagggttggttgacttaggttggaccagcagagaagagaacatactttggttgaggccttcgaatcactcttcagttctgaaatagacagacttgagcagtggagagacgtctttcctaaaactgagttaggtggatgtgaacttaagaactataacgtatgaggcagcccatcttggatcatctttgtcttttgggacctaatacttgggcaaataattgatgctgagttgaaaggtaaattattagttatcttccccacccctcgcatttcagaattataaaaattcggaggcaaattgaaaactaaaatgtttggtaggccctggagtcgccagattgtctttatcaccaggcctttggctttcttcagtttcactggtatcttttggttttgtttttgactttggtggctttttgtagttggagcatcagtagtctcttggaattgctcctaggacattgtggtttaggtttcttcctgggtacagtacattgtaaaatttagcagattaaaaaaagtacacagcattttttttctgtgcacgtcgcagagtcctgagcttgaggctgtgttactctactcattccaaacgaatgaaagatctctgttgccttactctaaggaagtgggatcgagtgcgttaggatctatggttgtcttggttttcaactctgggcagattcctgactggctgagtgtttctgaatgaagatgttttcctgtctgttttgtactgcttgagtgcagaggccagatcctctcagaaagataagattgtatgccagaaattcagattagcagtcagcttaagagagacttattgtcagaagtagtagaattgctttatttacttggttaatgaaggtggccttgggccctattgggttttagaagttttagaagctgctaaaaagttattaaagaatattgggaacatttattttttaaattacctaattctggtaataggcttcagcatttctggagtataataatggtggtttaaaaaactaatcaaacggctttagtaattttactactggtttcacagcttttcagttacagttggtctgtttagtgtgttaattattaggaatcgggtacatgcatccaacttcagtgataccttctagctaatggtttcaatttagacttcactgcctcagtctcactgggtacatgagaaggttggaatcaacatgcttagttgcctcagtgggcacttgaaaattccttcactggcagcccgagtggaggcccagtatgtctagtcctgggatgactgttgtcagcagctgttactctagtacaggtgctcctgtgaactctttattaggaactgaatgtgtcttaacctctgtgttacatcttggctggcagagatttatgttacatgagattgtcttggtagcttgtagtgtggtcaggagaaaggggatggagcagtggtgcatagctgcttactgctcttataaacggtatataaaggttttacggattttgaaaatatttttttttagaggtcaaaataaataccattttagtggcaacagctttgaactagagaggtagatgtattaaagcagcatagaaccataacttctagataatgtagttgccactaggagatattagaaagttagaatgtatgtgtgtatttagtttttcaataataatgaacatacactttcaggagcaaagtatggttgagaaattgtggcagaaagaattttaaatgttagtcgaagttgtctgtagtttctttattaagctctgaaaacacttccaatgccagtttgattctgagggcttgggaagtgggatctcccttgtggagcagctggagctggctgggagggagcctctccatgggtaatttattatgcctgccctgcttcccccagggagctgcttcagtgtgaaatgatgtgattgtcgggggtggggtgggaggagggccaccttcagtcggggagttgctcacatattacacaggtagcatcaggtggacttcagcgctgaactgtactagtagtgagtccctgtagtcaatgtgcaatttctctaattctgagaaactctgtagactctgcctgggttttactgggtcagcatagaatgctatcagtttacctctgtgaaatattcagtcagttgaaggaaacttggattcctagtcagaggtgactaaaagttaccctgaccaaaaggatctctgcggggggaagagaatggagcttcctgattttaatgtgttgcgtcagtggccctcttcgactcccgttttgggtagatgcgtagctcttcactttcttacctcaaggctctgtctagccatgttaaatctttagactcagtctgatgccgtttttctgttttgccattctcattattcacagctttcagaacaagtgttgctaaaactccggggcctttgacagttgttctgaggtgatttaataatggactttttataagttatgttttcctggctctaaagtaaatttttttttttttttttttgagacagagtcttgctttgttgcccaggctggagtgtggtggggcaatctcggctcactgcaacctccacctcccgggttcaagcgattctcctgcctcagcctcctgagtagctgggattacaggtgtgtgccaccatgcttggctaatttttgtatttttagtagagacggggtttcaccatgttagccaggctggtctcaaactcctgaccttgtgatctgcccgcctcagcctcccaaagtgctaggattacgggtgtgagcaaccctgcccggccagtaaattgtatttttttaatgacatcattgatttgaagatctagatggcataaattacgacgtctgccatcgcatattagaaaggggacagtcatatttgtaacgtggagagaacacggagcaccagtcaccacgtgcacttaggatgcagagcttaccgcacaccgctgatggggacctccggaaagagcggtgccttgtggttggcctggaagttctctcccaaggtgaaattcctttaaaacctcaggctctgacctatgtctttgaagcagctgctttgtagagtccctctctttactgtcctcgttaggactgttttgtggttccatgaaaatgtttagcatccttgcagaattacttgagaaggggctggtaccagtgtaaagaatctatttctgtaaaactacgaacttttgcatagggaatttattctaagcaggtcatagccgtgatccagagctgctgctgctcactgccagtccttgcggctggcggcgattgccggacagactctctgtggcctggctctcatccttggcgtgtcagcctgcggcaggctgccagccatccatgacaatcatgtgagctcagccacagacctcagctggcggtttgatccctggcaggtccctcgagcagtactggtaagaggcttcacacattttcccactcttacagttcatttttcatagtaggaagggcccttggcctccccagtgcctcttccagagcctccaccagcactaagctcagaggaaagaagaaaagggccaggagtcagacgtcacacccgggggctcccctttcccatgtagaagtgttggcatgcgtcagtctcctttacagaggggtggatgtatccgtggaggaggggccttctctctttctaattgcactatacttgttctagcttcagtctggagatacttaagacctccatggggtcgtgatccatagacttagcaagtcttgccttatctatggagctcgatggtgagaattgtgaccattgtctgatgtccatagttccttccccctagattgtttctttccacggattgtgttcatctgaaccattttattttttatttaccaaagtactgtacttggctatttgcagtgttttcaaaaccaaatgtttctttttttgtgtttttaatcttcgatacttggtgcaatagaagctgcaaagatgtgccactttatctatgaaatggagttttgtataccaataaattctagttt

SEQ ID NO: 132007 - DNA, 709 bp, Homo sapiens
ggtctttgatcttgtgtagcatctcttgaaatagagcagtggaagtactatgaaggaaataaatggtatgatgtgatagtgagtacctgtgagaaagtaggagatggtgatcagggaggatctttctatggaggtgaaatagaaggtgagatttgaagaataagaggagtaagtaaaaaacacagagaccattccagagagaataacaggtgcaacagccctaaagcaggagtgggcttggagtcatcaagggatagaaagttgccagaggatagtgagcaagagagagagtggtagaaagtagggttgaacagtcaggtagaagccatatcatcagagctttgtaggtaaaggtaaagagtttagattttagcctaagatccaaggaaagaatgttgaagcatgggactgacatcatctgatttccattttacaagattactgtgtggagaatagacggcaagaggaaagagggaaatgggctgtggcattagtccagaaaagagatgattgatggtggcttagactagagtaattgaaataaagaaggagagcagtaactaagtgtgcctggtagaatgaattctggtatataattcattggagagagggttatttccttgtattcaggtgagttaggatttcttagatgacagaatctgagcgtgtggcttcagtatagctttgtcctggtgagttttaaaaatca

SEQ ID NO: 132008 - DNA, 217 bp, Homo sapiens
ggtcccttatgtctgacccaccaatagacttactctctcgccctccatcgtcagctgtgaatattattattgcctctcctacccgcaggacctcagctagtccctcaaagtcgctgggcctcagtcgcctcatctgtaacaatggggaagatagcaccttcctcacagggctgctgggaggatgctgagagagggtgcatggaaagcctgacaaaag

SEQ ID NO: 132009 - DNA, 670 bp, Homo sapiens
caacctacagaatgggaaaaaggatttgcaaaccatacatctgatgaggggttaatacttaaaatatataaagaatccaaacaaatcaatagtaagaaaacaacctgattgaaaatgggtaaggcatctgaataaacatttctcaaaataagacacacaagcggccaataggtatatgaaaaagtgctcaacatcactaatcatcaaagatattagaatggtgtctttgacaacccatggagtgggagaaaatcttcacaatctatacgtctgacaaaggactaacatccagaatcgacaatgaacttaaatcagtaagaaaaaaacaaaaaaaaaaacaaccagtgtgcgtggcgccggcctatgggcccccggaaaaacgcttatctataacaccaattccggtgtgggcgcgcgggggcgcccaagttgggtataaggtgtgaccagtgggccaaaagcggtggtcccaaagggaaaacccgggcgccaagaagaccatagggggcgtgggagtttttctccccatatgtaaaaaaagcgcgccggggggggaaccccggaggcggtccttagaaaaaattctccaagatgggggatttcaggaggggtcataccgggagttctattaaccgggggtcacagggaacgcccgaatttcaaattacgc

SEQ ID NO: 132010 - DNA, 514 bp, Homo sapiens
  misc_feature (41)..(41): n is a, c, g, or t
ggcaggcgttcagaggagtcccctccagtaaggtgtgccantccctaagataagaaggacagctacacggtcagtatagaaaacatagaaggttatgtaccagagacgtacagagtgagtgaggaagacaatattagggtaccctcggccctggggtggaaagaggatcaaatgaaatgtatggaggagctggcatgtcagactgaaaacaagctgaatttacacatatagaaatacaaataaaggaccgagagaagtcaaaggtatcagtgtgaacaagacaagatatggaatccaatgaagagattcagtcccgtttggttagaagaaagaaaggaaataagttggggcatattatgtaatgttactctgagaaatcagtaacaacattagagtagcaaggttagagcagcatagctctcctcaaggtacatgtacctggcattaacgggcaggatggttaggaagggtaaatacttgttggctacgagaccacatggtagagtatacgatt

SEQ ID NO: 132011 - DNA, 189 bp, Homo sapiens
accatggggttagcctcccagcataagttgggattgaggtctctgccttcctagtggaccaagcaggataagctgtgaaaggtgattccttttgcccattgtccctgttttcccagtgtcctgctgccaggcagctgctttcccttactccccatatgtcccttgctccagccgtatgcctccaacccg

SEQ ID NO: 132012 - DNA, 343 bp, Homo sapiens
ctatatgtctcgacgttacctgcggacctgtaacattataacactggtgctggtactagcgttacgcacagcaatgctagtcacgttaatgcccaaagtgagcctggtcctaggtctccaagattttctttgttttcttttcttctaaaaggtttatggattttacatttaagtccatgatccagtcaagttaatttttatgtaaagtatgaggtttaggtcaaggttcattaatttgcctatgaatatccagttattttgcacaatttattaaaaaggctctccttctgccatccatactaatttttaatgcaggttttcaaaaatttttactttatatttt

SEQ ID NO: 132013 - DNA, 650 bp, Homo sapiens
atattacgttgagtttattttctggaatcagcttgccaaaagaggaaaagtttatttttagtgaaggtaaaaattgattttaattatttggtagcaacccttactagtagaataagagctgaagtaccaatattagtgattttcactgttctgaaccaagcctggttgcatggtggtttttaggacaacagtgaagagctttaatttttatgttttgggaaatagcttgtgagaggtaagaaggattgcaaagtttttccaaaatattttatgaagttagtgaagtcagttgaaatgtgtatttaaacatttgaagggatacagttaacatttttttaatgagaggaaaccattgtctgtagttcagaaataagatggagtgttttacttatttaaggggtaatttaaaaagtaaacaaaagcattggcctacaagagaaaggtgatgttggattataagtgctttttctaatcgttaatattaatcaacaggtgagtatattttccgtttccaagcagttattaatttacattttctcaaattataagtagcttcctgcttctccaaaagtgaggcttaagaggatggctatttcatcataaattagaaaaacgactacaaatatgaaatggttaattttttggtacta

SEQ ID NO: 132014 - DNA, 461 bp, Homo sapiens
gaggcatgttgtaaagccaggtatacacagttcacagggagaacaattgcattttaggatttcgcttccttcatgattgccttttccttcttcaatcttctagttcttctactcttctcagtcttcccctgaactgactgtcgtgtttctgccctcaaggcaaagcttcggctctttttatcttttctggttatgatcctcacctgccctctgcacatgttctctaggagcacttttcattttctatggtctgatcatgcttcaaaccggggcagcaatcaggattgtctgattgaagcctggggtctccaaatgccctcctgttcactaaattccaccctgttaaccacgcctactctcgtttaccataaacatttattgcatgagcctatctgctgcagctgggtgttgtgccaggtgctgggttggaatcattccagtactgggcgatatggtttgtc

SEQ ID NO: 132015 - DNA, 388 bp, Homo sapiens
gtagagatgtggttttgccatgttgcccaggctggtctcaaactcctggctcaagcaacctacctgcctcaacctcccaaagtgctaggattacaagtgtcagccactggacctggccggttaggttattattattattaccaaaatgcagatgaagaaactgaaccatggagaatgtaagtaacttgaccaggtgatactactggttaggttgaagaactaggattcaaatccaggcagtctgggccaaagtctaaattcttaaccaccatgcagaactacctctatgtcatgttgtcagatctagtagatgcaagacacactgatacatactcaccagtgaagttcattgcaaagtcaggaggcagaaacggcagccatgaaaggg

SEQ ID NO: 132016 - DNA, 437 bp, Homo sapiens
aggtgaatggcagataaattactcaatcaatataataaagacaatttttctctgtgaggcaaaggttggacaggtttgcatgtaacctactttaagaagattgaggtttcttagtcttgagtctgctcagctgtgacacaaatcttccccatgtgcaatgtccatctgagccttttgaaatccctctaaaaaatgtagtatggacaaggagaactaatacaaaaatgaggcttttgcctccaggtagacagtaaatagtaggtttttttttcatacttcagtgtctcatgccttctaccagcatccatgaaaatggaaggttaataggttcgtttacaaataggatgaaatcttagatccttcacaattatttaattttggagatgacaatgggatgctgagataaacgcaactttctgaaaggggaaaatacacaa

SEQ ID NO: 132017 - DNA, 778 bp, Homo sapiens
cattggttttaatagccgttgattatttttacctgaatcatttattttcttgtaatgatactgtaaaatggtggtttttccctctatttgtaatttcgttgaaatttattagttggcaatcttcattagggaatcttaggattacagtttggcttcccacttagtaggcttgtaggggagattaggctgggcagagatacatgcaggcatgcatgtattttattttattattattattttttcagacaaggtcttgctttgtttctcaggttggagtgcagtggtgtaatcactgttcactgcagcctcaacctcccaggttcaagcgatcttcccacctcagccttcctattaactaagactacagatgcatgccaccatgcccagctaatgctttattttttgtatagacaggttctcaccaatttcccaggctcgtcttgaactcttggacttgagtgatcctccctccttggcctcccaaagtgctgggatcacaggcatgagccaccgtgcctggcttaattttgttgttgttgttaatagataaattgtccttgtggtttctatattagtcactttcgagctttgttaaatggatcaacaaccttatatcccatcaactcttaatagttgactcacttgagtttaagttatatatcctggagcagtcatcttgacttttgctatttaatgatgtttcttgacagttagcaagttatatagcttgttctgggtgaaacccttctgccttgcatctttacccatttgtattcca

SEQ ID NO: 132018 - DNA, 473 bp, Homo sapiens
catttagccacttaatatttattgagacctattttgtgtctgattgctaagccttcaggatacaaatacaggtagaactcgatctttgccttggaattgctcagaccctgtgagggcagactgatagagaaaaaaatacttacaatgtaataagcacaatatatgaacatgaaagtatgagacaaggttctgcccctgaagagtttatatagtagttgacaggacaaagaatttgtttgtttgtttgttttgcaacagggtctcactgtgttacttaggctggagtgcagtggcaagatcatggctcactgcaacttcaacctcctgggctccagccatccttgtacctctgtctcctgaacagagctgagactacaggtgagggccaccacacctggctaattttgttgttgtttgtttgagaccccagaacacagagcccaaaaaaaaataacaaaaacgaacacaaaaaa

SEQ ID NO: 132019 - DNA, 321 bp, Homo sapiens
ggggtagggaaatgggaaaacggagtcatctgtctacagaagcactcctgtggtgttttaagatgttgacacttaattctgacccagcagtgaggggcaagaaggacacttcgtcacccacgattactattcttgaggatctaacccctctattggcctggggggtggggagatgggagaagctcctttaaggcatccttaggacccttggttgttatgttttagggtgggggttgatgcctttgtctaaaatttcctcagctcaaaaccacatgccagtttctaggtgctctgtgtagaaggcgggtggataacaggagt

SEQ ID NO: 132020 - DNA, 625 bp, Homo sapiens
gtatatagccaggtatagtaactaagtcatttgtagatttcttaaattcccattgggaaagatctacccaatgtgtcaaaagatctttactatttaatatagccattatgattatttccttgcagaaaactcttttagcacattcacatagagaaactgacaatgggaactgctgtgggttgaattgtaccttctcaaaagctgttaaagcatcatgaggaaaaagccctcacatattaatattaaccttgaatataaatggattaaatactccaattaaaatacacagattgccagaatggattttttttaaaaaatgaaccaactatatactagttacaagaaactcaccttgctggtaaagacacttatagattgaaggccaagggattgaaaaagatattccacccaagcagaaaccaaaagcaagcaggagtagccatgcttgtatcagataaaacaggctttaaatcaaaaacagttaaaaaaaaaaaaaaagacaaaggaggttattatataatgataaaacaattcaacaagaggctataccagtcgtaaatatacatgccctgaactcaggagcagccagattcataaaacaatattacgagacctaaataaagag

SEQ ID NO: 132021 - DNA, 390 bp, Homo sapiens
ccacttccgggtgtatatgcaaaagaattgaaagcagggactaaagaagatacatgcacaatcatattcctagcagcattattcacaataggcaaaaatggaaacaactcagatgtccatcggtggatggatggataaacaaaatgtggtgatatgcacatacaatggaacatcgttcccttagaaaggaatgaaattctaacacatactacaacatggatgacacttgaaaacactatgctaagtcacaaaagagacagaattgtatagttccatttatatgaaatacctagaaaaataaaatttataaatagaaaaaaggatcatggttacaaggttctgggagaaagggagaatagaatgttattgtttaatgtatacaaagttttt

SEQ ID NO: 132022 - DNA, 488 bp, Homo sapiens
gctgcggtcgacttaagatccccgaattccggttctggggtcacttaggaatttaaatgcactttctcatgaggtttgacttttgttctaagagctcatgaaaacagtgctaccactagctgtaccttgcacctttgggattaactgcaacttaaagaaccatgtatgagtgaacccaaggtacttatttgaatgatacagtccttggtaactgtgactatgaataccttggcttcccttcaggttggaatctacagaaaagacaattaaaatctcactccctgaacataatttaaccatgtattactagaaaatgtgaaacgaggctagtttctcttgcattcagtatatgggtaaagaggtaaaaaaagagtgagaaatgcatcttaagagggcaatagagaaaacaaaactcaatatctggacatgggtgatctccctgaagactaggataatgcattggtggtttatacaaataccagattcat

SEQ ID NO: 132023 - DNA, 607 bp, Homo sapiens
ctttggataaggggcatctcacaccttagcacgcttcaaaccagacttaggattgccccactccctcttctctttctcaccttggtcagtggcagcatcatcctttggttactcgatgcaaaactgtttttttccttttctcctattgcacactcagtccatcatcagcctgatcatcctaaccacgtccatagccacttgtgcgtgtgccaggccactaccctcctttgcttggattatgttggtggcctcctcactgtgtccctgcttcaactctcctgttgcctccgcctgcctcccctcaaccgccaactttcttatcttcatgaatgttatggccactgcctagagtgatcttttttaaagatctccatcagattgtttttctttgctgctcacaaaacctgcagcaactcccttgtggcctgcatggctccacttgatctgggctctggccacctccctgactgcatttgttacttctcaccctctcttccccagccacgctgtcctccttgctgcttcttgaacatgccactgtcagcatcactcttgtaccatagaggggctgacttgttctcttactgcaatcaggaatagcaatccc

SEQ ID NO: 132024 - DNA, 368 bp, Homo sapiens
acaaacaaaacaacaacaacaaaatccacaactgagccaacggtcaaactatagcctaactctagatggaatccctatactgcagcccaaactataaggcttgtcctggttctacctcatgaaacaatgacgggcagcctgcaaggttagcagaattctcaagcgacctctactatgcccccttcaatcttcaaagaagaaatggactttgcagcttctatggcagtctgcaattccccttatcctaccgcctctccactatatctcacctttcttcataaatgttgatgccccgacaaatcaactcaaaaaaagccaaattaatatgaaattggggggagtggaggggagtggcaatgacacatttt

SEQ ID NO: 132025 - DNA, 325 bp, Homo sapiens
cttcactgcttctgcatgcaggtctaggctagccttaatcggactgtcaggctgaaaaacagcttgtctattccttattttagttttggttaccaatgaaagtaaaatgaacagtaaaataaaactttccttgcttcctgcttctgccccctgaaggccatttttacctcaatgaaatatcatctaaagaaaaattatttaaaactccagttgtataatttcaagatagtttagtgtatttagtatgactcactcttcattaaacttcacaactatttttaaaagctaatttacatagttacctgtttgagctgatcgatggaaa

SEQ ID NO: 132026 - DNA, 268 bp, Homo sapiens
tttattggcccctctctgccaggcatggtgctaggtgctttgtattatttcatttcttcttcacaacaacccatgaggtgttgattattatcatccccatgttactgttaactgaagaatcacaaggttcagaaacttggagaggagagctttacttctaacaaaaggttacagcctgcaggtggccatcctgataggctgggaagcatagcctccagcagacaccaaaagcaggcacttcaagggagagaggggcggagcaggaatt

SEQ ID NO: 132027 - DNA, 379 bp, Homo sapiens
tcagaaggatcatcttcatatgaaaaagactcccattatgttctagagaccacaggagctgaaaggttttagcaccttcatccacctctaaacatttgcccttcacaacaactttaaaagcaaaaggctttgaaagaacgaaagcccttttgaacagacttcattcacacttgcctgtaactctcttactccttgtatccagtcagggttcagacagggaagcagagtcccaggggctcatggaatagggcttgattataggaatctgaccttgtagttgtgggaggagctgttggggaggcatgaaggtctggacggggtgctggaggatcggcaaacacaagcagtcagagaggccaggcacgtttagccaccacag

SEQ ID NO: 132028 - DNA, 416 bp, Homo sapiens
gaacttgctgcttctgtttggggaggacagacctgactgtgactggattatctgataaccatttgtgaatactgaaattctgttaggcagtaactgataactgctctaaaggatcattaaataggatgctgaaattatgtatcttaatacagtgtggtatgagaattaccaagtcaagagaattgtggacataagcaagtttggccccaatactgctcttaactcactttccagcttactatttgctatttaaatggtaggcaccagctaagcacttctaagcactaacacagctagaactaggcaaaaatggttagaactcagctctcttctactagtccctgtcataattatttttggtatttatgtccaaacctcgcccccccttaaatctaagggaatgcccccaaacggag

SEQ ID NO: 132029 - DNA, 628 bp, Homo sapiens
ggcacatcacctgaacttttttgagtattagttggctcacctgtaaaatgagggaagtatcatcaaggttactgtgaggatgagacggcaaaggaaatgctataaatactcaataaatggcagtattttacatacatttaaaatgcagtccactttctggagaattctacttggcaattattcacctcctggtgttttcacatcacttaggttttttggttttggttttggtttggtttttgggtaacctaaaatctggtgataaagggtagagtggtgaaagtatttgaattctgactactctcattaattattccatctaatggggtagtttcatttaaagggataatatgtttaaaaagccaaaccaaaagttcatacctagtattggttttttaaagcctgctcacggcagatatttttatctgaaatttagactttcacattcataacagggctcttatttaattgcacatatcaatatcacaatattacgcaattaaaatgtcaaagatattaatgcataaaatttctacgcaagcccagacaaactcatttctctggaggctgaggtaggaggatcacctaagcctgggaggtcaaagctgctgtgaggggcaaaagaact

SEQ ID NO: 132030 - DNA, 627 bp, Homo sapiens
  misc_feature (602)..(602): n is a, c, g, or t
tccatcgagctcggtacctacttttccacaggggacaacaagagtcttcagaatcagattcttaatgtggtcaatcaccccatcatacatttctacagcagggcttaaaaggcacaaccctcaaccccaccgcctaagaccaaagcctccaatgcacctcctagttagcaagtccacaatcttacataggccaatctctatgtcagtctgtctctgtgcttcgccagagtgtctagagcagcactcctcaaatgtcaatgtgtgtaagtcagctgaggatcttgttaagtgcattttctgacacagcgggtctggggtagggctcgaggctctgtatttctaacggactcccagaggatgtccatgctgccagtctgaggaccacactgggggtagcaaatgtcaggactccactgcaacagcatctgatggcttttctttggtcaagtcatcctggaacaagtttctagaatgattccaccctggcccccctagagtccagcccacacagcataagccctacaacttgacttataatggcagaaacttgcatttctaataaaagcccaactcctacaacgaaaatgccttgtggaaagtanggtacgagctcgaatcgtatctggc

SEQ ID NO: 132031 - DNA, 258 bp, Homo sapiens
  misc_feature (233)..(233): n is a, c, g, or t
tacttatccacagggtacttttccacagggtacttttccacagggtacttttcactttgggctcttttctttggtcaagtcatcctggaacaagtttctagaatgattccaccctggcccccctagagtccagcccacacagcataagccctacaacttgacttataatggcagaaacttgcatttctaataaaagcccaactcctacaacgaaaatgccttgtggaaagtanggtacgagctcgaatcgtatctggc

SEQ ID NO: 132032 - DNA, 319 bp, Homo sapiens
ttttctttaaccataagttctagaagactatttttaaaggatacgcagaatgtaagtcaatgaactaaagaggccagtctgggctggggaaataacatcaacatatgcgagcataattaatcagctagtggtgtgtgcattgcagaaggaaggagacaggaatgaagagaatggccatgctagagcagaggataaaggcagagattagtgggggagccagtgctggatggataagctagagacagatcacaaagatcatcaacagctagtgaggagagttatgggagtaaaatctgagagcaaaaaagattcttacaga

SEQ ID NO: 132033 - DNA, 615 bp, Homo sapiens
gaaggaatatcttgttcatctctccttctccatctctatacatcctccccagctcctccagtcttcctcctgctcccagaacaaagcttgagaatgctctcagctgaacgctcctaagagctgtcactcccagacctagaagaagctgttttcaaagcagttgtctggcagcaaagtcaccaactggtcaaaccagattctgctctgactgcagaggtttctgggaaaggggcctcaagattacagaccttccagctctcccttttgcaaagatctcagagccaccctctgtataaggggctcatgttggaattcatgttggaattcttcataaatgctccaaacggagaggaacatgtaccagtttcccagccaggctctagacagaggaggcagaatgatttaccccttaatataattttagcactgggaaagttcttttaaagcaataccaacaaccacaaaattacagaattaggaagactctccatcagaataagccaggttatgctacaataataaataagtccaaaatttcaatgccttgaaagagcaaagaactctttctcacccgtgtccattgtgggccagcagggtcagtctacttgttactga

SEQ ID NO: 132034 - DNA, 375 bp, Homo sapiens
tcgtttgcacctgggctgctgtggactgttgttgattcctcactacggcccaaggttgtggagtgggcagatgagggtgttgttctcactgcttacgacgctgatctggaggggacgagaggaaggcctggccagcaccaggacggatcacacaggccgggtgctggtgtctgtacccactgagggccactaggagatgggaactgaggtcatcgatggtgaactcgcggctcctgcttaagaaccagaatcctgacttcagacgtttatgctggagcttcacatatgtttcagaacccatcgttcaacaaaaacctcagattcatcttaagagcccttgagaaaaggacgcctctatgacatcactgtcctacc

SEQ ID NO: 132035 - DNA, 141 bp, Homo sapiens
ttttcacatatctattggccatttgtatgccattttaatttcaaaaagcacttttctttcctctgaatttttttattttgaaaaaaatttttttagagacatgttgtcactctgttacccaggctgaagtacagtggccca

SEQ ID NO: 132036 - DNA, 420 bp, Homo sapiens
actccctggtctggcccaggctggggtgctcagggcctctgtgttgttcacctgcaaatccccagccccgttctgtgtgttctgaggcccacctgggtcttctttctgttgctccagctggaggcttcttggggtagctgcactgtcctttctgcaggaaagctggtttttttggtttttttttttttgagaaagagtcacttggtcgcccaggctggagtgcagtggtgccatctcagctcactgcaacttccacaccccaggttcaagcgattgtcctgcctcagcctcccgagtagctgggactacaggcatgtgccaccacgccgggctcacttttgtatttttagtagagatggggtttcaccatgttggtcaggctggtctcaaactcctgacctcaggtgatctgcccacctt

SEQ ID NO: 132037 - DNA, 901 bp, Homo sapiens
tttgtgagagtttacttctaggttttctgttctattctatgccagtaccacaccgttttgattagtatagttttgcagtaagttttgaaatccagaagcatgagccctttaacttttgttctttttcacgattaatttggctgtatggggtcccttaagattccatatgattttttttttttttttttttttgagatgggttctcactccatctcccaggctggagtgcagtggcacaatgtcagctcactgcaacctctgcctctcaggttcaagcgattcttgtgcctcagcctcccaagtacctgggattacaggcatgcgccaccacacccagctgatttttgtatttttagtatagacggtgttttgccatgttgaccaggctggtctccaactcctgacctcaagcaatctgcccgctttggcctcccagagtgctgggactactggcatgagccattgcatccagctagattccatatgaattttaagatgtttttatggatctgtggaaaatgccattgggattttgataggaactgcattgaatctgtagattgctttggttactgtagtcagcttaacaatattaagtcttccaattcatgaacatagaatgtttttccatttattggaactccgtttttaattatattcaattttaggaaatttaaatttgtttggccatattgtagctaatcatcatcctattggccagcaagcccaagagaattatcctcagattttcttttcttcctaaatcgtaggatcgtagtgacgtcttcagaggccttgtagtatctgaatcatcattggtctcaggatgtctggattgtatggaatgcatggttagaagggtgaataaatagggggtttcggtccctccaggttatctctg

SEQ ID NO: 132038 - DNA, 444 bp, Homo sapiens
agagtcctggaatatacccatgattatctggaaacagctggttccgtttcaccatcgtttcaagtgaagccccagttttgtgcttttctgccagaaataacgtcagcccagaagccctgaatcccaacagcactgaactgccggagttccacccagtgtgggcacataagtggcttcctcaacccacagaaagatgtgttgctaagaccgtaaggtgaccttttaacttcttcagagatagtttcagtcatgcatatctttaaactgctacatctcacccttggttaagccattttttagaaaattatgagatctaatgttgtcacctagtctgaaatactgtaatactgtggcaaagtcctacaacaggcagtcattaataacaggtagaaagaaaagaccgaggagaatggctagtaagacatggaagtaagtgattaaaaa

SEQ ID NO: 132039 - DNA, 812 bp, Homo sapiens
ctcaggctttctcttactctagcagaaacaggtatgttttactttgtgtcccactatggatagactgctgaatacatcaggtatgttcaagcattaccacatctctatttgtttccgtatctcagtaacagcagagatgagctgagaatgaatcagaacgtgccctgtagtgacattgatatatttcctgaggtacatcacgatagtctaggggacaaagggcgcagggaagcccagtgtactctttatgtctacacttgatcttagccagaaggctgagaagtgatactttttatgtcttacctctgtttctggtgactacagataagagactcatcccttgattcactcattcagcaaatatgactgagcaccgtctctaagcaggacatttgccttgtcctcagggagcatagttggcaaggaatctagacagcagcccttcttgagcttgacattgatcttctcatgaggaggactgggctccaggtggggaaagaaccccatcctcacttgtgggctagacgacctgggagtccacagacactgaagacacatcattcttcctattcatttcaaccttccctcgacagatcttcctgggaccaggtcttcaggacagtgtgagctaggtttattgaagtgctctgggctgatgtcattacatttgtaacttccatgccccccaaaaatgttttgaagacattcattttatcaaaatacaacatacatgcagaaaaatgcccacattttaacttacggcttgaagtgaagttacccatgcaacacccacccacatcaagaagtagaac

SEQ ID NO: 132040 - DNA, 783 bp, Homo sapiens
tgcagtggctcatgcctgtaatccaaggactttgggaggccgaggcaggcggatcacgaggtcaagagatcgagatcatcctggccaacatggtgaaaccccgtctctactaaaaatacaaaaattagctgggcatggtggtgcgcacctggagtcccagctactcgggaggctgaagcaggagaatcacttgaacccaggaggcggaggttgcagtgagccaagatcacaccactgcactccagcctggtgacagagttagactccgtctcaaaaaataaaataaaataaaaaataaaccaggtagtttgggaagctctgctccagtgaaaataatttctgaaaaagctgcattttttctcatgttcacaaataggggcatcttctgttccatgctgttaaatccaagaattctcttttttctttagtgatctccctttaagtttacagggagagctaatgtccactttatcgcttataaggggctgcatgatgtgactgctgttccattgcttttggagacactggaatatttgtgttactgaggagctgtatgtcaaagtattttttttcaaatattcttttcgtattatgtctaaaatgtgtaacgtgagtagtggacatagtgggatttggttcagaaatcccaggaacaccaaggacagatgttgcctcttttctacttagtgttttttaatcctatggaggctgcaaatgtaattctacaaaaattcttacttagcaattttatcagaacaataagcatttcctaaatatgaaaaa

SEQ ID NO: 132041 - DNA, 369 bp, Homo sapiens
cagtaagtgaaagggctgggttaaaatttttatagatgtggccacattaccatccagagtggttttactagtttctgctcctgatagtgtatatacgtgcctaatttactttgttctcactaatacttaactattttcagtacttgaaaatgtgatattattaaaattacagatttgtgccaatctggctgaatttccccaattgctatttagtactaggttgagcagcttctcatatgattattcactgaccttttacattttatcctctgggaattgcctattattattctttgcccatctctattgggtgctttcctcttgtcttactgacttatataagtcttaaaattattaatacttagcttt

SEQ ID NO: 132042 - DNA, 290 bp, Homo sapiens
gaccttgatagccctctcctccacacgacagctcaagagcccaggccagatttggaatttcttctgtctttgcccactagctacagaagaaattccaaacatggtagcctgggccatcactccacagatgaaagagatcttcctaagttcagatcctagtcttcgccttcaagacacctgctccaagcaacagctactccacgtcctggggtcagacacactcagatctctgtgttcgccaaagtgcttcctccacatattcatacatcctaggccttcaccttcctcaa

SEQ ID NO: 132043 - DNA, 131 bp, Homo sapiens
gttccagaaacacgatgtaagagagagtttccctgacagtgggccactctccgtggccttgtagggagacagaccagggagtcagtccttagggccaaggcagaaggattgcttgagcccaggagttgaag

SEQ ID NO: 132044 - DNA, 316 bp, Homo sapiens
gtcgtgaagactgaggaaagcgtatataggggagatgtgtgtaactgtgagatcgatgtgagtattataatgaattaagaacagtgaaaaaatatgataccccaaagataagaggatcaagacagatcagatgtccatgtgcacaaaatggtgtgtgtgtgtgtaattatcttctttctcctatttcctccaatcccccttttgagcaggcatctgggccattgtgcatgtagccttatctaccgtttttactttctgcaaagtcatatgtttttagctgtgattgcagtcactaccaagtagctcaccttgtctt

SEQ ID NO: 132045 - DNA, 604 bp, Homo sapiens
actgaaatcctaaataataagaatagaataccagaatactcatccagaataccagaaaagtgttatacattctaaatctacattttaaaaaatgctttctacattcaatatattattagcagaggaatatatccaaaaagatatatttgccattttaaaacatacttatatcttgacaaagacattttataatcactccagcttttaataacttgttcctgttgtttcattcgtaaagaaatttgtttttgttattgtatatccaaaggccagagctcctttgggaaaggaagttgaatgagctgaaagcaaacacgatcatgaaatagagtttaagtgtaaacaccattttattttggcagtacataactcagaaatgtatgtaaaacagtcatcaacctataggaatctgtatgtatggctaatagggaaactgtgcattaatcctgtatttgttccacttgtactgtttgctctactaatttttctaatctttatagaaataggttccttctagttctgaacctgcttctgccctaagttaaccatagcttattatttctactatctttttgtgctactaaatcaatgctcacactgttgg

SEQ ID NO: 132046 - DNA, 742 bp, Homo sapiens
gttattcattcaatatctgtatcagcagagactgtttctcccagcagcacatgtagtttgatcctcatctaggttaagtaggcccttgaagacgctggcccatcagcactggtacctggaccctcccatttgactgcacccatgtctgtttacactggggctgtgccttggtcctgtcacccgtgaggtgtccttaaggctggaatgccaaataggctccaggtgatgggctaactctgagtaaatacaagaggctgcttggagcccagagatgagggttatgaggcagactgtgtctgggttccattacaaagaaaccgtgattgattataaatacctgccctggcaatacacattagaagtgtctggaagtggggttttgggggaatgagctcagaaagggacaaggtgtatgttccattcctgccttgggtggtggttctgctacctaggctatgttgtctcactgctcacgccttaatcccagcactttgggaggctaaggcaggccaatcacttgaggccaggagtttgagaccagcctgatcaacatggtgaaaccctgtctctactaaaaatacaaagattagccaggtgaggtggcacatgcctgtaatcgcagctactgaggaggctgaggcaggagaatagcttgaacctgggagacgaaggttgcagtgagctgaggtcactccactgcattccagcctggacgacagagtgagactccatctcaaaaaaa

SEQ ID NO: 132047 - DNA, 430 bp, Homo sapiens
ggtgtgaaggggttgggagagagtggggtaatggggatgagaagcaagaaattgaaaggtttggttagggttagattctgaagagtctcaaatatgctgagaaatggattctgtagtcaacaaggggtcagaaagtcctgttctgaagagacaggcctatgtgatcgggattgtagtagtaacaaatgaccctgtagactcactgcataaagaatacacgggggaggagagactatcaacctagaaataaaatctgtaaagacattttttcagatctgggtaaatgatagcatgtgcctaaaatgcagtcgaaaaaggaagaatggagaaaagagagcaaattcagacacaacaaaaaaaatattcattgtacaaacaagagcttgcagttgcaaaatatttttctatacctgtgggatactataccatt

SEQ ID NO: 132048 - DNA, 343 bp, Homo sapiens
tatatgtttctactctattgcttttatatttttattttataagaaacacacatttttattttataagaaacaaggtcttgctattaatatgttaccaagaccagaatgcagtagttattcacaggtgtgatcattgtgcagatagccttgaactcctggcctcaccctatcctcccacttgagcctcctaaatagctggaactacaggtgcatgcagctgggcctggcttagtttactgcttttttaaaaataatttacaaataataattgtacatattcatggaatacattatgatttttttttttttttgagacggagtctcactctgtcgccaggttgga

SEQ ID NO: 132049 - DNA, 317 bp, Homo sapiens
aagtgctgggtttacaggtgtgagccactgtgcctggccagaaattcttttttactctatattcgttccctggagggatcttctctagttccatggttttaaatattgtctatatgctaccaattcctagatttatatcagggccatccacttataccctgtatcctcctcctgatcttcctgctaaactgctgatgtccggctgcctacttaatgtcttcacttggatgtccaatagacatcttaaacttaacatgtttaaaatggaattcctgatctccatcccaccctcaaacctgttcttcctgcaactctta

SEQ ID NO: 132050 - DNA, 665 bp, Homo sapiens
gtgtggggacttctttggagaaatgtggtaacttctatgatgactgctttgatcttttttaactgaggaaattgttaatatagtaaattgaattatcccttaaacttggtaacctagttttctcttagtacttaggtaaattcagttgcacatcagtgtcagtggaaactttgatgtttgtgtgttattaccaagatatttagagttattatgaagaattcgagaacatcagaaacttctaggtaatgcttatatcacaaggaagaaagccaccgtttttctggccaaaggttgtatttctaacattataaataaggtccgtaggttatggggcctatattgcctcacctcaggaagaaagcagatcttgttaaatgatctaatagattaatcaagagtaccttttctgttcaagaacagccagagagaataagtttctgaactatgtttcaagttccagagaacactttttttcttccctttctctatgggtctttctgcattggccatgttttagtcatctttttccagttttccctccctttggtgatgacatccccttacatacactattcatacagctctcttccttctcccacactgaacagtggggtcatcagaagttattacatgccaggcctgttcagctcagaaaaggtgctatt

SEQ ID NO: 132051 - DNA, 201 bp, Homo sapiens
cagggatgctaacgatcccctcactttccttcctgccaggtgaggtctgcctgttccacccatggtacccttcaccacccatggtacccttcaccttgaggaacccctgaacatgccctccagggggttcaggaggatctgagagaccaccttcagggcaggtgcacagccatctagcagacacacacactcactgactac

SEQ ID NO: 132052 - DNA, 527 bp, Homo sapiens
accgtggacgcgctgggtgtgctgaccggggcgcagcttttctcgctgcagagggaggagctgcgggcggtgagccccgaggagggggcacgtgtgtacagccaggtcaccgtgcagcgctcgctgctggaggacaaagagaaagtgtcagagctggaggcagtgatggagaagcaaaagaagaaggtggaaggcgaggtggaaatggaggtcatttgacctgccaggcgcccttcgcaaagagtgacgaggccccgtgggagaacggactcctcagactctccccaatagcggaagtcgatcttctgaaggatggccaatctgctccggccctggtcttcccccatcccggtggacagacttaacgatccttgctgcagatcctccggagaggatctggactggctgggagtggggagggcgtggagacagtctacggaaagcgctagcagacccccgagagggtgcagtggagccctgagcattgtaatatgcgcccagcctataaacagcctccgtgcttagca

SEQ ID NO: 132053 - DNA, 264 bp, Homo sapiens
catcactttctatctggaatttgatctgcttttccaccatcacttacagggattgtttcctttagatataagtggttttctccctttcagatatgtttctatttttttttggcaatcatgaactacattattaataagaaaaaacttttctttttttaaagactcaactacttttccaatgcagcatactggcttgagtcggaaaccttgggatcaaagcacatctctaacaataaaaagttggggccaggcacagtggctcac

SEQ ID NO: 132054 - DNA, 201 bp, Homo sapiens
atgataaatactgaaaagaagatctgacatttctgttaatttagcagcaaacatgctggaaatattagaactaatgctgagaaaataaaagagcagtattaaaataggaggacttttatttttaaaatgaaaaacttctgacaacctggctctaaaattgcaaacattcaaatgcattcctaagctgtgctgtcatctgtg

SEQ ID NO: 132055 - DNA, 793 bp, Homo sapiens
tatatatatagatagataatctaaacagaagaatacagataatgacaagtgatggtgaggtatgaagtgaatggaactttcatacttggctggtgggaatgtaagtagtaccacattttgaaaaagagtttggcagtttctaataaagttaagtatatgtaattgctcaatgggttcttccagcccattacacagacaaaatcaatttgctgagaccatgccattgcagtaaataaaaagtttaattaacaccaggccagccatgcaggataactcaagttatcactcaatcagtctcctagaaggctcagaggttacggtttttcaaggacggttcggtgggccagggtctaaggaatgggtgctgctgcctggctggggataaaatcatacgggtgtggaaaacagttcttgtgcactgagtccacctctttggggggggcatgggaccattgagtcacaagcctcaagtctaggtagcatcactagttatcagaaatgcagaagtctgggggaaaaaaatctcaaaaggccaatcttgggttctacaataagaatgtcatctacaggagtaattggagaagtcacacttcttgtgacttctggaacaatggctagtattggttaactacacctgcatcttagtagaattcagcccctctcaaaatcctaagcttgtggcctttcattagtttttacaaaggtgtcttagttttggggaagagctattatcatccttgctttaaggttaaactataaactaaatttctcccaaagttagcttggcctatgc

SEQ ID NO: 132056 - DNA, 432 bp, Homo sapiens
tactatacaacgcagcaactgcactcttgggcatttatcccagaaaaatgaaaacttatattcacacaaaaacctgcacacaagtgttcatggcagctttataaataacagccaaaaactggcaacaatccaggtgtcctttaatgggtgaacagttaaacaaacctggatgaaactccagaaaatcatgctgagaaaaaaaaaaaagacaatcccaaaaggttacattctgtacaactgcatttatacaacattcttgaaatgccaaagttacagaaatggagaacacatcggtgggtgccaggggcttgtggcaggggagcaggggaagatagatgtggctacaaaaggccaacaagagggacccttgtgctgatgaacctgccctgcgtcctgatggcactgatgtctatatcctggttgtggtgtgtg

SEQ ID NO: 132057 - DNA, 217 bp, Homo sapiens
gaaatgaaaatacatgcccacaaaaaaaaaacttgtagaagaatgttcacagtaactttattcacaatagccaagaactgtaaattaaccataccagatactaaggcttgttataaaactacaggctataaaaagcatgttattggcaaaaaacaaacaaaaagcccaacaaaatagaagatttaacagaaacagactcacatatattcagtgactt

SEQ ID NO: 132058 - DNA, 335 bp, Homo sapiens
ttgccatagctgactcctgaggaaaaaactacttcagcgaaagcggtattctttaccgagggtggttcctggcagaaaactggaggctgtaaactcaaatgtttctttctagatagggctggaaacttgaatctctggaatatgcaaaatgcccccttcaccaccaagaaaggaccatcctggtccctgatccccgggggcacaacactgctgtgtgacaggggcatgacagctcccatgaaggagtccagaaccgagacctgtggagagaacatgagatgcccaaggtcacgaggtgagaggctcaaggtcacagagtccatcataagactcag

SEQ ID NO: 132059 - DNA, 305 bp, Homo sapiens
aacgacgtcagggagaagcgaagtcatgcccatggctgttgcccgagccaaaaaacctgtaaactcaaatgtttctttctagatagggctggaaacttgaatctctggaatatgcaaaatgcccccttcaccaccaagaaaggaccatcctggtccctgatccccgggggcacaacactgctgtgtgacaggggcatgacagctcccatgaaggagtccagaaccgagacctgtggagagaacatgagatgcccaaggtcacgaggtgagaggctcaaggtcacagagtccatcataagactcag

SEQ ID NO: 132060 - DNA, 278 bp, Homo sapiens
aagagagacagaggctgagaagcgccaacctgtaaactcaaatgtttctttctagatagggctggaaacttgaatctctggaatatgcaaaatgcccccttcaccaccaagaaaggaccatcctggtccctgatccccgggggcacaacactgctgtgtgacaggggcatgacagctcccatgaaggagtccagaaccgagacctgtggagagaacatgagatgcccaaggtcacgaggtgagaggctcaaggtcacagagtccatcataagactcag

SEQ ID NO: 132061 - DNA, 213 bp, Homo sapiens
attactgaggagccaattgtgctctgcttaacgcatccaaagcaaggcagctattagtggtgtccccacttcggtgtttatgctagaatacaggaggacagcctggttttctcatacgatttgatctacgacatgatgagcctatggccgatgttgtgttctgaacacaggtgtggcttgcccacccagaggcgagtaggatgtttagtttta

SEQ ID NO: 132062 - DNA, 373 bp, Homo sapiens
ggacatttggtataattcttttttattgaacattgattcatgacctagacactcacccgattatcagtatatgcctctgattagtttctgggttttaacaccaaaaaaagtacatggttataataaggtgttaggttactgaaactgcaaaccagcagttttgtatttcttctataaaaggtagccataccacctagaaacaaaagtggataccggccaagtgttcaaatagatatgatctaattctgggcccaggcattcctatctcagctcaaagcctgggcacacattaggagctccataatgtgtgcccatccaatctaagccctaaccccacttagtgacctcagtgtcttcttccattccttcttac

SEQ ID NO: 132063 - DNA, 370 bp, Homo sapiens
gtattccacagagaattctgatggtggctgtatttgccaaaaagtccccacaaacccaacaagccttgcaatgatcatcagctatgtgaagttatcccacaagggaattctagtacagtacgttctctaaaaaaaaaaaaacaaaaccaaaccaagtaggaaaactgtgaaaccaaaggttagttaagccattgatatgattccaggcactcagtcattcctctttccagaaaagtattacctattgtatcaaaaggacttttgagccctctctgaagtgtcatagctaagttataaaatctctcccttcttaaaaatattactgatcactacaaggaaaaggtgcaaagcatgaaatatttctgaccct

SEQ ID NO: 132064 - DNA, 277 bp, Homo sapiens
tcacttgaagtcccagcgactcaggaggctgaggttgaacccaggaggcggtggttacagtgagccgagatggcaccactgcaatccagcctgggcaacagagactcggtctcaaaaaaaataataataaataataaatgaagctgaggtgtcataggatctaaattatgcttttaaaatattgttctggatggagaatggactggagaagaacagagtcaggagaccaccaaggtcactattgtgatttatattgtcggttacttaggttctgtcg

SEQ ID NO: 132065 - DNA, 260 bp, Homo sapiens
tcggtacccgaactgcagtgttcccaagtagctgggactacaggcatgtgcaccatgcctggctaatttttgtatttttttgttgagacgaggtttcaccatgttgcccaggctggtctcaaactcctcttgagctcaaacagtccactcgcctcatcagcctcccaaagtgctagtacaggtgcaagccattgtgcccagcctcagacactgtcttaaacagcttgtttatattaacacacttcatcatgaaacagatg

SEQ ID NO: 132066 - DNA, 143 bp, Homo sapiens
agaattatgtggcagaatgaaaaatcaagtcagtagatgcagaggcgaagtcatcaatggtaaaccaggagattaaagaaggaaatgatagggaggcaaattgaggtcagtacaaaagaactaaccactaaaagaatgggatg

SEQ ID NO: 132067 - DNA, 462 bp, Homo sapiens
ggttgagtgtttgttgccctggtacatttcttttccccagctcccacttgctcatccaggccacagaaagtagaacaccaacctctggggcctcaacaaagcccagaataattttcttacccagattcttcttcctgtgtgtacctgggtggattctgaggggtccccagcttcccagggctggcacatgttgtcctaggaactgccaagggcatcctccatagtcccatgcacctgtcccttccagccgtgtcctccccaccccacctggaaagcagagatgacattgacagcgccaaggagtgcaagttcaaggtggccctagtctcacagtcaggactgccctgcttcttgaagcctccagcctgcctgcttcccctccaggagccccatttcctgctctctgcagctccagggctgccagacgcctcagatggaaaacaagcccagccccatttcctc

SEQ ID NO: 132068 - DNA, 164 bp, Homo sapiens
tgcttttttgtgtgatattaacagtacacagtctctcagcctggacttcacttcagttttttttctaattctctgagttttgttctcatttgtaaaatggggatgatagtattgagtgtgtgttaaagggcagtgtttggactttgggcactgtttggactttg

SEQ ID NO: 132069 - DNA, 924 bp, Homo sapiens
atttgtgtgaacaggtactcacactgtctgtggctgtccataagctgaaataattcagcccagtgagtttggtggtttctcatctgattctgtccaagcgaaacaaagccagacactaaagtgacggagttttgctcttgtcacccaggctggagtgcaatggcacaatctcggctaactgcaacctccacctcccaggctcaagtgattctcctgcctcagcctcctgagtagctgggattacagacatacagagggaaggctcaggggaaagacagccctctacaagccaaggagagagggatctgaagaaactaaacctgacagcaccttgatattggatttctagcctccagaactgtgagaaaataaatttctgttgcttaagccacaaaaaaaaaaaaaaaaaaaaaaaacaaaacaaaaaaaacaaaacaacaaaacaaaaaaaaagagagggcgggggcggcggcggcgccataaagaaattatctccccgccgagagggggccacaagaagtttatagggcggcgacccccgcgtctttttgtgggaaaaaggggggcgcccaaataagagaggggcgctcttatattatatagcgaagcaggagcgagaggagggcggcaggatttaaaacaagcggtgtcggtgtgacggggcgagaagcaggtggtgtgagtcggggacatttcttggggggggaggaggacccccatctaggttgtgtgggggggggggagaatataatgcggggcgaaacactcatcacaaaaggaggaaattagataggctaggaaggaacaataatcaacattagcaggagtgtatagatgggtgtaatcacaaggggaattagtgttggtgtgtaagaaaatttggttcacggagtatagttgataatattttcgacgaggagaaat

SEQ ID NO: 132070 - DNA, 218 bp, Homo sapiens
agcctgttttgtgtctcactgttccctaaagtcaggaaaatcttagactcttgccctgaaaggtatcactaatagcaacagcctgtaggattgttttatcctaaagaaagtaagtcgaatgccccttatgaagatcagacaaaaagcaataaggctacatcgtgacataaatccaaataaatacaacggcagctaaaaatcttttttttttttttttt

SEQ ID NO: 132071 - DNA, 225 bp, Homo sapiens
agggcacccacacttccgaccaacagtctatagattctgaggtcctactattttctcagactttataattgactaaggttttataaatgactagtagatctcaagaaagtgctatacttactagttttttttataaaggatacaaatgaacagatgcatagagcaaaatctgggcaggtcccacacaaatcttccctgtcctcaggatgcattacctgcacatta

SEQ ID NO: 132072 - DNA, 351 bp, Homo sapiens
taaaaataattaatatgataatatacaaatcagggctgctgcaatggaatgtgaagaaaatagaaaatgtttgctaaatccatcatctcccatgatatgtatacgtgcccatgaacatatacacatacacactcacatacaaacttttcctagatacacacacagaacctttactcaaagcattttgttcctagttacggaataaagatattgaaaaatgcattttcattaatgtgataaagcataataaattactcctgccagatgtgatgtgacatgtacatattttcttaaaagagctgtagaaatgggcaaagatcacacacacacacacacacacacacacacaca

SEQ ID NO: 132073 - DNA, 446 bp, Homo sapiens
acatgagcgaagacaaaagacagggaaaaaaagagtgaacatcacatgggcatagcacttacatctgaggatttcaagaagactgaaacattcattgttttctttgatatcatatataattatatgtgataattatcagctgttatatttttaaccttgtaagtgaatcactatttttatctgactgttgctctatctataactgttatatattttaccagttaatgtaattatatcttccctcctatatgagaaaagcaagagaatgcgataagactataatagaagacattgtaatttacgtgtcaaaaagacaaacctaggggaagactaagtccccagcaaacgatagaaatgattctttcatttggcaattcttatagaaaaactctgcaaagtaattgttaatggcgtgaccttgaaataatcctctttatttaaactat

SEQ ID NO: 132074 - DNA, 178 bp, Homo sapiens
tgtgcttccatgcctgctgaggcagttttaaaatgcgtcgacgaattccttgacactccttctaggtagaagagagaacttgtcctcccttcttgaacctgttttctgttttgttttgtttgttttgttttgtttttttcgagacggagtttcactcttgttgcccaggctggagtgc

SEQ ID NO: 132075 - DNA, 139 bp, Homo sapiens
ttcccagcctctcccctttggttcataacaacagctgctggtgattgagctatggccaggattggggctcgatgctttatcttcctcatgatatgcagtctcaccacaatcctatgaggtaggtgccggcattatcccc

SEQ ID NO: 132076 - DNA, 303 bp, Homo sapiens
atcggggcctgtaagatccctcaactgtccctgtccatccttcacaatcttgtgttccctcccacccttgccacactgcactttttctcttcctcacatgtcccaaattcattcccatcttcaggcccttaaggcatctataccttctctgaactgctctccccacagttgtgaaacggcggttcctcctccacactcaggtttcactcagacactacctgctcagagaagctttttccacccctctaaagcagcattcaccccacagctctctgttctattttctctgcaatgctcattact

SEQ ID NO: 132077 - DNA, 151 bp, Homo sapiens
aggttgggagagaagaggcaggtatgtgtgtgactcatcagaagttcaatgtggggtgtgctgaggtccacaggaactgtccagccctttaacttattgctcatatttgcatccctagcaattagggtaggacctggcatgcaaaagtgac

SEQ ID NO: 132078 - DNA, 411 bp, Homo sapiens
ctcccatcttaccctctctgaacgctgccagacaaatacctcttggcaaggaggaagacacaggcccctcccaagccccctctaaatctggttctcaggagatgggagccctagggagatgtcccactgcattgactttagatgagcaataactcagtcagtctggaatcagcatcaccaagggttacatgatagtcttgaaggagtgttgctcagaatttcaggcgactggtctggaggagagaagggggcaagtgcttaccttgaacccgtgcaggtggacagatgtgtggtggaggcatttgagggttacctcagaccacatgctgacccacgcagggccaaagtcgctcattgtgtggaggcattttgcggtggaaacacacctggatgcagagaggggcggagcag

SEQ ID NO: 132079 - DNA, 874 bp, Homo sapiens
tgtgtacgtcatctcaattgccttgtgctccgacaacacaatttctgttcgccctaatatttgttcccacaccaccaaatattgtggtaaaacacccaaaataaacccaccatgtttaaatgcacacgaaccagggttaacacaactgttttttgaacacgtaccaaatgttggccgtcatttgtgtgatccctcttccaaaatatgttcccccgggcccaattgaaccactacccttgcccgtgacacaaatttccactcctttcccagtgttggacttaaacaattttcgaattgtatttcttagtgtttcaaaggaaaaaagttaattattttcgatttcacaccgcaaggggtactttcccctccccaacctaacccccccccccttttttttttttttttttgagatggagtctcactctgttgcccaggctaacaaatgtctatcaggtacccaacacaaaaactaaaatcttctcaggaaacccttagacctcaaattattcctagaaatagcttttccaacacaaagaccagtgtgttgtaaagataaccggcacacaggagggtaggcaacaagggggaccgggagaagcaaaaggcctgaaatccaaggagtcttattcagactacaaaatagctgtgcttatagaaaaagacagaagaattatctgcaacaggaggagagaaaagatggaaaatacagaaaaggtaaaactcatcaccgtaacattaatatttataaaactcttttgtaaaactcttgaaatagtggctggcacaagagaagtgtatataagtgtggtattatatacatgtgtgtgtctctgtgtgtgttcgtttttgtccatagttcgtggctcctaactcc

SEQ ID NO: 132080 - DNA, 339 bp, Homo sapiens
tttaagatgcctgatcgatacttctggagagccactaccctctagtgaattcattcactcccttggttttattgccatctatatggtactaatttccaaaactgtatctagagcccagcactttttctgaagtacagattcatataattatctgcctacatggtatctccttaaactcaactcatttaagttggaggatttgctgggtatgtgatcaaaggacaaaagggcactctgtgaattcaatgaagggtagttaagaccatagcatcaaagctagatggagaaagaaatgaagataggggcctattacacatgataaacagtgtcagcatgctt

SEQ ID NO: 132081 - DNA, 209 bp, Homo sapiens
ttaggacaaacccccacaacctcctttgctgactcaaacacattgttccctatgccttaagaacctcccctccctctggctgcttaccacacttaggacaaacccccacaacctcctttgctgactcaaacacattgttccctatgccttaagaacctcccctcccttggccgggtgcgctggctcacgcctgtaattccagcaccttg

SEQ ID NO: 132082 - DNA, 268 bp, Homo sapiens
atattatcctgagcactcaaagaggatgatttgttttctcagcttatagtacagtgccttacatctggaaaatgcttggtcaatgtcttattatagaggaaacatcattcttattactacacatggtcttagaatttgtaataggccactaattctatatcgatagagaaaatcaactagaattctacatacagatgccatgaaccttcatcttcacttctcagttataaaacaggtatatatccacatttttacaaaatgggatcgt

SEQ ID NO: 132083 - DNA, 204 bp, Homo sapiens
gtatagggtagtgtgtatagtaatgttggccccattttacatattcctcttatatcaacactgacttctatcttaatttataagagcatccatgtattagtcatgaagcatgggttgtttacgtttcattttggattttgtgcaacatggtgatatagttggaaaaattggggtttgcataccaggcagcattttaattcctgt

SEQ ID NO: 132084 - DNA, 606 bp, Homo sapiens
gctacttttccacaggcaaggagttttacctttgccacatcttgagactgactgacctggcagtttgggcatctgccctggtggttagcaatgaactacagagaagccactagcatcatattactgtggctacaagtttgctctgggaactaaacatttttaataaagtgtcctgaaacctatttgctgacctccactgcatttagggaattgggtgtgtcttgccagagaaagaccaatagcctgggttaggccctttggatctgggtcctcaggaaccagcaaaacccatattaatctaaggtagtctgaaatggaatgatataagtggacattcccaagtctcttccagtcaactgactccttaagagttgaaggccttggtagatgcaccttcttgcaatcccttgaaagaccctgctgtatactcacatgtcacctcttttaacaactctagcttgccctccaccaacagttttattcacagcagctcaaaaaccctctcagtattcttacagctgtgcttagaaatatcagctgaataaacactagagatgacaggctatcttttgaaattaagcttatgaaggatggaaattttcacaa

SEQ ID NO: 132085 - DNA, 1063 bp, Homo sapiens
ggggtttacactgcggtgagcatgggaaaagcacattaggggaaactatccttgcagtggatggggattatctttccctcccatttcactaatggagaaagtcaaatgtttggcacaggaacataaaacactgtaagcagggaccaggtcctgagttttcccagtggcaacttcggtgctctgtttttcagaggaagctatctgggaatttccgtttcctagcatgcattataacatgttatttttaatagctaggtctctgatcagttattgtgactgatctcagtcttcttgcatgaagatgatgcctctgatttatgatattttctagaattctgagtcagtatgagttagtgtcacttcttccataacaaggtgggaatgcacccatacatttggtccttgtgttgctagcagatatgaattaagcagtagtttagcttaccttggaaccagctgttccttgcagatgcactgatattaagggtacacatgtctattataaggctggtaaattagagtttgctttatcagaagcttatcaaaggtctgctgtgtgcaaagcactatgctgcattcttttagagctattagataaatagcaatactctatctttaaggagcttacagtctattggacactatgggcaaaaacactaatgttagagttgcaagatgatgtggaagtacaaaggaggtagagatgaattatgagtggacagtatgggaaagccttcctgaatgagacagcaggtatttcaactgggtgttaaagtttgaaggggcgctgggtaggttggcttatgcctattatcccagcacttggggaggctaagactggaggatcacttgagcccaggaatttgagaccagcctgggcaacaaagtgagactccatctctacaaaaacttcaaaagattagtcgggaatagtggcacatgcctgtagactcagctacatgggaggttgaagtgggagaatcacttgagcccaggaggtcgaggctcctgtgagctgtgattgcatggcactctaacctgggcagagccagagcttgtctca

SEQ ID NO: 132086 - DNA, 566 bp, Homo sapiens
gtgctttgtatcaatcagcttttcataatgctaaagcagtggctttgattagtcagctagtacacaaccagttccctaatgtctatcctaaagtgctttttttttcatactgaagagttctttgaccggacatagtggctcacacctgtattcccaacactttggggagccaaggccataggatcacttgaacatggaaggttgaggctgtagtaagctgtgattgcaccactgcacccaagcctgggagacagagcaggactctgactcaaaaaatagtaataataagttattgctttatactgttttaaaatgctcttttcttatccttgtgacaagctgatttcttcagctgcgttattacctaagcatttgcttgatatttccataaataagcatttgttaagattaatagattaatcaggaattttcctttgaagaaagttttaatttgcctcacaacaaaaggctcactttgaactccatcgtaacaaagttcagtgtttcctcactttttccaaagactaaatcatgattgataaaaatagtaacaatatataagaaaa

SEQ ID NO: 132087 - DNA, 346 bp, Homo sapiens
ttcttaagtttcagtaagtgttcacacaaacaaaatgtgtcttggattcttggtaggctagcagaatctgtgtcagggagaaaaggtagaaataaaatatatgagtacttttaggtattaaaaaactgtgcatttttaacattgtctccttcatacattgaacaaatatgcactgagtgcctacaaagtgggagacattctactaagctctgcagataaaacagataagacctctactctcatttagccttaagtgaagtgaggaacaaacacaacaaaaatgacaattataaattcagatatatggtgtaagaaaacagagttctatgatcacacagaagaattt

SEQ ID NO: 132088 - DNA, 555 bp, Homo sapiens
tcaatattaagcagttgggcagagttttcatacatatatttgtctctgccttttgcacaatataaaactatgaaatctcttttcatttttctattgtgcacgctaccacattaggtaggaatcaaaatcatctcaacttcagaagtataattcataacaattataacaaagcagaaaaatgattctacattagcagaagaaatgtagtaggaatagatttaaaatagcatggttgagtacaaaagaaacatcgttttttaaaaaatggcagcctttatcactcatcagctaaacttaaagtcaatgctgtgaggctgttgcgggaaaaaatagtcatgattcttgggtgtattaaaaggagtatggcatagaagggtaagaaaacaagacgtagtgtgtttgtcagactcatcattgtgtcctgtttgagtcacacttaaaaaaagaatttggacaattgtgaaaagctgatacacaagcaacagaaattacacgcccttccaggaaaagataaggcaactgaggattttattccacacaaggctggaggatttt

SEQ ID NO: 132089 - DNA, 480 bp, Homo sapiens
agtgcactgattcgaggtgattagaggatcccggttaaggctcgagtcgtcatactggctcgttggtgttactgctgtgagaccagcctacgaagaaggtgcctacttctcccttgccttctgccatgattgttaagtttcctgaagcctccccagcaatgcagaactgtgagtcaattaaaattttttattttataaattacccagtcttgggtatttcttcgtagtagtgtgagaatggactaatgcagaaggtaaggaagatacatttgaaataatgaataatacaagttaggaggaaaaagtgctctttaattatccttattaaaaaataatattttctactgttaagcaatatttgtgaaattattaaattaaaaaatcagcaggcttcccagacaactgaggttttctcacttttgatagagaagaaaagtgacggcttaatcattgagagtacagacatagatcataccctgg

SEQ ID NO: 132090 - DNA, 215 bp, Homo sapiens
ttttgtttgtgcagtccaatatggcaggcactaaccacatgcgggtactaggcacttaaattgtggttagtgcaggcaaggaactgaatttttcgttttattgaagtttaatgaacttagctttaaatttaagcggtcacatatggctagtgttgaatgtatttgacagtgcagctctagatccctgttactccaatgatgctgtgggccagcag

SEQ ID NO: 132091 - DNA, 160 bp, Homo sapiens
gtgagtggcactgtttgaagaaaaaaaagttaagaagtgactgaataagagatttctctgtcagtgtctgagtggggtttaattccttggtgagagctattgcttagaaagcccctgtagttttatgagtctgctccctgtggatgcttctctctctcca

SEQ ID NO: 132092 - DNA, 121 bp, Homo sapiens
cacaggggagatgcaaactgacctgactcaattttgaatatgtatcctggatctgatcctttcttactacctctctctcactatgttgtttaattcagtatcttccttccctgcattattt

SEQ ID NO: 132093 - DNA, 542 bp, Homo sapiens
gctgggagactagttctggccagtaaaaagtgaaccactactgggctggagcagtgaatagctcatacatgatctttgggtttcttttgttctctgctgccatcagagtggcaacaggttccaaatatggtggctgcaagatagtgtagccatgatcattcccagaccttgagtaaatgcatggagcacagccctctgagaaactgtgctggaaacatggcataaatgggaaataaaacttgtttttgttttaagacattacgaattgggagttgttgctgccacatcgcctatctatcctattacaggaacatgctcagaatacagaaacctctgcattcccttgataactgccactagctataactctgattttcttaggatccagtgtctcagtactaaatcatttattattaattattatcaagtattgtatggcatgatagtggcaatactaataaatgttcacatttttaaattcatgtgctagtcaaggcacattaaatgtttatttcataatttattcctcataaactttatga

SEQ ID NO: 132094 - DNA, 898 bp, Homo sapiens
tgtatagatgatctccttgggcaattgtgttaatttctcttgggtatatacctgggagtaaaattaagataagggcattttcagctttaccagaccccgttaagttactctcaagtggttttatcaatttatattctagaaccaacattatgtatcagtaacatttggtaacttcaggcgttttttttccattctgctgagtgtgaaaaatgtgttttgattatggttgtcatttgttagaatactttgttaaagctttttaaagattcttggtccctctaccctccccaccccctaccccaggaattttgattgggtaggacctggggattatattcatctttatatgcagaattatattacttgttactgttaggcctgatttaagaagtaaaataaggctgggtgcagtggctcatgcctgtaatcccagcactttgggaagccaaagtgggcacatcacttgagcccaggagtttgagaccagcctgggcaatgtggctaaaaccccttctctaccaaaaatacaaaaattagctgggcgtggtagcacgtgccagtggtctcagctactggggaagctgaggcgggaggattgcctgagcctggcaagtgtaggcagcagtgagctgagattgtgccactgtagtacatcctgggtgacagagcaacacactgtctcaaaaaattttttttagtaaatagttcttatcccatgtgggcatggcacagttatgaagtacctacaccaagtatttacttcttcgttttctttttttcacaatggccgctaacgaattatgggcccctaagggccatcggtcccgggcacactggtggttccaaaaaaaattggcgccaaaaggggcgaaaatacgtgaggcacacggaagtttcc

SEQ ID NO: 132095 - DNA, 122 bp, Homo sapiens
tgctgggattatagaagtgagccaccacacctggcctgtttgtttgttgtttgtgttttttgtttgtttttgttttttgagacggagtcccactcggttgcccaggctggagtgcagtggtg

SEQ ID NO: 132096 - DNA, 393 bp, Homo sapiens
tcaagctccccactcccacattttgaatttttgatgtcacaatttgtatcattttaaattgcatattccttaacgaattattgtagctgttatttttaatagttttgtcttttaaccttcataataatttgtataccacaattattctaaatttagtacttttaccagtcagttttatactttcagatgtttttgtgttactcattagcatcattttcctttagcttgaggaactcctctttagcatttcttgtaagacaggtctggtgatgatgaactccctcagctcttatttgtctggaagtctttatttctgcttcatttctgaagaacatatttgctgggtatattattttggttgacaatacttttccttcagtactttgaatatat

SEQ ID NO: 132097 - DNA, 510 bp, Homo sapiens
tcatctctacccgccccagaaaaaaaaaaaattgctggacctcctgattgggtgatggaacatggggtgtttccttggctgtttgtatgcagcatggggggcaggtaccaaatgaagcctttttaaattctgggacctgtttctgtagagaataatttttcatctcctgcctcaaaacactgcacaggctgagtgactggtacagcgtggcagagatctgagaggacctctcgcccttcgtattcaggcttagtctttggattttctccaagttgtcccattactgccctcagctggaccgtgttctgaggatagagctgtctcagcctctgttgaaacttgtaatgcagtggctccacgtggagacttttaaccagcttctgcgtctgcaccctcacccacagccaccagagctgcctggcatgtgcagtgctgatttttcctagggctctgactcccacccccacccccaaccatccgccactcggtgaccatggagcggtgggcatg

SEQ ID NO: 132098 - DNA, 231 bp, Homo sapiens
gccacttcagcccctgattgactgctggtcgggtctcggtttcagccaatccttcacggtgtagccaattggaggcctctacagggcatcaaggggtgttgctaggttcctttagcttaataaaaaccgtaattgagaaggctcttgagctgcttgcaggagcccactcctactctgcgaattgtctttaataaacctgtgctttcgctctttccttgctccgttcttttg

SEQ ID NO: 132099 - DNA, 749 bp, Homo sapiens
atgatagttatatttttcttcatttattccttttgcaacactcttcctttaattatgtacacccaattttctgacctatatcataaccctctttctgaagaatttcctttaatatttagactgtaagacagtctgctgatgttgagtttcctcagtttttgtttgtctgaaaaagtattttatcttaatttttgaaggatatttttgcagaacttggaattctggattggcatttttttcttacaatactttaaaggtttcatttcactgtctttttgcttatgtggtttctgacaagaagtctggtataattcttctctttgttcttctgtgggtaagatgttccccacctaccgccttcttcctggcaatcttcaagattttatttctgtcttgattttctgcaatttgaatttgatattgtctgggtgtggtttttggtttggttttggtatttaccctggttggtgttctctgagcttcttgaatctgtggtttggtgtcagtcattaatttggaaaattttggccattatgtcttcaaatatttcttctgccttattctttcttccccttcttgtgttctaaatacgtatatgttatactgtttgatattgtcccacagttcttggatgttttgttctggtttctttttttgctctttttttctctttgcatttcagtttgtgtgatctctattgacctatcttcaagttcactgatgcctcagctgtgcggagtctactgatg

SEQ ID NO: 132100 - DNA, 380 bp, Homo sapiens
agctagttttttgtagagatagtgttttgcagtttcaccctgttgcccaggctggtcttgagctcctggacccaagcagtcctcctgcctcggcctcccaaagtgctgaaattacaggcgtgggccactgtgcctggccagagacacccattttgcaggtgagcaaaccaaggtactgagaggtctagcagcttgcttccttacacacagcccatctgtggctgagctggaagtctgactcagccatttggctgtaacatttgtgcatgtaaccactaatctgtgccatctctcatggagtggtcgagagagcctctacagacaaacgaccccacttcgagtcctagctcagctcctttctggctgtgtgaaagtttctt

SEQ ID NO: 132101 - DNA, 213 bp, Homo sapiens
ccagccttgctgtgatgggatacattggtttgactttaggatatgttgttaaagtcatcaattatccctgttggaaaacctaaggttcatgtatcaagtttccatgaaaaaagaattgaagagtaaaaagcaataaaaggggtaaaagcattgtgggcttactttcctcatggtggtcattttgttggaatcataagccttattgcaaaatgg

SEQ ID NO: 132102 - DNA, 178 bp, Homo sapiens
cacacctgtgacgccctcctgtgagcttaccggccttcgatcacacgccatcgcacacgccccacacctgtgacgccctcctgtgagcttaccggccttcgatcacacgccatcgcacacgccccacacctgtgacgccctcctgtgagcttaccggccttcgatcacacgccatcgc

SEQ ID NO: 132103 - DNA, 399 bp, Homo sapiens
agctgggaccacaggcgcccactaccacacccggctaatttttttttttgtatttttagtagagacagggtttcaccgtgttagccctaccgtgttagtttttctactgctattgatatctggtttcacttcattgtgatcagaaaagatacttggtatgatttaagccttcttaaattttttaagacttgttttgaggcctaacacatgatctaacctggagaatattccatgtatatgtgagaagaatgtgcattcttctgctgtttggtggagtgttctgtatgtgcctattaggttcagttggggtataatgctgtttaagtcctcctattccttgttgattgtctatctggtttttctactcattattaaagtagggtattgaaatttcctgct

SEQ ID NO: 132104 - DNA, 370 bp, Homo sapiens
cctgtaaggatgtagaaggtatgggatgaccccttgctgggctgtccaactcagctgtgcagccaggctgctctgagctgcagggcacatgcagcctcctcatcaggtcacctgcattcctagaattctccaagttccagacacacggcctttagtgtccagggctctccccgcaggaccctttgagctctgcagaagccaagcatgacgagcaacctgcagattcctcacttagagaagctagccttctccagctcccgtgaagcctggcctttagaatcctactaaccttcttctaggaatcacagaagccaaggaaggcagtcgggatagggaaagacagagggtatggctattctgaggacagggg

SEQ ID NO: 132105 - DNA, 239 bp, Homo sapiens
taagtttttggtaatgagggggctcttatttttgaagcagcacaattcttcagaaagtcataaaataagactctgaaatgctatctgagcatctaaatgttgagttgggtgtggggcagagagtgagcagtgatttaggagaggggaaagagaagaaagaagatgataagaaaagaacaccttgatctgagagctggaacctgctggggctctgaccctcctgaggtcccagttctcat

SEQ ID NO: 132106 - DNA, 418 bp, Homo sapiens
ttcttgctctaacgcttgacatcggggtgactttgggcaaagtaccgtgacttccctgggtctcagttcctcaccacaaaaatatagcaacacctgtgctgttggggtcttgggtggattaactggaatgatctggacagagcccttggcacagtatttggctcataagcagcatttaataactttctagcttctaagaaattaccacccaatatacaaaaatcaacacaaaatggatccaaaatttaagcttaagaaaaaaaagaaattaccctccattatctcaactagactttacatcaaccctatgacttggtaggtatttgccccattttacagataagaaaactgaggcacagagtgtcctgtgcatcccccaagatcacaaagccaggtaagggcagagccaaggtttgag

SEQ ID NO: 132107 - DNA, 673 bp, Homo sapiens
tgatgaatataagaaaagcccagactttaccactctgcaataaatccatgtaacaaaactgcactcgcaccccttacgtttatacaaatttttaaaataaataataactagaaaagcaagaggaaaccaaacccaaaattattagaagaaaagaaatgataaagattggggcagaaattaatgaattgatactaaaaatagtacaaaagatggatgaaagaaaaagttgttttttttttttaaaagataagcaaaatcaacaaacctttagccggactgtaaaagagagaatatccatatgaataaaatcagagatgaaaaaggagtcattacatctgataacacagaaattcaaaatattttagagactattatgagcaactatatgcagtaaattggaaaacttagaagaaatggatgaattccgagacacataaaaacataccaagattgaaccatgaagaaatccaaaacttgaatagaacaacattaacaagatggaagcggtagtaaaaagcctcttatcaaagtagaccaggacctggtgttttcgctactgaattctgccaaacgctgaaagaagagctaataagagttctactcagactgttccaaaaacttgaggaggagaaaatacttccaaacttgccagtattaccctgataccaaaacc

SEQ ID NO: 132108 - DNA, 418 bp, Homo sapiens
tctggctgcaccgccctagggctgggtgatgtgagagaaggagacccctctctcagcaggggcagcccccagagaacttggttgctgccttcaggctctagaaagcagaaagggccaccaacctgaactagaccagaacagcagaggtacaggaagcagtgaaaggagcactggaccaggagccaagagttctggttcaggcactaactgtggacttgggcaataccctctccctcttcctctgggtgaagaagaggttctctcaaagtttcctggagcacagggctaaggccaagggaccctattcctgctgccaatttctccaacacccactgctcttggagaggagctgagcctgacactcctggggtggcctgaggaagtagcctggagtttagcagggttgcaagacagagag

SEQ ID NO: 132109 - DNA, 184 bp, Homo sapiens
agagggaaagaaaactatcaaggcagaggctgccatgatcaccacatgatatgccaacttgctaagacattgagtttcaattgagtctcccaggccaggctaccttcctcatgatgaggggaacagggaaatcaatatgggttcattaacacttaatttaggttttccagtgtggagcatatca

SEQ ID NO: 132110 - DNA, 317 bp, Homo sapiens
ggaggcggcatcaccactgagttttgcagcatggctaggtgtttgctgagggtaaagaagggcaaaagtgcttcagggaagaggaaccaaatgtgccaaagcttggggtgtggcgaggcccagcagattcaggcagcaggtcagagaggaactggagggactagagggaggtacggcggtctcagacagagcagcagggtgagcagccaaggtggccatggtcctcagatttagaggggcctgcagccagactggggagtttgctggtgccaaagaagtgcaaagaaacatgtcttctcttttcaagcaggggagag

SEQ ID NO: 132111 - DNA, 416 bp, Homo sapiens
ggagatgaattggagatgtttgaagaagagcagtggtggagagtcctggaaactgtcatgtgaggaatgattgaagtagctggaaaagattaagctgaagacacatgggggtgtgagaactgtattcagcagttgagggacttccctgtgaaggaatctgatttgttctgtatgtgaccaaagagtggaactagaaccaaaccagtgggtggaagctgctggcaaatgaaatttcactcaatatcaagaagggcctttcttaacagagctgttcaaacacagaatggacagcttggggaggaagctcccaatgctggaggagttcaagcctagtctggatgtaacttggcaggtattttgcagagggtttggttgagtgttagtattagagttgtgtgaatgtcacagaaaaccca

SEQ ID NO: 132112 - DNA, 282 bp, Homo sapiens
cggggcttggtggcatcgtgcctgctggggacagagcaggagctccacagccctgcctggtcaaagttgtggccacgggacaggggccccaagtcccagcctccctcttacacaggggccagctgcggggtggggcgggaagtgaggttcagctccagggacttagtgcctcagtttctccacctgcaaaatggagacgctaatgatgcctcccatagggcggggtgagggtgtatgagattcttcagggagaggttcaaagggtgctggtggccatgtcgt

SEQ ID NO: 132113 - DNA, 404 bp, Homo sapiens
gtcttgggcacagaccaagccaggagatggataaaatgttaaaaaatcaagcaacttctgctacttctgaaaaggataatgatgatgaccaaagtgacaagggtacttataccattgagttagagaatcccaacagtgaggaagtggaagcaagaaaaatgattcacaaggtaaataattgaaatttgagtgtgatcttagttgttgtgtggtgtatttgactggtggaaattattggagagtcagcatgagatgttgtcatgcagtcagtggtatgtgaattttagggttttattagggaactgcaagactaacagtaagaccaacatgctttgtgattttatttgctgatattctgaatttacctgagtttcatacataaagctctgtacatttaaaaggtt

SEQ ID NO: 132114 - DNA, 693 bp, Homo sapiens
gacgagggtttaacggtgttagccaggatggtctcgatctcctgaccttgtgatccgcccacctcagcctcccaaagtgctgggattacaggcgtgagccaccgcgcccagcctctcctgtgtctcttattataaggggttctctcagactacggccccatcccgatgacttcatttaatcccagttaccactttaaaggccctattccaatacagtcacattggggattatggctttaaataggaagtttagggggacatagtcagtccataacactgccagtacttttgacagattttaatgaattgatgaaacaaaatataaccgtatctctagaagaaattatgtaactgcttccaaaatcatgagccttattccaaaacttgtcattttttcaactgatatattaatatatctgaagaattcatgaaggcagtagaattagggaaccttggataagtttgcaaactgtttttcattttgttttggctttttgtttttcttttggctatgattttaaacatatgtactaatagttattggatcctaactactttcaaaattatatgtatattctaacaggatgttcaggagttaagcttttaagagttatgtaactgcagaatagcttcttatttgtctaaatatcttttttagattgcatgggaattttgagatgaatgggattgccc

SEQ ID NO: 132115 - DNA, 144 bp, Homo sapiens
ccacgtaccaccaaacacacttctacatgaatggcaagcttcagcaaaaatacaacatgaagtaaccaagtgtcattcattcattcacttaacaagtatttactgagcatcttgcatgtaccaggaactatacaacgtacatgt

SEQ ID NO: 132116 - DNA, 441 bp, Homo sapiens
gggaaagaaaccaacatttgggccagacacacctgtattcaaatggtagttctattatttagctgtgggcctttgggcaagtcttttgaagctgatatgaatttgctcacctccttaggtataagaaacatcacattgcctctttcttcaagtcaaattaaatctagctctggatctccaaaagaaagcaagaaatgtattctctatcatgtgtaaggggatcaggggatgagctgccctccataggaaagttcaaaaatctcaggagagtatagtcaccagactatgaggaagggcttctgctcttcagtctatcttggaccacttgagttcttaatgtcggagccctcagggtccatttgaatgcagaaccattcaaatgcagtccaattgaatgcagcccatttgaatgcagggtccatttgaatgccaagcttggca

SEQ ID NO: 132117 - DNA, 349 bp, Homo sapiens
agaggccatagccacttagagccactgatgtcctgctgttcccctgagcttgggccctctccgcccctgggatcccgatttaggcttccgcagaccagttccccagaaatccagcccccctccccatcacttacacttctttatactctaagataactactatcctgatttattacaccatggattcattttatcttactttattgtaaaatacacataaacgttaccattttaaccattttaaaatgcacaactcagcggcatttagtacattcacagtattgagcacccatgaccactccctagtcaaaggacattttcatcacttcaaaagggaagcccatatcca

SEQ ID NO: 132118 - DNA, 356 bp, Homo sapiens
atgcttaccttctttaaatacacataaggaatcttctttattttcactataaatctgttataatggaaactctgattttatatttctctgtaatggagtcaactatcacctggcctatgcaggcaagtgcaaagaggtgacagtttttatttgtgccataaccacacacagctttaaatgtttttactataacatattttagaaagctaacaagctagagagagcggtgaagggctctctcagcatgttcctctctgtctgtgtgttagttttgctttactttttctttaatctgtgtctgtgtgtgtgtgtttgtgtatgtgtatgagagagagagagcgaaagagtcttatttt

SEQ ID NO: 132119 - DNA, 191 bp, Homo sapiens
actaatttaggcaaggcatgagttacagaggggcatcgctgataatacagagcaatactggggcagtgaagaggaagctgcaaaggtggccagaggccagatgtgccaggtcctgagcacctagcagagaagttgagggctcacctggtggggagtgcaggggaatcctttgaggaatcctgcagagctcg

SEQ ID NO: 132120 - DNA, 311 bp, Homo sapiens
agaatcactaaaagttactaaaatacagccactggaaaacgacgaatgaacaaagtggttaatgttccttcccaaaattatagcaaggaaaactccaccacctaatgaaaatcattaagagaattcagaggagttaactgcaggcaggcgtgacttctcccccagaaagtaatcagctaataagcattaatcatcttgtgcacagtctgcgcatttataatagggtttaataaagccttcaacaacaggcccagaattaatgaacggcatcttaggtctaacacaaaagtattccttagcggacgaaaatt

SEQ ID NO: 132121 - DNA, 763 bp, Homo sapiens
tatggtggcacgtgcttgtagtctcagctacacgggaggctggggtgggaggatcacttgagcccaagagtccaaaaccagcctaggcaacatagggagactctgtctgtacaaaaaataaaaataaactagctgggcatggtggagcgcacctgtggtcccagctacttgggagactgaggtgggaggatcgcttgagcctaggaggtgaaggctgcagtgagctgtggtcttaccgctgcactccagcctgggtgacagagcaagactgtctcaaaaaaaaaatttttaataaaaaataaaaaatgaggaccccagtaggagctgcagtggacagggggtgtgagcgtggatccagctgtatcagagtatagtcctgcccatcaggggagaagaggcgcttgtctcaaagtgaaatgcacaattggtctcgaatgccaaagagaacaggaaaagacaaaagactccagtggatgtatggacaacccaagaatgtttgcagaaagtcgacttgatttccctcggttcataatacctggaaataaggagtatgaaaagcagctgcgtgtgtgctacaattttggcacaatttgctcagtttcaatgggtctattcctaattgttttaaaggtgcttatgcatcctctactgccaagtactgcatttgcgtccaagcaggatttggtgttctgtctgctaaaatgctgcctggtcttggagtatctggtctgcccagaagcagggtcagcagtaagcggtgatc

SEQ ID NO: 132122 - DNA, 423 bp, Homo sapiens
aattccacagagtaaaattgtaaagattccaagataaactttgtgaagtttaaaagctcatgctataattacacaccaaaacagaagcaacttctcaaagaaatctgctatactcaactaataaaagaaacaattagagataagggcatgatataatagcttttatctgtccaaacaaaattgaattcttacttgtaccctccccttctaaataaacccagaaacacaggaggaaaataagaacaaaaggacagactttccactctgaaattatgctgctagcaacaactgctatttgtcccttttatgcctgctcaaatgatgtcacagtttggtcccaggttctgggaaatccaatcaactctcatcctggccacttatcagtccttcactcagttgccaaactgatcactgaatcctagc

SEQ ID NO: 132123 - DNA, 242 bp, Homo sapiens
gtggtacaaggacgttttgtgttcatctgaaacccagctgaatttataattatgtaggaaataaacagttaatatggttaaaaaaaaaaaaaaaaaaaaaaaaaaaaaaccttaatatagtttttaaaaagtgcaatgggatgagattatgctattagtatattaaaagcatgtttctgttttactccaatttgtaagatcatttaatggaataaagatcacaacaccatgttaaaaaaaaa

SEQ ID NO: 132124 - DNA, 3090 bp, Homo sapiens
atagatttcagaataacttaaaaaatttaatggtaagaaggggtgatgtgtcgaaaactcatactaaagtattaggtcactttaaaaaaagtgataatgtatgatttaatgaaatcttaagattcagttactatttaaattcaccatttctgttttggtcttataaagagaccttggtttaattatccagaggaagtcctcttcaccattttttttttttcttagttctgcttctggaaagtgttttataaagttttctcagtgagggttcttaagagttttctttggcctcttttctctcaacagtaaattgatgattttatatcagctttttcaataaaagatgcattatcattactggctataaatcatcctggggagatttataaccaggttaaaaataatatcttttacttctctcaccttttacttgtggttcagatgctcagactgtgcctgtttgcgtcgtgtctgttgctctgccgctttccatgcaggcatttttaattttacacaatcctaacaatatatggaactcattcctatgaatatataaaaggaggcttccaaaattttctattaaaatatttcaggataaattaagtgttgataatttgaaaaaataatttcaatgagctgcttatagtaaaaatggtagaatcagagttttcattctttgagaaatctttctgtaagattggctcatagataaaatgagacaaactactatgtatgataaaacaccttcagagtcatgccttgttttattttattttattttttgagacagaggtctcgctctgtcgcccaggttggagtgcagtggtgcaatctcgctcactgcaacctccacctcccaggttcaagcgattctcctgtctcagcttcctgagtagctgggactacaggtgtacaccaccacgcctggctaatttttgtttttttactagaggtggggttttgccatgttggccaggctggtctcaaactcctgacctcaggtgatccactccccccagcctcccaaagtgctgggattacaggcatgagccaccccgcccagctgagtcatgccttattttcgtagtataccaagaaatgttctatggaagtttacgttttaacacctcttttatacttggtaaaattgcctgtgtttcgctttattcctttttttttttgagacggactcttgtactgtcacccaggctgaagtgcagtggcgcaatcttggctcactacaacctccgcctcctgggttcaagtgattcttttgcctcagcctcccaagtagcagggattacaaggcatgtgccaccacacccggcttatttttgtatttttagtagagacagggcttcgccatgttgaccaggctggtctcaactcctctgggaatccgcctgtcttggccttccagggtgctgggattacaggcgtgagccactggaacctggccttgttttgctttattttttctcttacatgaagtaaagcgctttggtcaaacacacaaaaatactgccttgtactggtggttggtttcattagtggatcacacacagtgttctacttggcttgtaaaatggtgccttggatagggtgagtttggataagtatgtatgtatgtatgagttatagcaaaattaagtagattgaatcaagtccatgcaaaagcaataaaacagttttaattttttaattttttaaaaattaaaactttaataaaacagtttttaattttttgctaggttcttttaaaaaatgatgtaacttacatggaagtcttcacaggacttttttctttcctggaactattgaaatgtaatttaggatgatttgatcttccatctcaagttgtcaacatggctgtgtcattctggcttacatatgttttatttaacaaaattctagtcaagggataagggcataatgaagacaagcttcagttatgaaagtacaaactatttgtgtgattaatttttaaaaatgacattaagaagcccattgtaaaataatatttgcagtcaaatggtttttcttgctgtaagtcctgttgtagctatgtttagggtagtggttctcatctaccttggagtgcataagacttacctagcaggcttgtttaaaaagttcagattcctagctttgtacccagggattgcctcaggtggtatgggctgtggtcctggagtcatcacttttataaatagtggttcagagaccacagagagagactgcttcatcgaatgggaagtaccaaggagaaagtacaattcagtattgtctggaggcaagtggacactttgtacctgaggtttagaataggtggtctcttgccagtacaatccccaggcgttttctgtgttcagaagtagtaagaatgcctttaattcagaggattatctaagctctttaaagctgtttttctccattgtcatagtgccttctctgaaaaatgaatgtacaggtatcctattttctaatgtaattaggattttttaaaagcaatttttgatagtttttcttttaaaaagtaaaattcagcactgtgacttgaacccccaaatctttcacatacaggtgaaacattaagccacaaataaaaataatgaacaagaaagaagacaagatcctaattcctgtcattagtgacctaagtaccccatatcagaaactttgcaaaacagatctagggacagaagggctttgaaagacatttttctttggggcaaatttcgtgtgccagaactacagtttaaatgtttttatgagcaagggaaggtagcattgattcccatagctttctaattagatacatgctgtcatggatgtaagccttaaaggagttaatactaatcttgtacatacacaaattttcctcaggtttttttattttaaaaaatgatttgttaaaagtactgtctgctagacccttgcctttgagtggctttgaaacttaatatagtttttaaaaagtgcaatgggatgagattatgctattagtatattaaaagcatgtttctgttttactccaatttgtaagatcatttaatggaataaagatcacaacaccatgttaaaaaaaaa

SEQ ID NO: 132125 - DNA, 1533 bp, Homo sapiens
agcggccgctcgcgatctagaacgtaaaatggtgccttggatagggtgagtttggataagtatgtatgtatgtatgagttatagcaaaattaagtagattgaatcaagtccatgcaaaagcaataaaacagttttaattttttaattttttaaaaattaaaactttaataaaacagtttttaattttttgctaggttcttttaaaaaatgatgtaacttacatggaagtcttcacaggacttttttctttcctggaactattgaaatgtaatttaggatgatttgatcttccatctcaagttgtcaacatggctgtgtcattctggcttacatatgttttatttaacaaaattctagtcaagggataagggcataatgaagacaagcttcagttatgaaagtacaaactatttgtgtgattaatttttaaaaatgacattaagaagcccattgtaaaataatatttgcagtcaaatggtttttcttgctgtaagtcctgttgtagctatgtttagggtagtggttctcatctaccttggagtgcataagacttacctagcaggcttgtttaaaaagttcagattcctagctttgtacccagggattgcctcaggtggtatgggctgtggtcctggagtcatcacttttataaatagtggttcagagaccacagagagagactgcttcatcgaatgggaagtaccaaggagaaagtacaattcagtattgtctggaggcaagtggacactttgtacctgaggtttagaataggtggtctcttgccagtacaatccccaggcgttttctgtgttcagaagtagtaagaatgcctttaattcagaggattatctaagctctttaaagctgtttttctccattgtcatagtgccttctctgaaaaatgaatgtacaggtatcctattttctaatgtaattaggattttttaaaagcaatttttgatagtttttcttttaaaaagtaaaattcagcactgtgacttgaacccccaaatctttcacatacaggtgaaacattaagccacaaataaaaataatgaacaagaaagaagacaagatcctaattcctgtcattagtgacctaagtaccccatatcagaaactttgcaaaacagatctagggacagaagggctttgaaagacatttttctttggggcaaatttcgtgtgccagaactacagtttaaatgtttttatgagcaagggaaggtagcattgattcccatagctttctaattagatacatgctgtcatggatgtaagccttaaaggagttaatactaatcttgtacatacacaaattttcctcaggtttttttattttaaaaaatgatttgttaaaagtactgtctgctagacccttgcctttgagtggctttgaaacttaatatagtttttaaaaagtgcaatgggatgagattatgctattagtatattaaaagcatgtttctgttttactccaatttgtaagatcatttaatggaataaagatcacaacaccatgttaaaaaaaaa

SEQ ID NO: 132126 - DNA, 3036 bp, Homo sapiens
atagatttcagaataacttaaaaaatttaatggtaagaaggggtgatgtgtcgaaaactcatactaaagtattaggtcactttaaaaaaagtgataatgtatgatttaatgaaatcttaagattcagttactatttaaattcaccatttctgttttggtcttataaagagaccttggtttaattatccagaggaagtcctcttcaccattttttttttttcttagttctgcttctggaaagtgttttataaagttttctcagtgagggttcttaagagttttctttggcctcttttctctcaacagtaaattgatgattttatatcagctttttcaataaaagatgcattatcattactggctataaatcatcctggggagatttataaccaggttaaaaataatatcttttacttctctcaccttttacttgtggttcagatgctcagactgtgcctgtttgcgtcgtgtctgttgctctgccgctttccatgcaggcatttttaattttacacaatcctaacaatatatggaactcattcctatgaatatataaaaggaggcttccaaaattttctattaaaatatttcaggataaattaagtgttgataatttgaaaaaataatttcaatgagctgcttatagtaaaaatggtagaatcagagttttcattctttgagaaatctttctgtaagattggctcatagataaaatgagacaaactactatgtatgataaaacaccttcagagtcatgccttgttttattttattttattttttgagacagaggtctcgctctgtcgcccaggttggagtgcagtggtgcaatctcgctcactgcaacctccacctcccaggttcaagcgattctcctgtctcagcttcctgagtagctgggactacaggtgtacaccaccacgcctggctaatttttgtttttttactagaggtggggttttgccatgttggccaggctggtctcaaactcctgacctcaggtgatccactccccccagcctcccaaagtgctgggattacaggcatgagccaccccgcccagctgagtcatgccttattttcgtagtataccaagaaatgttctatggaagtttacgttttaacacctcttttatacttggtaaaattgcctgtgtttcgctttattcctttttttttttgagacggactcttgtactgtcacccaggctgaagtgcagtggcgcaatcttggctcactacaacctccgcctcctgggttcaagtgattcttttgcctcagcctcccaagtagcagggattacaaggcatgtgccaccacacccggcttatttttgtatttttagtagagacagggcttcgccatgttgaccaggctggtctcaactcctctgggaatccgcctgtcttggccttccagggtgctgggattacaggcgtgagccactggaacctggccttgttttgctttattttttctcttacatgaagtaaagcgctttggtcaaacacacaaaaatactgccttgtactggtggttggtttcattagtggatcacacacagtgttctacttggcttgtaaaatggtgccttggatagggtgagtttggataagtatgtatgtatgtatgagttatagcaaaattaagtagattgaatcaagtccatgcaaaagcaataaaacagttttaattttttaattttttaaaaattaaaactttaataaaacagtttttaattttttgctaggttcttttaaaaaatgatgtaacttacatggaagtcttcacaggacttttttctttcctggaactattgaaatgtaatttaggatgatttgatcttccatctcaagttgtcaacatggctgtgtcattctggcttacatatgttttatttaacaaaattctagtcaagggataagggcataatgaagacaagcttcagttatgaaagtacaaactatttgtgtgattaatttttaaaaatgacattaagaagcccattgtaaaataatatttgcagtcaaatggtttttcttgctgtaagtcctgttgtagctatgtttagggtagtggttctcatctaccttggagtgcataagacttacctagcaggcttgtttagtggtcctggagtcatcacttttataaatagtggttcagagaccacagagagagactgcttcatcgaatgggaagtaccaaggagaaagtacaattcagtattgtctggaggcaagtggacactttgtacctgaggtttagaataggtggtctcttgccagtacaatccccaggcgttttctgtgttcagaagtagtaagaatgcctttaattcagaggattatctaagctctttaaagctgtttttctccattgtcatagtgccttctctgaaaaatgaatgtacaggtatcctattttctaatgtaattaggattttttaaaagcaatttttgatagtttttcttttaaaaagtaaaattcagcactgtgacttgaacccccaaatctttcacatacaggtgaaacattaagccacaaataaaaataatgaacaagaaagaagacaagatcctaattcctgtcattagtgacctaagtaccccatatcagaaactttgcaaaacagatctagggacagaagggctttgaaagacatttttctttggggcaaatttcgtgtgccagaactacagtttaaatgtttttatgagcaagggaaggtagcattgattcccatagctttctaattagatacatgctgtcatggatgtaagccttaaaggagttaatactaatcttgtacatacacaaattttcctcaggtttttttattttaaaaaatgatttgttaaaagtactgtctgctagacccttgcctttgagtggctttgaaacttaatatagtttttaaaaagtgcaatgggatgagattatgctattagtatattaaaagcatgtttctgttttactccaatttgtaagatcatttaatggaataaagatcacaacaccatgttaaaaaaaaa

SEQ ID NO: 132127 - DNA, 3094 bp, Homo sapiens
atagatttcagaataacttaaaaaatttaatggtaagaaggggtgatgtgtcgaaaactcatactaaagtattaggtcactttaaaaaaagtgataatgtatgatttaatgaaatcttaagattcagttactatttaaattcaccatttctgttttggtcttataaagagaccttggtttaattatccagaggaagtcctcttcaccattttttttttttcttagttctgcttctggaaagtgttttataaagttttctcagtgagggttcttaagagttttctttggcctcttttctctcaacagtaaattgatgattttatatcagctttttcaataaaagatgcattatcattactggctataaatcatcctggggagatttataaccaggttaaaaataatatcttttacttctctcaccttttacttgtggttcagatgctcagactgtgcctgtttgcgtcgtgtctgttgctctgccgctttccatgcaggcatttttaattttacacaatcctaacaatatatggaactcattcctatgaatatataaaaggaggcttccaaaattttctattaaaatatttcaggataaattaagtgttgataatttgaaaaaataatttcaatgagctgcttatagtaaaaatggtagaatcagagttttcattctttgagaaatctttctgtaagattggctcatagataaaatgagacaaactactatgtatgataaaacaccttcagagtcatgccttgttttattttattttattttttgagacagaggtctcgctctgtcgcccaggttggagtgcagtggtgcaatctcgctcactgcaacctccacctcccaggttcaagcgattctcctgtctcagcttcctgagtagctgggactacaggtgtacaccaccacgcctggctaatttttgtttttttactagaggtggggttttgccatgttggccaggctggtctcaaactcctgacctcaggtgatccactccccccagcctcccaaagtgctgggattacaggcatgagccaccccgcccagctgagtcatgccttattttcgtagtataccaagaaatgttctatggaagtttacgttttaacacctcttttatacttggtaaaattgcctgtgtttcgctttattcctttttttttttgagacggactcttgtactgtcacccaggctgaagtgcagtggcgcaatcttggctcactacaacctccgcctcctgggttcaagtgattcttttgcctcagcctcccaagtagcagggattacaaggcatgtgccaccacacccggcttatttttgtatttttagtagagacagggcttcgccatgttgaccaggctggtctcaactcctctgggaatccgcctgtcttggccttccagggtgctgggattacaggcgtgagccactggaacctggccttgttttgctttattttttctcttacatgaagtaaagcgctttggtcaaacacacaaaaatactgccttgtactggtggttggtttcattagtggatcacacacagtgttctacttggcttgtaaaatggtgccttggatagggtgagtttggataagtatgtatgtatgtatgagttatagcaaaattaagtagattgaatcaagtccatgcaaaagcaataaaacagttttaattttttaattttttaaaaattaaaactttaataaaacagtttttaattttttgctaggttcttttaaaaaatgatgtaacttacatggaagtcttcacaggacttttttctttcctggaactattgaaatgtaatttaggatgatttgatcttccatctcaagttgtcaacatggctgtgtcattctggcttacatatgttttatttaacaaaattctagtcaagggataagggcataatgaagacaagcttcagttatgaaagtacaaactatttgtgtgattaatttttaaaaatgacattaagaagcccattgtaaaataatatttgcagtcaaatggtttttcttgctgtaagtcctgttgtagctatgtttagggtagtggttctcatctaccttggagtgcataagacttacctagcaggcttgtttaaaaagttcagattcctagctttgtacccagggattgcctcaggtggtatgggctgtggtcctggagtcatcacttttataaatagtggttcagagaccacagagagagactgcttcatcgaatgggaagtaccaaggagaaagtacaattcagtattgtctggaggcaagtggacactttgtacctgaggtttagaataggtggtctcttgccagtacaatccccaggcgttttctgtgttcagaagtagtaagaatgcctttaattcagaggattatctaagctctttaaagctgtttttctccattgtcatagtgccttctctgaaaaatgaatgtacaggtatcctattttctaatgtaattaggattttttaaaagcaatttttgatagtttttcttttaaaaagtaaaattcagcactgtgacttgaacccccaaatctttcacatacaggtgaaacattaagccacaaataaaaataatgaacaagaaagaagacaagatcctaattcctgtcattagtgacctaagtaccccatatcagaaactttgcaaaacagatctagggacagaagggctttgaaagacatttttctttggggcaaatttcgtgtgccagaactacagtttaaatgtttttatgagcaagggaaggtagcattgattcccatagctttctaattagatacatgctgtcatggatgtaagccttaaaggagttaatactaatcttgtacatacacaaattttcctcaggtttttttattttaaaaaatgatttgttaaaagtactgtctgctagacccttgcctttgagtggctttgaaacttaatatagtttttaaaaagtgcaatgggatgagattatgctattagtatattaaaagcatgtttctgttttactccaattaaccgatggtaatgatagcacccccccgggtgctgtgtgggggggggggggccg

SEQ ID NO: 132128 - DNA, 923 bp, Homo sapiens
atcgagctcggcaccctgattgcatttagaccacttttataaatagtggttcagagaccacagagagagactgcttcatcgaatgggaagtaccaaggagaaagtacaattcagtattgtctggaggcaagtggacactttgtacctgaggtttagaataggtggtctcttgccagtacaatccccaggcgttttctgtgttcagaagtagtaagaatgcctttaattcagaggattatctaagctctttaaagctgtttttctccattgtcatagtgccttctctgaaaaatgaatgtacaggtatcctattttctaatgtaattaggattttttaaaagcaatttttgatagtttttcttttaaaaagtaaaattcagcactgtgacttgaacccccaaatctttcacatacaggtgaaacattaagccacaaataaaaataatgaacaagaaagaagacaagatcctaattcctgtcattagtgacctaagtaccccatatcagaaactttgcaaaacagatctagggacagaagggctttgaaagacatttttctttggggcaaatttcgtgtgccagaactacagtttaaatgtttttatgagcaagggaaggtagcattgattcccatagctttctaattagatacatgctgtcatggatgtaagccttaaaggagttaatactaatcttgtacatacacaaattttcctcaggtttttttattttaaaaaatgatttgttaaaagtactgtctgctagacccttgcctttgagtggctttgaaacttaatatagtttttaaaaagtgcaatgggatgagattatgctattagtatattaaaagcatgtttctgttttactccaatttgtaagatcatttaatggaataaagatcacaacaccatgttaaaaaaaaa

SEQ ID NO: 132129 - DNA, 2483 bp, Homo sapiens
atagatttcagaataacttaaaaaatttaatggtaagaaggggtgatgtgtcgaaaactcatactaaagtattaggtcactttaaaaaaagtgataatgtatgatttaatgaaatcttaagattcagttactatttaaattcaccatttctgttttggtcttataaagagaccttggtttaattatccagaggaagtcctcttcaccattttttttttttcttagttctgcttctggaaagtgttttataaagttttctcagtgagggttcttaagagttttctttggcctcttttctctcaacagtaaattgatgattttatatcagctttttcaataaaagatgcattatcattactggctataaatcatcctggggagatttataaccaggttaaaaataatatcttttacttctctcaccttttacttgtggttcagatgctcagactgtgcctgtttgcgtcgtgtctgttgctctgccgctttccatgcaggcatttttaattttacacaatcctaacaatatatggaactcattcctatgaatatataaaaggaggcttccaaaattttctattaaaatatttcaggataaattaagtgttgataatttgaaaaaataatttcaatgagctgcttatagtaaaaatggtagaatcagagttttcattctttgagaaatctttctgtaagattggctcatagataaaatgagacaaactactatgtatgataaaacaccttcagagtcatgccttgttttattttattttattttttgagacagaggtctcgctctgtcgcccaggttggagtgcagtggtgcaatctcgctcactgcaacctccacctcccaggttcaagcgattctcctgtctcagcttcctgagtagctgggactacaggtgtacaccaccacgcctggctaatttttgtttttttactagaggtggggttttgccatgttggccaggctggtctcaaactcctgacctcaggtgatccactccccccagcctcccaaagtgctgggattacaggcatgagccaccccgcccagctgagtcatgccttattttcgtagtataccaagaaatgttctatggaagtttacgttttaacacctcttttatacttggtaaaattgcctgtgtttcgctttattcctttttttttttgagacggactcttgtactgtcacccaggctgaagtgcagtggcgcaatcttggctcactacaacctccgcctcctgggttcaagtgattcttttgcctcagcctcccaagtagcagggattacaaggcatgtgccaccacacccggcttatttttgtatttttagtagagacagggcttcgccatgttgaccaggctggtctcaactcctctgggaatccgcctgtcttggccttccagggtgctgggattacaggcgtgagccactggaacctggccttgttttgctttattttttctcttacatgaagtaaagcgctttggtcaaacacacaaaaatactgccttgtactggtggttggtttcattagtggatcacacacagtgttctacttggcttgtaaaatggtgccttggatagggtgagtttggataagtatgtatgtatgtatgagttatagcaaaattaagtagattgaatcaagtccatgcaaaagcaataaaacagttttaattttttaattttttaaaaattaaaactttaataaaacagtttttaattttttgctaggttcttttaaaaaatgatgtaacttacatggaagtcttcacaggacttttttctttcctggaactattgaaatgtaatttaggatgatttgatcttccatctcaagttgtcaacatggctgtgtcattctggcttacatatgttttatttaacaaaattctagtcaagggataagggcataatgaagacaagcttcagttatgaaagtacaaactatttgtgtgattaatttttaaaaatgacattaagaagcccattgtaaaataatatttgcagtcaaatggtttttcttgctgtaagtcctgttgtagctatgtttagggtagtggttctcatctaccttggagtgcataagacttacctagcaggcttgtttaaaaagttcagattcctagctttgtacccagggattgcctcaggtggtatgggctgtggtcctggagtcatcacttttataaatagtggttcagagaccacagagagagactgcttcatcgaatgggaagtaccaaggagaaagtacaattcagtattgtctggaggcaagtggacactttgtacctgaggtttagaataggtggtctcttgccagtacaatccccaggtacaaagctaggaatctgaactttttaaacaagcctgctaggtaagtcttatgcactccaaggtagatgagaaccactaccctaaacatagctacaacaggacttacagcaagaaaaaccatttgac

SEQ ID NO: 132130 - DNA, 472 bp, Homo sapiens
gctcggtacccggcttaaaagggagtcttcacgctctgtgatcagaggccctgcgtagagagcactatctcctccacgcgcaccccagtgctattgaaacttctaaaactaggcctagttttagaagtttccatagcagtttaaatgtttttatgagcaagggaaggtagcattgattcccatagctttctaattagatacatgctgtcatggatgtaagccttaaaggagttaatactaatcttgtacatacacaaattttcctcaggtttttttattttaaaaaatgatttgttaaaagtactgtctgctagacccttgcctttgagtggctttgaaacttaatatagtttttaaaaagtgcaatgggatgagattatgctattagtatattaaaagcatgtttctgttttactccaatttgtaagatcatttaatggaataaagatcacaacaccatgttaaaaaaaaa

SEQ ID NO: 132131 - DNA, 307 bp, Homo sapiens
aagaattcctggtgagaacagctaggggagctgttggcctttagcactgctggaatcctgtggccgtctcctaactctttcaaagagctgcaggctggtcagcttgaagtggcataaaaagatttatttaggatctaaatttttccttgatcttgacctaagttagttacatgttacaagcatttgttggccatgttccataatgtactttggcttctgagcctctgagttgaagagtgagctagtgctgctcttaaaaaacaacaacaaaaacaaaaaaccagtcatagtacacacatgttgatta

SEQ ID NO: 132132 - DNA, 503 bp, Homo sapiens
tggagctcggtacctacttttcacaggggtatagaatattattcagccataaaaagaaggaaaccctgctatttgtgacaacatggatgaacctggagaacattaggtaagtgaaataagccaggcacagaaagacaaataccgtatgatttcacttatatgaggaatctaaaaagttgaacccatagaatgaagcagataatagaatctgcttctattatcggccaagagccgttgggaggtggggagaaatggggagatgttagtcacagggcacaaacttgtagttataggatgaatgtgttttggttactagccttgtagtaatactgttgatttttaaaaaatgttctgtgaaagagtagtaaagtagtctaccttaatatcactgccttttaaattaggtgaacagaggaactattatctccacttttaaaaacgaatttaagggatatggtccaggtcatgcaaacatagtatgtgatggattgaactgagaaccc

SEQ ID NO: 132133 - DNA, 137 bp, Homo sapiens
gccttaaaacttaagtaataaaagaaggtgttcttttggctcatgcagtgtgtcgatctctgtctctcccaagcatttttagactttatgccagagaccacctggaggcaaaagacaccatttatttaattccttcc

SEQ ID NO: 132134 - DNA, 260 bp, Homo sapiens
tatgggatatagcgattgtttttaagagttggttgcttaacatggaaaatgtgcttctgggaaaaagagttttaaaaacccagctttcatgttttattttacttcattgaaatgaggttcttcttgcgtgccccgaggctttatctctggaatgatttttactaaataattcttcatattcaggtagtactttcatagacataatcccttgtagtcttcaccattgttctgtgaggggtgtggtatcatctcagttttac

SEQ ID NO: 132135 - DNA, 150 bp, Homo sapiens
caacgtgcaacacaagtccagaggtgcacacatgttgtaaatgtacaactctgtaagttttcacaaactgaacacacctgtgcaaccagcatcccatcgagaaacattacccgtggctgggcgtggtggctcacgcctgtaatcccagca

SEQ ID NO: 132136 - DNA, 302 bp, Homo sapiens
gtgcccggctgctcacctgtgcacgtgccctgagtgtagctgggtgcagacctggacggcgctgctcagctgggcagtcccggggcactcggcccctagtaggtgccacagagaaaccggcaccaggtggcagggaacaggctgagtctgtggaggggacccactggagtggcccaggaggctgggaaggcttccaggagaagccccgcctgctgctcatcctcattgcctgacccttgtccaagtgcagaccgcagggccggggatgctgactggccagttccaggtgttcctgagaacca

SEQ ID NO: 132137 - DNA, 431 bp, Homo sapiens
ctgctccctgggccccgggctgcttcctaggaaggacaatctggaggcaaccataaggaaagaaaataacgaactgcctggccctgcattgcataacccgtgcgcagtaaaccaggagctctgctgggacacagtctgttatctcaacaggtaaacaggaaccctgccccctccctgaccactgtcagcactgggccaccacagacactccagacacagaccgatagcacatgaggaggacaccactgctctttagcctgtattttcacactcccatttccctgcagctgctggcatcatcactgggcacactcaataacggacactccacccactccagcccttccctggctacctgctccaaaagggtggtcccgagtgactcaaagctgccttctgcaccttgctcttttccatccacggagaccaaa

SEQ ID NO: 132138 - DNA, 260 bp, Homo sapiens
caacaggaatttctcccatatctaggtattcttttattgatattctatcagctcctaacaacagaactcctgtgcacatcgtatacaatatctaataatattacactgccttgaattttaaaaaaccatagacattcagttctagaagactaagtggtcttctcatatatgaaatttacaaatttggccaggcgcggtggctcacgcctataatcccagcatttttgggaggctgaggaaggcacatagctcgaggtcat

SEQ ID NO: 132139 - DNA, 579 bp, Homo sapiens
ggtggtgtggtggctcgtgcctgtagtcccagctacacgggaggctaaggcacgagaattgcttgaacctgggaggtggaggttgcagtgagctgagattgtgccactgtactccagcccgggagatagaatgagactctgtattaaagttaaaagagctggtgagagcaggtatttttgtctggtttctaccaataatataatattacctataactttttcatggatattgtttatcagattgggaaactccctctattcctaatttttggcttaattgaaccagcttttggtttattgattttcctctgttgttttgctgttgtctgtctcaggaagttccttcctattccaaaagttttttttatcataaatggatgttgaattttgtcaagtgctttttctgcatctgttgagaatgtaatatggtgatattgcgttattataatgaattacattaactgattttcatatgttaaaccaaccttgcattcctgggataaacctcggttggtttttgtttttgttttcttcctatacacacaaacagccagaacttgatcttttttatgattgact

SEQ ID NO: 132140 - DNA, 511 bp, Homo sapiens
ttctatctgaagcacagtaatgaaagctttcccaattccagtttaattttaaacccaatgcctctcatccttggaagcttcataatcatttcctactcttagctgttcagacaaaattacctccaaaacagatttagaaatgttacctcacatttctaccattacaggtatcaaagaatttaaatacaaataataacaattataaagcatgtgttgcacccaacaggaactgaaaatcttgcttgactcagaagagatgacttaaaccccagtgagaaaatatgagtatgatgtaacactgtaagtacaaagctaaaaccattattatagacattaagaacattaaggggaaaaaaattaaatgttcaaaacataaaaagctcacatgccaactcacctgttttaggatttggtttttcactgataatttctaagttatctttcttaaaagctctcttaaataaaaccagcatacacactgagaatctacaaaatgggctgggtgtggtgg

SEQ ID NO: 132141 - DNA, 718 bp, Homo sapiens
tgatctttagtattttctcctttctttgctttgggcttatttgctcccttttctagcttattgtggcggaagctcagatcattgattttaaaatttacttatttatttatttatttatttaattcaacactgatcagaaggctttttgtgcttttctaaaaaaagcatttaatgctataaatttcccatttgctttatctcacaaattttattgtgttgtaattttgtgttcaatttagaatattctgatttttcttggtattactataattttcaaatatttagagtttttttcagttatctttctgttactgattgtaatttattgttttttaaaattatagttctttgaatagttttgcagtatttgctctagggattactataaacatacttcactttttacagttcacttagaagtcaatattttaccagttcaagtggaatgtagaaaaatcttaccactgtttacattcctttaccctctcccctttatgttataattttcttataaatcataagacttggctgggcacagtggctcacctgtaatcccaggactgggaggccgaggcgagcagattgcttaagtccaggagttcgagaccagcctggacaatgtggtgaaaccccaactctacaaaaaatacacaaaattagctaggcgtggtagcatgttcctgtagtcccagctactcaggaggctgaagtgggagga

SEQ ID NO: 132142 - DNA, 257 bp, Homo sapiens
ccaattacccaggccctaccagagatccactcactcgggcacgtctgcccatcacttatcacagttaaatacagccattacgtgctggctgcggcaacgctgtttatctgggacaataacgagtccctgaggactggattgctctcaggtagccgcagctattctgggacactcacaagggtagagccctgcggtcaatgaacagagccgcctgcactagctgataaactctgagtgtgatgccagatagtggtccc

SEQ ID NO: 132143 - DNA, 739 bp, Homo sapiens
gtggacatcacggacctaccaatatgatgtcacccctggaggcccagctgtaaaattcctctctttgtactctttctctttatttctcagaccagccaacacttacgggaaacaaaaataacctacattgaaatattgggggcgatagaccatgggaatgcaagtatctcttcaacatcctgatttcaattattttgaagaaaccctggcagcctcggcatcacctcatcagcaggtttgcaacttgcaaccacttcccagcacttggcaaaagaaggcaagaaagccgccctgttctcctgtgatgtctttactaagtaactgcggaaggaccagtgcattttctaccttccaaggcagacactctggcacctgagagtgatgatcttgtgtaaaccaatcagggtactggataaatacagctctgatgcctctggtatgccagtggctttagtgtatggtagaaccaaggtaataatagtattccgtggtatgtgtgacatcttccttatcagcagtaagccaagattttttttagagtcaatatcaactacaatcttgcagcgtcataacgtttaaataaattacaacagttagaccccaagaggttggttcttgactttaagcagtctttcctgcttgctttagagatttaaaataattcaacttcctggaaaagaactctaaaaataagcccctagaattataaaaacaatgtaaaagatcgccatcattaccg

SEQ ID NO: 132144 - DNA, 350 bp, Homo sapiens
tatggaataggtttagcaattcagaagcttttccacgtgcactgcagagccggagcccaccccactggggggaaagggaggcacagatgtggaatgagatcagagatatcaggaaaggttcatggtttttattttattttattattattttttgagacgaagtctcactctgtcacccaggctggagtacagaggtgtgatctcagttcactgtaacctgcacctaccaggttcaagcgattctcctgcctcaggtgatctgcctgccttggcctccctaagtgctaggattaacaggcgtgagccaccacgctcagccttatatatttatttggagacaaagggaaaca

SEQ ID NO: 132145 - DNA, 828 bp, Homo sapiens
tcagcatagagtagttgcatttcagagtatctttgtgtctgaaaaatccgtgattctgctcaactgctgttttacttccatatttttaagcaaggaaactgtttttaaactgtaaagagttcagaactgcagaggcctctgggaagtgtagcttagtgtgggaggagatattcagtgactactgttaaaaattagtggttctgcagtgagaacacatggacacaggggaggggaataacatactctgggggtgggggagagagcatcaggaaaaagatctaatgcttgtggggctcaatatctaggtgatgggttgataggtgtagcaaatcaccatggcacacgtttacctgtgtaaccaacctgcatgtcctgcacgtgtatcccagaactttaaattaaatttaaaaaatattaatggttctcagctgggcgcggtggctcacacctgtaatcccagcactttgggaggccgaggccggcagatcatgaggtcgtcaagagatcgagaccatcctggtcaacatggtgaaaccccatctctactaaaaatacaaaaattagccaggcgtggcggtgcacacctgtagtcccagctacttgggaggctgaggcaggagaatcacttgaacccgggaggcagaggttgcagtgagccaagatcgcaccactgctctccagcctggcaacagagcgagactccatctcaaatatatatatataatttttctcaaactctcgggtgtgctgaaggagcatgcaaatattgaaaaaccctgatgctgactttgagaaatcatgcagaataggggccgaatgcaagaaaaa

SEQ ID NO: 132146 - DNA, 542 bp, Homo sapiens
tgcctgcctcagcctcccgaagtgctgggattacaggcgtgagccaccgcgcccagccaggagtctcttgatttagaatgggaacttgaaatcatctcctcttgccgtgtacttgaacgcgataacctggcacttatctttttaattcttttactcacctgcatctttgttctttttgcctctgatgttcagggaagcctcttctcccactgcatctgtgatctctcctgaaatgtagcacccacacatccctgagaagctagctgcggcacgtgtgtgtgcacatgggcatgcgtaagtctgggcgtgccttccacaacagattaaggatatcaatcctgacgccatgctgggatgttttagtgaatcttgacagggttgttgactcccctgtttccctggaggactttaccatgaaagtcttctgctgtgtgactttggacaggcgtcttggcctctctgtttctctttattcataattgaggctaaagtgacacctttgccatctctgccacaggatactgtgggcatctgtgtagttg

SEQ ID NO: 132147 - DNA, 399 bp, Homo sapiens
gaacccctccctggggcctggcttgggggatactcaggtttgagtccctctcccccactggggctttgctctgtgtgaggtctgtgctcacccaccttcttctgctcatacccctctcctctgacacacaccaccagctctgctgctctcccagagttgccctgagtattaggtcaccctaggaagttgctcctagtcagccagttctggcctaccaaaatggcatttcatatggtttcagctacctcatccccagctgctgtgtttcttgagtgggctggggggcttctgatttcaggaacctgctagattcttggctcccatccttcaggcgatgcttcaggttcctcgagtccttaattttctttgcagtaaaatggagaaacagtgaaaaaatat

SEQ ID NO: 132148 - DNA, 118 bp, Homo sapiens
agattttcagccagtgacaaaggttgggagcagcagagttcatgcaaggagtccacacaagggttcctcacttctgacagcaacagcacactgaaggggttcccaagccaacttcaga

SEQ ID NO: 132149 - DNA, 388 bp, Homo sapiens
cacacatctcgcacgtgcacccacacatctcacatgcgcactcacacatctcacacgtgcacccacaaatctcacacgtgcactcacacatctcacacacgcacccacaccgcacacgtgcaccctcacacatctcacacacccacatctcacacatgcaccctcacatctcacacgtgaatcctcacacatctcacatgtgcaccctcacatctcacatgcgcactcacatctcacacgcacactcacatatcacacgtgtacccacaaatctcacacacgcacccacaaatctcacacgtgcactcacatctcacacgcgcacccacacgtctcacacgtgcaccctcacacatctcacatgcgcaccctcacacatctcccgtgt

SEQ ID NO: 132150 - DNA, 595 bp, Homo sapiens
gctccagccactcctagagccataacagggttacaaggccacaactgtttaagaacagggaactcttctttacaaactgaccagcaaacaagtacaggagaatgctaccaaatcctcaattctatattcattagatcagtagccctcttcagctacacaataaaatcacctgaagtgattttgtttaaaacactgatgcccaggttcctctccagatgaaataaattacagtatctgggagtaaggcctaggcatcagaactttgcaaaaaatctcccccagtgaatgactctaaggtgccaccagatagagaaacttaactgattggttctaactcactggctctcaagagattgagagagacttcccacaagcattgcaaagtttcatttctaagttttctaattatgacctggcttaagacattcaaaaccaaatgtataccatggtatataaaacttacctgggggcttgcttctgtaatattaatacccaagtatttttcaccacttaggttaccaagccactgcaggaagtttcgaagtgctctgccacaactcacttgattctcatacccagtctatgcagcacagaa

SEQ ID NO: 132151 - DNA, 431 bp, Homo sapiens
ggttgcagcgaggcgagatcgtgccactgcactccagcctgggtgacagagtgagaccccatctcaaaaaaaaacaaaaaaaaatttgaaaagtcatcatcaaatgatttctttttggtttcttgtcatctttctttgtcttgtttttaggctatactcagaagcgcattaaaaatctcatgtcattctctttcttgtaaacgattgtttttttgatgaagttcctccttaagtaatgtgtattagtatgtgtatggtggtaaacattatgaatccttgcatgtttaaaaatgtttttatcttgccctcacactcgagtaataatctggctggataatagtttcaatatcataattattttcttcacaactttgaaactactactccatcattctctagcctacaatctccatgtgctctaggccctagtc

SEQ ID NO: 132152 - DNA, 323 bp, Homo sapiens
tggcaatcagtattaaattgcagcctctattactgattatcattcataaattaaaactataattgacatattccaacctggaggaagagaaacaacagacttgtttttatgcaacagtttgcccactgtttaaaagagaatgggctgggcacagtgcctcatgcctataattccaacactttaggaagctaaggtgggagcaccacttgaggccaggagtttgtgaccagtctggacaacatgtcgagaccctatctctacaaaaaaataaaataaaagccgagcattgtggcatgagcctacagtcttagctacttagaaga

SEQ ID NO: 132153 - DNA, 591 bp, Homo sapiens
aaataagtacacatgcatatgagtaacacgcactccatgagtacacatgcgtacaagtaacacacgttccataaatgagtacacacatgtgtactatcacgatgcctggtcattataactaccatttacttagcacttactatgtgtgagttaccctaagacatttgatgtgcattatctcaatcttcgcttcaaccctatgatccaaatactagtattatccccattctacagatgaggaaactgatactcaaaaagatttttttcccttgtatcaagggttgtgagctcaagcataagcagagctggatcagaactcaggtagtcttgactccagaacttacatctaagtttttatatttttgttataccttccttgacttctgaatcctgccatgtatcttgctgtccaggagactggctgtatttcattgttttctctggttggctgttcttttcacaatggctcccacggtatccagggtttgcaggtggggagggaggaggagggtgtagggttcaaggctaaccagggcagtctatactacagccaaactcactacgctagcaagttcattttgagtgatgggg

SEQ ID NO: 132154 - DNA, 295 bp, Homo sapiens
caatgccaggtctcctctcagaaacacaggtgctggtctcacgcagctcccactctgcgggctcaggccctttgcaggcatgatgcactcagctccctggagctgagagactgtctctctccttccacttacccatcagaaaacaaaacaaacttttatccagatccttctctgtgttagatgccaggagtgtgatgaagactctgctctggaaatgtcctgaggctgagggagggagggtgacaccaaatcccaacccaggtcccactgggaagtcacatccttcaaatgcagg

SEQ ID NO: 132155 - DNA, 564 bp, Homo sapiens
gtagctgggactataggcgcgtgccaccatgcccagctaatttttaaaaaaattttcttcgtagaggcaaggtctctctgtgatgctcagtttctcaaactcctgagctcaagggatgctctcgcctcagcctgggattacaggcataagctgccatccccagctccttgaaatgagttttaagaggccaagttacgatttattgttggaaaggaatgggatatgtgtttattcatgaaatactgcctggggcctactgtgtatacagccttctcccaggcaccatctcatgcacacacgcctggtctgggaggaactttgttgccatagtaggagggaaagggcacgaaggtggtcgggggtggccagggcaccgcccactgctggatctggctgcattcgggcctcaccgccagtgctagggctagctgtgcacttgagacgtgctagacagctggagtggaagtgtagtccttgattaggacatctttaatattcgatcaagttatgtgttcggggagctactgtgctgatcctgcactgtgcatggctcatgggtctgcc

SEQ ID NO: 132156 - DNA, 288 bp, Homo sapiens
accagccaacttcagacctttctttagactaattgcccagaaagaggtacccatctaaagataaggaagtcatttcctgtctgactacctcccattctcccttggcatggaaagaggggctcagggcatataggaaagtgaggaggaggcctggagagacggagggaaagaagaagggagaagaatagatagaaccccacttagcccaagtcaaaaccccaactgagatctagagcaggcagagggaatagactgctaatgggctttacccacaggaagtcatctagg

SEQ ID NO: 132157 - DNA, 415 bp, Homo sapiens
catcatattgatcaggctggtctcgaactcctgacctctggttatctgcccgcctcagcctcccaaagtgctgggattacaggcgtgagccaccgtgcccggccgaatattcttcatcacagattcctggaggggaatttccaggtcaaagttgtgaccctttcaaagtccccagaccaagctgccttccaggaggcagtcccaccagccgtacacagcgccaaggactgcgcctctcatctcttcttagaggtggcaaaccttttgaagactgattgattgattggtttggtttggttctttaactgtcagaagttactcagggcccagcttggaagggatgctggaagggccctgggacttagaggccaaagctggtggtgaatctgatgtcatgccgagatgcccggttctg

SEQ ID NO: 132158 - DNA, 193 bp, Homo sapiens
cgggacttcagggtctccgcgggagcttaggaggctcaggatctgagttggagagctggaaggccaaactccgagccgctgagggactgcgcaggaagaccacagaaataaaccaaagggacaccgcggacagatgtaccagaggacaccactgaagtccaggagaatctccaccaaaaccatcagcgttttc

SEQ ID NO: 132159 - DNA, 412 bp, Homo sapiens
atacatgtgcaggatgagcaggttggttacataagtaaacttgtgccatggtgacttgctgcacagatcaacccatcacctaggtattaagcccagcatccattacaaatattaaagatggtatgaacagaaaaccccatatttacttctccaaatctattatataacattaaacaatcaactaagataacattttactgacttttgcagagtatgtgttccaaaaatagcaatattgtttgttgaagtaagccatctcttcttttgttaattgaataatctcaagcacacaattcagaaagtaagtgtgctgtagtgaaaagtgggctgagcttggtgccttaagattggggctcaagggaaatgggtgctatatgatctatcttgggatgtcctatgttggtatcggtca

SEQ ID NO: 132160 - DNA, 256 bp, Homo sapiens
gttaagacacctgcatatattcacatatattaacaagagagagggtttgaataaatatgacaaagtaatatttatttaatattacaaaacaaatacaacagtgttaatgattggtaagtaaaagcattaaaaagaaccaagctggttacagcgtgtcatgtctgtaatcctagtgctttcagaagcacaggcaggaggatcacttgagcccaggactttaagactagccagggcaatatagcaagaccgtctttac

SEQ ID NO: 132161 - DNA, 438 bp, Homo sapiens
gtactccagcctgggggacagagtgagatcctgtctcaaaacaaaatcaataaaagcagtatgtatagttgctatcaactatatagaaatggttttctccaggtgaactctggtacagaagccaagtcacatggtacaatacaggtatggatataaggtcccataaaggaatgactagaaaccaaatccacagaatgttattttcagtgagaacaaattactgtcccccctcacaaggaaacttagtattgcagttattcccatcaaagtatatttcacattggagctcagttgtggtaatgtttaaacttgagtggatactcatgttgaagatatgttcattgcctttgctgttaccaatctatcctgctgctccaaccctttaaccacgaagatgattagatattgatctgtccagaagatacctgtaaactcatg

SEQ ID NO: 132162 - DNA, 651 bp, Homo sapiens
aagtaatgtttatgagatacagaccataattataactgtatttctttaatgtttctcctaaaaactcagaaagtgttttcatttgattacattgttacagagtaggtagggtgttttggttaacagaaagccaccatgtatttcataagggtgttacaaatttccaaagaactagaatgtaataaaatgtagcagcctactaaatgtgatgtcatctttgcctctgtaagcatcctagagtttatagtattatgaccatcagtcatgtgctggatattgctgaagtggtgactcatagagacttccgcctactgtcatacaacataaacgtttctctaagaaagtataatattagctatggtgaagggctcactttatatagatagttagctgttgaaaaaaagtttgatgttcagcatgtcttctttgttacacacacagagaatttagaaaagcactgtgatcccagtaacattacatatactgttctacaggttgcttttgttcacttaacaaaatagacatattttcatatcagtgcatatagctctgtgttattctttgaagtggttaaatgagtctactgtatgaatgtcccattagttatttgagcagttccctgttaatggatagttagatattgttcttata

SEQ ID NO: 132163 - DNA, 789 bp, Homo sapiens
gaaacttcgtggatggggttaacggcagctgtattttctgggcgctccatggatggggttaacggcagctgaatttgcaaggaactccgtggatggggttaatggcagctgtattttctgggagctgtgctttaattggataaagtaagttctggtaagatttcttccttcatcttcggtatctcaaatgttttcatttaaataatctttataataactcttgatgtctgagggggttcccacacagtcatctattgtaagactttctgattcctttttttcctttggtcattatgaatagggcttctgtacataattgcatggtagcttttgtttggaaatcacatcaaagtggttgtcaaaatacttaggaatgtcgtttttggattgtaaggagagacttatttagctttggaaaaaactgcccaacttgtaataggtgaggaaaaataattttctctctatcttttcagaattcttagattggaccctctgtaacaaatgacagattaaaatgagaaaaatgtagaaaagtttaaaaacatgtataccttatggatacatgggcgatactcagggaaaaatgagtaaatctccagcaggtggttttcaattcaagtgtaaatactatcttcaacttgaagatttgaggcacagtagtggggagttaaccagcaaaaccacattagacaagagtaacgtttgttatgcagactgaagtccatgcgtcctccattgataagactctagtgatttagttatccttctcttcttggtgccgagagagag

SEQ ID NO: 132164 - DNA, 437 bp, Homo sapiens
ggagagattaaatgggaatagttgtataaaggccttggatcccaagctaaacagctaagacattttcatacagacaataatagggagccattcatgctgcaaaagagtacaaggtacttttttcaatgcctacgaggtacttttttctatgcctaagaatccaataaatagctctactctctgttacttgggttctagtgaataatttatttattagatttatagtacagtattaataagtgatatgaagaaaagcaaaataaggtattttaaattaaggtggtcaaagtgtatttttctagacattggaattaataacatttgtgtccctgaaggctataatacttgttctctcgttttatcttacccaactctaggaatgccttgggaactgccccttcagtctagatatctataatttaaaacttgagttccta

SEQ ID NO: 132165 - DNA, 199 bp, Homo sapiens
tcattatccccttttcgcagataaggaaactgaggcagagaggccctgcctaaggtcccccagctggtgggaggcagagacaggaaccagccctcatggtctcactgtgagactggacttttcacagctgtgcggtcgagtctgagccaagtaaagtaaagcgagtttttgtacttcgaagtctgggacataaaatctt

SEQ ID NO: 132166 - DNA, 393 bp, Homo sapiens
tagcatttcttacagggaagatctagtagagtgatgaactacctcagcttttgtttatttggaaatgtcttatttccttcctcgtgttttgccagtataggattcctggttgacattttttttctttcagcactttaaacattattagccttctgagctccaaaatgtctgattagaaatcttctatgaccatattaagtatcccctgtatgtgtgacaagtcactgctctcttgctgctttcaagattctctgtctttgacttttgacagtttgattataatgtgtcttggtgtgtgtcttttttagttcattatccttggagttccttgaacttcttcaatgtttatatttatgtctttcattaaatttagggaaaattttgaccattatt

SEQ ID NO: 132167 - DNA, 100 bp, Homo sapiens
tcgaattacaggcatgagccgctgcgcctcacctaaaaactttctaagaagtgatctcaattctttcctgaattgaggctttacgacattcagtgaaatg

SEQ ID NO: 132168 - DNA, 408 bp, Homo sapiens
agtacagacggggtttcaccatgttggccaggctggtcttgaactcctaactttgtgatccgcccaccttggcctcccaaagtgctgggattacaggtgtgagccaccgtgcccggccaattttattatattttttaatagtcctcagattagggatgttactgttcattctaagctctaaatgctttttagggtttttttcctttggatttcttagaaatacagaattctgtctctcctttttaaagtgatttttttttttgagacagagtctagctctgtcacccaggctggagtacattggtgcagtctcggctcactgcagcctccacctcctgtgttcaagcaattctcctgcctcagcttcctgagtagctgggattacaggcccccgccaccatgtccggc

SEQ ID NO: 132169 - DNA, 476 bp, Homo sapiens
aggcactacataaatatttgttgaatgaagtcatgattgaatgaatgaatagacaaatccaagaaagaggagctcagttaacattattctctatccttggctctcaactgagggaacgattttgtagtagaatgttttgaccaagggtacaccctctagggccagctcagccacttactaactgcataatcttaggccagttacttaacctctttgtacctcagtttcctcatctggataatggggttagtaatattacatactttgtaggtatgttggggaggttaaattaatgaatacacaaaaagcacttagaatagtgcctgaaacatagggaatgttccagaagtgtcagcctttattattttgttgcaacttaaaggattcacttcaattttatttattttttaaaattattgtttcagaaaattcaatgtaggtattgaagggagtgaaaagaaatcccatgattaaaa

SEQ ID NO: 132170 - DNA, 377 bp, Homo sapiens
aatcaatcggaagttagcaggtgaagtaaaggcaaacagaaatcgcacatgtgtggtgccgtggtcaagcaccatgggctctggggacaggagtgttcctttggatgcacaggcccatgagggcttccaggggggtgtggagtaacaggctccagcatctgatatggaggcaagagagaatcatgaggaggagtagaaagcaggcaaatgggaaatggagaggacagtcttgtatgcacctgcagagagggtgagattcaagggtccctcagtctaaaatgaaggcatggtaatgtgaattcagccttcccaagctgcttttcggtggcttggttgctaacaccatcgttgcatgtgacaaccagccttagcgcttg

SEQ ID NO: 132171 - DNA, 295 bp, Homo sapiens
  misc_feature (94)..(94): n is a, c, g, or t
  misc_feature (243)..(243): n is a, c, g, or t
gagtacagcctgggcaacatagtgagacctcatcataaaaacgaaaagaaaacaaaaagcaaacaacttttctatatttttaaggcctagccanaaggttcttttcaaaatatgactgctcattgacagtgcacctggtcaacaagagctctggtggagatgtacaagatgaatgttgtttccatgcctgctaacacaacctgcattctacagcacatggatcagggagtaattctgacactncaagtcttattttttcaagtaatacattttgtaaggctatagctgccatagc

SEQ ID NO: 132172 - DNA, 326 bp, Homo sapiens
ggaaatgggtggtccctgtggaggcgcgatgcacagagcaggaggagggagccgccctgagaggagaaaggcagcctgctaagcaagagctacaggaagcacttggacaggccatcgggccagaagcacctcgcaagggtgtccgggagctttggtgatgaagggcaagaaagaagcagctaagaggggggcctcatcacagagatgctgtcaaagattcaccaagcccacctaaaagtatcttttattacgggaactgcaattcaccttagcagcgcaagagggcatgattgcactaccaaacccagaaaagcacccacgcattc

SEQ ID NO: 132173 - DNA, 484 bp, Homo sapiens
gactacaggtgcccaccaccacgcccggctaatttttttgtatttttgatagagacagggtttcaccatgttagccaagatggtctcgatttcctgactttgtgatccgccagcctcggcctcccaaagtgctgggattataggcgtgcgaccacgcctggcccaaccatgaataattttttaaaaatggtatcaagagagcagctcagataattcatttaatataatactattactaataatacctaataaactaatttcattctatgtatgagctttatgaagttaaagaaattagtatgttagaaattcatgttactcgtttaattaaatcattatctccaaatggatagaaataattttaaactagtattgtgacagtaattccataatgctcccaaattacaatggctattctaggagagtagtagagtcagttcaaaaacagaaacacatgttctagattcagacaaacctgggctta

SEQ ID NO: 132174 - DNA, 480 bp, Homo sapiens
gttaaattgttgtccctgtctccccactacaacttcctcctaccttatagcattgttttcttgaatactggctatcctccagtctttgagatgctctcgctagcctccttttattttactaaagcatatagtaatagcatggtaagatttatatgttttgacttgactctgctaccactgtcagtcatccagttaagttataagatcctttgttattccctgcaatgataaatatttcagaattccttctcttttcttctgatacagattttagttctgaacctagttctgtaatcattggcttttctccagttacaagttttaattcctttacccctgttctatttcatttcagaaaccagccttttaaagttccagttagcttccaagttactgctattgtgaaaactgtataacattgcttcttatactgaccatgaattgtgatactggacctgtgctttcttctcacatcctgcc

SEQ ID NO: 132175 - DNA, 200 bp, Homo sapiens
tttcaccatgttggtcaggctggtctcgaactcctgacctcgtgatctgcctgccttggcctcccgaagtgctgggattacaggcatgagccaccaagcctggccaaagtgtttaatttcaagcagccacaatggcacagactcttgaataaaaccaacaaaataggccagtgatgatacctgggggttacaagcttccc

SEQ ID NO: 132176 - DNA, 602 bp, Homo sapiens
gagtggatattgcctctccagcaggctaaccctagctagtttcaagcaggtgccaaatgagtgagtggaggcatgtgaatcctctcatggctcactcttggcactggcacgcaactacttctgaagcattttcttggcccagtttcaaggaatgaggaaatagtctctattcttaatgagaggaactgaaaagtcaaggagagtggatatagaaaggcatggaaacaatgggaacacaactattctattatgaaaggtattatgtgcatacacttcaaaagttaagaaacttactcaaggtcataaagctagaaagcagcagagacaggatttgggccttaatcttctgaccgaaaatctcattctctttcaacacttctttctaatattgctgattgatctgtgcagtccagatgtcacagtgtaattagtttctaaaataaatctgttcttagattacttttgaatgacttctaagttattataaaaaagttctttgttgtaataaaggtattaactttccatgagtatattcttgacccacacccataagcatttttgctcatatttgtatccacaataaaatgaagttcatattttca

SEQ ID NO: 132177 - DNA, 1113 bp, Homo sapiens
acattaagccgtggtcgtgccactgcactccagcctaggtaacagagtgagacccggtcacactcaaaaaatacatcctagatattgaccacttcatcattcttacttagcaataatcgtttcctgtttcctcctgtcttactccattttcacactgctataaatttactacccgagactgggtaatttgtaaaggaaagaagtttaattgactcacagtattgcatagctggggaggcctcaggaaacttacaagcatggaaggcaaagaagcaagtacctgcttcacaaggtgccaggaaagagaaagtgagcagaaagagccccttataaactgtcagctttcgtgagaactcactcattatcacgagaagagcataggggaactgcccccatgatacggtcacctgggggtttacacgtggggattacaattcaagatgagatttggatagggacatacagccaaaccatatcacatcctgaccatgctttatgatatagctaagaaagtctacctgctcttttcccatgctaaactctgatgatctttcctgattcctcttgccagaagctaatccagtgtggacttgagcctgtagtcttagctacttgggaggcagaagtgggaggatcgtttgaggccaggaattagaatctgcactgagttatgatcttgcccctgcactccagcctggacaacacagcaaactctatctctgatgagaatgctgagaacacattctattctatactgaatttatgttcccaggcaaaagaataaaaaaaatacaattttaagaaaaaaaaagggaggcaggagatacagtgtctcacgcctataatcccagcactttgggaggtggaggcgggtggatcaccagagatcaggagtttgagaccagcctgtccaacatggtgaaaccccatgtctactaaaaatacaaaaaaaaaaaaattaggcatggtggtgtgtgcctgtaatcccagctagtcgggaggctgaggcaggagaatcacttgaacctgggaggcagaggttgcagtgagctgagattgcaccactgtagtctagccagggcaacagagcatgaccctatctcaaaaaaaaaa

SEQ ID NO: 132178 - DNA, 435 bp, Homo sapiens
ctagcctttggaagcttccaaactggtggtaaggagagtggggagaggtaaattcataaaatatgcataatctgtagtgggaacccaggtttttcaacttttgaagtttattttctcactcgaaaccttttatgtaaactcctttgaatacccacataaaggaaagaaagttggtgctgataaactagtgggcagcaggttcatggtggttcagggtcggtcagcaaaccagtgccaacactgaagatgatgccaaacaaaattgactgcaatctgttctagccaggatcatggtttagatattttctagccagaattaattaatttattatttttttctttttttgagacagagtctcgctctgttgccagctgagattgcaccactgtagtctagccagggcaacagagcatgaccctatctcaaaaaaaaaa

SEQ ID NO: 132179 - DNA, 699 bp, Homo sapiens
gaaaatattgttaattttctttaaaatactttgattattgtgttgtaattatatagaagtgtactgttcttaggagatgaatgtatttagagaaataatcacgacaaatattcatcaaaagtgtgtgtgtagaaagagagagagacaaagcagatgtgcaaaatgttaacaattcttgaatctaaatggagacttgtggtacacaggcttacagtagttcccatgattccgactcctggtgttcatactcttatgtgacacctctccctctcccttcttgtgagcaagaactgtgacttgcttctggacaataacatatggcaaaggtgacaggatatacatgattacctaagttctctctttttcctttattagctttgaggaagcaagtgaacatcttgggcaatcccaacaaggaagtaacatggcctctatggggtgagggtagcttccagctgacagccagcaagaaacagaagacctcaatcttatagatgcaaagacctgaattatgcctataatgtgagtgagcttagaagttattttttcccccagtcaagcatctgatgagaccacaaccctggctggcatcttgtacagtcttgtgaaaccttaagaacaggatccagctaaaccatagccagcatcttgagccacagaagttgtgagataataaatatatgttgttttaagctgcta

SEQ ID NO: 132180 - DNA, 731 bp, Homo sapiens
ccctaagccatttttgaagagaggacctgccctagctttatgacttaagaccatgactatgcatcttaagttgcccctctgactgggcagctttctcctgaacacagtgaggaatgctaagttacatggtccagtaactgagtggataccctgagcctctgcatcccactggctgctatgcagggataagtccatgcacctgtggatggcagtggttgagctggttctctataaaagtatccagtgcccagacctttgttcacacatgcatgtaaatttactgggaaaactctagagaccaatgttctttcttccacagaaatctggcctagcagtctattcttaaattgctctttgtgtgtaagacacatctgtttgataccccactctgccctgacttttaggcaaatccgttaggacagaaccactattttctttccttccctttgaatcatcttttaaagcagcagaggcaaatgttggcagaggtccacattggaaagctagtgcatcacgactggtgttggtaaatgaactagtgatgggattggggcagctgggctttgaagcgggtgctgtaagaggcactgctcctgtgcatggcagaggtttcagggaaaacggcagctctctgatgttttgcccatgctgtatgattttattcaatgcagttcttcttttatattgaagattcttgtttttatatctaggaatgtatcagcctttccagt

SEQ ID NO: 132181 - DNA, 107 bp, Homo sapiens
tccagggatgcaggcagggatggtgataactgggagctggccgtgggggcagcacagctgagagaggagggtgcagggacaggactgagggacacgatgaggtgggg

SEQ ID NO: 132182 - DNA, 261 bp, Homo sapiens
tctgtggtcaatactgtggactccaccttcatatcaagttcatccagctctataacatagaggtctatgaccctgggcaagttgcttaaccacttaaacttcagtttctttatccataaaataagaacaatagtagtagctacctcttagaattgctgtgaagtttaaacaagttaatatttctaatcctgcttagaactgtgtgtggcacatgtaaagtgcccaataaatcttaaatcattataccactaatccacacta

SEQ ID NO: 132183 - DNA, 314 bp, Homo sapiens
gaaccagtattagattaggagaccagttctcctgagtcctagtcctccaatacactgaattcacaggtttggctgccttaaagaggcaagggagaggagcctgtgtgttgaggattaaataaaaatagtggaagcagaaagcccaatgcccagaatacaagggtatgtaaaaaccaaagctactactgaggaactatcagtcaagagactaattctcattaagttgtcaatgactaataagggaactctctatccccatgctagaaataaaaagacagctcttaacaaaaatgaaaaataaataaataaataaa

SEQ ID NO: 132184 - DNA, 355 bp, Homo sapiens
ccagaaaatgtactacacaacctttaaggtcctgttgggaaagctgtgggattccacgagaggaggatctgccatcagaaggccctgctgcttgcatgcttcctacctgcgaactgcactgagagctgagatgagaacagaccatgcagctggcagctctagaggaatggctggtctgtctccccggccctttcctgactgacttgtcatctctcatgctctatagttcacttaggtgtattttgtgttcttttatttccccacactacccagaatataaaccccaaaagggcaaggattttttttttgagacggagtctcgctctgtcgcccaggctggagtgcagtggcgtga

SEQ ID NO: 132185 - DNA, 486 bp, Homo sapiens
cctccacccacactaatttatgcattctttaaagccaaaggaatcaaagtgaaatttcacacctagtctgtatcaagcatgtgctaggttaatttaaccttactgctctgtgaagtaagtaagcattgctggccattttattgttgagagaagtgtcattcagacaactaaggtgacttgtagatttcccagctagtgagtggcagagctgggttccaaaacctaaatattgcaaatgccttgccttgtggctcaaacgctatcagtcaataaatagttaaggaattgaaatatatgttcctagagggaaacagacttctagatttaaagttttacatttgctgcatttctgactgtacaagtctacaaaatgcatataaaagtatgctaatgaatgtccttttaaaaccactcattttctacgtaagcatacaaagtgtatacatatgcatattaatgaatgttttctgaaacttctcattgtct

SEQ ID NO: 132186 - DNA, 819 bp, Homo sapiens
ggtatacatgcgaaggatatatatttagttgttttttaggatggcatatgtgtcaatatagtacagttgacttacagtgttgtaccagtcttctgttttcttgttggtcctatctgttattgaaagagtggttttgaagtctcccgttattattgtttaattgtatagttctgtcttaaattttgcatttttaccttatttatttttgtactgtgttaagtgcatacgtgtttataattattatatttttctttgggcttctctaatttcttaacaatttcccctgttatatataatgatgtttttgttttagatgcctttttttgtcttatattagttatagccagttcatctttattgtggttgctatttgcatgatacatatttttttcattattttacttgaagtatatatgtttttgaatttaaattgtgtctcttctctcatgtcttttgttcttctatttttgctattttattttgtattgaaataatattttctaataaagaattttaattgtattatttttctttcctttttttgattgctttgaaaggcagcatttatttatgtggctatgttctgagaactatgaaacaaataatttcattatattgtatcacaattcataccatttttcctgtatttatgataggaaaatatgacatgaagcatggtgtatacttaatgtctcatttgttttacaaactaagaagtgacaaaggaaattaacccccaaaattacagacattagaggtctactctgctgcttattgtcacatggtaactacttgtgtagaatcatatggagttttaaa

SEQ ID NO: 132187 - DNA, 685 bp, Homo sapiens
tgagctcggtacccgtccaaacagtgccctatagcacacgctgtgcttccacacaccagagcagagtgtaattgattatgtcactgtcatgaccagttatcaccattgattacagtttgattggctctctctgtttcctgtaactgatttgattagggccttgtttgctcatctttctgatataaaggcacaattgtgtcctgagagtaagccctggtcatcttcctccaggaggatgttttcctctctctttatccacttcatgagtcttcctttgggtatatcatttttgcaaagagctgatgccatccactgtgaattttactagtttaattttcagaagttaacctgatttccaagtttagggaggagcacctcattgttcttttgtgctgaaaaacagagagcagcaggttagttcatattaggacatgttccatagagtcagcagtgaaaagggtcctgaaaaagaggtaggatttaaagcagtgacactggggacaggaagaggctttccaagagtggggaacagcatgtcaaaaggcagggaggcctctgaacagtaagtagttcagtttgactggagtatggattatatttagaaaagtatctaaaatcaagatcaaaaaggaaagttgacagcagagaatgaagggcctagaatatcaggcagagaaatttggaa

SEQ ID NO: 132188 - DNA, 514 bp, Homo sapiens
tctggaaccaaacagtcaagttactgaaggaaatcaaaagtgccactccgatgaacacacaaaaaagaaatcaaccttattgctgatatggaaaaagtttgctggtttggatacaggatcaaaccagccacagcatgcctcaagccaaagcctaatccagaacaaggccctaactctcttcatttcaatgaagattgagagaggtgaagaagctaaaggagaaaagtttcaagctagcagaggttggtcatgaggtttaaggaaagaagccgtctccataatataaaagtgtaaagtaaagcagcaagtgctgacggagaagctgcagcatgttatccaggtctagctaagacaatcaatgaagatggctacaacaaacaatgaattttcaatgtatttggttggtgcaaaagtaatggcagttttgccattgaagttacttctacaccaacctaatagatgaaacagccttttattggcaaaagatgccatctagtactttcatagctagaga

SEQ ID NO: 132189 - DNA, 329 bp, Homo sapiens
acgggaaagctctgggttgaagaactggcaacaaactaatcaggaatattggacccccaaaagagagagctgaaaaaaataaaattcacttccccagagaaaaaccagagaactgtctcatatggatcggtccactgagatgccataaaagagaaaggcccatccactaattgccaggaaagtcttccagtacaggaagcggagagaaataaagtgattacaggttttatctggtatgtagtaaagttaccttgagcccaagatcgggcaaggtcatagcatagacttgtgaaggaacaaaagcctctgaggtcagtccttaggaccac

SEQ ID NO: 132190 - DNA, 457 bp, Homo sapiens
ccagatggggaggggctgggagagactgacattctgttcagattccaggctgtggagctgggccctggagcagccacacttggcggctgtgagttggcctcagggtcctgctgagtgccaggtccctgcacaccctcacagtccctgggggctggcggtggcattggcattgctgagggtcttggccaatctgttagggaagtggggtctccggggccgagctctgctctggggtgtggatagcacagcgtctgccgggtgctgcgggagccttttctgtggggatgtgggtcctgcaaatgtgagcaccagctgtgattaaatcaaggacagtgaacagcagcgccgtcatcttcatgagttcacaaaaacctattgctttatgtcttattaggtgaatttagaatgtatacagggtaggaaaagcagcagaaaatagcaggtgtgtttgggaaga

SEQ ID NO: 132191 - DNA, 161 bp, Homo sapiens
gcctaaaattctacattccgtaagtctagcaatttgaactgagtcatagtccataaaggactacagagtgtcaggaagttttattagtggtggagtggctgagctgtcatttcaacctgctcaccatctggaggaaaaaggggcaatacctctcatccaca

SEQ ID NO: 132192 - DNA, 909 bp, Homo sapiens
gaggctttgcggtggctgcttggcttggcggtggtcgcttggcttggcgtggcagtgatcgcttggcttggcatttctggcttggcggtcctcctttcgcagattggaaaccgcgggctatcctgctgggaggttgtggccgaggcagtagctcgctactgatggcctcctggggtggagaaaagcggggaggggctgaggggtctccgaagctggcagtctacgccacgaggaagacccgtagcgtcaggagccaggaggaccagtggtacttgggctacccgggggaccagtggtcttcgggcttctcctacagctggtggaaaaatagcgtcggcagcgagagcaagcacggtgagggcgccttagaccagccccagcacgacgtccgcctggaagatcttggcgagctccacagagctgcccggtcgggcgacgtccctggggtggagcacgtcttggctcctggagacactggcgtggacaagagggataggaagaagagcattcagcaactagttcctgaatataaggaaaaacagacacctgaaagtcttcctcaaaataacaatccagatgggcatccttactaatttgacccttagtggatgagacctgtccagagatccaaggaatctgaaagtggtggataaacaggccatctgtatcacccattcaatggctgaaaatcagtcaggcaacccagagaacgggacaggttgacttgacaggaccgggacaaaatgggcccgggggtggcctccctcggggaggaacctccggaacgggcacccagccgaaaaagaggcaggcgaaagagtgggcgcccagaggacacaaataggggaaaaagccgcgagaattaggcccagaaggaaaaaaaaaggggccggaaaaacgggcggaaaa

SEQ ID NO: 132193 - DNA, 188 bp, Homo sapiens
cctgctccctcgttttcctggaagaaatgcctacctaagacacagacacctgcatcccacgctttgtcacccaatgcctgtttccttaaggagaaaaaatgggcgccagaaaacttctaggtctagatcctggctctgttgctcgctagttgtggaacttgggacaggcgacctcacccttctgattt

SEQ ID NO: 132194 - DNA, 618 bp, Homo sapiens
attttacattagcaaaaaaatgaggaacaacctaaatgtccatcagtcagggatttataagtaatagtacatctagccgggcgcagtggctcacgcctgtaaccagcactttgggaggccaaggagggcggattacctgaggtctggagttcgagaccagcctggccaacatggtgaaaccccatctctactaaaaatacaaaaattagctcggtgtggtagcgcgggtctgtagtcccagctacttgtaaggctgaggcaggagaatcacttgaacccgagagacggaggttgcagtgagctgagatggcaccacggcactccagcctgcgacagtgagactctgtctcaaaaataaataaagaaataaagaaataataaataaataaataaaaaatagtacatctacatgatgaaattcaatatcggtatttaaaggaataaggttgaactatcatactttatcaattctgaaataccactaaatctaagataagccatctatttagtagcaattttttagcaggaagaaagtaaacataaagcttttattaataatagcatacatttattcattcaattgtataccattttcgtctgtcacaataaagtttgagt

SEQ ID NO: 132195 - DNA, 672 bp, Homo sapiens
aaaacttctatgttcaataatgcacataataaacttgtaactgcaattcaaaatattaataataccatcactattcagaagcaaacaaaatagcaacaagtttcctaaaagaacaatgtctaacgcctccccgcaaattccaaaattgaatcactgaccagtttataattcaagtaaggatatgaaaatacaagagtcctgatttcatcaacatctaggactccccataacatgttagtttcaaacagcctttttctctcagcaagagtgctttcttgcctcttatctgtagccacttctcaaaatgagaacatgacattactatagccaaaagtcaatctccttgtctcatggtcacaagctaggtccccagccaacactgctctctcaaaaatggaagacaacaaaacagggccaggcacggtggctcacacctgtaatcccagcactttcggaggcagaggtgagtggatcatgaggtcaggagatcgagaccatcctggctaacacagcgaaaccccgtctctactaaaaataaaaaaaaattagccaggcgtggtggtgggcacctgtagtccccgctactcggtaggctgaggcaggagaatggcgtgaaccctgtagttttaggacagcaatgagctatgactgccaactgacttcagcctggat

SEQ ID NO: 132196 - DNA, 179 bp, Homo sapiens
gacaggcaccatgctaagcacttaagcactttacacgcattatctcagataagtcacctaacagctctctgagttgctgtagtaggcacaagcaggacatctagcagatgcaggacatctaagtcagatactttccactttccacagtgtgactttatcagggacatcatagctgttct

SEQ ID NO: 132197 - DNA, 252 bp, Homo sapiens
aggcaaattctattttgcatacatacaaaaggagataagtagttgaattttgaatattttaaaagagcatcactggaaaaaaatctttctttaaagtcatggattcagattaaagatgtatatcacaaaaatctttttaaaacttaaatatctgtgtaaattgtttaatactactttcttcatattttcccaattagcttgactaatattccagtactatttttttttcttcagagaaaatgactacaagaa

SEQ ID NO: 132198 - DNA, 326 bp, Homo sapiens
tcctcctctcacctgaagatggagcactgagccagatgacttttcattgtctcttgttataattttccacatgtggttttgaactgggagtagccattaggtgacgaattctgaaaatgggctaaatgacatgccaaaaactgaaaaatggggtgtgaagaatgtgcttcttgctttctaaagcataaccataggaatgcagggcttctgaatgtcttctttttcttaacatgacaataagaaacaaacaatctttttcttcatctgtctatttttctggcttccattttttaaaaaaatcgtgaaaaactatctttctctatagg

SEQ ID NO: 132199 - DNA, 492 bp, Homo sapiens
tgcttacacctgtgagcgctgatgggtacggctgggtgcttacacctgtgagcgctgatgggtacggccgggtgcttacacctgtgagtgccgatgagtacggccgggtgcttacacctgtgagcaccaacaggtatggctgggtacttacacctgtgaatcttgcggtcctgggcagcatacgatctcaagaggacagagaggctgggtgctgtggctcatgcccttaatcctagcactgtgggaggctgaggtgagaggattgcttgaggccaggggttcaagaccagcttaggcaacatggcaaaaccctgtctctataaaataaaaaataaaaaatttagccaagtgtggtggcacgtgcctgtggtcccagttacttgggaggctgaggtgggaggatcacttgagcccagcaggtcgaggctgtcgtgagctataattgtgccactgcaactccagcctggacaacagagtgagatcctgtctcac

SEQ ID NO: 132200 - DNA, 640 bp, Homo sapiens
ttttttttttggtattgctaaaacaagcatacattactttcagagtaattaaaagtgacaattttattttatatatatttttaatttttattttattttgagttagagtcttgctctgttgcccaggctggagtattgtatttgcatgagaggagagcaagagatataaaatatttaactggtattcaaaagccaattttaaacaattcaagtaaattctaacaataatgtaatgacttctttcacaaaagaccaaatactcggcaactcttttgccccagggtctctagttagttagccgataataagtcctacattattctgctataactttgacttctcctagtcttttcttttctaaaaatggcctcaaaaaacaagtccatgattaatttactcttcctataagtatcttaaaaaaaaaaggtctctttatttaacacttccaccttccagtccaaaaatgttaaatgaaggcattaattcagaataatcttacaatgaacaggtctgagggctatattcaacctcactggttaaaaaaaaataaaaatatgaaatacctttttctacttatcaaataactacaacttttacatgatctcagcattggagaggtatgatggacaggcatctcaca

SEQ ID NO: 132201 - DNA, 675 bp, Homo sapiens
gcgcacctgtggtcccagctacttggaaggctgagctgggaggactgcttgagcctgggaggtccaggctgcagtgagctgacattgtgccactgcactccagcctgggtgacagagcgaaaccgtgtctcaaaaaagaaaataaactgctttgaatgagggtgaaggtattgtatttgcatgagaggagagcaagagatataaaatatttaactggtattcaaaagccaattttaaacaattcaagtaaattctaacaataatgtaatgacttctttcacaaaagaccaaatactcggcaactcttttgccccagggtctctagttagttagccgataataagtcctacattattctgctataactttgacttctcctagtcttttcttttctaaaaatggcctcaaaaaacaagtccatgattaatttactcttcctataagtatcttaaaaaaaaaaggtctctttatttaacacttccaccttccagtccaaaaatgttaaatgaaggcattaattcagaataatcttacaatgaacaggtctgagggctatattcaacctcactggttaaaaaaaaataaaaatatgaaatacctttttctacttatcaaataactacaacttttacatgatctcagcattggagaggtatgatggacaggcatctcaca

SEQ ID NO: 132202 - DNA, 408 bp, Homo sapiens
tttttctaatttatcactttgaaaattttgtagcagttctaacacagagacactttccaaagccttaggactgatacaaaatccagtggagacacagaaattaataatacaatcagaacagtcaagaaaaaaagagacaggagaggaaggtaagcaaaaagcaacataatcaatggcaattataacttgctgtggcagagcaaaaggagaaagctgtgtgttacataaaaagtcaaagataataaagcagaaaatattaacagacaatttcagcaaaaacataatgaatttgatgccatctcccctcgacagtcaaaaacagatcaatgaaattagtcactcaaaataagaatggccaaaaaaattgttttaatgattttttacatctcagctcataactctggccag

SEQ ID NO: 132203 - DNA, 856 bp, Homo sapiens
ctcaaactcctggtctcaagcaattctcctgcctcagcctcctgggtagctgggactataggcattcaccaccatgcccagctaatttttaatttaatttttttttttgagacagatctcactttgtcacccaggctggagtacagtggcgtgatctcagctcactgcaacctctgcctcccgggttcaagcaatttttgtgcttcagcctcaaatttttaatgtttttggtagagatgggatcttgttactttgcccaggctggtctcccattcccagactcaatcaatcctcctaccttggcttcccaaagcactgggattacaggtgtgagccaccatgcccagcctccaactttattcttttgcatgtggatatcaagtttcccctataccatttgttgaaaagactgcccttttcccaatttgtagccttgatacccttgtcaaaaatcatctgaccatatacttgagagtttctttctgggctctggattatattctgtctctgtctttatgccaggaccacactgtaatatgttttattttgtaaatcaggaagtgtgagtcctcgaactttgttctcctttttcagaattgttttggttatttggagccccttgagattctatctgaatttaggatgaatcattctattttgagtcaatttttgataaacaatatttttctaggaacatgcttttttttttttttttttagacagaatctagctctgtcgcccgggctggagtgcagtggcatgatcttggctcactgcaacctttgcctcctgggttcaagcaatcctcctgcctcagcctctcgagtagctgggattacaggtgcccgctaccacg

SEQ ID NO: 132204 - DNA, 201 bp, Homo sapiens
ttcatcgagccggtcccaagttatagaaaaaaaaagatttgaaatttgaatacatgttccacatacaaatacaggcctataatcatcattgtgcataacatacataccctgcttcctgtcttgagccaagcactatcaaatttgggatcagacattccatctcactttacttatacttagtgaaccatttgccagagtctc

SEQ ID NO: 132205 - DNA, 1721 bp, Homo sapiens
tgagcagcctcctcctcctcttcatggcttaaagaatttccctcctggattttagcactgattccctttctgtgctttccactttccaagtgagtcctcttcaagactttatatctttatgaagctttgttattgaccttcactaagtctcttttttattttctcttctctttctgtaggaagccctccctctaaatgattagatcagccactgactcacaggctacgggacatggcaaactcatgcaaggcttacggcgtttcaccagttgctgccataacagcaggtccttttcctgccccttttcttttctcacacacttggcttcagaaccaccatctatggacatgagtatatcacagaaccagagtcctgctaagaagggaattttttttaataactcatggttgcaggtactattctccagcttgattttggacttgaatcagaccctcccacctactctgatccctacacctccctgttcctgagcctgtagttctttctgaattcccaggttccctcatcctgaccattggtatctgtcgttttccacatagtgtctagttcctcctatgctggagaatctttcatccctaatataacatatttaaaattaggatctaactttagaggtaatttcatttagtcctctcatttcaaaaaactgagatccaacaaaacgcagttaatgagagagccagggctcaaacccccactgcctgattctaggttttggcacattccattatacgaggctgttttgtggttcatcttctccatctgagcacgcagtgaagggccacgtctgatagacacttgggcatcatgaaggttagtgagtcagcctgaaggacacttcactaacacttactgttagcaagggcatgtctagttcatagcttttcttatccaccattgttcttcattctgaaaagaaagcttagttgtctaattggtaatttctggaagaaataagaaagagtacccgtgtaaatataaataaataaattctttttatcacccaaaacttaaatcatccccaagtatttcagaaagtttaatataatggatagaacataaattacttttatgacttccaggatattactgaaaatctatttatgttattttggctttacattttattgatttttaaaattttaattgtcctcattttatcagtaaaatacataaaatgaatctaagctcatacataagttaagtttccaggaatagagggcagtaaatgagtagtaattgttttttctggttttatttgttggattttttttaagtcaaaagctatacctcaaatgcagtacttcaattatcttacaccttgtacctcatgaaggaaatagagtgattggaattttataggaccctcaaatctaatatttttattacagtctcagcaatatggatttagtcaaaagagatggaggaagttatgtaatttcttgtgcatgccctccctcatctttagggctttagaaagtttgtattattttcctattatggagacataatgtgtgtgttctttcagtgtctgtattttcctttttaggaaaatttcaaatgcaatattaagagatcataaggcatttaggcattatgagacgttttaaaattacatctgacaaaatgtgcgcacagcagaacaagttcatatttttcattttgtttttcataaaccaaaaaaagctgacaattcact

SEQ ID NO: 132206 - DNA, 566 bp, Homo sapiens
cagctagaaagaaatagttggggggagagagagacagaaagagaccctgcgtcctccgcccttcctccctcctccttcctcctctgcccgcttcgggatgcagggataactgtgctaggtgcctgcctgtggcccccagtcccttttcctgtccccatccctttgtctttgggttcctaaaggatggcacagagcctccaggagcggagtggggcggtgtaggcagaggacacagctcctagcagcaagtggaagcaggaaacggttctgtttccaggagctttcctcatgtggcccgggagatgagggggtaggggaccaggggactggccacggaggagcttccctcttgctctaccctcataggggctgggaagtgggccgtgccgtgggagcaccaattacctgttgtcagcacgcagtgggacccctgcttgacccctggcttctgccacccaagccggagtgtcctgcttcctgccattctgaaccccaaacatctccctgaggtcctgtctcctccttgcccccttgccctggcctgggctttgtcattgcaggcctgg

SEQ ID NO: 132207 - DNA, 205 bp, Homo sapiens
gctctacccatagggagaatactggtatcaggccagctgtctagactccggccactccgaagcttctagctcagcccaaactgctcccgtgagcccctgctggctcagcatctgcccaaagatgtgtgttgggcatgtcaaactcaatgcaccccaactcagtgcctattacccccttttccaaaacctgtgccagcagccatct

SEQ ID NO: 132208 - DNA, 527 bp, Homo sapiens
aacattccacagggtaagcatcagcttctttcgtacatcatcagagatagaccacagctttgtaaccaagaggaacctaaggtgtctgtggtcagaagcagctcagaggccaatatatatgttaataaaattgttttgttaataatatggggcaaatcaagtttccagaaactcttgagtttctgaaggtagaaatgaaaggctgcactttggtgacctgaggaggaaaatgtgtagaatgcggcaagttggaaaaaaacagattgatggggctagtgatcaaaaaaacagacaagcacctgaacatgatacagtgtctgctactgaggacacagtagagccctcgaggggttcttgtgaggacaagagaggctcatgttggaggtagatacgagtctgtagtgttgcagacagttagctaaggagaaagttgagagaccagttcattcccacacggagaaaaggggtcccattcaataagattttctgtgtctcactccacagaatttctctctcttttaaaagat

SEQ ID NO: 132209 - DNA, 472 bp, Homo sapiens
aatgctcaccactatgacctgccagtttttgtacttttggcacagacggggtttcaccatgtttgcggggctggtctcaactcctgacctcaagtgatctgcctccttggcctcccacagtgctggggattatagatataagccaccgtgcccggcccattcctgtctttttaatttaatctgctcgtccctgacatcgaaaatttttcttgcttaacagcttccacttatttctcggaatagacctttttctgcaggaagggtgtagttgattcaaccctcacccactcatgccaaccgtagtgagtgctgtgactgcagctgcactgtttatcctgttttctgcaggtaatttttccagtgtaccattccaacctgcaaaacctcacatttaaatgcaaatttcttggtaagctgtgaaatgttggctgtggctaatatgagaaacaagctattatagacaagatgaatc

SEQ ID NO: 132210 - DNA, 155 bp, Homo sapiens
ataaaaggcactatactaggcacatggcacgcaagctttgtctttaaaataatatgattatacatattacaattaaaaatcaaaagacaaaagtatgtagagaggtaactagaagctctttgttacaaaaagctttctatttatagaaagctatg

SEQ ID NO: 132211 - DNA, 366 bp, Homo sapiens
ctccctagcttctggttcactttttcttttctgcctcgatttagctgtctctaagctaccttgatttagttgtcactccaccctcaatgattggctaacaggtgtcaggacatgtctggttttaaggggtaccctcttttgagggatgcccaaacaaacgggcctggaagagaggttctggcactctgaggacacttccctagattctcacacttaaattgctgtccgagtcagacaggaatcacgttccaatctgcatggccagtgagggaaaaacagcgaagccgtcaaaagcacatgtgcctctccctctcttcccactgcgcttcccgctatgagttccgggatgggaaacccagttcagtg

SEQ ID NO: 132212 - DNA, 708 bp, Homo sapiens
gtcgcccatgctagagtgcagtggcacgatctcggctcactgtagcctttgcctcctgggttcaaacaattcttgtgcctcagcctcccaagtcgctgggattacgggcgtgtgctaccatgccctgctaatttttgtatttttagtagaggcagggtttcgccatgttggccatctggtcttgaactcctggcctcaaattatttgcccacctcagcttcccaaagtggtcagattactggcgtgagccactgtggctggccagtaattttgtttttaattgaactttgaaaacgcagttctatcattggtgttctatttctagccgactcagactttcacctggcaagttggtctctgtatttgatttgtaactccttatttaaagcaatttatgaggatgcataaaactacaaaatgcctcagataaaagtaaggagaaagaagaaacaaaaacaaaagataaagataaagtcaagtcaggatgtaggccaaaaaggtttattataattttcttcctacaggcagagcacagatttgactctgagctttctaggaaccagcaggagagaaaaacttggtagtttatttttttacagtgtccttaagatacaaaataactagatagttcagaaagataactaaccacttggcactatcaggctagagcagaagtgtccaatattttgacttccctgggccacattg

SEQ ID NO: 132213 - DNA, 580 bp, Homo sapiens
tacttcacctttcttcagaggggaaacccaagaaaggtggagtctggatccttgattgttaaggtctctcactctgcttaacacacctttcattgtgtgggattaattagcaggtaattcaacttgagggtttaggtttggtatgctacaaatgtcacaatgttagggtagttcataaactgttagcaactagctgtgtacttttagtgttttacaatagtatgtctattgtttgtatgtgagagattcagagagagagagagaaaatgagtcttgtttggcaaatttacactataacatatattcatcatctttaacctagagataatctggtattatgtgtattaatgatggtaatgttctaagacataaagcgtcatcactgtaggcttctttgggcaatcattcgtttattgggacctttactaattgctgagatttgtgtgaataaactgtcaaaagacttcagaagcaaattatcttaaaatgttttgcaaagtttgaaaacagtggcagtgtgatctccagataaagctaagttcattgttaacctctttctggaacatcttggtgacatata

SEQ ID NO: 132214 - DNA, 461 bp, Homo sapiens
tctagtggcccaaataagcatgcaatgaaactagcttatgcaaaatagcaataataataacaatctgttcatattgaaaactttggaaattttgcattgaaggagaatataggacatgtcggtgtaacccagtacaggattccctctacaaccatcttcatgcatgttttgcaggcaaatgggaaatgaagaaaggtcaaaagaaggaagggagggagggagtaaagggaagaaaaagaaaagagatgaacggcgacaagcgggcagggggaaagagcgggactatgtagtgtagtgtttcgacgtccagcagtaagcattagccttgagggctcgtggtttaggagtgaaagtttgggccatcacagcagggagagaatcctaacaggttgacgtgctgcctgagggcacagggggtgagatttgggtagagaacaaaagaatgaacatagctgaagtca

SEQ ID NO: 132215 - DNA, 316 bp, Homo sapiens
attgaggatttttacctctctattaataagagagagtgggctctagtgtttttttggggggtggtgcgtgtgtatgtgtatagttctttgtcaggttttagtattagggtaatacttgcctcataaaagatgtgtcccctccttttattcatcctctttgttttggaagagtttgtaaataagttagtattaatttttttgttgtttgttaaaattcaccagtgaagccatctaggcctgagtttttcttttgggtaggtttttttttggttttggttttttggtttttttttttttttttagtaattcagtctct

SEQ ID NO: 132216 - DNA, 719 bp, Homo sapiens
ggagtcagacactcacaggtcatgtccacagaatgttaaatgtgatgccctatcagggacccctctaggtatggatgcatttccccaaattctgacctcaggaccaagtataccatttaaatagattcagaaaaagtatttgacataacttaccattcttttatgataataactctcagtatattcagtgtagaacaaatgtacctcaacccaatacagaccatgcatgacaaatgcacaggtaacatcatactaaacaaaaacaagtaaggctttttctctaagagctataacaagacagggaaggccactttcatcacttttgttcgacatagtactggatgtccaaatctgagcctttagagaacaaaaaaaaaaaaaaaaaaaaaaaaaaaatttggggggcggcacttgagcgcccttgaaaaaaaggttctttttagaacccattctccgtttgggcaggcggggccccatattggttgtaagcagaaccggggctcacgacgaggtgtccccagagggaaaatccgcggcgccaacgacaaggaggcgctgggggatttctccaccccaagtaaaaaaagcgccgcggggggaaacacgacatgttttcgtgaaacaacttccccaggaaggagttcggaaggtcacaaggacggtgtacattaacaccggaggggtcccaaggggacgactcccattatcaaatttagccc

SEQ ID NO: 132217 - DNA, 185 bp, Homo sapiens
tcaggagtttggggccgtagtgagctgtgattgcgccactgcacttcagcctgagtgacagcaagaccctatctcaaaaaaagaaaaagtctcacccgttgtctctgtgtccttttagcagaagaaaaaaccaactgtcttctgtgaggaatacagggtcatcctcaggctagtctggaagagag

SEQ ID NO: 132218 - DNA, 331 bp, Homo sapiens
ctaccctggctgagggtgggtcggcctctcccagtccactgactcaaatggtaatctcctttggcagtaccctcacagtcacaccaggaacaatactttgcatccttcaatccaatcaagttggcactcagtgttaaccaccacagggaggaagggattttcctgagcacttgctgtgtgcggccgaccctttatgtgatctcccttcatcctcagaacacctctgtgagaggggattatcagccccctcatgtggatgagccagctgaggctgagagtggttagggaactgttttgggcagttctgtgtgaccacaaagcatagcaatgg

SEQ ID NO: 132219 - DNA, 184 bp, Homo sapiens
ccatattgctataaattcatgtcatttgtctcacttctcccattcaatggtacattctctaaagtgattggttaatgctatggtttgaatatggtttgtccccaccaaaactcatattgaggcttcatccctaatgtggcagtgttgggaagtggtgcctgtaagtagtcattgggtcattaag

SEQ ID NO: 132220 - DNA, 406 bp, Homo sapiens
ctggcttcctccttgactctattcaaactttttgccaggctcaccaatggtctttccattcagcaaacagttcccaaacacctgctgtctgcccagcactgtcctgatgctcgagtaccctatgtcttcttcctctccttccggagttctttctgtcctcctcgggggtggtgcgtgttctccttccttgtcatttccacagtcctcctgggcctgccttcctgcttgttgtattaggaaagctcccagtagggctctgctttcagatccttaacctcattcatctcccacagattcctaggatccccactcgtaagtatagacctgagccagtcttccatgctcaggacccacctgttcctgcagccctcatggctcttgataatctagccatcacctcttgtgc

SEQ ID NO: 132221 - DNA, 439 bp, Homo sapiens
ggaagttcattgtggaattagtttttctcatgagatttaatgttttaatgtttttcattttacatgaagaaggggacaataagcaaacgtattgcctctggaccagtatcaaatgcatttggaatttaccctgtgttatgaagaaaatattgtcagtctatcaaaagcatcagatagagttggtgatgacttccttctcaaacccttcattgccctctaggtttttcttccatttcacttggtgtttctaatttttctgtgctcagtcctcctaattattgttcatcagtgaatgttagaacatccaaggactcatcttccatgtcttcttttctttgcctacagtatctttctagcagatgttatcaagttcatatatcttctccacgctgattgcttccatatttacattcctgaccctgaccttgtccctaaattt

SEQ ID NO: 132222 - DNA, 352 bp, Homo sapiens
gttacaattattttattacctaacatactagatgaggacaaaagttctttaccccactttcccacttttataagtgagaaagagatatcaaagactcatctgaggctccagggactagatctgttacctaaacatcagcgtatgagcacaggaggaacaggagtggaaagtaaaggatgaaaaggtaactgcaatcatcagagtgcatgtcccattcatttcagatctccttgttgtctaggcttccttatgtccaatttaggttccttctaagaggtggcacaggacaaagccacaaccatcgactgggagaaagaaccaaaaggagccacctagtggccaagcaagcttt

SEQ ID NO: 132223 - DNA, 633 bp, Homo sapiens
gtcagacatagaacgccacccactccttccaaactacatacgaccaacaacctctgggcactcttccgagcttcttgttcatgctttatcgccaaggcctagaaaagtgaatgcaaacagttaagaaccggccctacattcttgctgtctctgcctccgagactcaggagccacttttcaagagccgagacaactcgttagagaggagccgtggcctgctctggccgaaaaccccttcctattaacagactgcaactagcccggaacgactttcaatttgcagagtccaaccatattccacaagacaatctaccacctcaaggttcacgcgtggattctacaccttaaatccttggatactgtctttgatttggagatgagcaaagaaaggaaacaagacaagagaaagtgacaaaatgcttaccaacccagaacaaagagtacctaggaggggcaaaatgtacaaaggaaagatgggactaaggaacagagaagtgatatgcagatgagaagagaatatggtttgtgttctagctactgttgcatttgtcttatgaatattaggaatgtatatgattaacgtgagttggttctattgcttaaatatagaaataagaatgaaaggtgattttt

SEQ ID NO: 132224 - DNA, 375 bp, Homo sapiens
gaccaatgctctgagctcacatgcctcccccagctctggttagcaggtcgctccaccttgcatggcctcggcctcggcctctgctctggagtcatgcatcctttaggagtagggaggttgctagcacaggattgtccatgcccaaggagggttggtgccaccactgagcccagcttgaagccaggctacctgaagagcaggtgaagtttgcggagggatgcccagcagcctggttgaatagctgagtagcaacacagggaccaacctctgctgcccagttagctactcttcccccagccaccaccacctgctaactgctctttgagcaacgagctctgtcttaggctgtctgcttgtgggtgggagcagggtaag

SEQ ID NO: 132225 - DNA, 774 bp, Homo sapiens
tgtcctcctgcccccctccattactgggggcatggaggggaggtgaccaagagggacatctaagcagctgctctgaagaggaggcccctggcaccacagaagcacaggatggcatttgacctggcctgggagtgttggcgtcagttttccagacagaggagacggcacatgggctctgaggagaaggagggcttgcctggttgaaccaagggtgacccagtagcggggctgagctgggggtgccagggggagagggctgggtgaggctgggcctctgaggtgctacatcccaaggaggccatgggaggctttaattcggggtgagggggtggccggtgggttgagtgccctttccatgttcctgaacgccctggtgttgccaggtccttactgggctgaggcctggctacaaggcaactcagatggcaccagttcagggtgggcattcccatctgggactccaggcagggtcttccctgcggtttctccctggcagcccctgtgggagacagtttcttccaccagcctggctccctgggccacctgcacagaggtccctgctggcaccctggccagtccagtgccaggccgtcctcccgccaccccgcttcccagatctctgggagctcctagaaagtgctgccaccatctgaaccacatggggctctgagcaggcttgaggcttgttcgggtgtagttgtgtgtgcctgtaattccagctacttgggaggctgaggcaggagaatcgcttgagcccaggaggcggaggttgca

SEQ ID NO: 132226 - DNA, 347 bp, Homo sapiens
ccactgcacccggccccctgtgttcttgtatcccatctcacaaaatccccgtgtcctaagacccactttacagatgaggagaactgaggcctggtaaaggggtgtgactcgtccaaggccccacaccactcagtggcagagatcgggttcgttccaaggcgtggtgttgtgccacagcagcgtgtggggttgcttatggtggcaggagggacactcggggggccttactggaagggcgaggcccagtggactcggggaagcaatgccgaatctcagcagccattagtggtggcttctgtactgcctgggcatgagggcatggacccagcgtgggccttggggtaacc

SEQ ID NO: 132227 - DNA, 580 bp, Homo sapiens
agaagaaattctggagaagataagagagttgcaagtgcctgtttgaatcatcagcagaagagaggcatgaaatctgcaaggaaggatgagtccttccaggaagagagtgcagggggaagagaaagagaagcggggctgagccccaaggagggccagaagagcaaagaagggagagagggtcagtaggaaagatcaagacgttgtcggagcagtggcaggaataccgagagagtctggtctcctagctgccacaggagaggtggctttagcacagggtctgctggcggccgcctcttggacattgctgctttctcagtgatctccctgaagcctcgttgcctgtggactctccaagtctgtagagtgattaactatttgaggtagattctattttcatagtcattacacagagaatactaaagctgaggcagttttggtgacttacaggacatcacgttccagcttaaacccacatagcaccctctccagagctctcccccagtctgttagatgcatctgactttctaaggtgctcctggattggagggtccagctggctacatgtggtcaagacatacca

SEQ ID NO: 132228 - DNA, 146 bp, Homo sapiens
ctctagaggactccccgcacccaggcgcacttctgggggaaagatgttgaactcagagtggtccttgttagtctgtgttggaacattctagtagccagtggacagctgggaggagaggccaggagctcgagaagtcaccagggctg

SEQ ID NO: 132229 - DNA, 439 bp, Homo sapiens
ccctgttccctacccaactgcgtgccaaagccctagcctctgaatttccggggaggctgacttgagtaataaaactttagtctcccatttagccggttctgtgcgtattaaactctttctctattgcagttcccctgtcttgacaaactggctttatctaggcagtgggcaagatgaacccactgggcagttacagtaccaaaaaatatagtcttctcccagccaagattctgtgtctgctgacgaattactcaaactgttcctgacgatatagttcacctgttccttcccttcttccctcacacacctaggtctttttcctgtccttccctatcctcaagaagcctgaattcatgttcccaatttgctgggattacaggtgtgagccactgcacccgcgaaggcagtcttttttaatgagtttgtgttggtttttatc

SEQ ID NO: 132230 - DNA, 364 bp, Homo sapiens
ccctgcagtatgccctttatagaggctgtggactctaaattcaaaatgtgtggccaggcacagtggctcacacctgtaatcccaacactttgggaagccaaggcaggtggatcacttaaggccaggagttcaagaccagcctggccaacatggtgaaaccccgtctctactaaaaaaaaaaatacaaaaaaaaaaaattagctgggcatggtggtatgcgcctgtagtcccagttacttgggaggctgagggagaagaattgcctgaacctggcaggcagaggttgcaatgagccaagattgcaccactgcactccagcctgggtggcagagcgagactccatctaaaaaaaaaaaaaaaaaaa

SEQ ID NO: 132231 - DNA, 409 bp, Homo sapiens
gtctggctacaaacagtgtcacgtcacaaagcaacatgtgttccaagtattcacacattcaaattttcagaaggtgtaaaaagagttcagagatttatcagagattagaaatgtttgagctttaattttcaggtttttggtgaaattttagcctcataaaggtgtaaatttttatggtaagccttatgtagtgagcagagcctggtatgtgtctagcgagttattggcattatttagtaaagggaaactaggcattgcatgtatttggcctgatctctaattctgtcagcctgcttactagaaaccaaataactgagtgctgttgaataccagtcatcaagaaaaccactgcagtgatgatggccaccgtttgttgtcttcttaccatgtattagacactgttttcagg

SEQ ID NO: 132232 - DNA, 277 bp, Homo sapiens
aagcggaggagggggccagcctcatcccactgccagctggcccacagttcctcaaacacagtgagtgaggatggacctcaggctgtctcttcgggtcaccgctgtgaaaacaaggcaggtacagcaccagggcagacacttgcccccaggggtggctcccccagatcccaggcctctaggccccacatcaacactgcactgcacgttgaggacaaggccatctcggactgcagaccctcacgaccttcccacactttgtcctcacttgcaacagagg

SEQ ID NO: 132233 - DNA, 342 bp, Homo sapiens
catctgcctcccgggttcaagcgattctcctgcttcagcctcccgagtagctgggattacaagtgcccgccaccatgcccggctaatttttctatttttagtagagactgggttttgccatgttggtcaggctggtctccaactcctgatctcaggtgaccaccggcctgggcctcccaaagtgctggggattacaggtgtgagccaccgtgcccagcccctggggtcccttttgtaagggcactgatccccttcatgaggttccaccctcatgatcacaccaccttctaaagaccccacctcctagcaccatcactttgcggcacagaaatttaggggaaa

SEQ ID NO: 132234 - DNA, 771 bp, Homo sapiens
atctgtcctctgattacatctttaataaacataagagggacctgcgaataaactttagcttttgattcacagatactaaacattggactagataaatagaagtaacaacacttaaccagatggaactgatctcatactggatgacatacatactgttacattctcatacaaataacttaagaactcagaaagctcaactatagttttttacaagaattatctttccaatgaaaatttatttaaggccgggtgcggtggctcacacctgaaatcccaagtttgggaggctgagccaggagaattgcttgagctcaggaatttgagaccagcctgggcaatgtggcaaaaccccatctctacaaaaaaatacaaaatttagctgggtgtggtggtatgcacctgtagtcccagctcctcaggagactgaggtgggaggataacttgagcccaggaggttgaggctgcagtgagtcgtgatcatgccactgcactccagcctgggtgataaaaatgagaccttgtctcaaaaaaacaaacaaacaaacaaacagtttaaatgaccgtctatatactagaagggcctcaactgctatccaaatgaccaactaaattataatctaagtaggtgtttatgagatatactatttactttatctatctatctatctatctatctatctttacagtcttgctctgtcactcaggctgtggcagagtgcagtggcatgatgatacatgctattaagtgaatgaacacattttgagaaagaa

SEQ ID NO: 132235 - DNA, 774 bp, Homo sapiens
ctaatgaatttgaagaacgtgattttggataatgttcttatcaagaagtgttcaaatgataccaatagtcaaatattagaggaaatgcttctactccagataactggtcttttacacaattaagaaaaaaattgtcctcacaaaaaagttaaggtgtttttcatcaccaaatatatccagttaatcaattattatttgaaattctgaactcccatcaaattatagataacttcaaggaaccataaaaaacatactaagggcggggcatggtggctcacacctgtaatcccagcactttgggaggctgaggctggaggatcacttgagctcaggaattcgagaccagcctggccaacatggcgaaaccctgtctctaccaagcatacaaaaaactagctgggtgtgatggcacatgcctgtgttcccagctacctgggaagttgagatgggaggatcacttgagccctggatgcggaggttgcggtgagccaagatcgcaccactgcactccagcctgggtggcagagtgaataataattcagatgagtccaggtctttctggtagcatttagcatgtaaaactgttgtcatgattcatcagctcagatgatttgttgtctaatccatagtcccagatttcttaaaatgcactggtatgttagtgctaatataaaataaaatgatctatcatataaaatttaaagtaggtatatttgcacctaattattctttaagttaactgattcgttcctaggatattcagataataaataa

SEQ ID NO: 132236 - DNA, 729 bp, Homo sapiens
aaagaaaagcctggcatgttaactcacaagcaaataaattccatattcactaaacatccctgacaggctttcccagccctgctgtttgttaaggtagtcaaagcatggcacatgaagaaaactacatctatggatattgtacaaaatattgtttttatgattttttaatatttttaacagacttttattgacttgtgtttgtatttttatcaaacatacttcatttatttatttattttgagacgaaatctcactctatcacccaggctggagtgcagtggtgtgatcttggcttaccgcaacctccgccttccaggttcaagcgattctcctgcttcagcctccggagtagctgggattgcaggcatgcgccaccatgcccagcaaattttcgtattattagtagagacggggtttcaccatgttggccaggctggtctcgaactcctaacttcgggtgatccacctgcttcagcctcccaaagtgttggtattataggcatgagccaccacgtccagcctcaaacatacttcagtttttcacctcagcactgttgacattttaggctatgtaattctctgccttgtaggatgtttagtaatatccctggcctctacacattagatgtcaggaagaccccctcagttataacaatgacaaatatattcagattgccaaatgtcccctgtggaacaaattcatcccttgttatgaaccgtgatccagag

SEQ ID NO: 132237 - DNA, 201 bp, Homo sapiens
actatcgtgcccagcccttattttcttcattttaaatgaataaactaaggcacaagataagtgaatttattgggggaacccacccccaatatttcaatgtaggttctttctattttctgtaagtgttggccggctgagaaataaagagtacaaagagaggaattttacagctcggcccctgggggtgccgtcacatattgg

SEQ ID NO: 132238 - DNA, 467 bp, Homo sapiens
ctctgatacaactgaagggactaagctaagatctccttcctctgctgctggctgacctgccacttgtcaagcagagccagctctttgctgtgggtgtgcttgagtggccctgtctccgtggcctctgtcctagtgcctgttccttgcgggagtttggcacctactctgggttctcacagtatttctcaagaggaatgggtgaaaaggcccttaactcatctagtccctccactggctgaatgcttgaatctccactgctacattcttgccaagtagtcaccgcttactggatccatcttgggggttgccattatggcttagaccgctgcatcagcccctctgcgctctgtctgctgccttcctccccatctcccctgagagcctcctggggaactgtcctgacactcagccagccggaggagccacagcaggtcttcccaaggaggctccacgatgctgctccccat

SEQ ID NO: 132239 - DNA, 308 bp, Homo sapiens
gagacagagtcttactctgtcgcccacgctggagagcaatagcactatcatagctcactgccacctcactctcctgggctcaagctatcctcctacctcagccttttgagtagctgggactacaggcgcacaccactatggaccactgcacccaactgtattatttttgtgtgtgataaggtctcactgtgtcaccctggcctggagtgcagtagccatgatcttggctcactgtagcctctgcctactcagttcaagcaaggggattctatacgagcctcctaagtagctggaaccacagccatgca

SEQ ID NO: 132240 - DNA, 100 bp, Homo sapiens
cctccctctatcctagataatggttggaagtgggccagatacacaggaaacttcaatcagtccagaggcgatcacttcatttaagaaagtgcattttaat

SEQ ID NO: 132241 - DNA, 359 bp, Homo sapiens
tctgtctgcctatgtgacgaagaatcaaaattctagggtaaaaagtgtcctgaaattttcacctggaatttctggggagaaatttagttttagacttcatgttacattaattatatatctcagggagaagagatttcttttcaagaatggatttattaaagtcagatggatccacggttcattccacttggagcataattaccatgttctaaagcagtttgagttcttaatgacttgactccttcatatccagcagtgtcaaatttaaaaccgaccacacgaaatgttgggggcaaaaagtagtccagtaaacaaacttattaatagaaatgaaatcccacagggaacacagacacaca

SEQ ID NO: 132242 - DNA, 318 bp, Homo sapiens
tgaagggaggctagagtttgtcacgttatatatttcagcaaagtcaacttgacttactcagaatttatttcatctaacttgtacctaggtttggaaaataagaaaaaaatcgttatcctgcaaacttaaaatccaaaaaaattgcttcaacatctgaagtgatttttctccatttaatcataaacaatctacaaccattttgctacaaaatggtctctttaaaaggcctccaaagagttattgaatgaatggctattacctagaatgtaaacatctgttattctagagtagtccaacctttagttataaagagagatg

SEQ ID NO: 132243 - DNA, 505 bp, Homo sapiens
cgctcaggggtgtagacaccctctctccatcgctcaggggtgtagataccctctctccatcgctcaggggtgtagacaccctctctccatcgctcaggggtgtggacaccctctctccatcgctcaggggtgtagacaccctcccttcatcgctcaggggtgtggacaccctctctatcgttcggggtgtagacatcctctctccatcgctcaggggtgtagacaccccctctccatcgctcaggggtgtagacaccctctctccatcgctcaggggtgcagacaccccatctccatcacttagggggtggaaacctctctctatcactcagcaggtgtagataccctctctccatcgctcaggggtgcagacaccccatctccatcacttagggggtggaaacctctctctatcgctcagcaggtgtaggcacccccctccatcgctcaggggtgtagacaccctctctccatcactcaggggtgcagacaccccatctccatc

SEQ ID NO: 132244 - DNA, 313 bp, Homo sapiens
ccaattattggttttaaaggcaaaagccaaccatgtttttatacatatttatgacaaaactccagcagtggtccccatcagagcggcttctgattttactttacaccatgtcctgtagttcgggaaatttttaccttgaagatggcatcatatattgcatggatttaaaaaaagaatactatggactatttcaaatatgtattaaaagagagaaaatagtgcaatgtcccctcatgtcccccattatctactcatggataagtagtttcatctataccgccatccatcttatgatttcttttttttttttttt

SEQ ID NO: 132245 - DNA, 419 bp, Homo sapiens
tgctgcggtctttctagaggatccctttcttgccaccagagtcgcctcatacccaatctatcaaatttttcctcttactgaaccgtccatccaaatacttccaatcatatccaaaaactatttattttcagttatctcaactacccagttcaagccatcattttctcctgaagtattctcttttgctataatccgttcaagacctaagaactgtaaaaactaacaaggcatcacgtgactcctctctaaaccagcttctcattcaccttgtaattaaaccaaaattctgtactttgatgacctgcaaaaattccattcaatttaaatcctttcctctctctctaaccttgtctaatactaaactactctttactcatactagcctttatcccttaaacataacaaggttggctgggtat

SEQ ID NO: 132246 - DNA, 411 bp, Homo sapiens
tggaacccgcttacttctcatcacccctattgctcccacgttggtgcaggtcattagcaactcttgcctggaagattgcaataagtgcccctccctatcaaccctgcttgttttagttttctccattgtacttactggtccttaactcgctaatttacttatattttaattattgtttatccccttccactaaaatgtaatctccaccagggcaagggatttttgtctgttttgttcacttttatatcccttatacctagaatgctggctggcatgtagaagacgctcattttatttattggaaaaatccagctttttaactccctgctttaattctttaattcttgctcctgacaatctattttcaacaaaaccttcaggatgtatctattaaaatctaggtggcattac

SEQ ID NO: 132247 - DNA, 403 bp, Homo sapiens
ccctagtagctgggaccacaggcacacgccaccacgcctgtctaatttgtttgtatttgtagagatgggttttcaccatgttgcccaggctggtcttgaactcttgagctcaagtaatctgcctacctcagcctcccaaaatgctgggattacaggcatgagccaccatgcctggcccaataacaatgtttgatttcttcatttattcaaccagtatttgtagagtcatattgctctgtgctggacactgtacctggtaatggaagtaccaatcgacaaaacaggcaaccctacacgctctcccacacctgtaggggaaacgtgtataaacgatgatggcaattccatgtaccctatcagagggctgggggtgggagacctcctagggagaatatagtcttca

SEQ ID NO: 132248 - DNA, 106 bp, Homo sapiens
aacaaatcagtaacatttatgcaaaaaatcataaaaaatactataacttatggtaatatggtaatatcatgattccacaagtaaaacatctaaaagaccttccact

SEQ ID NO: 132249 - DNA, 150 bp, Homo sapiens
agtctggacaaaaagagcaagactccgtctcaataaataagtaagtacataaacaaatgaacaacttgatacttgtatacctagaacttggtatacatcaaatactaaaaagaaagaaaagtcagataaaaagcagaagtgtctctgggg

SEQ ID NO: 132250 - DNA, 655 bp, Homo sapiens
tcttttggtatcatccaaacaattcacctccacattaattctcctgctggtactcaaacttttttttttacatcttaagccttatcagtccctttaagattttttttgaagcaaatagcctggtttttcatagattgtcatatgtatgtttatgagagttttaaaatcttactatttatttacagcaggtttaggggaatatgaagttgtaatatactgatggagtaaatttgattgtgattccttagttattgtcatgaaaacctaatttcccatccagacccactactttctcgagtagtaaaatcctccatcaaaaactactgagcaagaaggctttaccctatggggaagacaatgaggagaggaagtgaagaaaaccagctgtattatatgccgtagtatataatgttgacattttgcagcttattgatcagtggatggttctgaaagtatctgttgccatctttgcttgtcaaataaaatccaaactttacttaatgaccctaaccatactaaccttgagtaaaagcagaacttccatttctgtttgggcagaaatccagcttttcacccttaacatctgctattgaaagtgctagctatctttctggtgatctgtaaggcaccataatactatttgtgttaacaattt

SEQ ID NO: 132251 - DNA, 137 bp, Homo sapiens
cacagggccttgggactggctggacagacactgctacatgccctccaagggcaggagtcatggtaaggagcgactggggtggaaaatagggaaaaaagtaacaacaactagatcatttttggcattttaacatggag

SEQ ID NO: 132252 - DNA, 476 bp, Homo sapiens
ttaatcttagttgactctgtattgttatcacactgcactctgttgtggttgtgccatttttgcaaaattgagctctttcggttgttttcgaaataagggaacttagtgttgaaaaaccagagaactttttctttaataagaaactaaaaaagttgcagccacataggttcagtttggctctttggtttccagtggctctcaaatcccctaaggttaaaagaaaacactacagctaccctagggtttctcaaccttggcattattgacatcttgaatcaaataattcattattgtgggggtgctgtcctgtgccttgcagaatcttgagcagtgttcctgacctctacctattgagatgccagcagcacacccccatcccagtgtaataaccaaaaatgcctccagacattgtctcatgtcccttggagagcaaaatctccctagggtgagaaccactgagaccattgtttaagcag

SEQ ID NO: 132253 - DNA, 206 bp, Homo sapiens
ggtcaggcactgagagcctgtcaggcactgaagcctggtcaggcactgaagcctggtcaggcagtgaagcctggccaggcctggtgccaatcatgaactgggcttggtgatacaccaataaccctcagaaccaggaagcaaaactacctgctgacccatgtaactcctttctcttttccttctctattcctcctcaagtgctcctc

SEQ ID NO: 132254 - DNA, 511 bp, Homo sapiens
aatatgctgtctagcctaccaagtagctaggatacaggcacacgccacgcaccgcaccagctgtttttttttcttttgtattttgagtagagatggggttgcaccatgttggccaggctggtctcgaactcctgacctcaagtgatccactcgcctcagcctcccaaagtgctgagattacaggggtgagctaccgcacccggcctaaaagtttaatttaaatctccatttttattacaatttgttgaagtaagaaggtcagcttcccaaagtttgaattttgctgactgcatccctatggtgtcctttaacatgtttcctgtcccgtgtatatctcctgtaaattggtaggtagaaccagaagcttaattaggtttgtgttcttttctctttgtgcaagactacttcactggtgaaattgtttaccacaaggtacttaatacctgattgtatctcgtttttgtcactgataaatgctttaactttttttttattttttgagatggagtct

SEQ ID NO: 132255 - DNA, 894 bp, Homo sapiens
tgtttaatttctgatagtgggatttgagtccattttcttacagttaacatttaacattttggccaaaataacaatgctgtttgcagaaacaaaaggaagtctgctataatctagcccatagagagatcatcactgttagtttattttctgcatttttgtttgtcttcaaaattagactcacgctatataaaaagttgtacattctgaattttttatgtaagattaggtggtgaacattttttccattgggtagttttgtttttgttatgaactacttcagatatacagaacagttccatgaaaaataataaaatgataaccagcatatccactatgcagctcgaataaatcttaacattttgttacacttgctttgggtgttgtcataatttttttttatttcttcaaatatatatttaagcccctaagtactactcccaatctcagtcccctctccttctccagagttactcactttttcaacattaaaaatacttagaggttaagatttttttaaacacatatttacatttaacactttgcgctaaaggaattactacatagagattcttttagatcactgcaaataatcacccatttattttcttttctgcagtactaggcctgtctaatccaatcctgggtagaaacaaaagaattagaatacaaaggaaccaaatcttacattatctgcatatttcatatgactgtataaagtctattctgtataatttaagaaaataagatggatattacatctaaatggatatgtagttatttcttttcaatatatttaatattgctttagtggaattaaagacttaaatcctggtaaatgttacactttttagacattctaaaataaaaatgggtaattataataattagaagaat

SEQ ID NO: 132256 - DNA, 408 bp, Homo sapiens
tgcgtggtgactctagacgatcgcttagagccttaccctcccttaccctggcgtacacttgctgacttggtcccacacggttccccagatgccccatttcctcaggtctgctcaatccccaccatatgactaccgcagaacaatgagcaagccaatttcactgcatcttcacaaccaggcacacgctgattcttcatcattatccccattttgcagatgaggaatctgggtccaaagaggggaaagtactgctccaggggcacacagagagcacaactggcagagcgggggttcaaacttcagtcaccctcaactcttccctctacattacccaccagcaaatcccatcagcccccctcaacatgtcctgactgtaaccatacttcccccctgcatgctaacactggt

SEQ ID NO: 132257 - DNA, 326 bp, Homo sapiens
tgaggcatgaggtgatacctggggattagtggcctgctgggacttctgctggggcctcttcataccagagccctgtagtgaggtatcttactgcgggggaaggaaggaggcttgcctgcagcattctcttgctgggaaagacagaagggcacgtggtaagaagagggtcattggatcgaagctcatgtgcaccacagctgtttccccatcctccagtggctggcacaggaccccagggtagcacactggcacttgggacctagaaggggaggatctgggaagttcttggggactgaaggccctctctgctctagcctcaccatagt

SEQ ID NO: 132258 - DNA, 687 bp, Homo sapiens
tgatctagaggatcccgtgtctcagtttcgggacgaaaaaagatttactacgaaaacagtgaccaaaagacagaggaggtcctatgtgggtactagaaaagctggattttaagtaaaaaataggagggtaaaaaaaggaatgcttgaaggtgtaataaacaagaagagatatgtaacttacaaatgcagtctcaaaacataagaagccatgctgagggctacgggtgcagaggtatccctgactgtggggacttcggcgaaccctcttgggaagtggctgttagggaaagaatgagccgtatcacgggtggtttgtacagcacagtcaaaaccaccaaactaagagatgccgtgagatttcctatctgatatggtctggctctgtgtccccactcaaatctcatcttatagttcccataattcccacacgtggtgggagggagctggtgggtcttccccgtgctgtccccgtgagagtgaatgggtctcacgagatctgacggctgtaaaagcgggagtttctccgcacaagccctctccctgcctgctgccatccacgttaagatgtgacttgctccttcttgccttccaccatgattgtgaggcctccccagccatgtggaacgctaagtccagtaaacctctttcttctgtaaattgcccagtctcaggtatgtccttatcagc

SEQ ID NO: 132259 - DNA, 858 bp, Homo sapiens
ggcagcagaagtcggagagaaagtgccatggatggacgcgtgacaggccgccagatgtgtcttttgaagacttcgtaacaaccgttaactaaacagattcagattaacagaaagacagactctggagtggatgtctttagcaacatgctgtctaaagaagacccacttgatacaacggttagtgaaaagttgaaaataaagggacgaaaaaagatttactacgaaaacagtgaccaaaagacagaggaggtcctatgtgggtactagaaaagctggattttaagtaaaaaataggagggtaaaaaaaggaatgcttgaaggtgtaataaacaagaagagatatgtaacttacaaatgcagtctcaaaacataagaagccatgctgagggctacgggtgcagaggtatccctgactgtggggacttcggcgaaccctcttgggaagtggctgttagggaaagaatgagccgtatcacgggtggtttgtacagcacagtcaaaaccaccaaactaagagatgccgtgagatttcctatctgatatggtctggctctgtgtccccactcaaatctcatcttatagttcccataattcccacacgtggtgggagggagctggtgggtcttccccgtgctgtccccgtgagagtgaatgggtctcacgagatctgacggctgtaaaagcgggagtttctccgcacaagccctctccctgcctgctgccatccacgttaagatgtgacttgctccttcttgccttccaccatgattgtgaggcctccccagccatgtggaacgctaagtccagtaaacctctttcttctgtaaattgcccagtctcaggtatgtccttatcagc

SEQ ID NO: 132260 - DNA, 618 bp, Homo sapiens
acttgatttgttcaaagttttgacaatgacttatttgaaggtaaagcatggtactccaagctggtagcagccacttgggtctgtgccttccttgacctataagatggaagttaagcttctctctttcaacagaagtatgtcccagaaaagtttgagaagcactaatatagtgcacagagcacttgcattgacatgttgtgcagtcaccagcctaggtggtactggccagtcatttaacttttttgagccatagtttcctcttctgtaaaatcagaataactagtaattggtgtagacataagcactgaaaacagaggaaaagaatctagttcaaaggaacaggcccaagagagatagtaggacagctaattcttgtaatctaatgagtttgagtaaaatgcacttgggagaattattgtggaagagattggaaaggtaggtaggggctaggtcatattccaagctcaaaggaatttggacctagtccatggtttactagtagaatactaaaagaaggccagatttagctgacttttcttgaggcctgcaataagccatactttgggctttgggcatttggaggtagataggaactagttagagactgttaaaacaggc

SEQ ID NO: 132261 - DNA, 710 bp, Homo sapiens
taagcacttgaaatgtccttggtataactgaaaagcttcatatatatataccttaaattttaattcaaataggcgcatgtggctagtggctactctattggaaaacataacgtagggttttcaggatcttcttggattctatatgccccatctctcaattcacatgagcattaacacaggaaaacaaagacttctccaacagtggaagaaatgattagatttggggacaagatggagatcataaaccacctgttttcttccaagaaaaagaaaaggaaaaaaatgcatttgttgagaagagaacacacgttcacatggttgctctaaattgcctgtgagccagacttggctcttaacatttgtccactagtgaaaaggttctcaaactttagcatgcatcagaatcacctagagggcattgctgagtctcaccacaacagtctcggtttcagtaattttgaagtggagcctgacagtttgcatgtttactaagttccaggtaatgctgatcctgctggtatgagactttgagaattgctctagggattttcttaatgggaaaaacaaccccctcagatcatgtatttttttttgcctattggagtgtctggaccactgttaatataggaagattctctcaccaagaatcagttctcttgaaaaaagagaaaattcacttgcctttgccttccccacaaagtaagaaaaaa

SEQ ID NO: 132262 - DNA, 191 bp, Homo sapiens
tacgcttgcgtactgagtccgtccctaacaaagatagggctgcgaatatcccatgatggcatttacattttattaggtattgtaaataatctagagatgatctaaagaagcagtccccaacctttttggcataagggagtagtttcatggaagacaatttttccacacgccgctgtgtatgtgggggtgag

SEQ ID NO: 132263 - DNA, 608 bp, Homo sapiens
caaacggacctaatacacctaaatgcatttgaagctacttggtctcggttcttaccaacgatataatttaatttttttttccaaacgatgatgttgttgcatacctgtggaaagcaaaatgattctgtgaaactatacttttagttttgcaaccatttgataacttcaaagattatcaatgtattatatctttagtcttagctttccagataacccagaatcatatggttccaagttgattaagctttgttaccagcagactatggtaggatcctgatgaacgacactatggaagaaacttgttaggataaacagtcttcaatgtgtgcatattgttgacagaatttgaaggcacaaatttaagagtaactagggtgtaaaaggcgagcaaagaaaagtcagcactactgggtaagcaggtgagggggcttattgataggagagtcggctatgtcaaatagggactcaaggcacaaagtcaatttctttactgacaactttcaatccaagtaataggaattttgtatttgtaaattactaggtagtggctctggctattcttgttttttcattgatttctgtgagcatttcttagtatgtattgtgtg

SEQ ID NO: 132264 - DNA, 280 bp, Homo sapiens
ttcctgagaatgctgttttcagataccttcagattttccccgttttcaaatacctggagacttcctgtgaaaatgctacgtagagggtcaggattttcacagaactttaacggccctgagcaaacaatcgactgtaatcaacgtgtagcttcctgtccccaagaacacaccttaccccatggcagggcattgagtcatgttctgtgaggtgactcctagtggagccattacccggggatttttttttttcatttctaaaaataaaatgtagaaaagcatg

SEQ ID NO: 132265 - DNA, 225 bp, Homo sapiens
cgagctgcatcgctgatcaagttaacaagttgtttatatgcatttggagggaaaaaacacaatcattagaattactagacagaaagattcatgaagaccaaccatgccaagctaattttcttttccgatatgtctactaaacatgtagagcaatagatcgcatcggtacagagcacctccatctccacaattatcactctaccatgattcatgataaacctcagg

SEQ ID NO: 132266 - DNA, 216 bp, Homo sapiens
tgaccttcgggcgtctgtgacaaagacctgtcacagtgtatctatttgcttatgggagggaagggggaaaaaaaaaaggattctaggcctgctatatgttaaatcaccatgaacataacggcacagttaaagacacaaatggccaataatcatacgaatagatatttaacctggctaataactaaataaaagcaaattaaagcaagatgcacatta

SEQ ID NO: 132267 - DNA, 239 bp, Homo sapiens
gaggaaactgatcctcagagaaagctcagtcatacagcaagcccgaggcagagctgggacaggtccccggagctctcagctccatgactctgctacctccttcctctgttaagtcctacgaagcccagaaagaagccccttcaggcaggacacactgatacccctgtcttagtccattagtgttgctgtaaaggaatacccgaggctgagtaatatataaagaaaagaggttaatttgg

SEQ ID NO: 132268 - DNA, 787 bp, Homo sapiens
agcattgtgccgttttaagaggtagatctttgagcaccttttctatttttgtttggatatccatctcagtggttttctttttgagttaattttggtaattatatcttcctggaaaattggtcatctgttttattttttagttcatttatattaaattttaacatactatctgaattttgaaagtaataattctatcctttttctttttgaaattcattttgccaaatatttgactggcttaggtgtctttgaaatcaccaggttttggttttattcattaactctactattttctgtttcttgatttctcattcatctttttattgctatattaatttctcttttctatatgtttattttctttctcttgtttttaactttttgaattgaaatttttggcgacttactttttattgttctcattttctaaaccagcatttaaggctataaattttcctgagtgctacttttccagtaatacataggatttagtgtatagtgcacacatatcattcatttttaaactgctggtgattttcattttcacttttttactttgacctaaaagtttctgaagtgtttttaaatttctgcatgtatagaattctttgagttgtttagatctgtcaggtaatttggcctgtatgttttctgtttgggaatgtttttgagtgctactctgtggcctaatacaagatcttttttttgtgaatatacaaaaaattaaagcttagtaaattattattcagattttctcatcatctgatgagaccctggtgcctgctat

SEQ ID NO: 132269 - DNA, 889 bp, Homo sapiens
agccatgagaaggtcagttggaacttgtggactgaaactcatcaatttgattggttggtaaaacaaaagtatcacatattccataagagttaagcaagacacatagtctcaaaacacattaaaaatgtcccagatactatctaaaattatttggcctaagaaaaaccagaaaaatttcaacctacatcaagaaggcaatgaacagatacggatgttttgaagatacagatgttggacttttctaacagccttttggagaaactattataaaaattgttccaacaagcagtcacaaacactcctgaaacaaagttaaagtagaaaacctcagcaataggaaataagaaatagaaagaaaaatcaaatggaaattttagaattgaagaatacaataacccacaataaaaatcttattgggtctgctcaataggaaaatggcaatggaagaggaaagaatcagtaaactcgaaaataaatcagtagaaattatccaatctgataaacagagaaaaaccagactgagagaaaaaataaacagtctcaaagatgtgtgggacaatttttaaaaaaaaggtttaacatttgcatcgtaggagttctagaatgggatgacaaatagtgtggtgctaaaacacacttgaagaaataatggccaaaaaatgccaacactaggagaaagaaaataacccatagattcaggttcagtgaaaatcaacttgatcaatatcctgtcgacctctatcaaaaaaaaaaaaaattgggggcgcggccaagattaaacactttgggccgcccagatgagacggctcgccagaccgccaatggggttcccaaacggcggggtgaacagtgttgttgttgtctgccccccctcgcgaaaaaggcaaag

SEQ ID NO: 132270 - DNA, 468 bp, Homo sapiens
tctgaaaaaaaggcccaggtaactcagaccatgtctctttttccagatttcccagactcaatggttaagtttgagaacacattcgaacctttaacatctaaaacaaaaactcctgcagaagggatcttgcttcattgatttcccaagcaacttctactacttctttattttgtcctgaatccctgccacagaatgagcatgggacccaagcatgatcgttcagctcccacacaccctacaccactcaccagcccatccccaccctcaattctcaccataggccacacagagagcgtaagagtcagatttatgttaagctggctagggcccttccccaaaagtttttcaacaaagatggttggaaagattttttcctccctgtattaatccattctcacactgctaacaaagacatacctgagactgggtaatttataaagaaaaagaggtttaagggactcacagttc

SEQ ID NO: 132271 - DNA, 365 bp, Homo sapiens
taatagcctggaccagaatgaggttcaccgcgttagccaggatggtctggatcttctgaccttgttgatccgcccgcctcggcctcccaaagtgctgggattgcagacgtgagccaccgcgcccggccacaatgctgactttctattaactgtcactctcaataaaaagacagaaccaaatctacccatgtctctagaactaactcccagtttatagaataaacagcagataatggaacaagctcaatgacattacaagttcatgaccagcaagatccaaaacgtgggaaactgtatagcacaaaggatactgcatatttctttagcaaataaaatgacacttaaaaacaaaggaggggctgggt

SEQ ID NO: 132272 - DNA, 864 bp, Homo sapiens
ggcgctggcagaggggacgggcaccacgtggtcatccccatgacaggttctgtcatggtgacagtgttgtgggaggatggtgtgctgctgcccctgcaccccgtgagatgaatcctgcctctgggaggtacagctgggacggggcgagggacccactcagctgtccaggaagggtcccctgccctgtgcttcctccaggtgtcctggtgcactcctgagcacggcacctagtgggggtccccacaccctcaccctgacccatgggtgcctccccttggggactccacgcccttcgctggcactgagatggagagcgacctgtccgtggcagaagggctgctgcacctgaggtgcctaaggcgacaccaagggccacagccccagtagctccagcctccgtgtgctcaatgccaagccctgtgcccaggaggacagggaaatggaggcagaggtggccttgatgtcccaaggtgggcagtggctgcctctgccctggaggcctgtgagggtcagggtctgagggtctgaggtgcactatgacccgggggcactgcctggccacggctgagactcgcagagggtctgcagttcccacctgcctctcggaagctgccctgggtcagccgtcagtggtgctccgccttgggttttctattatcagaaagtcattgagcaacagcagtgctgaggacgcaggcagggctgtgggcactgcaggggccgctcccagtgtccacacgcgtgctgggctctgccaaggtgtgggaagcctgtgtttcaccctgaggttgtcctggtgcccctggtttggcccctccccacctcggggccctggcgtgcattaagggtggcgggttcccatag

SEQ ID NO: 132273 - DNA, 375 bp, Homo sapiens
agttcttttttataatatctaaagtgagtgcacatgacaaaagaatatttttaccaacctctttttaaggtttctattatattaactgttgcctacaagtacaatttttaaatcactctggctttatagtgaattgacttgactttggcatcaaatgggtagcgaaatataaatgggtatcttcatgtgaatgaagaggagaattctcaggtaaacagtgggccactgctgttgcagatgttggtaaagagaattgccttttacggctccatttcttattaggaacacaagttacaggataacctgcaacccattaagactgtaaatgcatatttgggtataaacatgaagtggtatcagaatttttatgccaag

SEQ ID NO: 132274 - DNA, 257 bp, Homo sapiens
ctgaatcaactcacctatttttatcagtccaaatcaaagtacattgtgcccccttatcgggtgatgctctgtccttgtactttttctctactattattttaacccagtcactgatcccaaacattcctcatcagattctttggctttattatgtctaagttgatttgttcacatgcgtgaatgagcgtgttgtgcctctgctgctggcaagattcttgtctgatcagagttttgcgtctcctgtgtttactctaggc

SEQ ID NO: 132275 - DNA, 428 bp, Homo sapiens
aagactcccaggtttgaatgctggctctgacatttattagctctattacttaataagttacttaacctttctttccttcagtatcattatgtacaaaacggagacaataatagtatattaaagttggtgtgatgactaaacgaacacaggtaaagttcttacaacaatgaactggcacatatatgaccaataaattcaaattatctctgataccacacagaattttaatggttgttctgaaattctcaactgtaattccaagtttcattagtctaaagttactagactacactgctcattttctaaattaatctagttggatttttatgatatttaaagatttttttccattatactttcactagaaattacagaaatttcactgggtacagtggatcatgcctataatcccaacactttgggaggcc

SEQ ID NO: 132276 - DNA, 570 bp, Homo sapiens
tgcacagtcttactggctgtttacaggccacttcccttctgcctggatcacagcaccctgtcaggtgcagcagggcccaggctgtgccacttgtgaagtattttgaaaactaccttggattagctcacagaatcactgaaagtgtggagaaacaggttttaggctggtcttcctagaacaactcccagaaccctgctaaagaactgacccaataagggacctgataccaatccactagccactcacccaaactgctttctcacatatttgcaaatcaaaattccacataggattatctggttaggagaacctagaccatgattctactctcttgctgcaatggaagctgggaattgtaggttggctggttggtttacggtttttggaacctaccttgaggtgacaagattcacgaaacatggcactactgaaatgtggaaatatttacaagatttgggcagccacacatggtagatttccattataactcacaaggcggaaagcagtggccacaactgtacggcttatagcttcaacgcactgaagaaagattgacctgactagctgtac

SEQ ID NO: 132277 - DNA, 464 bp, Homo sapiens
atccttagcctgtccgtcgattttacaatcgtgtctgtaattggaaaaccccttgcgcgtgcaataacagaaacctagcttaaatcaactagagtaagagaagagggggatttttgagtcacaaaactaaaaagtctagaaaaagacttttaagcatgaatggggttccaggcatggctggatctaggagttcccaagataatgttgggaataacaacgtctctgactctcagctctgctttcttgatggtggtttctttattagctggtagtttcctgatcatcctgtcacctcagcaacccctgtgaacagagagtcttactcttttcccctaatatttcctgcaaagctatgggattgagtctcattggttgtggtctatcacatgcttcttcctgagccagtcactgaggccaggcagataggatgcttgggtcagccaggactaggtcatgtctttcag

SEQ ID NO: 132278 - DNA, 411 bp, Homo sapiens
attaatttcacctcttttcattttttaatatgtctgtttgaaaatttaaaattacatttgtggttcacattatatttttactggatatcactgttctactgttgccattctgagttgacaattctaatcaaaagcaagggaactaggtatttcacttagcttgtgcagctgttttagtagacatatgatttctgttagttcttgtgaaatactaaaaataggtcaaagatttctatttctactttttcagactcccaggaagtctgtaatttatatatcctttaatgtttgttttcccatctttggagattccaataatgtaggggttgaagcccaaaggggttagacgcacctaacctaaggtgaaggacatagagctgaatttgcttccaaatgagagagtggaaaaga

SEQ ID NO: 132279 - DNA, 176 bp, Homo sapiens
gagagctggaaggcttcggttctgtcccagtacacgcggtgcaggaccacggttgagcagaaggtgcatctgcgtggcaccgtggcgctgaagtccaggtgtgcttgggccctaggctcccaagacgttcccactgcctcctcctgggcacaaggctcaagcacagggaccgccgg

SEQ ID NO: 132280 - DNA, 314 bp, Homo sapiens
cctgaattgtctccatcaatcctttttacttataacacttgttttatcattcttaagttctaagggtagaagccttccacactgtaatttttctacactttctcattatttgtttcttgtttcagggaatatttcaagatgcttagttttataactgtttcttgaaaggcttcttctttaacaaatttgaaaaatattagttttagcttccactgaattttcctgtcttgtttctgcctctcatttcttgttttttttttttcttttcttttttttttttttttttgagacagagtctcgctctgttgcccagg

SEQ ID NO: 132281 - DNA, 214 bp, Homo sapiens
tactgagggggctgaggcaggagaatcacttgaacctgggaggcagaggttgcagtgagccaaggtcgcaccgctgcgctctaccctgggcaacaagagcaaaactctgccttattgaaaacctagaaaaaattgtgtcataaacaaagcagggacaacattgattaaaaatacatagatagggccgggtacagtggctcacgcctgtaatccc

SEQ ID NO: 132282 - DNA, 559 bp, Homo sapiens
gcgattctcctgcctcagcctcctcagtagctgggactacatgcatgcgccaccacacctggctaagttttgtatttttagtagagatggggtttcaccatgttggccaggctggtctggaactcctgacctcaggtgatctgcccactttggcctctcaaagtgctgggattacaggcttgagccactggtcggccagagtggcaaactttctcaactctcagattgctttatagcttccctccgtggcttccaagcaacacaaaaagatgttcaagtatgtaggttgaactgactaaagtgcatttatggatttcccatcattctactttttaggtctctatagcatacctggacctggatactcatcctgggaagatgtccttctgctaaaccttttaggtgttgctggtatcccctgaattctgtatcctccaggctacccctaaggttggctttaggcagagatgaaatattttctcttggaaatgatgtggctgcctgaaatattgataaatattctgaggctatatctctgagcctcatatgtagatatgta

SEQ ID NO: 132283 - DNA, 532 bp, Homo sapiens
gtctggagttggggtggttttggaggattgaataaaatgcataagaaacaaaataatcatcatgggaaagtgaacttcctctcagactctctccctctttctggtcacctggtgtgatttctccttctttctgtaagtcacttcattcttttctctcagaaggcaggtttcctctgcttctctgtgcccatgacagaaaatggccactctatgcacaattctttatagaaaaatattttatttcttaatttcagattcccaaaggagaaaatttaattggcccagctttagtcagttgttgaactcgggtgaaatcaaccatggccagaggggcaaggttatttgggacatacatagctgtcaggcccaaaccctctatgtgttgggggaggattggttctcagagaagagggatattagtttgtcagatgacccacgaagcagctaccaaacttattttctgagaccctgaactctattttaaggagtacttctgccctgccttcttttctagtattgttttctttcattt

SEQ ID NO: 132284 - DNA, 452 bp, Homo sapiens
gaagtattaaatattagttcataagattgttaatctgctgggtcaggcaaatacagaagagtttttcactttattcttgattattttacttatgatcatttccaatttagttggggtaataacctgatcagttatatacattgcactcattcattcttcagcaaacatgtactgaatacctgcccctagtatgttcttggcccagactaggccctagcaacccaagtgaactgcctgtctggctgccttaatgggggctcccaatctagtggggagcaaatgaaatgatcagtgcgatcatttactgcactagcagctgttctgccaagagtgtgcagaatcactctttattaacctagaaatgacctgagagagcatgtagtcgagttctggtcattttgtaagtaaagcatatggccacagaggtgaaggacacatagaggctaaggtca

SEQ ID NO: 132285 - DNA, 1280 bp, Homo sapiens
agtgtgagcttcctccctgaagcagtgccatagtataatctcctggcagctccctatgttaatttcagggcctgtgacgatcaaggggctctcccatggtagggttgcaggagtccatggtagaaatgtggactgctgatggtctgtcacttaccttttccctgtactggggagtcccttttgactgctagacattcctggacaggcaggcgttcccacttccttcttaagtatttcctatccctttgctgttgacttccagtattctctcttggatgatctatttgaagtgtgattatctactcaccactgtggttcttcttggtggaggcggcaactactaaatgcttctagtcagctgtcctgaagtgcctgttggaatttggtgcttaaaataatttcttagttgatttccaattttgtttggtttttctgtgttctcctttagttctttgagtgtattttgaagtctttagtacatctgatgctttaggttaagggacagtttctgcacattttttcctatgaatagaccatgttttgttctttgtatgccttgtgatcttttgttgaaaactggacatctgaaaaacagccaagtttcccagtctttgcagactggctccatgccaggagggacctccactcactagtaagatgtgttctgacctttagcatcatcccacgatgaagccccaaagaccctccaggactttgcttggtaagggtcttgcctgaggccctgtgtgtatttgtttttattctgttacaccacgcttttaaattttttacttttccaaagagtcttcctgtaccttgttctagtccataggtctgcagtcctgcagctttcagttacccaccactttctatggcttttccaaggctgcgctctaagtataccacttttcctcatccaagctccaagttaggcaaaacagagaccagttcttcagcagcccccaaaatgttgcaaataagatctgtcctgctccctcctacttgagggaggtcactggtacctgggctgctgcttcctcccaacactaccacactgtggagagggtggggcaagcctgagtaaaactaccacaaaatttcttaccattttgaatgtgacttttccttgattgggcattagcttggttcttgtagacctttgcctttcagagttcccataaagttttctttagtcagtctctacttgtaatctttccatggggaatgaagacatgtagctgcctattcttcttgctgctgtatagtccaagcacagtgca

SEQ ID NO: 132286 - DNA, 496 bp, Homo sapiens
acaccaaatgctggtgagaatgcagacagactgcgtaactcatatatttctgatgggaatgttaaatgctacagctgttctggaaatcactttggcagtctgttacacagctaacatgcagttaccacaaaacccagctaatacaatcttgagcatttattgcagagaaatgaaaattgatgtttatacaaaaacctttacctgaatgtttacatcagatttactcatcagagctaaatattggaagcattccaaatgccctttaatgggcaaatggtcaaataaaatggtatatacatgccaatggaatgttactcagcaaaaaaagggaacaaatgatcaatacaagcaacttggatgaatttccaggaaattatgctgaataaaaaaaagccaacttgaaaaagttacatattgtttgatatcatttatataacattcctgaggcacatacttttaaatttataattaaaggtttatccatgttttagcatga

SEQ ID NO: 132287 - DNA, 459 bp, Homo sapiens
gttttgtataattataaatataacatgtattctgaaaattctaggaaaatgtagacaaaatgtcaatcacctataattcatccctatgagacctcccttaaagttggagcatttttttcttgcatttggaaacacatgtatacatgcatgtgacctgttttcttaagatactgtaaatatttcctcttactattaaaaaccacaaggaggtttaacattggattcccaagtccacagttaaaaggaaaaaggaactattactcaatagatgcttccaaagcactcgataaaatttatctcattaacaaaagcttcatataaactttaagaaaactagagttacctaccagaagtcataatgggggagctgaggcatttccattggattcaaaagtcacacaaaaatgtcagacattaacttctgtcatttacatttgtagtacagatgctaaccaacag

SEQ ID NO: 132288 - DNA, 294 bp, Homo sapiens
ggaaagcatttattttgtttggcatataaccattaacaaatgttcattcctgacctttcttgaatttagcaaaattaatctataatattgtactaaattttaacatttattttcattttggataaaaactcagtggtaccaatttgctcaatactcgttcttcagtgctgatgtaaaaaccctgcctagggctggaagtggtagctcatacctgtaatcccagcactttgggaggtcatggtgggaggatcacttgagaccagtctgtgcaacttagcaaaaccctgtctctac

SEQ ID NO: 132289 - DNA, 464 bp, Homo sapiens
gagagacagggcccagtctttccagcagtgggctgggttcctacacaggggccagatcctgtcttccaaggacatcacctgtttcaggtagattagttctgtagactccctctcctctcactggagactcggcccctacagagcccttttaatccttctgatggattttcccatcagatggggtctccttgatgaccccagcactcagtgcccagtgaaccagatgcctggacagtggtgtgggtgggagcatgctccagggaaccaaattccacttctctcagatgacacagctatgaggcatgaggggctgcaacagtgggcccggcagctcccgggggcccctttgtgcaactcgggctgccgattcagccgtttctccagccactattgactgagcacgttgagcatgtgctgcctgctgtccttactgggggccatgaaggtgagctagacgatcaagt

SEQ ID NO: 132290 - DNA, 659 bp, Homo sapiens
gaccctctgcgcggcggctgcgacctgccggcggtccccgggcccccccacggcctggcccgccggaggcgctttactaccccggagccttactgcctttgtaccccactcgggccatgggctccccgtttcctctggtgaacctgcctacacccctataccccatgatgtgccccatggaacaccccctttctgctgacatcgccatggccacccgtgcagatgaggacggagacacgcctctccatattgctgtggtgcagggtaacctgccagctgtgcaccggctggtcaacctcttccagcaggggggccgggagctcgacatctacaacaacctacggcagacaccgctccacctggctgtgatcaccacattaccgtctgtggtccggctcctggtgacagctggtgccagccccatggcgctggaccgccatggccagacggccgctcacctggcgtgcgagcaccgcagcccgacctgcctgcgagccctgctggacagcgcagctccgggcacgttggacctggaggcccgcaattatgacgggctcaccgccctgcacgtggcagtgaacaccgagtgccaagaaaccgtgcagctcttgctagagcgcggtgccgacatcgacgcagtggacattaagagcggccgc

SEQ ID NO: 132291 - DNA, 363 bp, Homo sapiens
gtgtctcaggtttctgttcctggggaagactgcaggatgaggaataagggttcagaaaacctgagggaggcaggactagagagcagggctggacacaggtccctcacagtcactgttccccagacaccgctccacctggctgtgatcaccacattaccgtctgtggtccggctcctggtgacagctggtgccagccccatggcgctggaccgccatggccagacggccgctcacctggcgtgcgagcaccgcagcccgacctgcctgcgagccctgctggacagcgcagctccgggcacgttggacctggaggcccgcaattatgacggtaagcatttaccgcggggcaccgctgggctgtcc

SEQ ID NO: 132292 - DNA, 358 bp, Homo sapiens
ggataggttatatgcaaatatcataccattttatataagggacatgagcatctgaggatttgggtatctgtggggcaggaggaggtgtgtcctagaatcaatcccctacagttactgagggacagctgcatatctttttctgttcctttactcttaacctatttgtgtctttatatttacagtggatttctcataagcagcagatagatgggtcttgctcttttattcagcctgacttaattggcatattcaaccaatttgctgttgatgccttgctgtgcttcggtttaacctcttgatactttgctgtgcttcggtttaacctcttgatactttgctgtgcttcggtttaacctct

SEQ ID NO: 132293 - DNA, 325 bp, Homo sapiens
aacaaatgagttcacacgcagacttacctagcatcccagtaacagtctttcccctgcaatttgcaggatcacagcctcttgcaacctgagtcgacccaattatttctgagatcaccaagtatctcacatgttcaagatcaatcttttcatgatttccattctaaaaattatgttgatgatcactacatggcaagaaatccaggtggccattgccataactaatgataccctctttgagtgaaccctttcctattcaggactcccaaagccacccactctcaatgccgtgtgcatctcaatgccgtgtgcctctcaatgcggggat

SEQ ID NO: 132294 - DNA, 508 bp, Homo sapiens
atagcctttgcaatttcttttaattgattgagctaccctacaccagaatgggtgaaaaaggaccttattttttctgtatatggctgtgttgttttgttaagagatgagttcctgcatcaggacatcatgggcactagcatttcaaaaatagtggaggcaataacctaagctcagtggcatgaatccacactgcacattttattagcagtgtaataattttctaaaagattagtatcacagatgcactgatataagaatgctttgaattctttgagttctccagaggcatattttaagcgtcagatacaaactttacttttccaaataatgaaaaccaaggcagttttcctgaaagtaagagcatctttaattaattctaggtaagcgattctgaaggttagccagaagaggcaggtataccttaggggtagtggataatctccaaggtttggtgagtactagcgtgtgtgagtctgtgtgtttgcatagctgtttctgaaaatatttg

SEQ ID NO: 132295 - DNA, 733 bp, Homo sapiens
tgtggtggctcacacctgtaatcccagcattttgggaggcctaggcaggcagatcacttgagtccaggagtttgagaccagcctgggcaacatggtgaaaccccgtcataacaaaaataaataaataaataaataaatacagaaaaactattataagtatggcaggaaaacttgaatacttttatatgataaagcatgcacataagttgattaaaaacatcaaatccaaataagtattataataaacaggaaaaggatgtaaaaagtatacaaaagaagtatatcgtgaaaaatgtcaaatttactgtaattaagaaatacaaactaaaacaatctaaaaattgataaaattatttaaaaacaaaaacaccaaagctgtcagggatgccacaaaacaggaactgcttttgagagcatgaagggcccaacctttgggaatgcaacctggcaacagtaatcaagaactttaaaaaacattaacaagtttcaatctagtaagtctatttctgggatcctgtcctcagagtgcaatcctacatatggaaaaaacttcctgcacaaagacatttattggaaatggaaacatcctcaatattcaataacaggagaactgttaaataaactatgtgactataaaaattacgctaacaaagaccacgctataaaatggaaaatacatgtgcttcactgctacagtaaaaccaggctttaaaactgcatatatagcctaatg

SEQ ID NO: 132296 - DNA, 698 bp, Homo sapiens
gtggggccccatagacacccggctatgcatagaagcaatatagcatttggaatttgaaaataaattttcatggaatatgttccatatattaagtagtttttcagaaatgcaagcttcttggagcatgcattttgtgaactgtgataagcttttttatccgtcagaaataatgtgaggggagttaggaacaagaggtttttcaccctttgaaaaagtcaggaatgtggattggctcattgaagatcttggctacatataaggagtggacagcattgctctaggagttgtgatgatgtaacttttgccataaaaggatatggattttttttttttttttactatacacagtactgagtttttaggatggagaaaaatagtgaatagtcccatgggggtgctgcccagaatgtagtaaaacaaacctttgcttgtttcagcctctatctcttgagacattggagaaactaaggtagtttcaaagattattcaaaaagaggcagagccttccttcattccttctaggcaaagtagtctagacatctttaggaaatatgtccaggtctcctggaagcatttcctacctggtggtgtagaagattcctagggctgtctacgtggtgtttctctatttccctgacgtccaggaaagctgccccctcactccctaaagtgccccagggacatgggcagccctccta

SEQ ID NO: 132297 - DNA, 734 bp, Homo sapiens
gggtttgtcattgaatgttgtgcactccatcgtgcaatgatgtctgctgcctctctcacctgttgtgtcgtggctgctggtcccaaagtttctgcagtgtatttggctgtgcccaccagaacttgaagttgtttaaaaatcttaatacttggggggcttccagtgatatctgctccaaccagttggaggagctgttgcctgctctccattcttcttaagcattagattagaatatattaattgcttattttagagctggtgtcaatcgtgctgatttctttatgtggtcagagcaaaattcacatttttttaagtgttcagagactgcgtattgagagacgcataaggagaaaggtagtgtgagtgagcctgtcagcttgggcagtgttgggcagagcttttgtcccgggacatcatctgtgctcacagtgatcctttttcccattccatctcagcctagccttttaaaaaattatttttcctttgggcttgaccagtaagtaattgggaaaggggggtgctggagtcttggagatgctgtttgtgtgtgtgtgtgtgtttgattcattagtatcccgactccctaaaattgtatttgacagttcttgacaggttaccccgtaagacagtgaaaatatgactagttctctccgtgcatctgagtgtaatttccttattttatgagtccgaaagcagacataattatcacatgcaatgtagaatatttattctta

SEQ ID NO: 132298 - DNA, 381 bp, Homo sapiens
agggcagccgtagtgtgtggcttccccagggctgctctaacagatcaccatccttgccatggcttaagaagctgcagatttatttgcttacagctctggaagccagaagtccaaaatcaaggtgtcagtagagtctctctctctgaaacctgctgaggatgatgcccctggcctctccccagcctctggtgttcccagcagcccttggcattccttgccttgtagatgcaaaactccgatctccacctctatcctcacagtgagttctcctgcatgtctgtctctgtgccttcacattcctctctgtgtgtctgtgtttccatctccttatgaggacacccatcactgaatcagggcccactctataccagtaagacctca

SEQ ID NO: 132299 - DNA, 638 bp, Homo sapiens
ttggctattcctgagttgtgtcctttataataaatgggtaataggtgctttcctgagttctgtgagtcattctaaaaatgctcaaacctggtgaggggtgcggggaaagtatgggagtaggttgtgagaacctctgattttatagccagttgatcagaagtatgggtggcctgggacttgtgattggcacatgaagcaggggcagtcttatgggactgagccctttaacttgtgggatctgatgctaattccaggtagatacagtactccctccttatccaaggggaatatgttccaagacctccgtggacgtctgaaaccatggacagtactgaactctatatacactatgtttttttttcctatacatatatacctatgataaagtttaatatataaattaggcacaataagagaataacaataacaacaaaataattataacgatatactataataaaagttatgtgaatgtggtctctctctcctatcttattgtactgtactcaacatgcccagctgttttgtatttttagtagagacagggtttcaccatgttggccaggctggtctcgaactcccgacctcaagttatccatctgcctcggcctcccaaagtgctgggattagacgtgagc

SEQ ID NO: 132300 - DNA, 775 bp, Homo sapiens
agagtgagtgtgtgtgtgtgtgtgtgtatgtgtgtgtgtgtgtgtatgcactgaatgtgagtatatgcttatataccgtggttataagtgtatacatgtatatgaacatagacacatacatgttccttaaaagttcctagtcctatttactggatatttaaatttgaaaaatattttgccttcaaagtgattccagctaaagaggtggttagaattctagagttagagaaacatgtgatccttaccatgctttggagactctagcagaacatggcactcagtttcctttatactgttttgttcttttcaactcctcagctcttgtgggatctctggcgcctaactctaaaagtcagtttgtttttcagctgagctgcttacctttattggcatttaattactgttttactctgatgcctatttttttatctaaattagtaacactgtataacatttatatagttttatgagttcaacactttatataatcattcacatagtcctttgacatacatgagtattatgttctacttttacagatataaaaactgaggttcagtggggtggtatgtgttatgctttacagcacacatttgagtctgagtcagtggcacagttgggaacagaagtcaaaattgcatctagtccgtctcctcagaggacaaactatgatgcttccttctcgattacttggaaggagaagaatgtgggctttccctcttaagtcctttgaattagcagttgctgcagattgcctactactgtttcttgaatt

SEQ ID NO: 132301 - DNA, 742 bp, Homo sapiens
gccttggcctcccaaagtgctgggattacaggtgtgagccaccgcacccggccaacatcagcatttagaacctaaaccctaaataaaatctaactcactctttaagctttggcacaaatgtcgtttcttatttgctctgatgtgggtcagtcttccttcatgctcccgtaagtatcagagttccttcaatcatttgcacatatctgtgttataatgttgaactgtaattatttatttaattttcagtctctctcctttaggcagtgagctctccaaggacaaaggcatattatttgtttagctagcttttagagatagggtcttgctaagtttcccaggctggagtgaagtggctattcataggtgagatcccactattaattagcacagaaattttgacctacttcatttctgacctgggccagttcacctctccttaggcaacctagtgggcctcactcctgggaggtcatgatattgatgccagtttagtgtggacacccagtgagcatagctcactacagcccagaagttctgggctcaagctgtcctcctgcctcagctcccaagtatctgggactacaggtacatgccaccatgtccagcaacaaagacatattttagttatcctgtgtttgtgtctgtctcaatacctagccttagtataaacatttagcaaatgtttattgatgaaatggatgaagtcccacctcccattttggaccacttgcccttctcagaa

SEQ ID NO: 132302 - DNA, 350 bp, Homo sapiens
tgccatgtaggcagtgccttttgccttctgccatgattctgaggcctccccagccatgtggaactgaaagaattcatagactctcctcatgtggtccaatggctctcatgccagatgaagggagagaagttaagtagctgaagttatctctctgcccccaccctcccccacccagccatgcacagttggtgtcatcacaaggaggactggcagtggaggagcagggagagccaacggaagcattacttggcatcagaaaaatgatctggtctacagctcccagcgtgagcgacgcagaagacgggtgatttctgcatttccaactgaggtaccgggttcatctcactggg

SEQ ID NO: 132303 - DNA, 240 bp, Homo sapiens
tgatattgatgactgatgggtaagtagcatatatagcacagctacgctggacatagaaataatttatgtctctggcaggacaaagtggaacaacaaaagatttaatcacacaaatcaggatggcacacaatataaaaactacgaattgtttatttctagaattttccatttagtatttttggagagcagctgaccacacttaactgaaacctcagaaagtgaaaccttggatgagggggg

SEQ ID NO: 132304 - DNA, 473 bp, Homo sapiens
agttgagaacattttatttgctctttttgtaaccagtgcaacaaatctgcatggtatttaaagttcagacccagtttctttatttaaaaaataatactctgttatactgtattttatgatacataggaggtattcttgcatcagacatgataggtgtttaataagcaacactgctgggtcaaactgggttgcaaagtagattccattatatctacattgagataatgataaagatacgcaatttagtactaatgtttggagtatgagtctcaaaagatcagaacccataacataaaagttaaataggcaacatcactggcaattttttgtatgattaaattgcctggtttttaaattgttacaagtattttctttataaatagcagcattcctagagagtccttggatgatgtgtacctggtagttacaggagagttctggtgttcattaatcaaaccacccttgatttctgt

SEQ ID NO: 132305 - DNA, 421 bp, Homo sapiens
aagctcaaaatgctttgaaaggacaacttaaaaaattaaaacacatcattgtggtcctttgtaaatgaatggacctttgttaaatgactcactttggtcaataacttctccaccttagggatatttagccatctgcttctctctcctttcatgtctgtgtctctctgctttctttcaactccatctttccattcacatagtcccacttggaccctcgtcatgatgtatctcaaattttaacatacgcttgttctctttttcatgcatgctgaatggcatccctcttgagctagatgctaaaccattctgtattcattttccttggaagtttacatatatatatatatagaaaaatatatatatttaaaaatataaaatatatatgtatatttcctaaagtcccaaacacttaaatcttttt

SEQ ID NO: 132306 - DNA, 141 bp, Homo sapiens
ccccagtaaagcaaggacttctctgatttcttcacaggacactttgcatcagcctcctgaggactagagaaggttcagggcaagcactgccacttgcatttgttgttgccaagctaattgttcattacttgaatttctgtg

SEQ ID NO: 132307 - DNA, 801 bp, Homo sapiens
tcctgtcatgcagctggttttgatcagacatcctgtcatgctttatttggccattcacaatcaataataaaagacttctttaaggggataggtctcagttcatctgtttgtcccataggcctctgccctgcctgggaagctgctgggtactggaagggtactaaggtactaagtggaagatgctttagggcacatgagcaggagcagcagttagactgagggcccttcacgtgttagcataaggaggccagtctcttactagaagccctcgatcaatcctaggcagttcattcaatttatttaaagaggcctcctgtctttggctgtggttctgcagagcttttgggccctctgtgtgctgcaggtatgggatagaggagctggctggcacaggaccttcagtggatcccttaattttttggcccttctgaatcttctcgacgcctgctgtcttcaggttcagagcctccctggggtcccacaccattccttgtctctcatttccaatggtgctttcttgtccttgtgctccaaacttcagcttctgttgtcatacctctctgaactttttctatcttccggaaattatttgaaatgaaatcccttgttctctaatgatccttccttcagcaaaaaaaaaaaaaaaaaaaaattttgggggccgggcccggaaagtttaaaccctccgtgggcggcccccgagggagaatggccactgtgcagggaccggcaggaggtgtggttccaaaaacggggcggggtgacaccggggcgggctggtcacaggcgcaccgcccgcgg

SEQ ID NO: 132308 - DNA, 260 bp, Homo sapiens
tagagggtagggttgaaaccacaccccgggcatcttggcaaccctcccagagccagatatcgtttttccatatgtagcagcctctgctgtcgcctgaaggtttgtgtcccctaagcaaattcctatgttgaaatgctaatccccaagtttatgacatgaggtggagtctttgggaggtaagagccctgaagaatggggctagtacccttccagaaactgagaactgggaagaaacaatggaaatatatatcttttttttt

SEQ ID NO: 132309 - DNA, 396 bp, Homo sapiens
ctattgcattagcccaaaaactatctgttgagtgaatggatgagccatgtcctcccactcactgcctggatggccttggcaagttgcataacatgtgggagcctccggtttctcttctgtcaaatggagatagtaaataaaacagtaggccgccgcggtggctcacggctgtaatctcagcacttggggaggctgagacaggtaatcacttgaggttcaggagttcaagaccagcctggctaacatggtaaaaccccatctctactaaaaaatacaaaaattagcctggcatgctaggcaacatagggagagctcatctctacgaaaaataaacaaaaattagctaggtgtgatggcacatgcctgtgatcccagctacccaggaggctgaggtag

SEQ ID NO: 132310 - DNA, 413 bp, Homo sapiens
attcacatgttgaaatcctaaatcccaaggtgaatatattaggaggtagggcctttggtcataagggtggggccctcatgaatgagattaacgcttttataaaatagtccccagagagttcctttgtccttttgccatgtgaggttaaagtgagaagacagctgtctatgaggaattgggccctcaacatatatcaaacctgctggcaccctgatcttggattttctagtctccagaactgtgaaagatatgtttttgttgtttataagccacccagtttatgatattctattacagcagcctgaacagactaggacaatacgaaaaaatttatggaaaaagggtagtctatattggtactatgacttaatcccacatacacccacacacaacacctgaagtgccggaatgtt

SEQ ID NO: 132311 - DNA, 490 bp, Homo sapiens
aggaggactgctcagccctgaaccctgaaccccagattcatgcatcaccttcaaatggggtatctaactggcacctgcaaccaagcttctttctggtcctccctaaaacacatgcttccccccgagatcttgccactttcattaattctgtcttttcagtcgctgaggccccaaacccagtcagccttgactcttcttgtcggtcataccccataatttcccacccagaaatcctggtggctccatcttcaaaatgcatccggaatctgagcatttctcactggtccgagccaccatcatcactcgcccctcactgctctccctcctcctgtccttccccatggaggcttctctaccacagtagccagagtgaccctcttagtacacaggtgagaccatgtcacatctctgctcagccttcccctggcctcccaaatacctccctcagagtgaaatcaaaagtcctgcccctcctccagatatgccactg

SEQ ID NO: 132312 - DNA, 449 bp, Homo sapiens
gaccctaggagtttgagggctgcagtgagctgtgctcatcctactgcactccagcctgggtgacagagtgagacccagtctcttaaaaaaaaaagtcattaacctacaagtgttcttagagtctgtgtttgatagttaatgattactacttaaagactgcttacgaaggccgagtatagtggctcaagcctgtaatcccagcactttgggagggtgaggcaggcgggtcacctgaggtcaggagtttgagaccagcctgcccaacatagtgaaaccccatgtctattaaaaatacaaaagttagccaggtgtgctggtacatgcctataatcctagctactcaggaggctgaggcatgagaatcgcttgaacctgggaggtggaggttgctgtgagccgagattgcaccattgcactctagcctgggcaacagggtgagacggtctcag

SEQ ID NO: 132313 - DNA, 870 bp, Homo sapiens
catgatggtgggtgtctgtaattccagcaaattgggaggctgagtgggagaatcacatgaacctgggaggcggaggttacagtgagccgagatcatcacaccattgcactccagcctagatgacagagcgagactccgtctcaaaaacaaaaaaacaaaacctagtgcaaatggactggtaagccttccaaattattaaaaataataataggtatactgcaatttatattgccctttccctggcaatattacatcaacatgatacttcaaagcccaccttaattcagtgcttggtaaataatctttacagctagattgaggttctgaaaatagtagtgcagttacacagagcatatttgatgttcacttgcacgcccatacccatgttgatactggtgaagaatgaatttcagaaaaggataggcagagccagtcacggtggctcacacctgggatcccagcactttgggaggctgaggcagaaggatcgcttgagcccaggagttcaagatcagcctgggcaaaaatggtgagactcatctctacaaaaagttcaaaaattagccaggtcatggtgggacaaaactgtagtgcagcttacttgggagactgaggtgggcaggtgttgacccaggtatgaggaagcggtgcagaggagaccgctcaaaacgaaagaggaaggcaactgtaatgcttgcacagattaggaactagaggcaggacaacaacaacgattcagccagggaatctgaccaaaaaacacgttctaaggggccaaaaaaaaagagggcgaggaaataaccgggcagaaaaaagacgaggaaaacaacgagtaaggaatagaaacaggagagaagaaggacaatacga

SEQ ID NO: 132314 - DNA, 915 bp, Homo sapiens
caagccgggtgctgtgattcttgactatggctgagtagaatcaaccgtcagtgcatgcagatagctgggccagaatctggagggtggaactggccatttaaaaaagttctttagatttaataatgtggagctatcattggtgggagtagtattataactcagagcttcctaacttcctaagctggcagttcagtagtggctgataatgagtgaatcatgtatatggcaatcttacacttgttattgtatgtcttttttatagccatcctagtgggtttgaagtatctcgtgattttgatgtggtttacattctgactaatgatgttgagcatttttttatgtacttcttggccacttgtatttctttggaaaattatctattccagttctttgcccattttgaaatgggttatctcatttattacagtttcaggagttctgtatatataatagacataaagccactataaaataaattaattacaaatattttctcccattccaggaattgttttttcactttattgatggtatcagttgcagcacaataattttaattttgatggggtccagtttatctatttcattttgttgcttgtgcttttggtgtcatatccaagagaccattgcaaaattgaagattatgaagatttacccccagtattttcttctgttttatagttttagctcttgcatgtaggtctatccattttgagttaatttttgtgtatgatgtgagataggtgtctagcttcattctttcacctgtggatatctgttttcctagcaccatttgttgaaaagattattttttctctgttgaattgtcttgacaccctggtgaaaaatcgattgaccacagatctatgggtttatatctgaagtctcaattctattacattgatttatatgtcg

SEQ ID NO: 132315 - DNA, 861 bp, Homo sapiens
caagccgggtgctgtgattcttgactatggctgagtagaatcaaccgtcagtgcatgcagatagctgggccagaatctggagggtggaactggccatttaaaaaagttctttagatttaataatgtggagctatcattggtgggagtagtattataactcagagcttcctaacttcctaagctggcagttcagtagtggctgataatgagtgaatcatgtatatggcaatcttacacttgttattgtatgtcttttttatagccatcctagtgggtttgaagtatctcgtgattttgatgtggtttacattctgactaatgatgttgagcatttttttatgtacttcttggccacttgtatttctttggaaaattatctattccagttctttgcccattttgaaatgggttatctcatttattacagtttcaggagttctgtatatataatagacataaagccactattattgatggtatcagttgcagcacaataattttaattttgatggggtccagtttatctatttcattttgttgcttgtgcttttggtgtcatatccaagagaccattgcaaaattgaagattatgaagatttacccccagtattttcttctgttttatagttttagctcttgcatgtaggtctatccattttgagttaatttttgtgtatgatgtgagataggtgtctagcttcattctttcacctgtggatatctgttttcctagcaccatttgttgaaaagattattttttctctgttgaattgtcttgacaccctggtgaaaaatcgattgaccacagatctatgggtttatatctgaagtctcaattctattacattgatttatatgtcg

SEQ ID NO: 132316 - DNA, 206 bp, Homo sapiens
tagcctctagatgcacagcagtgcctctgaaatgaatcacccatggttaacaacgccaaatgccaaccattagcagatgagaaacagaactgaatcttgagtgtttggagagcagagctcttttgatcacaactagagcctccttcccctctgccattacaggagcgtagatatatatttccttttgactggtgtgcctgtcttac

SEQ ID NO: 132317 - DNA, 640 bp, Homo sapiens
cttgcaaagacccttcttccagtttctgggcaaggaacaacccattttaactcaaaacacaaaacgaccttttatcctttaaagaaatactaccaaatgtaacacaccttgatttacattttttaaccccagattccggatggcgaacacggaatgcaaaggcaggtaactagtttgggtctgacagtccccattcagcgaccgagcctgtgactccgttcaaaatcgacagtgcagtagagcatctttcccttttctgcccattcaccattgtgacaaaaatcaaagacgaaaaaaattatctactcatttctgaatactgagagaaatgtgctcattttgcgcctgactccgtggatcttaaacactaacatcccgctcagagatcaaccatgatttccataccaatctcatccactcagttttacttagcaaacacctttgctgcccttccacagtgagaaaaatggtgcaccaatcccacggatgacaggttgctactcgactgtacccgctcaatagttttatcagcaaccggaaaacttcacaatcggtcaattagctacttaaatctgtctaagacaaactaagaaagcatctcagtttcacctgtcttaaatctagtctaagacaatccccc

SEQ ID NO: 132318 - DNA, 396 bp, Homo sapiens
acaatagtgaaaagaataagagcagattaaacattcattttcctgtaacatattatttattttaaaaatgtcatgtgaggtaaggctgctgtgtattctaattggctaaaataaaaggtttaagtgagaataaaggaacacagatatgacacaaaatagcaagtgggaatctaagtttttctaatagaaagttgaaatggcaaaaaaaaaaaaaaattcctcaagaaatctcaccataacgaaaagaattgagcaattcttaaaaatattaaaaagctcccaaagcaaactgatttgtatggtcacttgaaaagaggaagagtaattgctgtttctaaatggtgagttgaatgtttagaaatctacatggaaattactttgttagtatgtctcctc

SEQ ID NO: 132319 - DNA, 379 bp, Homo sapiens
atttgggcatccatgaaacctgctaagtaacagagaagcagtaacagtccccagaggtttaagacaagtatgtaggaggggaaaacttacatttgagaaaattctgttgactttaagttttatgagaattgagaaaagaacactgttatttggtgttattggctgtatggcttaatccatttagaatgaaaattactgaccaagtttttataccttcaggtataaaggttcatgcccttaactcctgaatatagatgtttcatcattaagctcgtttcccatgtggacttggggatttctggggaatactgaagaatccattcagttctcttgcctattataccctatatgctatgggaaaatgagccttctgtgagcc

SEQ ID NO: 132320 - DNA, 781 bp, Homo sapiens
aatgattcattcatttcttcaatcaattcatccatccataattcaattatccaatccctttttattaaatgcctactatatgccaggaatcatggtgggcacgacatctatgagcatatacaagaaatctctgccttcaggaaggagaacgctgctgcgaggagggtcttctctcctttttagaggaaggagcaccgttgtggaggcagacaatgatatatccaaagcttggctttcaactagctgtctgaccagacactctaaaatcctgggggacagagaaagtgtgaaagtttttattcattttaagtttgcagaccctggcacagtgtgtggcttataaatgatgcccagagtacatacatggatgggatgagggaatgaatgagccgaagaacaccgagtgcagaattcatcgaaaggggtgagggaaagagcggaggtttttaggtaggaagcatgtgagcagaaaacccagttaggaggcttcttctaattgagggataattagagttggaatgagtggctccatctggctctttgctgagagtctgcgtgctttatttccttcaattttcacaactatccttggagatagggactggtttttgaatcttatttatttttacataaacacatgtctgtaaaatttaactaactgcaaaattatggtcatatagatgatgattagtgctctattttttctttttataatttgtttacatgcattttccccctcctgtctctttattagcaattcctaaccttgttaagaagttca

SEQ ID NO: 132321 - DNA, 532 bp, Homo sapiens
caagcaaacagagagagtcagtggggacaggcctggagcacacagtatctttgtaggtaaggctgtggaaaggtgtctgtgtgattggggcagagcaacccacatatccacgttcccacaccactgactgataatgcagttgctagaattagcaccaagagcctgttctttctgcagtgtgcctccaataccctctactgagaaagtttaacatcatgctcactgtagaggatagatgatgcttaaaggaattctcttctttatctcagagcaggtattgaaggattaatttgaagcttagtggcattaaattgataaccagcatagacatttagattgtttatacttttccactattatagtcatcaatgctacagaaacatccttcttcatattctttttgtatatatgtacacagactttttctggcatatatatggaggcatggaattgataagtcttggaataaactgtataaatttttaggagtaggatcaataggtcaggaggcatgcatattttaatgttgttt

SEQ ID NO: 132322 - DNA, 192 bp, Homo sapiens
tatagtagttcagtattgattaatgaatgagtcagcttttgaaccttttttttttcacatagggtatagagaattgagttcatcatactcctcagttcaaggcctagtagggaatgttgtcccatttagagtgcatttccctccacgttctccttcccctttgctttctaacatgtttgatgcatatactct

SEQ ID NO: 132323 - DNA, 200 bp, Homo sapiens
ctgtggccaccaggcctaaaatattgatgactcagccttttcagcaaatattttgaaacccctgatttaaaggactgacaagtaaaatattgtatccaaggcataacaatttttttctttttcttttttctttctttctttctttctttctttttttttttgagatggagtcttgctctgtcgccaggctggagtgcagt

SEQ ID NO: 132324 - DNA, 129 bp, Homo sapiens
tattcctgttgtcctgccctagcttgcacggcacacacacctttgctcggttcctggaatatgtctattaattttcttacttgaggcctttatattttctgatccttcagcttgtagtgctttaacccc

SEQ ID NO: 132325 - DNA, 530 bp, Homo sapiens
tgctagtggtgttcttggtatcttttcatatttgaggctttggtgctagtgctgaagtattacactcaccatccaaggttcacaggacttttgttttaatatggaacagatggaactgtttagttctgcatctttgcaggtatgcaaaatgtgcctaccaggactctgcttcatatccatggaaagcaagaagtaatacagtaaaactttgtctggctagaggctttgaaggaatggagtgttctggttgaattctattaacttggaagtatgaaggtgaaaaaaattcagaacttaaatttcctttgaatgcaatttgaaaatatagccaataattccacttttcttctctagtaagtttggacattctgatctacttggtgttttatgatagaacccctagtgtgcctgagacttactttgtgaagatacttttttaaaactttagctgtaagaggatgtaaatgactttgtatgagatcaagctggatgagaactaatacttgtaaatatactttttagactaaact

SEQ ID NO: 132326 - DNA, 176 bp, Homo sapiens
ttagttcttaaacacttggtatctatccatcgttaataccttagtgtaaattattttaatcagtttgacatcacagtatcacagactggcctgatttaagctaagatcagacttcactgaccgagtacaaaggatgttggtttgctgaaggataaaggaggaggcaaaggaatagg

SEQ ID NO: 132327 - DNA, 340 bp, Homo sapiens
atttcctccagatgcctctaaaattgtcctttcagtgttggttaaggatccaaatgagagtcaactattgcattttattagtgtgtctcttgagtcttttaacctataaattatcccttcttccccattcttagaccatttttcaaattgaagaaattagatcatttgctctacagaatttcccacattctggatttcactgtatctatggtattaatgtatccctctatcaacctctattttttggtaattgttagatgtgacacctttattagattcaataggtggtgagtgcttccgactgattcacatcagaggatgcataatgtctggttgtctc

SEQ ID NO: 132328 - DNA, 174 bp, Homo sapiens
caggactcagttctcatactctgggcaaataagaatctcctggtaacttgctaaaatcacatatccatgtgaggtctaaaaacatctataaaatgttctgtattccttcctcaaaaagctgtaagttatacatgttaaaatataattacttactgacttaatagtttgtttagc

SEQ ID NO: 132329 - DNA, 199 bp, Homo sapiens
ctcatcccagcaagactgcactagaaacttctcaaccaaagaatcctatctcattttcattcatttccctgagtacattttggggacacacagtggagtcggggctgagcaattgcttgttgagaaaagattgcattcttctctgagctcctagagcccaccataggtcccagcactcaggaggcactaagtgatgtgt

SEQ ID NO: 132330 - DNA, 272 bp, Homo sapiens
accatgtaagaggttcaccgctttagatttgcagctgtagggaagtagccagactattaggcgaacctggggggctgggatagtagtacaagggtaacagacacttgtatgctcttaccatgtgccaggtacccttctaggtgttttacatgtattcactcatttaattctcgtaaccacccatgagttagatattgttgctgtgtccactttacaattgggaaactgagccacataacttctctagattcacatgggcaggatttaaaccg

SEQ ID NO: 132331 - DNA, 560 bp, Homo sapiens
caaagtgaaagataaggagaagttttaaggtttaaagaaccaaaagtacctggagcaaggcccctccctcccgtttcctcatgactattgtgcttagaagaaaatcgcattaatacataagctttcaggaatggaggaggaaataaaggatattaaagtctgtcctcggcattcatttttttcgttctatgagaaaacaatgattaaatcttgagagagggagaggcgtatctgatcaggacatctgttttataaaactgcaaaggtgcttttcagcaagtatttgaggcaatggatcaagctggcaaagccatagagatgggatcaaagagtgtgctctctactgttcttttctaaaagtacccacttatcgcgagcacaaattgcaaagagatgaggtgtaagaattacctaaaggaatgaataatggaagaggtagtcaaaattagaaatttttaagtctgcacgtttgttgaacaccagatactctgagcccggtgtggggatgtggagctaaatagggttcttgcacttagttgtattcaaacacagaatctaaa

SEQ ID NO: 132332 - DNA, 301 bp, Homo sapiens
aggtgggtggagattggaagtaggctggtgatcacagtaccttattgatttacagtcattatcaaatctcccaggaaggagtttaattgcaattcaggagaaataatgatgtacaaaccaactagaaagagaaccaaaataggactgactctcaaagcacattgctagcatccaccaaaaagcaaagtggtagagaagcagtgagtgggattaggggtgagagaagatggagaacattaggacaggcaagataggcaatggttagatggaagctaaaaaataagaaaaggaagcagctatg

SEQ ID NO: 132333 - DNA, 791 bp, Homo sapiens
ttgagatggggtcttgctatgttgccccagttggtcttgaactcctgggctcaagtaatccccttacctcagcctcctgagccagcaatttctctatgtgttgtttcctgtctttcaatggtggccctgctgctgctcttccaagaagcacatacgctgtgccccaggcctcccactgaaggccttatgcctctaggcagaatggtgccatctcaggtggggtccatagatagtttaaaataccagccaagctgaccaaactctttatgccagagtccaaccatgggcctctaactcccacatcatttgctctgccctgttcgttcctcagattccaggaagcctgagcgcctcattcagccagatgatgcaatttacacctggctttgaggaaaagcagggatgtggaaagacaagagcagctttcagaattagcttttgttagtggaaagaccctggatttaaagccagaggacaagagttttggagatagcagtgctgctgccacttagtgcctggaattctgttacccttactctcatctataaaacagaagaaataagctctgccccacaggactggtgtcaagatgaactcatgtaaacgtatatagctcggcaccttggtttcataaatattagccttttcctcacatggaaaagtgctttgagaaccagaaagcccgataaaccatatggcttttgatgaaaacgaggcacattttggagtcagatataggagagaatctccctttatgagctgtgcacctgaggcaaattgcacagcctctc

SEQ ID NO: 132334 - DNA, 202 bp, Homo sapiens
ctgacttggggtgctgcagtgggtgaggtgaccctgcaggtatgtggcaggtgggagatcagataagcacgttattatgaccccctgcacatgtgactgtggtgaccagctgtaattgcttcagatgatttcaggtggcaggtgttacagcctccctaggggaaccccagacaaagccactgagcaggcactttagggaaag

SEQ ID NO: 132335 - DNA, 392 bp, Homo sapiens
ggtgtttcaccttctcagtggattttcttaatattctaaaataagcatgaatatttcttaatattctaaaataaacatttattgcaatgatatttaaaaagcttttaattttcaaagtccctctgacagccatcatcattcctaactgatttctatttagccctctatcctcatctctcattcctctatcacagaaccagacacagaattaagaagtactttatttatttatttatgtagcccaggctggagtgcagtggcacgatctggctcactgcaacctccgcctcctggttcaagcaattcttgtgcctcatcctctggagtagctgggactacaggtgcccaccatcatgcccatctaatttttttgcattttagtatggacagag

SEQ ID NO: 132336 - DNA, 713 bp, Homo sapiens
ggcatgaatacccacgatctttactctcagtacacagcttcatacttacatgcagggttacaatgtgcttggtaaggcaagaaatctctaccaacacaggatttttttgaggattaactaagaaaacataaataagcacacagcctgttgcctgatacacgttaggaactaagtaaatgcttattttgttttaaaatcattaccctacattctggaaaatgtgccatggaatgggacgggcccacaatggtttttctatagagtttttagcgggttctggggacaactattatatattttaaaatagcaacgctcacatgctccatagtaaatcagttggccaagttaaaaatagattctaaacatagcaagagcagaaattcaatctaagatactaagtcatggaaagcagttgacagtggttgcaacagagaaaaggaagcgcaggcacacactgattctacatgtggataaaattctccaacctccatttcaggtttgttctattctctatagcagaaaacatgcacacatatatatgcatacatgcatatacatatgcatgcaaataaataaactaagatgacacattctatttatctgcaatagcaccatttacaaacctattaattttgagattttggtacttattagcacgtactagatacactacaacaatatatagttcctcaacatttttaggtgtaagagag

SEQ ID NO: 132337 - DNA, 256 bp, Homo sapiens
ctcttttctcttggcaaatggttatatgacataccttgtagggttgtttgttaattttttcaagtatcttttgtttgtcaggcacggttctaggtaatgggaattcagtgacatctgtagttgctgccgttaatctatatcctattgagggaagtagaaaataaacgagtgaacaaacaattgcagtcatgtctggtggtgatgattctaggaaggatatgaagagtattagcagagattggggaggtcagacaag

SEQ ID NO: 132338 - DNA, 729 bp, Homo sapiens
atgatcgtagttcactgtagcctcaaactcctgggctcaagtgatcctcccacctcagtctcctgagtagctgggactacaggcacatgccaccatgcccagttaattttttaatattttgtagagactgcttcgctatgttgcccaggctggtctggaactcctgagctcaagcaatcctcccacctcagcctcccagaatgctgggattacaggcatgagccactgtgcctggcccaacatttcttctaatggcatcctgccaggtgccctcacactctcctccttacttgctcaagtttcagagtatggttctgattagcataaaatacaatggatctgttacctctcctgtcctggacattgctattattagtgaaagctgaggctgaataaaataactctttctgagttacttcccccacctcccttgatccagatcaacttccactatgtatcttcctagttctgatgtttaccctcagcttctagccattccattttatgtattttctctgcctttcccttggcatttgggtatttagataccatatattgcatgtttctacttggccaggtacatttatttactcattgagtcctcctaacaaccctatgagttaggtactactataattcctgttttcttagtagaggaaatagagcttacccaatgttacattgtaagtgatggcagcagaaataactcaggcagtctgactgcatcat

SEQ ID NO: 132339 - DNA, 778 bp, Homo sapiens
gtagaaaacacaggtgtcattgaggaaattgtgacttgagatatgagactcagcatcccaaagttagaaagaaatggaccttaagcttgacactacctacttccactctgctttcatttcctccgttctgtatccacttcccctttcaagaatttctcactaagccattctttttggtatgaaaaacagtaagctagatcataaccaaaatgcaggggccagcttgggatttcattcaagatatttggcttgggatttgggaaatattcaccatgaataaaattaatattacatatacactagcacaaattactaatgaattgtcttagtctagtcgggctgccataaatttattttctcacggttctggagaatagaagtccgagatcaaggagacaatcaacttagtttctgatgagggctctcttcctggcttgcagacaaccaccttcttgtgatctcacatggcctttcctcagtatggtaacatggaggaagaaagagccctgttgtatcttcctcttgttttaaatataattatttattttgtttgtcaaataagaattgtatgtatttactgtgtccatgttgttttgaaatattctgtttatcttcttataagggtaccagccctattaaataaggcgcccatccctgtgacctcatttaaactttatcacctcctcacaggccccatctccaaatacaattacattaggaattagggcttcaacatatgaatctggggccaaggacacaaacattccatctaatatta

SEQ ID NO: 132340 - DNA, 206 bp, Homo sapiens
gtggaccagacaaatctctaagtccctacccctctttgttaaatggaaacataactggaccacttcctaatgttatacctgaagcatcaacacagcacccagcaagaaactctcagtgatgttcatctttcttttttttttttttttttttgggccttggattggtgcccagggtggccctgaaccccggggccaaagggattcct

SEQ ID NO: 132341 - DNA, 471 bp, Homo sapiens
tgagaagagtcctggtctggtgagtttggaaacctggcttctggcctgtttctaacactgtatgtccttgggccagaccctttcccctggggtgctgatttcacacctgtaaaatgaagaagtttgacttgcacagtgcttttcttagactgtggtaaggggtggatgtgggggtagtgccaagaccaagtgaaagaggcttctggacctccatccttgcttcagccagagcagcgtgggttcatttcatttttggattttggtttgtgggaagaaagggttctcttgccggtgtgtgtgtttctgataaacaaagaagtgtggaagtggctgaatgagatgacccaaggactctttctgggaagatgcaggaggaagtaggtgagctgaggggaagctggtggggataggcctggtggggcctggggagaaggatttgaaggctcaagtcacacggtgcaggatgggact

SEQ ID NO: 132342 - DNA, 616 bp, Homo sapiens
gcaccctcagttctctaagcctagcaccctcagtactctcagcttagcactgtttagtactctcagcctagcactcagcactctcagcctagtactgttgatactctaggcctagcactgttagtactctaagtctagcactctcagtactctaagcctagcactcttagtactctaaccctagcatgttagtactgtattcctagcactcgcaatactctagggctagtactgctggtaccatatgcctagcactgttagtactttgtaagcctagcactcttagtactctggacccagcactgctgacactctctgcctaccactatgagtgctctgtgccaagcaatattctagactctgctgacacagaggtacagagaacaaagtccctggcttcgtggagcctatttgcttgtaggggcaagcagagtgtgttagatgtcatgacatctccatgtgtgtatctgggcggatagtgacaagtgaagagagaaaaatgaagctgaatgagcatgtggcaaatgggggtgtgtgagcggtgccctcttagatggtatgcttagggaggcctcactttgggtggctgcgccctgggagagatgcaagagcaggg

SEQ ID NO: 132343 - DNA, 513 bp, Homo sapiens
tcccagggaatcagccagatctttgaatttggttcccagtggagacttttctccctcctccagtggggcctgcagcttggaaagggggtctgtggttggcttctcatttcccacgttaagcttccatccttctctcctctggcttactgatgattctgactcctggcagggggaaggggaaaagagaagaggcaggaaaggagctggaagtccgtacttggttaatgctgtggcaagctggcatttcagtggcaggttctggtgggtgtgtaaacctagttctttctctctaggcacaatcttgtggatacttcagagagcaccattatttctcatctttggggatctctgagttgctggtcccttgaagctggttgcctaataagactccttccttagttccctggcatctaagcagtgccgtattagtttgctgggactgccatgacaaaatatcacagactgaggggcttaaaccagcagtccccaatttttttggtaccagagaccagt

SEQ ID NO: 132344 - DNA, 424 bp, Homo sapiens
gctgcccaactgaggggaatgaagtaagcagccaggcttcagctgtcagatcttcccaatctgcctcaattgcagggagccccttcacctgaggtaatgcccttcctggggtagcctgtatccagaggctgagacagaaaagaaagacccagccattgtagcctgacacaggatgctttgttggtcttcactctacagagctctccaccaggttcagggaaggtttgtaaggcctgcatcacggctcaatgtctttctctgccaaatcctacttttgccccttttcttcacaggcgttgatccctaataaacatcttgccctccacactgttctaccgtctgctcttggggaaatcaacctgcaacctacttcaaggcattggtagatattgctatgtcaagatagatttggacaatggggtga

SEQ ID NO: 132345 - DNA, 193 bp, Homo sapiens
agaggatcccccgtccataatgtgtgccataggtggtaggtagaaggagcttagtagaagtagaataaaatatttaaagcgcggatggaaataaaacgcgcagtgaggtcgcggctggaaggaaagaagtggggagaatatgagagaaaatcatattttgaccggctgggagaaatctagtagatgcccgacg

SEQ ID NO: 132346 - DNA, 239 bp, Homo sapiens
acacagacctaggggtccagcccggagctttgcaatgtccttctagttccctagaggccctctgctggctagcagcccttgggtgacagcttgctttcttttcacatctcttgcctctcaaatctgtttaagattctgcttcttaaactgtctgaattaggtgtctccgcagatttccctgtggccagctacctcccaaaccaaacacctatgtaagcccaccttggttgttgttcctg

SEQ ID NO: 132347 - DNA, 449 bp, Homo sapiens
atttctcagtcatgggtgactttctgattaattaggatcatatcctcagttttgtctgaacttagatgtatctcattagaatgggaagaacagagactaccattcatatctgctggatatagcttaccttttggcagaagaaaaaaagtctactaataccatcaccacaggagaagaaggatgtgtggactgcatggtaaaaaatggggaaatagaactaggccctaagagggttggaaggaaggaagttcaagattttgtaggtactgaaagtcagagacactgaggcatttgtaaggtaccatgaaggtacccctgaaatcagaaataccttgtcttggaaccaatcagatgaatagcattcttttaccctaataaagtacaattttgtaagacatctatacagtgaaagaaagtatgaaaacatggtaaattttgtttaatagaag

SEQ ID NO: 132348 - DNA, 275 bp, Homo sapiens
tcaagcataatgttgagtgacagataaacagataacaaagatcacacctagaccggataaagactatgcactgtattactatatttacataaagttcaaaaaataggtaaagttaatctgtggtgtcagaagttgggagagtgactgtccttgtttggtggtaaagacaaagtgagcaggaagtggacttctgagtggattggtaatgatatgtttcttgatgtaagtacctgttacatggttgtgtctatttttttttttttttttttttttga

SEQ ID NO: 132349 - DNA, 323 bp, Homo sapiens
gctgggactacaggcgcccgcaaccacgcccggctaattttttgtatttttagtagagacggggtttcaccattttagccgggatggtctcgatctcctgacctcgtgatccgcccgccttggcctcccaaagtgctgggattacaggcgtgagccaccgcgcccggcctaaatagtgtttttaaatgacttttaaacataaaagcttgttggatatttgtgcaagcctgccacatacctctttttcacaaaatcatgttacacattcacagtattataaaattttggccactctaagttattcttagggagcagagcacatg

SEQ ID NO: 132350 - DNA, 407 bp, Homo sapiens
tcttcctagttcaaaacagaaatgcccaaacgtatatgaacataagaaaaaatcttaaatagcactcagcctggaaaaaagggagcaatccatatttcctactgtttcaggaatttctaccagaaactaggtgagaaaaaagaaagtctccaatagctcgttcacaatgtatctaagaatttgtttctaggtcctaaaaggaacttatgagcatgaacatccattaacactaagggctcagagaaagctgtggtactgatgggagatcagctcctgaaagcccttcctgctgaaaatcatgatgcttgcaataaacatgttcaagaagcaaaaggcaaagtgtcagaggaaaaaaaccctgaaatccaggggtttttaatatttcccctcatctgggaggaagatcc

SEQ ID NO: 132351 - DNA, 392 bp, Homo sapiens
tgaagatttcactttgttaattgtgcaacaaggtttccttccttcctttcttccttccttcctctctctcttcttctttctctgtttctctttctttctttctctctctctctttctctctttttctctttctttcccttcctccctcccttcctttctttttctttttttcttttttttttttttgagacaagatctcactctgtcatctaggctggagtgcagtagtgcaatcttggctcactgcaacctccacttcctgggctcaagtgatcccccccacctcactactcaggaggctgaaatgggaggatcacttgagcctaggaggtcaaggctgcagtgatcacaccactgcactctagcctaggtaatgaagtgacccctgtctc

SEQ ID NO: 132352 - DNA, 621 bp, Homo sapiens
gaaatggatcaagtgattttttcattgtgtaaacatcatagggtatatttacacaaactagatgttatagcctactatacagctaggctatattgtatagcctgttactcttcggccacaaaactgtacagtgtgttactgtattgaacaccataggcaattgagacacaatggcatttgtgtatctaaatatagaaaaggtaatgcattgtgccaccaaatcaacaacagctatgatgtcactgggtgataggaatttttcagtgccattataatcttatggaaccattgtttcatatgcatgcagtttgctgttgatcaaaatgtagttaagcagcacatggctgtaattaaaacactattgtttgttataatagaaaataaaatttttctttttagcctctgtattaataaagagcactagaaagtactttgtttatcagataatgaatatgtttgacagatgtacatacgtatttatcaaatgaatctttttttgtgggggaaaccttaactaagaataggcctgtgttttaaaatggctgcctggaggacaagtgctataaggaaatttcagtggtatttgcttgacctggcattaagtggggggaaaaacaagcc

SEQ ID NO: 132353 - DNA, 299 bp, Homo sapiens
agatcctcctgcctcagcctcccaaagtgttgggattacaggtgtgagccaccatgtccagctcggcagctttataatcctaataaagcatttgtgggatttgggtccatctttaaatgtcctcaagaagcatatgtgtgtgtaactcaaactcagaacttgagttctgaaacccaagttcatgattccttccttcactgtgatgtgggcacttctccaaagtgaggtattagtggaatggaacttggatttttaaaaggtgtagtggaatgcttatataatattataactaagtaaaa

SEQ ID NO: 132354 - DNA, 468 bp, Homo sapiens
tcatctttgagacgatcctgtagggcacttagcataatactaagcaacatggagagggctcagtcaaagttagctctcctgactgcctggggcatggagaggagagttctgcctagcatttctgagatatgcatacaaatcgatggagataatgtacattgacaattttaatgagcaaagaaataaaaggtacatgttaagggaaaagtaaaaaaggatttcaagtctatttgcacatcttcaattttccagtgaccagggagggcaagaaggccaagcccctttgcttgtacttcactccccatgacacgggacaggtggcagctctgcagtggaagtggcagaccagaccaaaaaattcatgtcaaaaccaggatttctgtagatcagggatttccggtttttctgcctgaacttaccaaatagtaaacgtttatctccttttctttctttctcccttccctccct

SEQ ID NO: 132355 - DNA, 761 bp, Homo sapiens
ttaaattttttgtcttgaaaaagttatttgtcattaaaaatgtgttaggtaatgaatttgttatttaaataatttttaaaatttcttacatagtaaatattaacaaatataaatcacacaaaacactctttaggtgttctaaataaatttttttttttgagatggagtctcattctgttgcccaggctggagtcaggaatgcccttcagttgttccaagttgaggcacagcagctagatcatcattcccctacatggtctagccactggctaaaagtgtcccctgtgaggcagtgttaacactgaatagccctaattatcttcactgaattacagactgatacggctgacattaaaaatgggaaagtcgagactttcagagcacagacacatgcaatctccaaattcacagaatagttaagacaacactagcaaaaaaggatacacaaacataagtgagtagaaaggaatgggtgtacttcatatattcagatataaggaaatacacacaatggtgacaatcactgtgctttatgcctggtgttatggtgactgttttacatatattacctcatctacttctcggaatgtactggacaggtactatcatcatacccaatacacaaatgacacaaaacaggttaagtaactcacccaaggtgacaagtaaacaactggcggagctgggcatcaaacccaggtctgcctgacttcagagcccatgtgcttaatcaaccaatccattccatgatctccctattt

SEQ ID NO: 132356 - DNA, 318 bp, Homo sapiens
ttaacacacactggtccaatttctgccccatcactcttggcaaaatccattatgacctccaggctgctaaatccaagatacagttcaggcctcaatctgctcatcctttcagcagctttcacagggcttctgagtagggttgagcagttttgccctgcacacaggtgccctgcagaggaatgaggtgggctgaatgaaactccttttttaaaaattcttggctggcatagtggctcacgcctgtaatcccagcactcacgagcaagacaaggtagggccgatgacgacggtacatgcggaggttcgagaccactctgt

SEQ ID NO: 132357 - DNA, 405 bp, Homo sapiens
tgcctttcccttctggatacccctctgggctccaaggggtatgtgcccgcagccccaccagcacttacaggaagctgcctttttggttttagctgctggttctcctcccatatttatttcatacagtattgcccacctctgagaccattccctagggcaaccacatacaatccattcatttgacaagtatttgttgagcatcccagcactggactgtgctgtctcccatgaagttgtaatctagaggctggaggaaatagcaaacatgtaacctcagcttacagctgactggggctgtgagggaaagggatttaccattatgatctaacaagggaacctgcttttggtgcctaagaacatggtatttaagttaagtcctgttggacaagtagaagttagccaggt

SEQ ID NO: 132358 - DNA, 713 bp, Homo sapiens
tgtaaaaaaaaaacccacacatatttaatcatttatgtgttccagtatttattatctctgactcttttgaaaacattgctttgagcatagaaagaaaccctatactatattttcctaattatatatggaagttttcttttcacaatagaattatttctggaaactaagaacattttgttgtttttaattaaacaggttcttcatttacttatgcttaaaaagagttattcatctacctattccctaagttagttatttattactgtgatttatttactcattatggatgtgattctgtatgttttctagccattgcataacaagagaagacatgtaatagagcttttttaccaatatttaatggatttttaattgatgggtttatcagtctgtatccagtgccacaatgccaccaaacaagtactacaagtgggaatggggttaaaaatgtgaacacgctggttaagtgtttgcaataaatcgtatgtcagctctttcaactagagtgctttttttcctaagtaaacaatataatttgtacatttttccttcaagtttaatattaacttgcctcatatgttctgggttactttgctgatctatgcactggctttagcactctggagggggtacagaacttgttagtggaaaatcatattaagccccaaattcataagctataaaataaaagacagttgtctcttgtggaattt

SEQ ID NO: 132359 - DNA, 738 bp, Homo sapiens
attctaaaactattaatagtaaacataaaaatatataattctgattaaaaacaacgttaattctaaaactattaatagtaatcataaaaatatataattctgattgaaaaacaattttaaacatctctctttagttgaaagctctccctccttatggcttcaatgtgaattctgtcacaatgcacttagtgatgagcattaaaaagcccacttataatttgtcattagaaattatagtgagaaatattttttaagacacaatgctagttacatggatgaagccctctcccatccctcccctttgttataaaggagttgacattatcaagtgcaagggcttcagatttaagacgggaatttaggagaagactctagttaaaataagtatttgaagttatattgaatataggaatttcaataaagagaaattttgatgttattgcaatgagagtaaaattaaactgtagggtacagtcctaattttgtgtatgtgtagtaacaattctgcaagtattaagagaaataacttgttatttaagataaaaaaaaaacccatggatgaggtaatacaatctttactgaccatctagacacaagcttgttacaagaacataaccttggcagatggatctccaattgctgcatgtcaaaaagtcagtctgccacctcacctgagggtggagaacctcttataccaaatatacctataaaaaagttttcttttttctatattcaatg

SEQ ID NO: 132360 - DNA, 335 bp, Homo sapiens
ttttttttgcaaaaagggagtaaattgaagatactactaatcatgaaagcacaataagaagcatatcgatgatagggaaatgtgctcaatgcatatcttcaaacaagagcatgcagtcaaggctaggagtaatggctcatgcctgtaatgccagcactttgggaggctgaggtaggcggatcacttgaggtccagagttcaagaccagcctggccaacattgtgaaaccccgtctctacaaaaaatataaaaataagttggacgtagtggcatgtacccataatcccggctactcgagaggctgaggcaggagaatctcctgaactcaggaggca

SEQ ID NO: 132361 - DNA, 552 bp, Homo sapiens
atgttggtttggtgacaagggcattctcagacatttgtggcagcagcaaaaggggttcaagcctttcagataggatttagcatggtatcttaaattgttgcaccttttgacccattaatttcacttcaaggaatttaaagaaataagaggaggctgggcgcggtggctgacgcctgtaaccccagcactttgggaggccaaggagggcggatcacgaggtcaggagatcgagaccatcctggctaacacggtgaaaccccgtccctactaaaaatacaaaaaattagccaggtgtggtggcacacgcctgtagtcccagctactcgggaggctgaggcaggagaatggcgttaacctgggaggcagagcttgtagtgagccgagattgtgccaccacactccagcctaggcagcagagtgaaactctgtctcagaaaaaaaaaaaaatggtttccctatttagtatgagaacaatatattataatgagtgacatgattgtcagaattactcaaatttgtgtacatgttttctccactaaactgtaaacttct

SEQ ID NO: 132362 - DNA, 234 bp, Homo sapiens
agggaggcaggacactggtacataggacaatatacgtgaggaaggaaaaaaagcaaggaagatagggaatagtcccactacagcttccacgctggaaaagcaaatggggaatgggtcagaatgttgcccagacactgggaacatgcaacatcataaggccttgcccacctctgctccccaagaacctccgatagaactatcacctcaggcagactgtgcctccctgagccaagg

SEQ ID NO: 132363 - DNA, 412 bp, Homo sapiens
tccccagttgaactcctgaacctccctgaacacaagactcatacagccaaccaccctctcagcatttccatctgaatgtctaataagcatttcaaacttaacacgctcccaaaccaaatcttactttcccacccccaaacaagggttccctatttgagcaaattgcacatcatttacctactgctcaagccaaaatactttggcctcctctgtgagtcctctctttttgccacaatatacatacaacctgacacacacacacacacacacacacacacacacacacaaacacacacaaatctgtgagctcaatctccaaaacttacaccaagtctgaccctttctcatctccccagggatgacatgccactccctagctcccagccatcctcacttcttgcctgacatcctg

SEQ ID NO: 132364 - DNA, 606 bp, Homo sapiens
cattgaatggtataaatcaatatatttgagctaagcaagttaaaaaaaaatcagttatctttgggaacagcaatctattattgttgtttccctgagtgccactttaactgtttcactcaatggatggtggtttattcagttcaacacgtaatttgatttctattttcttaaaagtaaccatgttggacttacaaagagacttagaatgtcagaggtgttaggcagatattggataccagtaaaattggctggatatgtctgaaggtcggtggaattgtgagaaagaccaatggtgatggggttacattgaagaaaatataagatgagctaaatcaaaaccagatttgatttttttgggactccaccagaagtggaaactcataaacaagagatgaaacagaaaactacatttttattgattgtatgaaggagttaaatatatggagacatttcctcagtgatgatcaagggtaggtggggaaattccaataagaatgtaggatgacaataccttagatatgttgaaaaccaaggaggatggggatatagtatctttcgtattataataagcataaagttagcaaagggacatttaatttggttagc

SEQ ID NO: 132365 - DNA, 331 bp, Homo sapiens
tgtgtattttctcagatcctgaggtggtgtaatttcatatacagatcacataaaagggctaggttgtaataataaatcctggagtgctctttttaaaaaactttccattaagagccaatgttagaaacaagctgatagtatcctcaggaagtttgttttaattcaaccttggcctgattgaacaccagctttgtaaagtttgcgttgagatttgttttctgtttctgtgcactcacgtctgggatgaccagaacttctgctccacttgctagcaaattccctcgcgggaaaaccagcctaagggctccgcttacttctctggcttcccatt

SEQ ID NO: 132366 - DNA, 769 bp, Homo sapiens
caaaagggtgatgtgacatatttctgaaattcttttgagaagtaagcatttgttggtaatgaggatgtgattaatcctagaagatagaaagatagtggctgtagtgggttggatggcatgccgcctccacccccacccccccaacagacaccaagagatgtcagcctggaaggaaaagcatcttgcacgtgtaattaaggatctcaagatgagatcatcctgaattatctgagagaggcttaaatccaaagacaaggggtccttataagaaagaggaaggcacagaagaagagaaggtgatgcgaagacagaaacagagtgcagtaatacatctacatgccaaggaatgccaagggttgtcggcagccacgggaagccatgggtgagaggcatggaacagattttctcacagagcctctcgaaggaaccacactacaaacaccttgattttggatttctggcctccaaaactgagagagaataaatttcagttgttcagaggtaccaggtttatggcaatttgttatagcaatgaatacagcgactttttggtgatgtttacatgatttttggggacagatgggggttagtaggtggcagaaatttggggagggagcaagatgaacttggtaatttggatatttactgtgacttgattatgaaaagttttgtgttacaactaccagaagatagagagcagtgtttggtttgattagatgagaaaagatagattatgctataacaacctcttctgtcttgtcttgtgaac

SEQ ID NO: 132367 - DNA, 214 bp, Homo sapiens
accgcagtggcatgaacatggctcagtagagaataggctgtgtgcatcttagctgcatcttccatgctctgtgcatcctccccgtgctctgtgcatcctcttgtgttctccatcagcactctctacttaccttgctaaatgccttttctttcaacgccaccttaccctgcccaccccatggctgctacctgtttattttgtcattttgctaaga

SEQ ID NO: 132368 - DNA, 346 bp, Homo sapiens
ctcggatctaccctaggcattacaccggacaatcccctatctaggccttcttacgagccaaaccctgcccctactcctcctagacctatcctgactagaaaagccagattctttcacagctgttcatctcagtgctgtttgcctcaagttcttcaagctcttcacttgctgtcttctgcttctcctcccctcttctaggctagctcgcactggagtcgctgtgtttctcctcttgtgttctccatcagcactctctacttaccttgctaaatgccttttctttcaacgccaccttaccctgcccaccccatggctgctacctgtttattttgtcattttgctaaga

SEQ ID NO: 132369 - DNA, 312 bp, Homo sapiens
aaagcaccctgtgcttcttccactaacagaatgtcgcctgacagggttagacacgttttcaggatcctttcatcaccaccgtatatgttcaaagtaactttatcctatagttctgacaaaaggttaggactggaaatacaaggttttgcagaaccaattagttattgtttaattaaaataatggtaatcttgtgtagagtataaaatgggagactctggtgatagattgctattgcccagcatgttaagtcctcatcattcatttcattgcatctgtgttgcctgtctaaaataaaacatctcctatgttcc

SEQ ID NO: 132370 - DNA, 254 bp, Homo sapiens
aggctttcaactgggcacttctgggacctccgcctcatgccgttcccccctttcaatgacagagtccctccttatccccactcccagctgatgatctggtttcttatttggctgagagaacagaagccgtggacacagagccagctcatccctgcatctgcttcgagtactgaagcccctccttgcccctccttgttgggtgagccgcctctgctcctctggcaggaggctccctccagctgtgtgccaggtcg

SEQ ID NO: 132371 - DNA, 555 bp, Homo sapiens
ctcaagagattaggagtcttgctcatgataaaacaggaagtggtgggtctgcgatttggaattctgcgttcctgcaggacaccctgccgcccgtgccacctgttctctcccacgtgatgggcgcaaacccctgagaggtcccttttcagctcttgctccattctcagctgttgtgtttccctctccagatcccccacattgacacaagagatgtgatgcctccgggcagttaagggtgaaaagcgaatgcaggttttctctctcctctttgcccccaatcctacgggtgaatgaggcttgcatctctcttttgctaccatcgagagcagcagctcagtcagctaacttccgtttgcctgccggcatgagttcagcgagtttccccttggttttagagccaaagcctgagcacttggtgtaactttgcgtgctgtcgccctgagaggcggcaccgtcgggccccgagtcagccgtgtgctcgaaccgccccactttaccattcctgttcctcaccggtcactctttagtagagtcccgtccacttaaggagcactt

SEQ ID NO: 132372 - DNA, 361 bp, Homo sapiens
tggatttgtggcgtaggggattcatcaaatttcagtcctgctatgtaatcttggacaacttgtttaattttctgaacctcaggttacttatctgtaacatgtaaatgacagtatgcctcacatatttattttgaggataaaaagagttaatagatataaaatcactggcatagtgtcctgcctataagtaaataactaagtaatagtgattcctccctccctttccactactttgttttcagtcagggagcatccctagttctaaaaatcagaatgtaccaaccatctggtctgagaccagctattcgacaccaaattgtgttttctgaagtcctggcaaaatagaattttcaaaagttag

SEQ ID NO: 132373 - DNA, 241 bp, Homo sapiens
ttggatgccaagactcaggcatggctctggatctcaccacagaaagaggttcagggggcctctctggctggcggcacctgggctgccctaaggattgtgtatccacttggggaccttccgtctttgctaccagaggcaaggaatcccacaactccatgtgccacagagaccttaaagccggaggaacgacaaacaccaccactggcacttggctccggaggcttccctttcgccctcacct

SEQ ID NO: 132374 - DNA, 785 bp, Homo sapiens
gttggtttttgtttgtttagacagttgattctccttaaataaatttaaataataagaaaaagacttttctgtttgcctacatgtttgccattttcagtgttccttgttttgtgtagatctagagtgtcatctggtgtcattttccatctgcctgatagacttcctttaacatttcttatactgctataaagaaaaatatagacataaatgactacataaatattaaaaaccttttagtgaagggtaccgtaaacaaaatttaaaaaaaaaaataaaaggctgggaagtatttacaacatatcaggtaataataacagcagtacataataataataataataataatagcagttattaaatgtgtactgtgctataccaggcactatactgaacactttacaatgtattttctcattcaatccttagaacagctgtttgaaggtaatgtactattatgacttccatcttacaaacaaggatatgagactaacagataagtggctaaagtctctaacaataaaagatctaaaaatcaatgagaacataattttaattggcagttcttcagaaaaatgtgaatggcttataaacataaatgtaatactcagctgctgtcatcatcagaagaatgaagttgtttttaagctcttcaactgtcaagagtaagaagcaatgttactaataccggcaagatatgaaaagacgctcatacattgttggaaataaaagttggtatagcttttcagagaccatttaggtttaactgttgtcatttaaaatatcca

SEQ ID NO: 132375 - DNA, 244 bp, Homo sapiens
aggggatagaagaaaaagttaaataataccaagaggaaaaatatcaggtaaatccagaaagtgagaaattttgtaggacaagtgacacaatttgtctaacaaatcagtggcatgaaaacagacactggtgctgggaagggggctgatatggactaaaagaggtgcaagaggcctaacaagcaaacatactctgtggggcttttgtttgattctgatttgaacaaatcatatgtgaaatatgggg

SEQ ID NO: 132376 - DNA, 165 bp, Homo sapiens
tcttatatacagttacatattagtttttaaaactatatgcatatatgtacatacagtgcgggggatggactgagacccagtactaccacgtaacaaatagcaaagcaatatactaaacacctagcaccctcaagtggccaactgtgttatttctcattctgatct

SEQ ID NO: 132377 - DNA, 646 bp, Homo sapiens
tgacaggtcagggcattgacaatctgctccctcttctatgcaaattacatgcccagcctggctctcagcaagcgacttctcctccccatgataaatcagtttctattgctaccaagaaaatgcatgcagtaagattgctttgttttcttttaaaaaatacattaattctactttttcgtaattaaaagttgccagaaattgtaagccctgcactcagttttgtaacagctttttgttaaggttgaggaagtgaaacagcaaaactaaatatctcctattaattatacctattgattttaagatatatcaagttcagaattttaaatgtgacaaactttgtgccttgcaaacatgaaggcattgtcttcaaacatgaagtaggtagcttgcataatttcctatagagctcttattaagagataggagaaaagcactgctccagaatacacataatttaggttttcagtatgaaatttgaagaaactgaatttacattattaaatcaactaatatgagagcttctaggggaattttgttattgttttattagctatgaaataacatattgcctttgatatctcattttctactctcagtattctacccacttctagccacctttcatcaccacctatttcagcaaaaa

SEQ ID NO: 132378 - DNA, 326 bp, Homo sapiens
caggggcccaaaggtgagactgagcgagtgggtgaactgtggatgaaatgttacgaactcaggtctgcggagatggaaaaaggagagaaggcagtgcccacggaatgaatcgaagagaaaaatagaattagtcactgaacagattatcgaattgagcaaatctttaaagaattccaaagatagaaatgtcttggacacagcaggactaatttttgtttcaacattggaaggcagccctgcttcttattatagacatgttcaaatagtttaagtgctggttactgaccagattatctggtacaaacatttatattacagcaagttac

SEQ ID NO: 132379 - DNA, 366 bp, Homo sapiens
atatccacaccagggattagtcatgagaaatcatatagtggtggctttaaatgtattaacatgaaaagatgtccaagatggatgaaagaaagctgccaaaatggtccttgtggcaggcaggactccacgcctgcaaacatgtaaaaccaaaacaatatcaaaaggaaaggaaaagggtcacaagtcaatctccccttcttcctgtgtttttaactcacttggtgaaaaaatatgctatgaagaatttaaaagatattttatgtagatctcaaactacccagacttctcacaaatgacagggctgtgactgaccccaaaataccagttaaagggggagtcaggcatctgtccaatactcgaccatgc

SEQ ID NO: 132380 - DNA, 390 bp, Homo sapiens
tctgcatgccttttgtttcatcctttttagattaaagattatttcccttgctatggaaaatggaagcaaagtaggaggtgagcagttttgcttcctctttgttccctggtatatttacatcatttcctccaaacaatgtgtctttccttttcttgttcttcttgatctatacagagccataaaacctccttctgatgagttcagcattttctccaagcctctgctcttctcaagctctagtttaagcctctgttcttcctgagctctgtttggaggcagccctgcttcctccatcttttatatatggtctaagtctgtacctggaggagcttccaagaagcttcactaattccctccatgcttcctccttccctctctcactgtgcaata

SEQ ID NO: 132381 - DNA, 208 bp, Homo sapiens
aaaagcctttcattagatttgagttgaaaacttgataaggtaaatcaggtgatatgcaatttctaaaccactagtcttttccaaatatgagttgaactcctcttccagcattttatatttcctgtagtatttaagtttctttagattcatgcagtcaaaccttgacaattatctccttccttctgaaatcacacaaaaatcttgtttg

SEQ ID NO: 132382 - DNA, 337 bp, Homo sapiens
ttttttcttttgagtgtctttatagactcaaggacttttatttaattcagggtgttagtaccatttaaatgttttctttgatgctcagattatcacagctagtcatttggacctttataccacctcctatgtccatttgatataggccattaatctctataagccttcctccttctcttggaatgaaaaggtatcctaggctcacctgtaccttccctactccagacctggcactgtttggactctgggcactgtttggactctgggcactgtttggactctgagcactgtttggactctgggcactgtttggactctgagcactgtttggactatg

SEQ ID NO: 132383 - DNA, 526 bp, Homo sapiens
atatactgtttatgtgaaataaaatactgtgagatttgtgtaactactgcacagtaccagaaaatacgtaagtgctgaaattggaggtagcagtggacagacattaaagtttgagagataatatttcttaagatgtaccaatttatttcatttccttatttcttgttactttatttggagaagaacgtttaaaaatctacaaaaatattttcctagaacttaaaaaatactgtcttataacaatttttgcttgcttgctgcttgtagtagcttctctaagctcagctcacttagacactggccaagcagaatgatgacacagatgcaaattacttatcgcttgctccattctagatggggagctaaccttccttcaatataatagtagagctctgtggcttcccaaatatgtctctgtcattaaactattcttcctgaactttaaaaaaaggaagtcttaaaagtcagcaccactacttgatggtacttgtacacgaatctcccagcctctcggttttacctgcag

SEQ ID NO: 132384 - DNA, 218 bp, Homo sapiens
caaaaggaacaaagtcttgatatacagtaacctggataaatctccagaaaatgatgctgagtggaaagtaaaatctcaaaggttatatagtgtatgattccatttatgtaacgttcttgaaatgacaaagatacagcaaaattagtagttgtcggggtttaggaggggtggaagtgggaggaaagttggtgaaactataaaaggggaacatgaggcat

SEQ ID NO: 132385 - DNA, 883 bp, Homo sapiens
catcacggccggctaatttttgtattttgggtagagcgaggttttaccatgttggccaggctggtcttgacctcctgacttcaggtgatccgcccacctcggcctcccaaagtggtgggattacaggcatatgccactgcacctggccttggattcgcattagagtaagaaaatgtaatgaacagtccttacaagaaacagagctcaaataggataaagatcataaatgaattcactttggctatttaatgcccactcaaccatggctgaggcttctcccacctttgttctgctattgtttctacctcatcatctgctatcccaccgtgctttattatagataagagaaaccttgtaggacctaatatttgtgaagagactacagaatcagcatatcaggggaattgtatatacatttttttctgtagaaaaggaaagcaatggtaatttaaacttatttatatatttttaatatagtttaattatttgagtatgttttaacttcacattgcaatgactaggcctttttatacacgttgggaggattataactatatcagatgaattcaggctttgattaatttgtgcttaacaaaatgttgataatttttatatatcaaaaatcttttaaaggtgttaaatttttagcagaaatagatgaaaagggaccagagtcttatttctttaaaatatctttcaaaaatcagagatctgagatcatctagtataattttcaagttatcattttgttttaaattttacactacttgagagtactcaaattattaacctctaaagagatacagaaaccatgttaatttagaatttggttttcaatatgtgaaaaccacattggctgcttttattaaaatttttggatttt

SEQ ID NO: 132386 - DNA, 609 bp, Homo sapiens
tgcattgcacaggggaagtggatttcaaaatcatagaatgaatccaaccagatggaaaaaacaatcaggtcttggagacaagaataaacagggctctcctagggaatgatgggagttcagtttggatgaagcaaagtgtcattccagggggcatgaggccggcgtgcctgggagcccgggtaggctggactttgtcaagggaacaacagagaactggagactcccggccctggagcgaccttccaaggtcatccagcctgaccctctcccagggtcatctgacctgaccctctcccagctgcgtccatcccgtctcacaccttcctagccatggtcctgggcaaatgattcccctagccacttacacacccatttctgctcagctgtagcaaaatcagtcagattaaaaaataagttttcaatacaagtgccttcgaggtcatgatgtgcttatgtactttatcaaaatgtgtatcacctactcctagtccaactgcagtacacacgtctttccatatccacgcacagcatatccttcgctaagatgctgctgatgcaaatacacatcactctgcactgtaggccctgtggaaaaatggcatcccacga

SEQ ID NO: 132387 - DNA, 434 bp, Homo sapiens
cacatgaaagtcagtgcggggggacatcatgcttaagtctttctcagcttgacctctctttgcagaaaccaggctctgtgttctgaggggtagatcaggaagggaatgtgatatgtaatgagtcatggtgtgtcgcagtggatagcacagtttcgaataagtgcaatattggcatataaacatgagggagactttgaggttggggtgagcagggctgaccccgtgtgtgtgtgtgtgtgtgtgtgtgtgtgtgtgtgtgtatgtgtaacttggggacaggatagggtagcatctttacatctttacatgtcattggcctggaatagggggtcctgaagggtttgtcgtaagaaagagaaagtgctcattgctgcaaggggagcacagccgggttctgagaggcaaaacacttccctcacttcccacccaagagt

SEQ ID NO: 132388 - DNA, 168 bp, Homo sapiens
ccctcctcattctcttatccacactctctccttaagcatccacatccagatcttcctgatgatgactccccagtggatatctccagtccaggcctcttccctgacccaactaacgtgcccacctctctattctacagcaccaccaagatgccttacaggcacctcaaa

SEQ ID NO: 132389 - DNA, 323 bp, Homo sapiens
aggtgttgggagactgggttgataatatgggggttgggagtgaggagagagtccagctttgaacatcttcttccatttgaggaatttaagatcatccagctagaaaattagaaatactaggatggagtgtggaagagaaattagtgctgaaaataaagagctcgaatcatcagtgtatgaatagtagttaaacctctgaaaatgagtgaacttgtcccctgaaaatgtgtggcaggggagaagcgaggttcaaggacagtgcccccgagaatgccagcatttaaagggtggaccctcggtggctcacgcctgtaatcccagca

SEQ ID NO: 132390 - DNA, 487 bp, Homo sapiens
caggcgatcctcccacctcagcctcccaagtagctgagaccacaggtgcgagccaccatgcccagctaatttttaaataatctgtagagacagggtctccctgtgttgcccaggctggtctcgaagttctgggctcaagcactcctcccaccttaggaggaaccttcaaagtgtaattcttcaaagctccaggattacaggtgtgatccaccatgccaggcctaatatgcaactttaatatgttgcttactgtgtgttttcagaacacctgagtgtctatgcaggtgtgtgtgtgtgtgtgtgtgtgtgtgtgtgtgtatagacacacaaaacccactttttatagatatagggtataggcatgtgggtttttttgggagagagggtctcgctcggtggcccagagcgggagcgcatgggggagatcagggctcagggcagccgtgagctcgggggatcaaacaatcctcccaccatagccggggag

SEQ ID NO: 132391 - DNA, 751 bp, Homo sapiens
caagaaaagggaatcgcattagcatcagaatttgcatttgcatcagaatttacaacagcatagatgctagaggtcaatgggatcagagagaaaatgattttgaaccttcaattctacaactaggcaaactatcaattaaataccctttcagacaaagattgtttgaggacatattacatgcaaaattagaaaggaatctgaaagacaggaaggcatggggtagaacgaacagtggaattagcgcagtgtggtgccctgaaaggaaatcccagctgcgggctgcacaggaaccagaaagccagttcagaaccttccccactgattacaaatctgggtgattttaaggacatggaaaagaagagtgtgtttcttctttggatgagaaatgaaaggcagaacaagaaggagccaggaaaaagaacaaactgaacacggcagtcatggcccaaatatgtacaatttaaactaaagtgcagcaactgatgggtttgagaagctgatggcgtgtgcagtaagagaatccctctgaccccaagtcttgtgtcttcttcaagcagcctaggtttagtgacttgagaatacagttgcttctctgaggggccaacctggtactgtttttgtaatcatagtactataagagctatgttgaaatcgacctatagacaaagcccagaagtcatagcttagaaatgcggtaaccttgatcatataaaagaagttaataaagtaaaagaattggtaatatatttga

SEQ ID NO: 132392 - DNA, 3650 bp, Homo sapiens
aaaagcaactgaggtcttaactttcagacgctgaattctcatctaattgaaattactgggcataatgctatatatagccaatgaagagattttgagctctcactcagtgccttcaagacatgtcgttttgtagtcagagaaaacagagatcaatgcattttcaaactgacagagggaacggatgctctttagtagcacatgcccaggatcgtgtgtgtggggcttgcgctgtgctgagaagctgaataccggtccatatgctccttatttactgcaatgttctttgcatgttactgtgcactccggactaacgtgaagaagtatcgatatcaagatgaggacgctccacatgatcattccttacctcgactaacccacgaagtaagaggcccagaactcgtgcatgtatcagaaaagaacctctctcaaatagaaaatgtccatggatatgtcctgcagtctcatatttctcctctgaaggccagtcctgctcctataattgtcaacacagatactttggacacaattccttatgtcaatgggacagaaattgaatatgaatttgaagaaattacactggagagggggaattctggcctgggattcagtattgctggggggacagataatccccacattggagatgaccctggcatatttattacgaagattataccaggaggtgctgcagcagaggatggcagactcagggtcaatgattgtatcttgcgggtgaatgaggttgatgtgtcagaggtttcccacagtaaagcggtggaagccctgaaggaagcagggtctatcgctcggctgtatgtgcgtagaagacgacctattttggagaccgttgtggaaatcaaactgttcaaaggccctaaaggtttaggcttcagtattgcaggaggtgtggggaaccaacacattcctggagacaacagcatttatgtaactaaaattatagatggaggagctgcacaaaaagatggaaggttgcaagtaggagatagactactaatggtaaacaactacagtttagaagaagtaacacacgaagaggcagtagcaatattaaagaacacatcagaggtagtttatttaaaagttggcaaccccactaccatttatatgactgatccttatggtccacctgatattactcactcttattctccaccaatggaaaaccatctactctctggcaacaatggcactttagaatataaaacctccctgccacccatctctccagggaggtactcaccaattccaaagcacatgcttgttgacgacgactacaccaggcctccggaacctgtttacagcactgtgaacaaactatgtgataagcctgcttctcccaggcactattcccctgttgagtgtgacaaaagcttcctcctctcagctccctattcccactaccacctaggcctgctacctgactctgagatgaccagtcattcccaacatagcaccgcaactcgtcagccttcaatgactctccaacgggccgtctccctggaaggagagcctcgcaaggtagtcctgcacaaaggctccactggcctgggcttcaacattgtcggtggggaagatggagaaggtatttttgtgtccttcattctggctggtggaccagcagacctaagtggggagctccagagaggagaccagatcctatcggtgaatggcattgacctccgtggtgcatcccacgagcaggcagctgctgcactaaagggggctggacagacagtgacgattatagcacaatatcaacctgaagattacgctcgatttgaggccaaaatccatgacctacgagagcagatgatgaaccacagcatgagctccgggtccggatccctgcgaaccaatcagaaacgctccctctacgtcagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccagcaaaaggagggtggaaagaaaggaacgtgcccgattgaagacagtgaagtttaatgccaaacctggagtgattgattcgaaagggtcattcaatgacaagcgtaaaaagagcttcatcttttcacgaaaattcccattctacaagaacaaggagcagagtgagcaggaaaccagtgatcctgaacgaggacaagaagacctcattctttcctatgagcctgttacaaggcaggaaataaactacacccggccggtgattatcctggggcccatgaaggatcggatcaatgacgacttgatatctgaattccctgataaatttggctcctgtgtgcctcatactacgaggccaaagcgagactacgaggtggatggcagagactatcactttgtcatttccagagaacaaatggagaaagatatccaagagcacaagtttatagaagccggccagtacaatgacaatttatatggaaccagtgtgcagtctgtgagatttgtagcagaaagaggcaaacactgtatacttgatgtatcaggaaatgctatcaagcggttacaagttgcccagctctatcccattgccatcttcataaaacccaggtctctggaacctcttatggagatgaataagcgtctaacagaggaacaagccaagaaaacctatgatcgagcaattaagctagaacaagaatttggagaatattttacagctattgtccaaggagatactttagaagatatatataaccaatgcaagcttgttattgaagagcaatctgggcctttcatctggattccctcaaaggaaaagttataaattagctactgcgcctctgacaacgacagaagagcatttagaagaacaaaatatatataacatactacttggaggcttttatgtttttgttgcatttatgtttttgcagtcaatgtgaattcttacgaatgtacaacacaaactgtatgaagccatgaaggaaacagaggggccaaagggtgggacagaaaagacattgcagtatgaaggaaggctttggtttgctcaaagtgccaggtgtagggatgaacctctgacgggctttctgcccaagagatgagatgagagcctcctcaccccagcagatgtccagagctgatttagctgcagagctctctgtgtcttttgctttaaagaaaaattgccagcactcgaacctcatcagccttcccattacccacatctgtaattggtacactttgaattttataactatgcacatcttttgatttcttaacaagcaaatgaaagaaagaaggaaaaaagaaaggaatccctttggagacgacatactatcagggaaggataagtgtgtagttttttgactggcatctgcaaagacaagaatttcataaaatttgcaagtgtatggaggactaacctcactgacaggaggggattccacctgggattagctttatgattgttgattgcctattttgccatttataaactgaaagaaggcactaaagatgagaataatttatacaataaaaatatattaaatgtatagaaacaaatttctataggttaaaaaagtt

SEQ ID NO: 132393 - DNA, 787 bp, Homo sapiens
ataaaggcaagtgtgaaccggacagcagacaggagaacctggcaccaaggagacggagaagctgcctttggtgcctcctgcctcctccctgctttgttccaataattttgtgctcgattacgctcgatttgaggccaaaatccatgacctacgagagcagatgatgaaccacagcatgagctccgggtccggatccctgcgaaccaatcagaaacgctccctctacgtcagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccagcaaaaggagggtggaaagaaaggaacgtgcccgattgaagacagtgaagtttaatgccaaacctggagtgattgattcgaaaggggacatccccggattaggtgacgacggttatggaacaaagactctgaatactttcttcatttgctaaaaagaagaaacagcaatcaagcagcgggttcctgtaaaatggagataaagttttcatcttctttatcttatctgagttttcttaatgcagcctcctctgcggcttttacttgcctttcgctcacatttctggtagccttgcatgagtgtattcctttccgttctggctgctcttcaatgcttggtatctctttaatttgctgtgctgttcttgcagaacatgtttcttctaatgcca

SEQ ID NO: 132394 - DNA, 3169 bp, Homo sapiens
aactgtgaagctctccgggccccaaactatcagtagcataaaatatgaccaaggtcaatgggacagaaattgaatatgaatttgaagaaattacactggagagggggaattctggcctgggattcagtattgctggggggacagataatccccacattggagatgaccctggcatatttattacgaagattataccaggaggtgctgcagcagaggatggcagactcagggtcaatgattgtatcttgcgggtgaatgaggttgatgtgtcagaggtttcccacagtaaagcggtggaagccctgaaggaagcagggtctatcgctcggctgtatgtgcgtagaagacgacctattttggagaccgttgtggaaatcaaactgttcaaaggccctaaaggtttaggcttcagtattgcaggaggtgtggggaaccaacacattcctggagacaacagcatttatgtaactaaaattatagatggaggagctgcacaaaaagatggaaggttgcaagtaggagatagactactaatggtaaacaactacagtttagaagaagtaacacacgaagaggcagtagcaatattaaagaacacatcagaggtagtttatttaaaagttggcaaccccactaccatttatatgactgatccttatggtccacctgatattactcactcttattctccaccaatggaaaaccatctactctctggcaacaatggcactttagaatataaaacctccctgccacccatctctccagggaggtactcaccaattccaaagcacatgcttgttgacgacgactacaccaggcctccggaacctgtttacagcactgtgaacaaactatgtgataagcctgcttctcccaggcactattcccctgttgagtgtgacaaaagcttcctcctctcagctccctattcccactaccacctaggcctgctacctgactctgagatgaccagtcattcccaacatagcaccgcaactcgtcagccttcaatgactctccaacgggccgtctccctggaaggagagcctcgcaaggtagtcctgcacaaaggctccactggcctgggcttcaacattgtcggtggggaagatggagaaggtatttttgtgtccttcattctggctggtggaccagcagacctaagtggggagctccagagaggagaccagatcctatcggtgaatggcattgacctccgtggtgcatcccacgagcaggcagctgctgcactaaagggggctggacagacagtgacgattatagcacaatatcaacctgaagattacgctcgatttgaggccaaaatccatgacctacgagagcagatgatgaaccacagcatgagctccgggtccggatccctgcgaaccaatcagaaacgctccctctacgtcagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccagcaaaaggagggtggaaagaaaggaacgtgcccgattgaagacagtgaagtttaatgccaaacctggagtgattgattcgaaagggtcattcaatgacaagcgtaaaaagagcttcatcttttcacgaaaattcccattctacaagaacaaggagcagagtgagcaggaaaccagtgatcctgaacgaggacaagaagacctcattctttcctatgagcctgttacaaggcaggaaataaactacacccggccggtgattatcctggggcccatgaaggatcggatcaatgacgacttgatatctgaattccctgataaatttggctcctgtgtgcctcatactacgaggccaaagcgagactacgaggtggatggcagagactatcactttgtcatttccagagaacaaatggagaaagatatccaagagcacaagtttatagaagccggccagtacaatgacaatttatatggaaccagtgtgcagtctgtgagatttgtagcagaaagaggcaaacactgtatacttgatgtatcaggaaatgctatcaagcggttacaagttgcccagctctatcccattgccatcttcataaaacccaggtctctggaacctcttatggagatgaataagcgtctaacagaggaacaagccaagaaaacctatgatcgagcaattaagctagaacaagaatttggagaatattttacagctattgtccaaggagatactttagaagatatatataaccaatgcaagcttgttattgaagagcaatctgggcctttcatctggattccctcaaaggaaaagttataaattagctactgcgcctctgacaacgacagaagagcatttagaagaacaaaatatatataacatactacttggaggcttttatgtttttgttgcatttatgtttttgcagtcaatgtgaattcttacgaatgtacaacacaaactgtatgaagccatgaaggaaacagaggggccaaagggtgggacagaaaagacattgcagtatgaaggaaggctttggtttgctcaaagtgccaggtgtagggatgaacctctgacgggctttctgcccaagagatgagatgagagcctcctcaccccagcagatgtccagagctgatttagctgcagagctctctgtgtcttttgctttaaagaaaaattgccagcactcgaacctcatcagccttcccattacccacatctgtaattggtacactttgaattttataactatgcacatcttttgatttcttaacaagcaaatgaaagaaagaaggaaaaaagaaaggaatccctttggagacgacatactatcagggaaggataagtgtgtagttttttgactggcatctgcaaagacaagaatttcataaaatttgcaagtgtatggaggactaacctcactgacaggaggggattccacctgggattagctttatgattgttgattgcctattttgccatttataaactgaaagaaggcactaaagatgagaataatttatacaataaaaatatattaaatgtatagaaacaaatttctataggttaaaaaagtt

SEQ ID NO: 132395 - DNA, 3526 bp, Homo sapiens
gattttttaaacttttattttagcttacagattgcagtggatcaaaggaaaatgcttcatgtattgagcaaaataaagaaaatcagagttttgaaaatgaaactgatgagacgacaactcaaaaccaaggcagatgcccagcccagaattgttcagtggaagcccctgcttggatgcctgtccaccactgtactaagtatcgatatcaagatgaggacgctccacatgatcattccttacctcgactaacccacgaagtaagaggcccagaactcgtgcatgtatcagaaaagaacctctctcaaatagaaaatgtccatggatatgtcctgcagtctcatatttctcctctgaaggccagtcctgctcctataattgtcaacacagatactttggacacaattccttatgtcaatgggacagaaattgaatatgaatttgaagaaattacactggagagggggaattctggcctgggattcagtattgctggggggacagataatccccacattggagatgaccctggcatatttattacgaagattataccaggaggtgctgcagcagaggatggcagactcagggtcaatgattgtatcttgcgggtgaatgaggttgatgtgtcagaggtttcccacagtaaagcggtggaagccctgaaggaagcagggtctatcgctcggctgtatgtgcgtagaagacgacctattttggagaccgttgtggaaatcaaactgttcaaaggccctaaaggtttaggcttcagtattgcaggaggtgtggggaaccaacacattcctggagacaacagcatttatgtaactaaaattatagatggaggagctgcacaaaaagatggaaggttgcaagtaggagatagactactaatggtaaacaactacagtttagaagaagtaacacacgaagaggcagtagcaatattaaagaacacatcagaggtagtttatttaaaagttggcaaccccactaccatttatatgactgatccttatggtccacctgatattactcactcttattctccaccaatggaaaaccatctactctctggcaacaatggcactttagaatataaaacctccctgccacccatctctccagggaggtactcaccaattccaaagcacatgcttgttgacgacgactacaccaggcctccggaacctgtttacagcactgtgaacaaactatgtgataagcctgcttctcccaggcactattcccctgttgagtgtgacaaaagcttcctcctctcagctccctattcccactaccacctaggcctgctacctgactctgagatgaccagtcattcccaacatagcaccgcaactcgtcagccttcaatgactctccaacgggccgtctccctggaaggagagcctcgcaaggtagtcctgcacaaaggctccactggcctgggcttcaacattgtcggtggggaagatggagaaggtatttttgtgtccttcattctggctggtggaccagcagacctaagtggggagctccagagaggagaccagatcctatcggtgaatggcattgacctccgtggtgcatcccacgagcaggcagctgctgcactaaagggggctggacagacagtgacgattatagcacaatatcaacctgaagattacgctcgatttgaggccaaaatccatgacctacgagagcagatgatgaaccacagcatgagctccgggtccggatccctgcgaaccaatcagaaacgctccctctacgtcagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccagcaaaaggagggtggaaagaaaggaacgtgcccgattgaagacagtgaagtttaatgccaaacctggagtgattgattcgaaagggtcattcaatgacaagcgtaaaaagagcttcatcttttcacgaaaattcccattctacaagaacaaggagcagagtgagcaggaaaccagtgatcctgaacgaggacaagaagacctcattctttcctatgagcctgttacaaggcaggaaataaactacacccggccggtgattatcctggggcccatgaaggatcggatcaatgacgacttgatatctgaattccctgataaatttggctcctgtgtgcctcatactacgaggccaaagcgagactacgaggtggatggcagagactatcactttgtcatttccagagaacaaatggagaaagatatccaagagcacaagtttatagaagccggccagtacaatgacaatttatatggaaccagtgtgcagtctgtgagatttgtagcagaaagaggcaaacactgtatacttgatgtatcaggaaatgctatcaagcggttacaagttgcccagctctatcccattgccatcttcataaaacccaggtctctggaacctcttatggagatgaataagcgtctaacagaggaacaagccaagaaaacctatgatcgagcaattaagctagaacaagaatttggagaatattttacagctattgtccaaggagatactttagaagatatatataaccaatgcaagcttgttattgaagagcaatctgggcctttcatctggattccctcaaaggaaaagttataaattagctactgcgcctctgacaacgacagaagagcatttagaagaacaaaatatatataacatactacttggaggcttttatgtttttgttgcatttatgtttttgcagtcaatgtgaattcttacgaatgtacaacacaaactgtatgaagccatgaaggaaacagaggggccaaagggtgggacagaaaagacattgcagtatgaaggaaggctttggtttgctcaaagtgccaggtgtagggatgaacctctgacgggctttctgcccaagagatgagatgagagcctcctcaccccagcagatgtccagagctgatttagctgcagagctctctgtgtcttttgctttaaagaaaaattgccagcactcgaacctcatcagccttcccattacccacatctgtaattggtacactttgaattttataactatgcacatcttttgatttcttaacaagcaaatgaaagaaagaaggaaaaaagaaaggaatccctttggagacgacatactatcagggaaggataagtgtgtagttttttgactggcatctgcaaagacaagaatttcataaaatttgcaagtgtatggaggactaacctcactgacaggaggggattccacctgggattagctttatgattgttgattgcctattttgccatttataaactgaaagaaggcactaaagatgagaataatttatacaataaaaatatattaaatgtatagaaacaaatttctataggttaaaaaagtt

SEQ ID NO: 132396 - DNA, 2277 bp, Homo sapiens
  misc_feature (2132)..(2132): n is a, c, g, or t
  misc_feature (2137)..(2137): n is a, c, g, or t
  misc_feature (2140)..(2140): n is a, c, g, or t
  misc_feature (2145)..(2145): n is a, c, g, or t
  misc_feature (2157)..(2157): n is a, c, g, or t
  misc_feature (2173)..(2173): n is a, c, g, or t
  misc_feature (2177)..(2177): n is a, c, g, or t
  misc_feature (2186)..(2186): n is a, c, g, or t
  misc_feature (2188)..(2188): n is a, c, g, or t
  misc_feature (2191)..(2191): n is a, c, g, or t
  misc_feature (2195)..(2195): n is a, c, g, or t
aactgtgaagctctccgggccccaaactatcagtagcataaaatatgaccaaggtcaatgggacagaaattgaatatgaatttgaagaaattacactggagagggggaattctggcctgggattcagtattgctggggggacagataatccccacattggagatgaccctggcatatttattacgaagattataccaggaggtgctgcagcagaggatggcagactcagggtcaatgattgtatcttgcgggtgaatgaggttgatgtgtcagaggtttcccacagtaaagcggtggaagccctgaaggaagcagggtctatcgctcggctgtatgtgcgtagaagacgacctattttggagaccgttgtggaaatcaaactgttcaaaggccctaaaggtttaggcttcagtattgcaggaggtgtggggaaccaacacattcctggagacaacagcatttatgtaactaaaattatagatggaggagctgcacaaaaagatggaaggttgcaagtaggagatagactactaatggtaaacaactacagtttagaagaagtaacacacgaagaggcagtagcaatattaaagaacacatcagaggtagtttatttaaaagttggcaaccccactaccatttatatgactgatccttatggtccacctgatattactcactcttattctccaccaatggaaaaccatctactctctggcaacaatggcactttagaatataaaacctccctgccacccatctctccagggaggtactcaccaattccaaagcacatgcttgttgacgacgactacaccaggcctccggaacctgtttacagcactgtgaacaaactatgtgataagcctgcttctcccaggcactattcccctgttgagtgtgacaaaagcttcctcctctcagctccctattcccactaccacctaggcctgctacctgactctgagatgaccagtcattcccaacatagcaccgcaactcgtcagccttcaatgactctccaacgggccgtctccctggaaggagagcctcgcaaggtagtcctgcacaaaggctccactggcctgggcttcaacattgtcggtggggaagatggagaaggtatttttgtgtccttcattctggctggtggaccagcagacctaagtggggagctccagagaggagaccagatcctatcggtgaatggcattgacctccgtggtgcatcccacgagcaggcagctgctgcactaaagggggctggacagacagtgacgattatagcacaatatcaacctgaagattacgctcgatttgaggccaaaatccatgacctacgagagcagatgatgaaccacagcatgagctccgggtccggatccctgcgaaccaatcagaaacgctccctctacgtcagagccatgttcgactacgacaagagcaaggacagtgggctgccaagtcaaggacttagttttaaatatggagatattctccacgttatcaatgcctctgatgatgagtggtggcaagccaggagagtcatgctggagggagacagtgaggagatgggggtcatccccagcaaaaggagggtggaaagaaaggaacgtgcccgattgaagacagtgaagtttaatgccaaacctggagtgattgattcgaaaggggacatccccggattaggtgacgacggttatggaacaaagactctgagaggacaagaagacctcattctttcctatgagcctgttacaaggcaggaaataaactacacccggccggtgattatcctggggcccatgaaggatcggatcaatgacgacttgatatctgaattccctgataaatttggctcctgtgtgcctcatactacgaggccaaagcgagactacgaggtggatggcagagactatcactttgtcatttccagagaacaaatggagaaagatatccaagagcacaagtttatagaagccggccagtacaatgacaatttatatggaaccagtgtgcagtctgtgagatttgtagcagaaagaggcaaacactgtatacttgatgtatcaggaaatgctatcaagcggttacaagttgcccagctctatcccattgccatcttcattcantattnctnggggnacagataatccncacattggagatgacnctgncatatttantncgnagantataccaggagatctgcagcagaggatggcagaatcagggtcaatgagatatcttgcggtgaatgagaactcgtcagagctg

SEQ ID NO: 132397 - DNA, 544 bp, Homo sapiens
ggattcagtgtgctcagattttcttaagaacatttataactatgcccgtgggggatattggtgtgtagttttcttgttaatgtctgcatttagttttgctgcctagacaacactgccctcataagaatgacttaagtagaatttctttcttttcaaattcctaggtgagttttgagaaatgggattatttcttccttaaatgtttggtagaatttatgagtgaagcaatctggtctttttttctttggcaagatattttactactatttcaacttttttttttttgaagacattagtgctatttaggctaagtatttcttcttgtgagagctgtggtagtttgtgtcttccaagcaatttgtccattttccattacatttaagttgtcaattaatagaaacaaaattgtacataatatttcctcattatccctttaatttctgaagagtttgtagtttgtgtcacctcattcctgataatggtaatttgtgccttctttcttcttttccagattatagtctgttttaggaaatgccttgtgtgg

SEQ ID NO: 132398 - DNA, 613 bp, Homo sapiens
ttaaaccctggattgttttgcaataaaagcaaccaccgtttattgagttaggtgcatatatgttatttcatttaagttggaagtaggaaggatctaagaaaaagcaatggatctgaagtagttgttttggcacaactcctagggctgggttttgggcttctgactcttcaaaacttacatgtcagcaaccccaagtattagtttcttgttgctgctgtaataagttgctacaaacttagtggcttaaaacagcacagatttattatcttatagttctagagtcatttattgtgttcctctgtgcattgtcagtgtaatggggtatgtatgccagcctgtatggcagtgtaagatattaaaataagaacaaagcccagttttcttagcactgcttgtatcaaagtgtgatttccatataagctcacatcatagggaatcagttgcaatctggtttcatggataacaagaccaggttatggaatatttttcattgcatgaagcctgttaaaagccagaagagaaaagcaatactttctgctgacattgggatcaactgagaatgtggtgggcttagtggtattaaataagataaaaagttgaaatcaaaatttaa

SEQ ID NO: 132399 - DNA, 208 bp, Homo sapiens
tgacctcaagtgatcctcctgctttggcctcccaaagtgctgggattagaggtgagccactgaacccggcctcatctgggtaccacgttctaatagcatctagtgtatccgtctcaattgctattgtctcttctttgtatgattatcttttagactcatacctctccttaaaaaaattaagataattttaggtgggttttgggaagga

SEQ ID NO: 132400 - DNA, 481 bp, Homo sapiens
ctggaacaaatgaatattcttaggaccaaaaaaaatgaatttcaacctcacaccaatataaaaatttaatagaagtgagttctatttccaaatgtaaattatatctcaaaatgtaaaaactaagattatagaacttctaaaagaaaatataggagatatttttggttcggcaaagatttattaataaaaagcacaaactatagaaaaaaattgacaaactgaacttcatcaaaatttcaaactttgttcttcaaaatatagtattcagaaaataaaaggcaagccacagacttggagaaactacttgcaaaatatatatccaacaaagtacctacatgtaaaatatagaaagaattcttaaaactgaataataagaaggcaaacaataatgtatcaaagaagatgtatgggtagtaaataactacgtgaaagatgctcaaaaacattagtcattagggaaatgcaaattaaaaccacaatg

SEQ ID NO: 132401 - DNA, 361 bp, Homo sapiens
agcctgctagaggcccagctcctgcctcgcaattgcctttgtaggccaagatcatgccgcgaagtggcctttcctagcctaacttttgctttttgacgcatactccggtcccaaaacttcctccagtcagccagtccaggccaagctcttcctcccaaaggcttctgcaggccaaaatcgtcctgaagtcaccctctgcaggcccagctcctgcctccaagtgctgtgtaggccaagctaatgcctcacagcacactttccaggctgagcatttccttttgtgcatcctctccaagccctgaacttactccagttggcctctccagaccaagctctccctcccagtggcctctacaggcca

SEQ ID NO: 132402 - DNA, 395 bp, Homo sapiens
ccgtggcccagagagatgctcataagatgcacgtttgctactcctccccatgttgtttttaaaaatgatatgattataggatgtactgtgtgaaagttacaaacacagtttttggtgccgacagataaatgattctcttgagtgaattacaaggatatgtataggttgagaagtgtttgcatttacttgcatggccaggttcagtggccggtagctaaagtgagtcaagtagcttgggtatttgtgtcaccatccaggatgtaacaaagcccctgggtctctttgctgagtgctccgtggtagaggcagtgctctgggctcccctgccagccctgcccttatgagcaggcaaagcatggtggaccagggtgttgatgaggatgaaacggccatgc

SEQ ID NO: 132403 - DNA, 423 bp, Homo sapiens
tgagaccctgtctcaaaaaaacaaaaacaaaaacaaaaaaaaaccagttggaggctgtacaatttcaacttgcttctgtcaaaaaacaagtttgcccttctatttgatatctgggtggtttttatgttctctacccatgggtgagcagtaagtacagctttataaagttatacttcactcacttttttatattactattttttaatttttatgttttgtagagaatagggtctggctctgttgcccaggttggtctcaaactcctggcctcaagcagccctcccagaggcctcccaaagtgttgggattaaggtgtgagccactgcacccctccacgcccgatatttctatttttttgactgatttgtgtgatcactgttttgcatggtgcaataattaggggttcgtgaaagaattttccca

SEQ ID NO: 132404 - DNA, 791 bp, Homo sapiens
cccagcaccgttgtggcacagggtagacttccttaaatgtgtgctcacatgatatttttaggctgtcccgcatgttagctcttcttttggttactcagcatctcttgagcagccaatatccaattatcatagtccttctaggactcattgctaatttccacatcccacttctctggcccataagtctaaatatgatattgcagtatagtattattaatgctgctgctgttttctaataagaagataaagtgttttaggtccagtttccttttttatttttatttttaaatttcttttcgaaacagggtctggctgtgtcaaccaggctggagtgcagtggcgtaatcttggctcactgcaacctcaacctcccaggctcaagcgactctcccacctcagctacttcagaggctgaggcagggaatcacttgaacccgggagggggaggttgcaggagccaagatcatgccactacactccagcctggtgagagagtgagactttctcccaaaaaaaacaaccatccaaacacacaacaaaaacaacgtgtgtcgcgccgccgcccgcggtcgcgaaaaacgtcttttaacaacccatcggtggggcgcgcggcggcccgccaggttacagctgaaccatggccatagcaggtcgcccacggaactcgggcccggcacaggtgcgtgtatttccccacaataaaaacgcccggggggaaccgccgttcgtcacaacccgaggacgtccagagccacagcgcctactacccagaacccgccagccaataaatg

SEQ ID NO: 132405 - DNA, 246 bp, Homo sapiens
atgacttgttttaagtgttctcaatatatctctttaacaatcaaaaaaatatcagcccccatagttgaaagtttgcaaaaaaaaaaaaaaaaaagaaaagaaaaataaattaaccatgaaagcttcagtgatactttgggctcaaatgagttctcaggcattttcagtaatataaggactctcattataacagctgagaaattcatagcaaaattactgactgtggttatgtatgtcacttactct

SEQ ID NO: 132406 - DNA, 303 bp, Homo sapiens
gaaaaatgggagtaggggagaatctccattttctcctcccacctttctgccagcccatttccccaagggtaaccattgttaagtttcttatgatttcttccaggagaaaaaaatatatattaaattgaggcataatgtgggagtcacattaatgtggtaagagctcatttgtttggaggtgactttctctctggaccatcaagaagaaagcactgacaaaaatgtcccagtgtaaatgaaaagcaacaagttggtagaacaaggagagggatgtcaagtcaaccagagtaggacagaataatg

SEQ ID NO: 132407 - DNA, 191 bp, Homo sapiens
ctagactcaaggcaataaatcatctctaccttcatcagattttcttttataaaaggaaagagaaattctaagttcttcaagacatggagaatattttcataatattctaggttattttgtagacattaaatctgaaaacctcaatatagtcaatgactgtattaaagcttgtagactggtttgggaaaaaa

SEQ ID NO: 132408 - DNA, 397 bp, Homo sapiens
attataactcataactatttcaacccaaggcatcggtttggaaatcaaagtttctagcttgcagtctattgtaattgtgctgaccatctcaaacattttacacatccttcataactcctttttacatcagtatcaaggaataaaatctttaacctgatgagtgtgctaaaacaataataattatataataaaatgtaacaacaatataataataaattagctcttaaatgtatctaaggttttctgatatctgggtaaatatgcatgttgaattcaaaagaaaacacagaaaataaattgaaacaaattttagacgctagtgtaaattaatatttccatttggaatacttccttgatggtagatggtaaaaatttttagatcaacacattttatgat

SEQ ID NO: 132409 - DNA, 362 bp, Homo sapiens
aatgcagtctttaaatatggaaacagaggaagtttacagtttaatcgaactatcatgccatcttttttttgagaaagtatctcactctgtcacccaggctggaatgcaatgacgctatctaggcttaccgcagcctccacctcccaggctcaagcaatcctcccaactcagcctcctgaaccatgcccagctaatttttctattttttgtagagacagggtttcaccatgttgtccaggctggtcttgaactcctgagctcaagcaatccacctgcctaggcctcccaaagtgctgggattacaggcttgagccaccactcctggcccatacaatctttttgaccaagctttcactatttac

SEQ ID NO: 132410 - DNA, 669 bp, Homo sapiens
cattattccaatttgaggagcaaaaactaaagatcattgagatccatggatctgctgccaggttcagtgactggaatgcacttgccccagcgggttcaagttctttgtagaaacagacccctcaaagatgacagcagctggcttcctccagaagtgtccttcaacactgtctttcagtactaagtgaccagtagaagttactccataaagaccatagccaggaatgaattatggggcttcctgcatatcaaatggttacctagggaaggcatatggtaaactagttaagcacagaggttctggaatcagactgcctaggtccaaatcctggctttacaacttactagctatgtgaccttaggtgatataacctctttacgcctcagttttcttacctacaaagcaggagaaataatagtaattagctcaaagggttgctataagaatcaaagaaaatcatgcaagcaaagcacttactacagtgcctggcacatagtaagctcttataacagttttctggtattattcttattaagccattttgtattatatccataaatgtagattcataaaatacataaaaatacaacttggtagaatttgtcttggttggcagcagttgaagcttctcatttgctaagaattaggtttagaatgttagaagggtga

SEQ ID NO: 132411 - DNA, 670 bp, Homo sapiens
gtcttagtgagtccaggatgctataacaaaataccatagactgagtggcttaaacaacagacatttatttctcacagttctagaggctcagaagtctaggatcaagggcttgcagacttgggcctggcagactgttttgatgctgatgaaagactgataaccatatggaccactaacatataccttaggtgtcttgataccccttacaactaaaccctgagaggcttacagcatccgtttataagaccctcttcaaaagcacagctttcttttagagtagattgcattttgtcatttcatcaacacatatgctttataacctcatcagaagtggtgtctccaatatcctccagaggtatttgggtgtgtttaacggccagaggatattggcagatctcattttctacaggctttgtgctacagaggcttatcttgaggagggccggtggcatccaggtgatgcctgttcctctacagagaatttaatacatcaattttatgtgttcagcaatttaaaggaagacatgaacataatgagggaaaatggacagtatgaaaaagaaacaaatgaagcctctagagttgaaaaatgttgtttctgaaatgagtatttcactggataggattaagaacaacctagacattgcaaaagaaaagcttagtgagtttg

SEQ ID NO: 132412 - DNA, 320 bp, Homo sapiens
ggaggtcgaggcaggagaatcgcttgaaccccggaggcagagactgcaatgagctgagattgcgccactgcactccagcctgggagacagtgtgagactccatttcaaaaaagaaaaaaaaataaaaagaaatgtgaccctattccgtggaattaattgttctttgtcatccccggtccccctcttctgttcaatgggcccagtgggtcctactgttctgtgcagctgtgacgtctccaccatcttccatccccccatatcttcttcagcttctacctatccaaccaatgtcagatttttcattatgagcggacagggtt

SEQ ID NO: 132413 - DNA, 672 bp, Homo sapiens
gcaactgaaatacttgtttgttcttagaaggagagaggtctaggtttggctcattcacagaaaagaacttttcaaaataaaaagagatttattataagtgtaacagattgatgtggggcactgattaagtatttttttctgccccatgttactgaatagtgaagaaataactgggtagatggcttcttgttgaggaaaagttactgaactcacaaaggtcaaatttaagtaaggcctctatagcactgtagggtgactacagttaacaacaatgtattctatattttcaaatagctagaagagaggattttgagtgtttccaacacaaagaaataaaagtttcagatgatggatatgctaattactatgatttaattataatacatcttagacatgtgtcgaaatagcacactctactccataaatctatataattatttatgtgtcaattaaaaaaataattaaaaagccaggagtggtggcacacacctatagtcccagctacttgaaaggctgaggagggaggatcattttagtccaggagtttgaggttgcagtgaactatgattccaccactgcactccagccagggtgacagagcaagactctgtcccaaaaaaaaaccaccaaacaaactttttgggcgcctcggccccaaaaaatttttagaaa

SEQ ID NO: 132414 - DNA, 745 bp, Homo sapiens
attaacccacttgctcattcactcactcatgctgtttctccatcatcatctgttttcatgttaacaagtcccagagggtcaagtgtcgagtgtcgggggctagggaggcaggtgtgtactgcatgcccagaaggtagcgagtagtctccaccccacatcgctgctcctctgcatgtctgcggcagccctcattcaagcaccgcgctgagtctcacagtctatgtctgagcgggagagaagccacagggagtccttaaacaggctcacagagtgaggaagcaggtctggagtctggcagagcagccaccatggctctgcagagcacgctgggctctgagtgtctgcagtgccacagtgggagcgggtgaggcaggcaggacgagcctcatcacaggcccagagactcggagagcagaagggttcgggaggtttctcttctatgttccaaaatgttagttttctcacttgttgaataattaaatgtgtgccacccagatatgctcagtttggatcactaagctttataactgtctgttcatttcttagcttagacttaattaaagtgatacgcttctcatttaaatagaacagggcacctatttagtattttggactttgccctaagtgtgtttcatgctatggcaatgcattcggatggaaagtaggaagaatgtggaaaagaccaggattcagagaatccacaggtactttctggagctttgcaaagaaagatttaaaaagaaaa

SEQ ID NO: 132415 - DNA, 354 bp, Homo sapiens
gtggccacccaaactgctggttttacagatgtgagctactgcgactggaccaaatgatgccaaatatattcctgaaaacaaacatacacacaacttctaaagtgtgatcaatgcatgactagtctagctttcatagttcaaataagactaaatatttgtgtggattttaaaagatatacctattccaggggttactggtaaggtttaaccaacaatcaatcactaaggcaattatttctggatcccatcacagacatcagtaacaggcagctggggagacatggaaggtttttgactatggcaaagatatgatccatactcagatttaagaaaaattactggggggaggctggg

SEQ ID NO: 132416 - DNA, 288 bp, Homo sapiens
tggcagtgaccaacctcaactcaaaaggtaagtatattttgtgttcctaagaatccagaaagttcaaaatttctattaagaagttgctgctggccaggcacaggggctaacacctataatcccatctctacaaaaaatacaaagaagccaggcatagtgacaggcacctatagtcccagctactggggaggctgaggcaggaggactgcttgatcccaggaggcagaggttgcagtgaaccaagattgtgccactgcactccaggcccagagcaagaccctgccttta

SEQ ID NO: 132417 - DNA, 153 bp, Homo sapiens
aaagcatgactgtgttcaggtactgaaatgggatgtaaatgaaggtaactaggaaggagctggctagcatttcaactgaatatcaacctggatagtgacatcatcactgaagactgtaattggtgggggtaaccatatgacccagtttgcctg

SEQ ID NO: 132418 - DNA, 293 bp, Homo sapiens
ccatccctatgcatcagtggcctcattgccacagaccagtagcctcattcctatggaaccatggtttcatccccaaagatcaataatttggtcttctaaaatctgtagccttcagcacattaaccaataagcccatcctcatggaaaaatgccccaccccattagatcaatagcctaactcccagggattggtgccccttttgcaatgaccagaggctccctatcttcatctccatagatcaatggtcttatccccaaagatcaatagcccagcctccaagaatcagtaacca

SEQ ID NO: 132419 - DNA, 727 bp, Homo sapiens
gggagacgcgggtgcggctcacccagcgttacctccgctactttcaccctagtccgagccaccgcttcgctagcctgggttcctgtgaggaccttctcaccagcctgggttcctgtgaggaccttctcaccggactcgctgctcccgcctttgctctcaaaccatccatttacccaagacgatggtttagcccctggaggctgttgcctggaggtgtcccatgatttcatcccttcccttagctaccacctgtgttcactctgccgtatatagtctctctctcccccctttccttattttgccttgtttcccaagcttaagataaccctccccacccacacccccatggagctagggctgcccactattttcactaaactcatagctcaaatatcatctccggcaccccccaccacaacccatttcaaatagtcaccctgtgtcacatcgtcctgtgctaagtttttgttgggcacctgtcactatctgatctttaacccatttattccttgtctctgccccgtgttaatgtgttcagagctgtatccccaggacctagaacaagacctgttatatagtagaaacccgatatgattgaattgaatgctcgctcttatctggaatccccaccactagcacaattcctggcacattgtaggtgctcaaaaaatgaataaaggtctggatagcagtccaaaggaatacatcccaatttggcagacaatag

SEQ ID NO: 132420 - DNA, 496 bp, Homo sapiens
gttcaagtgattctcctatctcaacctcccaagtagttgggatcacaggcacgtgccaccatgccctgctaatttttgtattttttagtagagacaggttttcaccatgttggccaggatgatctcaatctcttgacctcgtgatccacccgccttggcctcccaaagtgctgggattacagcatcaattcttgtgctcaagcggtcctcctgcttcagtctcccaagtaattgggactacaggtagcaccaccatgcccagctaattttaataaattttttttttaagagacaaggcctcactatgttgtccaggttggtctcaaactcctggcctcaagtgatcctcacacctcagcctcccaaactgctggaattataggtgtgagccactgtgtctggcctaactgttctttaagcttgtaaagaacatcttctgactgcccacctttttgataatcctttaagttcttgtctttaagtcataggcacccat

SEQ ID NO: 132421 - DNA, 1094 bp, Homo sapiens
gaaatgctgtttagttttaacaagtaagtgtttagtttcatcagaggtatgagaatgaggggaacgggggtaattaaatgctatattctttaataaagtaggtcagtttttatttcaggtcaatatcttttttatgaacattcctaatatacttatgtaaatgtcctgtcttagtctgagcagaaggggaaggaaaatgaaacttctggatgtcgtggtccttttctaatcagaagagaccatccctctctctcaatttgctttttccatcttcagcttctacaatatagctatgttcaattgtcctttcaactaacgttggtggttttgcagcagtttttgtacttgacttaggtttaactgtttattcagaatttgccatgttaaagctaaacaggaaattaaatcacagatataaaatgatgtctgtattaaatataacctcatagggtttatgtaagagataaacacaaactcaagcctaaaatacagtgagcagttgtacatacattattgatatataattaggttaattattctttaatttaacaaatatttactgaatgctgttgtgtgtcaggcattagtgctgattactaggaatataacagtgaagatgatgttcaaaatcctgctcccacattttagtgggaaagttagtaaatgttttagaattttctctttcctttatttggtcaactgtttttttgtatttgaaaggaataatttaaaaaactcattagtaaatgacaatgagccacattgttaggaagaactttcccttgtcacacttactgaagtaggggccagatgtggtggctcatgcatttaatcccagcactttgagaagctgaagcaggaggatctcaggagcccaggagttcaagatgagcctgggcgataaagtggaccccatctttaccaaaaaatgagaaaaataattagctgtgtgtgttggcatgaacctgtagccccagctacttgggagacttaggcaggaggatcacttgagtccaggagttggaggctgcaatgagccatgattgtgccgctgcagtccagcctgggggtaccatagtgagattctgtctcta

SEQ ID NO: 132422 - DNA, 637 bp, Homo sapiens
ctccaggagacatctaagtatgtctcattggccagagctatgtcacagggccaccctagctgcaaggaagtctgggaaagaggatatcttgccaaagactatgcacatgtcttccatgaacaaatctgtgcttcttcagtgaaggagaagggccggataatattggtgggacctggaagagtctaccctcacacagcctggtggagatggtcaggggttacagaagagcaagctggctggagcagcagccaccccccacacacgtgccgcatttgccttcagcttagatcacaccctgatgcttccatgaggatgctgagtcaagaaagcagtcttagggtgtggacaagaggagcttcttcatgcagcactgctaactctgcatgtttattccagctactgacatggtttccaattctgtgagattcataagggggaagggaataaaatttcagctacccttaggtagcatatttgcgtcctctgtgtctttctcgagtttgtgcccttctgtgcctttgtgtgtggcttaaatattgaagaatcaaaggctgccacgccagcagacagctgtgccacatcacaggcattccacaggcaattcctcactcccacttttttgacagttgcaccagtg

SEQ ID NO: 132423 - DNA, 495 bp, Homo sapiens
tatcctgtggttcttagctgaaatgtcccttcctcagaggagccaatttctaaagcttaagactgggctgtaaaaaatcacatacctcccctcccattcttaatgtgtaactgtgtgtttatttgtggtaaagggtttactggctggctccttctatcacattcaaggagcatgagggtataggctggctgtttctattcagtgttttatcttcagtgcttaatccatatggagcctgtcacggaccctcagtgaatgtttgacgagtgagtgagtgagtgagtgagtgagtgagtgagtgagtacttgtgcccaggtcaaaccaggtgctaggaccctggcaggggttccataaggctatgctggggttcaggcaacccaaggctggtctggagagtgtaaggcttgagagctcttcttcaggctcagtcatccctgcttccccagggctcatgtccacatgctattgtccatagaagctggggtccaaagttg

SEQ ID NO: 132424 - DNA, 488 bp, Homo sapiens
cactgaggtttcaagcagcttgtcaacagtgaggatagatgctggccagacctacttgtgcattcttggctgtggtagattaatgcaaagccatctggcttgtatctctttaagcttgattaatgcagtttcacatcccaatttcagcatgctgatcaaatcaggtttctgagccatcatcacgtctgaaaacttgaccttgaggtgatggattcaccaaggcttagccactggtaaggatctggttgagtgatcagccaaccttctcgaggttgggaaatttctttcagcaataccaataaccttgaccacgagactaatgttcctggattctcttgctagttgcttctcaggtgaccactaaagtgaccactaagtctaggaaaaacgcctttgatgtctggctcagataactgctctactatgaccttcactgtcatctcttgctgccaagttctgttatctcaaggtgatattcaccttgaaaa

SEQ ID NO: 132425 - DNA, 405 bp, Homo sapiens
agtatatgcttttcatcttactcccatattctcatttttctttgttattctggtagaatggtttcttttcctgtataaagctgcctgtcagtctgtgctctgagtcatacttttttctgtcttacgaaagacttcaaacctatgagtacccttactttctgctacttagtactctcacctctttaacttttgaacttgttacagtctcacttgtttggggaggagcacacgcataccttcattggatagttactatttcagtcatgaaagtttcttctttcaaggagatcagaatctcctgggggagaggtagataaagataatcacagttacatataaattctgtgataggtgtatttatactctgctttaggaataatagctcctttagcttaggagatggag

SEQ ID NO: 132426 - DNA, 135 bp, Homo sapiens
cccttgcagtactgtggtgttggatgtggtaaagggtagcctgggactgagtattctagaaaaattgctcagccttgtgctgtgcacacctggttctctttccagtgttatttatgtagctgaggaccatcgttg

SEQ ID NO: 132427 - DNA, 445 bp, Homo sapiens
gatcggcatactggaccttctgtctaacctgacggttctctggtaccttcaagtggatttttattttttggacccaattttctagtctcatggagattgttgacctgccatggttattaaatcataattgcaagtggtacccaattgggatttaaatcctggttcactgtttactagctgagtaaccttgggttaatgacctcttctctcttagtctcaatctctttatctgtgaaatgggtatagtaataattgcatcctcctcatcagatggctgtgggaactaactaataaacacaatgtttgcatgtagtatgcactcaacaaaggatagctactataataatacatttttagctttgtttttgttattgtactatcaagtaagaaaaaactgtgggaaggtgttaggggtttcatagcatgactttgaggggactgaggg

SEQ ID NO: 132428 - DNA, 437 bp, Homo sapiens
gatcggcatactggaccttctgtctaacctgacggttctctggtaccttcaagtggatttttattttttggacccaattttctagtctcatggagattgttgacctgccatggttattaaatcataattgcaagtggtacccaattgggatttaaatcctggttcactgtttactagctgagtaaccttgggttaatgacctcttctctcttagtctcaatctctttatctgtgaaatgggtatagtaataattgcatcctcctcatcagatggctgtgggaactaactaataaacacaatgtttgcatgtagtatacagctctttctcagtatagtacccacctgcggtgctttgtcattttagctgtaaagtatgaaatggtgaggcgtttctaggccaggagacgtctgatgggtctggggtattcagggccta

SEQ ID NO: 132429 - DNA, 1621 bp, Homo sapiens
tttgctatatgtaatcccaactactgttttcttgagagtagcagaggattagaaaaagtcctccataaattatgtaaccggccttcctgactagcctgactcaagcaatgtaagagataattattctgttttcataatttataagtgtgggggcatgcctcagcataaaaacaacctattagggaaaaacatctaatagattacctttatcgcctgttagggttttatgttgtttttaactcagatgccataagaacaaagatacatgtaatttataatagtaatcattaatacctatattgtgctttaaggtttacaaaataatttttctcatactttatcttagtttagtttcttgacagtccatgaggtaaggtggtagctttatcaccattttacaaagtgggaaacgaaggttcctcttaggaacctagttgtcacctttgtataataaaacttcgaagctcggagctgttaactggtttgctgaaggcttagctgtaagagccagaattcagacccaggtctgagtgacttcaaactgcacagtccttcccattattacccatatgctatcccttatatttttaatttattaggaattcattcatttataaacttggtgattcacctttattagattctggtcgctgaaggctttagtaacttcagagtaaaacttgagagatgagatgtaaaatgcagccattcttgagagttcctttttctataacattcatcaacacttcattgagaagtgaaggttcctatggctgtctctaccttcaagaggcttagctttagtcactgagaaagacaaggaaactaatgatagaatatagtagcttcttctggcgttaggtatcacagagtcacagctagttacagctagccctttattattgaaagaagaggagctagcagtcccactatcagaattaagactagagatggtaataggagctagtatcagaaaagcttaaggcaaagcataaagtgtaggctagaatgaagctggagaatggggagggggcttgggtaacatccagaacctggctggggacctggaactacatgagatgtaagaatggagaggttctagcagtcagaggtcaggtacaaatgaacagctgggatctgcgcatggcagacagtgaaaaaacccaggcaagcaaaatggtcagagcagaaaggggcccaaggccacgttcttgagatgtggagggggctgaggaagccacgccaagtaaggacagatgcagctcagcagttcctagcgagccctgacaagccagctcagctgaagcttcgggtgggagccagtcatggcacagtggagtgaaggaagagcagtttcaggcacccaaaacctgacccccacgacctgttttccacctgaagagccacccattccatccaaacccttggcaaaagtctgctaacagagagaaccggccagtgtgctggccagtcgcgatcatgcctgtctttaccctctaagctgaagctgctcatcaacggtgagatggcaaaaaggtgggtccagaagaggggaaaagaagggagtctgtgaaaacaaaatgctgaagaatctgcatcaaataaacccttccttccttcc

SEQ ID NO: 132430 - DNA, 457 bp, Homo sapiens
acatgtcttgtattttattagagagtttaatattttattcatgttactggaaaagttcttataaaaatagcactaaataactggatacaggttcttcacaaagtcgtaaaaacagagaaaggcttagggttttgtctagcattgtaaaataaaatccaaagggctggggggaaccaactttttattctagcgacttttctgcttttttagtgtttcatatcacataataaatacatgcaggttatggtataggttacattctttgattatactagcttaattttaagtgtttgattaagcatctgtgatgtcgttaagattttgttcttaattctcacctgaaatgagaatgctgatggtgtgcacacttagcagtttagtgttaatggctacctctgaggaccatacctttttaattgaatactgtatgtagcgcgaccttcatgttgctgcagtt

SEQ ID NO: 132431 - DNA, 773 bp, Homo sapiens
gttcatcgattgtaacacatgtaccactctggtaggggatggtgataatgagggaggccatgtatgtgtgggggcacaagggatatatgggaaacttctgtaccttcctttcaattttgctgtcaacctaaagctgttaaaatatctttttaaaaaagtttaaattaaaaaaacacgacagtgaatgccaggcttttacccagcagattcacaataattcctataggaatccatttaagaaagggttgagaatgtgaaatgatggatatgttaatttgtttcactgtaagaaccattttactatatactaatatcatattttataccttaaatatacacaataaaatttatttttttaataaaggggtgagaaaaggttatcagaaatgcagaataaaagttctctcctgtaatgacttgaagtgaaaggtagaaatgtccacctcccagccccttttcaacacacagttttgtttagtacccacatggaactctttatttcactgctggagcatatgaaatctgttctttagacgttagtttccatcattttggggactttggtgttattagtagtgattatggtatatttacttttagttaccaaactttatgtgctagtcattacctttgtgttgttgttattgtccaactttgacacttgtcctgcagctaaaataaaaaataatcatttttgaaaaatatttttgaaatatgaaactgtaggccgggcacggtggctcacgcctgtaatcccagcactttgggaggcc

SEQ ID NO: 132432 - DNA, 321 bp, Homo sapiens
gccttttgtcttattaagtatttatgtctgtggaagatttttaaaaattgatatgggaagtattatctcatgtttactaactcattattgcagtttaatagcttttaaacttagttatgattagctcctggacaatcagagaaagagcgggttttatgcatgtgtaccgtctgccactcacttgtcttcttaaagaaggcagaccctctaagagcaaactcatgaatttgtaataaggaccaattactgattaagcttctactcctatggagtagacacatattatgaatgactctaaaactgccagtacaccacaattat

SEQ ID NO: 132433 - DNA, 316 bp, Homo sapiens
gttcttctctattcctgctgtctcagccactccccctctacaccccccacagccccccaaaaaaagggattgagagaaagacaaatgatgagagaaggccagtcttgtcaggtgaacacccagttcctgtctcatttaaggttgcactccacttctttcaaataggaaattgccaaaatggatgtcatgggctgctaattagatgtattttaactgcaggatcattttaccagctaatactgttattatgtgcttcaatgtgaacccatggtggagctgttaaaatatgagcgtgcagtcttagcagacagctctt

SEQ ID NO: 132434 - DNA, 376 bp, Homo sapiens
ttcatcttccacagtgggaggtcaatagatactgctgaaacaggaaaaccaacaagtagcaataaagaatgatacttagtgatgagcagagcaataccaaaagaagaagttaaaagagatgaaatgggtgcctcagggaacaggaaatagtgccacatgggtaaggtgggactactgtttttcacacatagtagcttgaatctttttcgtaatttttatagaattatcaactcttgtgactaaatatttgatttttgaaaaacaaaattaagtatatacatatttttaaaagtcacccagattatgccattgacttcaaggagatttttcactaagtaagcccatttcttctattttgccttgacatgctctgtaa

SEQ ID NO: 132435 - DNA, 421 bp, Homo sapiens
cacttagcacagggaagagcacattgttttcatagctggttggctcttaatacttccccaggaggctccaggttcaaagagagggtgtctgagaaatttgggaagatgccagcaaagtgaaggttttcaatgacacactccaggatgtcagtcaggcagggagaatgacccaggtcattcataacagaatttttgtacaaaagaggagaaaaagaagagccagtggaaaaaattatgtatgcagagatttcttctttagtggcaggtaaacatttagttatgtaagtaactctcacttaatcaggactaattttgtcccctgggggtatttggcaaagcctggagatattttaagttgttaacaactgagttgggaaaagatggggaagctgctattaggaccaagtaagtaaaggtcagg

SEQ ID NO: 132436 - DNA, 223 bp, Homo sapiens
gctctagaggatccgcaactggtctgtctggttgggtgggctggcagagtgcgcggctggccgggtgcggagcccgggctccatcattactctggggacaggggtgagggcggatcccaggaactgcggagagcagctttcgctagcaggcttagacttcccgggcaatcggtctcgcggctttgcagtaaagtggggttcgtctggagcccggccagaagcg

SEQ ID NO: 132437 - DNA, 460 bp, Homo sapiens
acaaacaagcaaacaacaacaacaaaacacttaacatgcatcaaactcatttaatcctcgtaacactatgagggcgattattattattactctaattttacacatggaggaaacaaggcccagaatgtcacttttttaaaaaggttacttgaattcagtttaaaaacatttttaaaaaatctgtcagtgtgcagttatttgcatttacttttagaaaagaacacttttctaattaaaacatgttcagaggattgttattagtcaacttacatttcccccaccttattaataagttgccatagttccctgtctctttatttagtaaaaacacttttctaattaatatgtattttcagaaagtactgctgttactccacttacatttttccccatcttattgaataaattcccatactctgcctcctttctctccatataaagcgatactcctctcctccca

SEQ ID NO: 132438 - DNA, 438 bp, Homo sapiens
aacatgtttcccccttagctccaccctagatgctatcaggtttgctaaccagaaggttctgcagctgaccagctcatgcgcacactcacacacacacactctctctcacacacacacacacctccctaagaaaacaaattttcacaagagtaattacatacaaattctaaatctctaacctgtacttttaagctcatcatcttcacaattcagcacaaataaatttaaagcatgggatgaaaataaatcaaaattagccattttcatgacttcaaataggtaagtattttaaacttttaactgataatgtcactaaaatactaactagcctgtcaattgactgaaagtttctaaaccattcctaactactgttcctagatagaccccggactctcttcatcttctgccctgatgacccttcaactctgaactactctg

SEQ ID NO: 132439 - DNA, 616 bp, Homo sapiens
tcgtacttccaccctgcatgctggtgaattccactttgccctccagcccaagcatcatattttccagacagtcatttgccatgctgcccaccaaacaggctgtcccttgttctcatgccactgctgaacattgtttattccttgtgctaggcagggctctgtcagttgtaacaactgaaactccacttagacatgtttcagctgaagggtgacttattgatttttataactgcaaagaccatggtatgcctgaatttggaggttcaagtaagttattttctctctctctctctctctcctcttcctctttcattcttttctacctggccctggtctatcccaacataaaggcaataattcattacctcattaacggatctgtccttttttttttaaacagttccttatgttagccatgaaatctagctggggctgtgtggtttctgattccccctggcttattctttactttttcctacttttccaggctcagcagggagctgctggatgagaaagagcctgaagtcttgcaggactcactggatagatgttattcgactccttcaggttatcttgaactgcctgacttaggccagccctacagcagtgctgttta

SEQ ID NO: 132440 - DNA, 317 bp, Homo sapiens
cctaaggcagccttcaaagtggcaaatgtgttggtacaggacagacgcagatgggcgaggctgtggagggcagcagtaaagtgctcctgctcagggtgacacagacgaggccgcctcaggcaaatgacttcgtttctcagggcctcagtctccttgtctgtacatggggttcaatcataatacctgcctcaccacaggggctgagcagatgaaagaatggtgaggtggcccatgcctgtaaccccagtactttggtagtctgaggcgggaggatagcttgaggccaggagtttaagaccagcctgggcaacatgaca

SEQ ID NO: 132441 - DNA, 677 bp, Homo sapiens
tgcctattaatgatcattaactctatgtagtagtctaataggtatttacaacttaacatattcaaaaccaaggtcttgatctttctattgctccttgataccaaacatatttctgtactcatcttccttctttcagttactggtacttctttccttacatttgttcaggatacaacccttgatagttattcttgattttgctttttctctcacaccctagttaattcattaacaaatcaataccagctcttccattatgttaaatatagaatcttaacagttcttcaactcttctactactactacactagtctaagccataagccactcttatttcactattacaataaccatttaatctccctactttgcctgtgtcccccttcagtttgtcagcaaatgagcagctagggtagttcttttaaaggacatgtcagctcatgtcactcctctcctcaaaaccttccatgggcttcccattttacccacaatgaaaaccaaatccttacaatgacttacagagcccttcttccagatgatctctctaatttcatttcttatatgttttgctcattggctgagtcactactggactccttgctgttcttcaaacatagcaggcacattcctacctcagagtcttttgcatttgctgttttcactgcctggaatgcttt

SEQ ID NO: 132442 - DNA, 362 bp, Homo sapiens
caaaagagcacataacaatctacctccaggtgatcgagacaatgtatatggaattgtcaaatcagctgtttacaaaataatatttctaaccataaaattcactttggttactaagatttgtcatttttcaatttctgtcacttctgtagtttccattcttagtaattcctaacaagagagtatagtatgtttgaggaactaaaagaagggtagcagtacagagagtggagaacggtacaaaacagaggtggagaatagggcatgcagtgtgatttagagattcggggtgggacacatgtggcacacagccccactcagctccatcacttactagctgtccaaggaaataagtaaatagtgat

SEQ ID NO: 132443 - DNA, 918 bp, Homo sapiens
ttaactgaatcaactggattccttaattctcacaatattatccttcctaatttgtaaatagggaaatggaggcttagtcacacaaaatatcttgttcgaagttactaatcaattaagtaacttaataatttattgacatctgaggcatttctctctttctacagcctcagaccagaaatgatgggatttcagccttcttttcttagagattggtgagccaagacctggagagagaactctggttgtcttaagtcacccagatgaactattaatagaaaaataattctactcagtcagtacttaaaagcttgacatgtttgtgtggagacctgtgtgtgactgagttcagatcactctaatttcctgggcctcacttgacccatctgtgaaatggggcaatgagctcttttcggcatgaaggcaaggaactgtccagaagacctctggagaattcttcttaccctgagatcaagggttctgtgagtagtacaactcacacccaaagtcttagttgcagggcactttagtgggaaaaaaaaaaaaacgctgaggctatttttagagccttcatctggttatagactagttggtaggagagcaatacctttgaaaagttaagaaatagttttatacactgtgttaaggatgttgtcaaaactaatacttgtgtatgcaaagactttaacatttattaataattttttctatagattggtgaaattggtttgtaatttttgtcatttcacttttgtggaaattgagcaaaagtgagagataaaatgatgtgatcaggctgggtgcgttggctcatgcctgtaatcccagcattttgggaggccaaggtgggcgcctgaggtctggagttcaagaccagcctggtcaacatggtgaaaccctgtttctactaaaaatacaaaa

SEQ ID NO: 132444 - DNA, 936 bp, Homo sapiens
ggagagatgaggggaaaaagcaaattattgttcctaatgatatgaacctgttttgtggattgctgtttatttttaaagataaatgtctctggtatcctaatagaagaataataggaataatactttacatttataaagcaaatttctcatctgttatcttaataacattgtcacaacagtaacagcaagtattatctttgtttggctaaatgaaaactaagggtcttaagaggatgggtatcttcacaattactagagtcagggacagatctgggactctattccaagtctcctgcatgttaccaggccacatttctgctcctatataaaacaacagacacttctcaaaagaagacatttatgcagccaacaaacatgaaaaaaagctcatcatcactgatcattagagaaatgcaaacctaaaccacaatgagataccatctcacaccagtcagaatggctgttttaaaaaagtcaggaaacaacagatgctggagaggctatgaagaaataggaacgcttttacactgttggtgggaatgcaaattagttcagccattgtggaagacagtgtggtgattcctcaaggatctagaaccagaaataccatttgacccagcaatcccattactgggtatatacccaaaggaatataaatcattctactgtaaagacacgtgcacaggagcagcactatttacaatagcaaagacatggaaccaacccaaatgcccatcagtgttagactggataaagaaaatgtgatatacacacaccatggaatactatgcagccataaaaaagaatgagattggccaggcgcggtggctcacacctataatcccagcactttgggaggccaaggcaggtggatgacaaggtcaggagttcaagaccaggccaagatagtgaaaccttgtctcaaaaaaaaaaaaa

SEQ ID NO: 132445 - DNA, 114 bp, Homo sapiens
actgagtgttgaggctggcttgtcatactccaaagttgatttttccactgtaccctcaaaaccattcttcactcctccagttctgcctacccttgacaggtttgattactctaa

SEQ ID NO: 132446 - DNA, 421 bp, Homo sapiens
gattccattaaaataaaaatcatcattaaccacttaactttttctgtagtcacttagtatccccctctggcagcacaacgtctacaggcataacacaaacaatgcagcctaaaaaccaatgcctgaggctttttcctatgatgtaagtaggttttccacaaaatacagaccagaagctgccttcatatgctaagatcacctgtgcagttagtcagtcatcaaaatgacagtacataccttgtacctaaaatagctaagaacaacacataaccatcaaccttcttgggaacttaagaaagagtgcttgacagctggataataggcatcagtaaaggagaaaagtggaaaaggccatatgggaaggtcagtttcaaggagcaacagatgaggatggcagccaagtgtgtatttcctgaccttt

SEQ ID NO: 132447 - DNA, 788 bp, Homo sapiens
ggtaaaagcaagtgatagccttccttctcagataaaaaagaggtcactgacctgcttatggtgagatcctgtctgaactgggcctgggaccccatctcctgacagtgcagctagcctagttctctgtttcctgctgcctcagtaactgaatgtagtaatttcatttggagcagaggtcagcttgtctttggaaaagcctctattcagcagaaaaagcatcagcagtatatttaaaagctgccatgtaatgactatagggactccattgagcagatccttttcttatctccagatcttttccctcaacttccagagcatgtccttacacctgagatgtaggtacccccagctctgtcccatatccagtggcatagtaaccaggtggcttagtggaggaggacgcaggaccctctgttgtggtttgtgcctgtgggggctgccagagagagggctcaccccatgattgccttcaccccaatctctcacatgcttcaaaagaggggtctggtgggaggggctgtgtttaagggtgggatctggcagcctgtcaaatcctggtcagttgggattcaacggacccatgaccacaagcctcatggcctttcctgttgaccagcagtggcagtgggaacaactcaccttttgaaaatacataggaaggccgggtgcggtggctcacacctgtaatcccagcactttgggaggccgaggcgggtagatcacgaggtcaggagttcaagaccagcctggccaacatgtgaaaccccgtctctactaaaaatacaaaa

SEQ ID NO: 132448 - DNA, 514 bp, Homo sapiens
catgaatttaagttggagacatggttaatatttttatggtataatatgattcttttacaaaagtgaaaaatttagataattaaaaaatgaagttacctttctatttgtctgtttacattagtcctaaggagtaatttatgtgttgttaagaaccaatagattttgtttgggttctatgactaaacaatgtcaactagttcttatcactattcagtcatccctgcccttctttattgtggattcttgaacattgagcacttcgaatttataccacctaaaaaatacatctttagttttgtttgggtttttctgtacaaagttcagttggaaacactgcccttactaatgctgggaggcatcattctttaggcatcccaagttcttgcttcaacttttacatataaagatccaaaatgtgccaggcgtagtggctgatgcctataatcccagcattttgggaagccgaggtgggcagatcacttgagctcaagagtttgagatcagcctggccaac

SEQ ID NO: 132449 - DNA, 332 bp, Homo sapiens
taacagcctagccttccttatactttctcagaatacttagattagcctacagttgggcaaaatcatctaacacaaagcctatttttatctcatgtaagagtattttactgcatattgctagcccaggaaaatctcaaaatttaaaatttgaagtacattttctactaaatatttatcactttcacactatactcaaggcaaaaaattgtaagtcaaggactgtctgtctatatttgaaggccagacattcttctggccatcatactcccattagtgttcattcttctcatctttgaacacctggattagcatttaaaatctgcagagaggcc

SEQ ID NO: 132450 - DNA, 668 bp, Homo sapiens
tctctatatacaaaatgtctactttctctaccagattttaagattttctttttatcactgattttgagcaatttgattatgatgtggcttggtgtagtttccttcatgattcttgtgcttgcagctcattgtgctttttagatctgtggattttttgtttacgtcaaatttgtaaaaattctggccagtatttcttctagtaatttttctgttctccccatccctaccttagggactgcagttacacatacatgtaatatctgggattgcgtagttatcccagaaccgctgatactcttttaatggcaacagttttttctctctctctgtggcttctttgggatcatttctcttgctatggcttcaagctcacttattttttctcctgcattgttgagtgtgcttttaacccagcccgtgtatttttcatctcagatattacagctttcatcttcagaagtttgagttccatgtttctagttttttgttgttgatgttgtttgtttgtttgtttttaagaggttctgctttgttgcccaggctggagtgcggtagtgtaattatagctcaccataaccttaaactcctgggctcaagtgatcttctggccttggcctcctgaatagctaggaataaaggtgtatgccaccatgtctggctcatttttt

SEQ ID NO: 132451 - DNA, 631 bp, Homo sapiens
actctgggaggccaagtgggggcagatcacttgaggccaggagttcaagaccagcctggccaacatggcaaaaccctgtctctattaaaaatagaaaaattagccaggcatggtggtgcacacttttaatcccagctactcgagaggctgaggcatgagaatggcttgaacccagaaggcggaggttgcagtgagccgagatcacgccactgcactccaccctgggcaacagagcaagacactgactccagaaaaaaagaaaagaaaaattttgagatttgtgatctcactagccatttcaattaacaacatttctgattaatcagtcttttcactgcttttgttcaacaagtgtccactgagcactttcaatgtacaaggcaaattctaagaaattaggatacagtggtgaataatgcagatacaggggccctgaattcgcggggtcaaaatccagcaaaggaacttccgaaacaaggaatttcaacaatgcactttacacactatttttcaaagacatatataataggatcctgcagtaacatggagcaggggtaccctactttggtacctaacttaagttcccaaaggaaaagtaagacttagccagaaaagtggacatgggatggga

SEQ ID NO: 132452 - DNA, 364 bp, Homo sapiens
catcacccacagccctagtacactttgtctcgggttagtatcatccacactcccaggacatttcgggcccacaggagggttagaagccttgaatgttgtacctagaaaggcctcagaggtattcggagagactcaggctcggccaggcgagagggcagtcaggagaccagcctgtctgtagtatgtggactctttgtctgctcccatcactaccaccaccatattttacagatggggaacttccctagcaggggaaggcacttgcccaagctctcgtggccggcttggcatgctgtgatacggaaatatgctgaaaagggcaggctttggagttagggagacctggggcaatccagattcttcc

SEQ ID NO: 132453 - DNA, 719 bp, Homo sapiens
gagaaccctattgttacaaattttgtttgcaaaactgataccaattctggggagtctaggaagagaaaacagaaattgcaaaggtgcagaggcaggaaatcatatgagactttcaagaatctgaaaatagaaacttggaataaaaacctgaggaggacagggaaatagtagaagatgaggcttcagttgatcataaaccacctcttccagttgcagatccataaaatgtggttaccataggtaggttaattttatccatgctttactatctgcttcctttatcagcaaaccgtcattggttcatgaagactgctcctctgcagatctagccttatgatggctttctatcctcttggcaggaaaggaaaagtgacgtgtgtgtttgtgtgtgtgtatgtgtgtgtatttagtatagtacatttttagaaataacttcctattttctctaaatagaaatgactgaaaataaaatattgtttaataatatttgtaagtggattattagtttttataaatttttgtatgtttttactaattataaaataactttctcatttaaattaaaacattttaggaaaaaccagtcttaaatattattggtaaaatacaaatatcttcaagatgtaaaaatatggtctaaattacacaggtcatgtactacatttactaaatgttttaaggttgtaaactactttttttggccttttaaaaactgtcaa

SEQ ID NO: 132454 - DNA, 533 bp, Homo sapiens
gaggaatgggcaggtcaaatacagaatgaggtttgacaggctagatgtcaggaaaagccttaagggaggaggtgaccttaagctgcagtttgaaagataagttggccctgacagataatgaggataggctacacggcaggtgggagtgagaactgcaagatcttctaaggtgatcaactgaaggtactatgcagtattttcagttgatttcagaggtatttcctagtaccagcaagcaagcagtttgctaaggctgaattttggggtagggaggtacagcaacagccagggctatgtatgctatgctaagaaacatggctttatccacaaacagttcttaatagtttctgaacatataccctatttagaatttaaaagtgactaaaacaaacaaacccaacagctaaggtgcactgattacttattatgagtcaggtactttacgtacacttctgatttagttatatatccacaaaagcccttaaacaggaaccatttctatgagaaaatggtggctatgaacctggtacttt

SEQ ID NO: 132455 - DNA, 178 bp, Homo sapiens
gggtgtgcacacctctcttctttcatccctttgggtctatgcctatttttaatttctcgaggagccaccgtactgggttccacagtggccaccccatttcacattcccaccagtgacgcacaagagttccagtttctccacatcgtcgtccacactcattttgtttacttttttgatg

SEQ ID NO: 132456 - DNA, 420 bp, Homo sapiens
tgctgtgtcagagaatggggtgtggagggtcaaagatggaagtagagaaaccaactaggaggctatgttataatagtaatagatggataataatatttaggaaagttcaggtttgggtggggagaccaggacttcattttggagcatgttaagtctcagatataaagtatacaatgggaaacatgcagtcacaggagaggtctgagctaaagatgtaaactttggatttataccgatgacatgcaaagccacgaacctagatggaatcacctagagaacacaagtaaacagaagaaaagagagttgaggaacgagccctgggatagcctaacattaagaaactggggagatgaacaaaagcaagtcaagaaatagtgtccattgagctaaaagaaccaaaagaaactggtatcttaaaag

SEQ ID NO: 132457 - DNA, 410 bp, Homo sapiens
agtttgagagtctcagtgttttaaaaactgagtcaaaacaactaaattggtggaggttactgatagatttggactaattccaaatattctttggttttgtttatttttgaaaaactgctttattaagatacaatttacatataataaactgtacatatttaaaatgtacaacttggtgttttaaaataggtgtacacctatggaaatcatgatcacaatcaaaatagtgaacatatctatcaccccttttcctcatacccttacatgttccttctctcaacctcctcccttccccctcccccaaaacaactactgatctgctttctgtcattaaagcttgggttgccttttctagaatcttagataaatggcatcctttatttgtactctttatgtggcttctttcagca

SEQ ID NO: 132458 - DNA, 239 bp, Homo sapiens
tctctgcttcagccctggattcatctctcttagaagcctaatttcctttattggaaaatggtacttatagaacaagatatagaacaaaatggtacttatagaaaaggggataggtatacctttactaccggagtgccattatttctaggccatctcagcaaatagagctaggaaatatatacacgtacatgcacatacacatacatgaacacacatctatctctatttctatatctgtt

SEQ ID NO: 132459 - DNA, 607 bp, Homo sapiens
atctagtaaccaaatgagcctcataggatctcaggactaaaagagccacctaattcaaaactttccaagcctggcttcacagactgctcaacctaaactctcaaggtggaggctgagaatctgtgtatttaaatgcccccggatgactgtgacactcgagacagataatcactagtgtaactgagcccatgtgaatcatgtgaacgccctttacaatgaccctgtccagaaatgatccagccttatgcattagggcctccaacgatgggacacagcctatcacaactgcaagcacctggaccagcaaagtcctttctaatgtttactcaaatatctgtatttactctactcattggttctgtcctgtgaggcctgagaagacaaaaggtaacctctcctccttccacttgatggacttttgactcctgcgacaaaggatgatgcccctctgagttttctccaggctaaacacccttgatgaactatgcattaatcattaagtgctaggctctttaagtgcgcaacacaatacaacaacatgtcagagaagggagaaatcagggtgtgttatggtaaccagcaagacatcaatgaagaaggtgggtct

SEQ ID NO: 132460 - DNA, 936 bp, Homo sapiens
ttacttctttatttcctcatctgcaaaatagcaccaacctcctagggggtgcttattcttagcataatgcctggtgctttgttagcatgcaaccctggcttgttataatcagctctaattttccggtctgtgacatctacgtattaaacctaattccaggtgtgtcccatgaaaacaaaataagaaggccgggcacagtggctcacgcctgtaatcccaacactttgggaggccgaggcgggcagatcacctgaggtcggcagttcaagaccagcctgaccaacgtggagaaacctcgtctctactaaaaatacaaaatcagccgggcgtggtggcacatgcctgtaatcccagctactcaaggctgaggcaggagaattgcttgaacccaggaagtgaaggttgcagtgagccgagatcgtgccattgcgctccagcctgggcaacaagagcaaaactccgtctaaaaaaaaaaagtaaaaagaaaattttaaactttttggggggcctgggcccttggaaaagtttttaaaccattcgttgggggccggggcccattggtttgttgcaccttggcaatggggttcccaaggaaatccgggggcggacataggggttggtttctcacccaattaaaaaaagccgcggggggacacccgaaggttttctgggaacaatcccccgaaaggggtttgcggagggcccaacccgggttctcacccacacggctgccagggagatcggatacaaatcagccgcccgccggggtgggaatgcatagatgtgaggaaacgagacaaacaacaacgagaactagcacgagcacgacacgatgagagaaaggagaacaactagagagagcaaatacagagagcaaaactacaacaaccaacatacagaaaagaacgaaaactatagcaaagaatacgacaatag

SEQ ID NO: 132461 - DNA, 400 bp, Homo sapiens
cacagaactgatcacacagaaaggaacaaggtcatggtgtgtgtggctctgcagcaaacccttccttctgctacagagcagagtaccagaaaatccgcaatgcttcagtggaatctgaaggttagatacagcaatgtatcaatgctacattcctgattgtgttggttacaccgtggttatgtagaatatccctgtctgcaggaaatacatgctaaagcagtggtcccaacctttttggcaccaggggccactttcatggaagacaatttttccacagacccgtaggggggtggaggaggtgaggtgatggttttgggatgaaactgtcccaccctggatcatcaggcactggactctcataagcagcatgcaacatagatccctcaaatacacagttcac

SEQ ID NO: 132462 - DNA, 375 bp, Homo sapiens
ctgggcctgctccacaactattctctcagagtctttgaggacggggtctggcatctattttaacaaggcctcccagtaattcttacactaaagtttgtgaactctgttattaccaacttacctgtttatttactcaaccaatatccgatgagtacccattacccgccaggctgcactggtccaggtgcctgataggaaggagtgagtgaagctgaccacgcagagttaagcctgccccctgtactggagtattcaggcttaactcacaaaacatatgtaccattcactcctataatcccagcactttcggaggctgaggcgggaggattgcttgagcttaggagttcgagaccagtctggccaacatggcgaaaa

SEQ ID NO: 132463 - DNA, 276 bp, Homo sapiens
tggctccatgatgtcctctttccaacccattctgaatcccccacgggctgcctaaggtcctgctatgggtcagccactatgctatgtgcttgacctacatgttcatcctcagactaacctcatgagacaggctaacctcattaataactcctgtctggcagaggaggaaacaggtttggaaaagggaaatctaagaagacctagtgaatagaagattgggttggaattcatatctaggtagtctgactccaaaacccgtgcaactaataaacacaa

SEQ ID NO: 132464 - DNA, 483 bp, Homo sapiens
ttgagtgttctttcttatgtgtgatcgtggcacctagcattttggcctgtagtgggtgttcagtgaacccaaaatagtgcagtaatttaatggacattttttgggtgggacttcaagtagaccttggtgggtattgtgtccttgtttttctgttcctttgcttaccttgcacagtgccagacacactggcgcttagcctttgagtgaatgactgtcttcatgcgcccttagcacagggaattgaaataatggttgaatctagtaaagcattaagtttgtattttccttctactgctgctgatttttccaacagccattttatatgctaataaaaactttactctgggtaaagttaagtaaacaaaccttttgtttgagaactgtcagcctaaaatatatttgctaatttctcatttgcatagtttatacatgttagtgcacctctctaatacccataaatgtgtgtaaggattggatgaggag

SEQ ID NO: 132465 - DNA, 1442 bp, Homo sapiens
tcgggggctccaccaccgcgcgctcccaccctcaaggtctgcaggacacaccaaagaactcctccaagtcacacaagggagaaaattaacttcattggcttctatcaggaaagctatttttttttttcctcttctttcctgcaagtttcccaaaccccatgactctgatttccaggtcagagactaaggttttatttttcttactctgtatactttatatgtggagagtccctgaaggaacactgtgatgggctgattactgtgagccagttgtgggccagacctggcctcaggtgctgcaaagggaattcagtcacccctgtgcagtgatctgtgagccccaagtcagatccaactttttcctgatagacagcaccctcctcctccctaccaagaaatagcagggttggaggtagtgacccaatattcaagaggtttgaaattctacatgagatatttctgagttaactcctaaatagcagtttccttaatcatgtggaaaataagaacacttactaaagagaccattggtttaagagaaatggaaacttatgtccacgtaaaaacctgtaaatgaatgttcacagcagccttttcataatagccaaaaagggaaagcaatccacacgtccatcaaccaatgaatggataaacttaacgtgggatatacgtgtaatggaatgctatttggtgaagaaagaaatgaaatattaatacatgcgttaacaaggatggaccttaaaatatcatgctaagtaagagaagcctgtcacaaaagaatatgtattgtaccattctacttatatgaaattcctagaataggcaattctatagggacagaaactagactagtgattggctagagcttggggagagtttggggagcctggaggatgacagcaaagtggtgcagagtttctttttaggttgattaaatgttgtaaaattaattgtagtgatggttgtgcaactttgtgattttgttaaaaaccattgcattttgccctttaaatggatgaattgcacaatgtgtgaattagacataagtttatttacataattaatatctatttattgatatataactcatatatcaataaatatatactatataaaataattttatatttatataaaatgtgaattatatataaatacataaataaaactgctaaaaactaaaaaatatatactttaaaaaaaggctgttcgtttctttcacattttctgagcacaatcactttgggataaatgtgtccaggcttaaaaagccagattttatgggctaactaaaatggaaatgtgaaaaactgtgtttttttccataggaggagagagtctgatttgcaggtacgtgcatacccacagcagtcatacttgtaattcttggaaactttgctgaaagttttttcctagcctgaaatcattaaaatatgttgaaa

SEQ ID NO: 132466 - DNA, 1667 bp, Homo sapiens
ccagaaccagccgttgtcccctggcaaaaagaggcccagggctgagccctgggcaagtgtctcccgacatcgctacccctcctccctttattagtttccctttcccaacagaaaccatttccttctgccaccaaaactaggttgcatccaaaagtttttcacaagcttaaaaaagaaaaacgaaaaattgacaagtattacacagaagagcccacaaaagcttcagcaacaccaagggcgaagaagcagcgtcagatccaggtctgcaggacacaccaaagaactcctccaagtcacacaagggagaaaattaacttcattggcttctatcaggaaagctatttttttttttcctcttctttcctgcaagtttcccaaaccccatgactctgatttccaggtcagagactaaggttttatttttcttactctgtatactttatatgtggagagtccctgaaggaacactgtgatgggctgattactgtgagccagttgtgggccagacctggcctcaggtgctgcaaagggaattcagtcacccctgtgcagtgatctgtgagccccaagtcagatccaactttttcctgatagacagcaccctcctcctccctaccaagaaatagcagggttggaggtagtgacccaatattcaagaggtttgaaattctacatgagatatttctgagttaactcctaaatagcagtttccttaatcatgtggaaaataagaacacttactaaagagaccattggtttaagagaaatggaaacttatgtccacgtaaaaacctgtaaatgaatgttcacagcagccttttcataatagccaaaaagggaaagcaatccacacgtccatcaaccaatgaatggataaacttaacgtgggatatacgtgtaatggaatgctatttggtgaagaaagaaatgaaatattaatacatgcgttaacaaggatggaccttaaaatatcatgctaagtaagagaagcctgtcacaaaagaatatgtattgtaccattctacttatatgaaattcctagaataggcaattctatagggacagaaactagactagtgattggctagagcttggggagagtttggggagcctggaggatgacagcaaagtggtgcagagtttctttttaggttgattaaatgttgtaaaattaattgtagtgatggttgtgcaactttgtgattttgttaaaaaccattgcattttgccctttaaatggatgaattgcacaatgtgtgaattagacataagtttatttacataattaatatctatttattgatatataactcatatatcaataaatatatactatataaaataattttatatttatataaaatgtgaattatatataaatacataaataaaactgctaaaaactaaaaaatatatactttaaaaaaaggctgttcgtttctttcacattttctgagcacaatcactttgggataaatgtgtccaggcttaaaaagccagattttatgggctaactaaaatggaaatgtgaaaaactgtgtttttttccataggaggagagagtctgatttgcaggtacgtgcatacccacagcagtcatacttgtaattcttggaaactttgctgaaagttttttcctagcctgaaatcattaaaatatgttgaaa

SEQ ID NO: 132467 - DNA, 659 bp, Homo sapiens
ggtcccattctatttgaaaaccatattcatacctgtagtttccagctgggacctacagatggagcctcacagttcgagtgttctgtgtgaagaacttttaaaatgttttgattttttttttttaatttaaatacattctggatctggaagacccagtactgacatgggatttaagggcccacttgggttcttgtattgacacttgtattggccccaaatgatcttctacagccttggcattttacttccaaagtcagcatcttaacttgggatcttggaatcccagttttgcagattatcaagtttgagaaacacggctctgtccagggcctctccccatagagtgcaggttcttcatagcacaagtgtgctgtgcatggccaccttgacaaattcatgcaaagtctctccctgttcaccgtggcttctactcttggggctgtgtttgcccagagagattcttttgtctaattctcacaaaagtattgtatgggttaacattagccttgggcatacactgttcccagattaactgttctaaaatgtaaccctattcataattctgtttgattgttccttgttcacatccgaattaagaacagacttctcattctaagcatgttgctctgaccttacctccagctccatccctactcgta

SEQ ID NO: 132468 - DNA, 261 bp, Homo sapiens
cccccactccatgcctgagccatgcatcagcctcagcactaatcagcgtgcccagcacagggacatcttatctccccagcaaagacacatatcctctgcccttaagctcagaggaccacatcttacactgtgcgtactccgcagagcctggcagtgcacaacacacactaaagatgctcaaagtgggtcattcaatctcacccagttgccatgactccttaagaaaagggacaagtgaccaggcacggtggctcacgcctg

SEQ ID NO: 132469 - DNA, 173 bp, Homo sapiens
aaattgtctaggggccttggctgtgcaaagagcctttccgtcaaaaccctctgcatgagccacagtcagcacgtagtttgcacatgcccacctccaaggtggcacacagctgctctcttttgagtaacaggttagcccagtttgctgcagaccagagtctacttacaatgagg

SEQ ID NO: 132470 - DNA, 502 bp, Homo sapiens
gatgcagaataaataagcataatatatctaataggagacaaaggtgggattgatctgtcttgaattgaaagtcagttttgctatgttacgctattttcttgatcaatgaaagtataccttctaacccttaacaaaatcaatacaattgattggaaaagatagaacaaagcatgagaatgcagaatacacttgaaccttcattattcagaaatatttaaatgatgtttataatgcttagaagcattttccactaactccatgtaatggaagcttctttaaccaagattgaagacctgagtaatagagtttgagaatatgctatagtggcatccttcatagaataacatggtttttgttttttttttttaagttaaactcatctcacattacttatacttctaaaagtgagagcaatttctattactgagcatagagatagcaaagtgaaattcaatcttgaaaataaagtatataaattaatatgaaaaacttagaaaagaaa

SEQ ID NO: 132471 - DNA, 1224 bp, Homo sapiens
gatcactttgactccttttctctgaatgctctgcctttcacttttctgaagctaccagggagggtatatcttgacatctttgttgaagtagctttcactccctgagctaccctgcttcatttggtgaatcttagtaaacaatttttctttaggaattttcctttaaccatcttaaacgtcaaggtattcttgccccctcctcacttcatatcacctcttcaaagtagaattgccttctctgctgtgcccactgctttgtacttatgtcacagcacttattttattttattcccatatatgttgttatgtgtaactatatataaatttataccagttttatatttattctcaactccttgagaatgaaagctgagttgtttgatatttacattaaaattaataaaaactgcctttgtaaaaggtaaatcactctttaattcatagacagactttgaaggtgccatgaacttattaatattttattgactgcatttttcatgtttttagagaaaatcattttgtgattttaatatctgagtctgagatattaatatctgtgttttaatatctgagtctgaaaacacagataaaatgtacatggaggcatgtatccagtgatttgaaggagtaatgtttctactttgtttatctcaatgatcaagtcttgtaaaacttgaggtaaatttaggttgttctaggggctgatattcactgtgaaacttcaaaaaatttttatattagttgttaatataagagatctaatgttttcgtggctcctacaatgtacttgaagtatattgtatatgtgataattttatgataaatttgatttctcatgtgtttttgcttaggagcttagactcaaactatctccctgcattctttctttgctttctatttaacattcattttttaatctgttataatatttttattgttttggttggactatacattaccataaccattaaaaatatgaaattcaaattgagtgtgtttataattgtacacaccagaatttgaagactaaacaaattaatgtaaaatatctcattagtacgttttaattagattacatgttaaaataatattttgcatatatattttatgtaaacatttattaagccacaatgctgctactcagcatacctgtaattaagcaaaaatatgcacacacacaaaacatacacacaaagggcctgaatttccaggaatttatagtct

SEQ ID NO: 132472 - DNA, 456 bp, Homo sapiens
ttattgttagtgataagcactggggtgtgaccttgagagtgacaagtgggattaggtggaatgaagggagccagggaagtgagacgcaaggctcagagaaggatcgtctctacgtgtgatcaccaagaaagatcgtctctgcagaaatcaccaagaaggatcggtctctatggagatcaccaagaactgagacagggcagtgttgcagaaagagtgctcagcatttaaatatcttcagggaacggtagaggggagtgactagggctctctagatgactgcaacaaggactatcaaagaggtgtggtctgatggcacaacttcaaagccacagtttcgggggggatgcgcaggaataaatgatctgaaagaggcaacaaggagcagggaggacacctaccccacctacctgtggttcaggggctgcgggaatatgaacaaccaccacttgagaggga

SEQ ID NO: 132473 - DNA, 274 bp, Homo sapiens
aataaataaaatcaattaaatgttttaatctgaatttgaaatattgtgaaaaagtataatgtcaaatttaaaaatcacatatgtatcttttattttcacactgtagcttttttattgtacctgaaaatctttaagagtatgattttattttgtatttatattaaacagatttacatctgctaaatatataagagctttctaagatccgtgctcatttctgttttccaagaaaaataattttaaagtgccctgtccactgtccctacccctatag

SEQ ID NO: 132474 - DNA, 345 bp, Homo sapiens
ctccgaccccagtccgatcgactgagcctttcagatgaaaggccagtttggtgctggtaaacatcacagttcttgagacccatctaggcaagggtagttgcccaagtcctgtgagtctggtcagccagggctgggctggcccctcagcagctgctgctcagcacgtttggagagaaccctggtcctggccctggcaccgcgtgcctgcctgctaccatcccctggtgggccactccacccagaatcccgttcttcccttttcctgtccctgcctccaggagggtcaggcagcggcaggggcctgtggccagtgcacccttcccatcacagagaagattggctcct

SEQ ID NO: 132475 - DNA, 180 bp, Homo sapiens
taggcgacagagcaaggtaccctgtctcaaaaaataataataataaaatcctgtttccaggttactgaggatactaaatctgccaaagaaaatccttctttgcctacctagcatggagaagggctatttctttctttgacatggctcctcagaatgcatggagatttggagctgtgttgt

SEQ ID NO: 132476 - DNA, 370 bp, Homo sapiens
atcccagccgaggcatgagaattgcgtgaacccaggagacggagagtgtagtgagccgagatggcaccgctgcactccaggctggacaacagagtgagactctgcctccaaaaatataataatacattcataaaagggcgtttctactttccaaactatactactatagtttgttaaatattatattgatggcaaaacgtgttccttgactaatggagacaacagagtaacagaaccacaaaaaactctacatgtaaaaaagcactgtcttcaggaaacttcacctccttgggaagtaggaaaaggagtattagcctcaacctctgaaagtgcacctcacagtagttcatatcctaacctccacacgtca

SEQ ID NO: 132477 - DNA, 160 bp, Homo sapiens
attcttgtcttggttctcccatgttctttaggatcagcttatcaaattccgcagaaagctctattgggattctgactggacttgctttgaatctatagattcatttggggagagaattgacaggcagcaggtataggaaggtgatggccaggtccttttc

SEQ ID NO: 132478 - DNA, 445 bp, Homo sapiens
tactatataatcttattttcccttttcccacatccttacttagataaaaaacacaattataccatgcctcacattgtttttgagatgtacaataataaaaataaattgtattaaacagcagaggaaaaaagccaatataacatatttcttcggttttgttggggaggggcatgagcattgttcagccataagcaaacagcatatctgtagacattgacataggctgtgcatcaccccaagcttccccttatgaagtaaacttctcaacaggcatgggatatacatcttcaagctcttctgttgaattgcagccagttaggcagctgtaagttaaataaaactttttgagaacttggcctattttagtagacgctcatatggtttcttcactgaagtctttattgaagctcagttatttggacacagaaagacaaactattttttt

SEQ ID NO: 132479 - DNA, 730 bp, Homo sapiens
gaatagtgataaaactaaaagctagtcctttgagaagattagtaaaattgatgaacgtcttcccagacttatcagaaaaagactgaaattactaatatgaagagagaggtgatatcaccacagaatattcagatattagaaggataatgaatgttatgaataactttatacaaattttattttatttttagagacagggtctcactctgtcacctgctggaatacagtagtgtgatcatagctcactgtagccttgctcctggcacaagcagtcctcctgcctcagcctcccggaatttggtaacttagataaaatggacaaatttccttaaagatacgaactacctaatctcattcatgaagatataaagaacctgcatagtaccatatcttttaagaattgaatttctcatttaaataaccattcctcaaagaaaactccaggcctagatggcttttctggtgaattataccaaacttttaagaagaaaatgttaccaattctatacaacccactgaaaaagttgaaattgaagaatatttctaaactcattatttgaggccagcattaccctgattctaaaatgagacagaaacattacaggaaaagaaaactgcagaccaatatcattcatgatcatagatttaaaaattctaagcacaattttaacaaagcaaatttaacaatatataagaattcatgatcaagtgggatttatcccaggactga

SEQ ID NO: 132480 - DNA, 632 bp, Homo sapiens
tcccagactgggcggccgggcagaggggctcctcgcatcccagacgatgggcggccaggcagagacgctcctcacttcccagacggggtggccgccgggcagaggctgcaatctcggcactttgggaggccaaagcaggcggctgggaggtggaggttgtagcgagccgagatcaccccactgcactccagcctgggcaacattgagcactgagtgagcgagactccgtctgcaatcccggcacctccggaggccaaggctggcagatcactcgcggttaggagctggagaccagccaggccaacacagcgaaaccccatctccaccaaaaaaatacgaaaaccagtcaggcgtggcggcgcacacttgcaatcccaggcactcagcaggctgaggcaggagaatcaggcagggaggttgcagtgagccaagatggcggcagtacagtccagcttcggctcggcatcagagggagaccgtggagagggagggagagggagagggagagctagcgtggatttttaaaaataatctcttgcacatcatacttaggacttgatagtttttgtggaatttgtgttatttacttataactagagtttgaatgtttattgggaaaacttaatcatgat

SEQ ID NO: 132481 - DNA, 562 bp, Homo sapiens
caaacaaaaaaaaaaactcccatgataaaagtttacctacataacaaacctgcagttgtaccactgaacttaaaataaaagttaaaaaataataataataatttttttttgtagagatggggtgttgctatggtgcccaggctggtctctcaaattcctgggctcaagcaatcctccgacctcagcctccaaaagtgctgggattacaggcatgagctacctcgtccagcctagatacattcttgaatatgtaactttgggaagatttattaattgattaaggactaggaggtccagctaaaatgcaattggatttataaggtacttaaatccagatttaaggtatgaaatcaagaatggcgaagaaatcaatgaactgaggtcttaaagaatcaattcattttattgactagctgaatacaagggatgattgacacaagatgaaaattgagtgttaagaaagaataacaatgggcaagtatgaatgattaggacataaaagggagcaaaagaagaatgtaagaaaaaatgtaaatagcatatttatcaaacctttttatat

SEQ ID NO: 132482 - DNA, 616 bp, Homo sapiens
tccgtattaactacggaaaccacaattactaattttaaaagacctcaacgtttgattttgtatttttacaaaatgaaaatgagatatgaacagcgaaatatgtagtatttattgaattttaactatgttccaggaactgttccaagcactttacacatttaactctcaaaccacctttaaaggtagttactagtattatttctttctaaccaacagacaatagtataacgtttaagagactggattcgggggccaatgcgcataggttcaaaaatctcactctggcaaatgttatacctcctaacttaatctatatgtctattttttttttcatgtataaagaagagtgataatagtagtacctacctgattggattgccttaaaaattaaatgagttaattgtacaaatgacttaagacagagtctggcacacagtaagtactacaggatgataggtcttattatttatattttatatgaagaaatcgaagcagagagaggctgtgtaacctgtcctgggtaaaagagctggtagttatgggtaggattctgatttctatcacatgttctttaatagtaagtgccttaactttcagtaaattctatatagaaatg

SEQ ID NO: 132483 - DNA, 677 bp, Homo sapiens
ggttcaagcaattctcttgcctcagcctcctgagtagctgggattacaagcacgcgccaccactcttggcttttatctgtacatttgagtgcacttttcgagtatagagtgtggatagttaagggaatcaatttctagatttttgaattcccgatgtagtttttcctaacattgctctgccagagaatgtgtttggaatggaggtgtgtgctctgctttcccaccttcacttgcgtcgttatcctttctcacttttagaaaggaaaggcacactgctaatccattttagatattacaaaggtccattgccctggatgtaaaaactaccaggacaccaaacaaagggcaattgaaaatttggtgtctgtgttaagatagtgaatgtcgagaaatactgtctcagggaatgactagataacagttttttgcaatattagtttccaatattttgctgtcaacagaactgaaagaaggcctgatagagttgtctgctaagtaactaatagatcagtaagtatatttttgatggtaggttactgttatttttgtcacataactcaaaagatttccaagaattgagagataattgctacaacaagacttccatttttatcttttcatttatgtgaaaaaagtttctcaccacttaaagttataaaaacaaaaaatagggataa

SEQ ID NO: 132484 - DNA, 540 bp, Homo sapiens
tcagcttcctcagagaaacaagaaaaatttcaactcagatattgctccataataaggtaagataatccttcagagatatagagcatactttttctggagccaaaatctatggacgtcttctcccatgaaaatgcctctgtgcataggcacataaaactttccatgaaatttcagggggagttgctgaaggccatccagggacgagtccagggggccaggagaccagctttagggagctgccatatggatctggagacagagccaggaccagtgctgcactagcatgaccctgagtgggtgcctcctcaaagtctctgccctaagcccttcctttgcttcactctagtcccagtcctgctgaagatggaaggttatgggtacatctgaaagtaataaatatccagtcacagatgtcatttcatattccatcataacctgattgacatcatatataaaagttggatgcttgtacattaaaaccttccctccaagtccctggtcataagggttaacatggtcccagcagcattgaattgggac

SEQ ID NO: 132485 - DNA, 749 bp, Homo sapiens
tgccttccttgctacctccttcaccatgattgtgaggcctccccagccatgtggaattgttaatgtttgatcaaaatcttcagctcgaaggaggagaaggtaaagggaatcctggcaatttggccatcactattaaaagaagacaagagcctgactatattgaaggaaaagaaggggttggttagaaagactgaatgatcccaacctggctcttcaaatgttccagttaatcacttggcttcaccccttctgccttctagcatgagcactcccagaactgaatgatcagagtcttgcctgctttagaaaggacatgactactcatgcaggccaactccctacttctcaaaacaaacacacactaccacacacacaaacaacacaccttcaccaccacccacccagaccccccccacacacaccctcactcaacacacacagccaccggagcggggcgcagcagcggcccccgaagcggacacccaccccgacccacgcgcacacaccacgcagcccctcgacaggacaaccccaggggcaacgacccaatcgcgccagcggaaacaaaccccccaaccacacaacaagcgcccacagatagggacaacacgcccgacaccgatgccaaaacacaagcacaccccaccgaacagcaaacaaccgcaaccgccaccacaacagtgggaaccgtacacacaacgaacgaaaacaaccgcgagaaccgcggacgataccacaatacaacgcgc

SEQ ID NO: 132486 - DNA, 202 bp, Homo sapiens
accgcgcctgcctagtcctagatcttaaaatgttccaagaatccaggccgggcacagtggcacttgcctgtaatcccagcacattgggaggttgaagtgggagttttgcttgagcccaggagtttgagtctgtggtgagatatgattatgccattgcactccatactccagtctgggtgacagaggaagatcctgtctcaag

SEQ ID NO: 132487 - DNA, 198 bp, Homo sapiens
ccccagttgagaaacatctcaagaatcaaataaatggcatgactaccctcatcaataccatacttttgaaagtttccaaacaaaagtgttcatccaagaattcaatggtatactggaatgtctctattcacttctctagtgtacaacacccactgcatagattttcatcactaaaacttatctttcccataactaact

SEQ ID NO: 132488 - DNA, 625 bp, Homo sapiens
atcatttaatgtttaatgaaatttattttcagtatattttatatgggtttttttacctcctctaaagaggaataatgtttattgattaaaagtgaaaaataatggtttagacaccaattctttttcaagatctttgactatattacgcattgtacaatggattttattcttcatgaaattttttagtttccctactggtaagatagagataatgacttagagagagttctacaggatactcagactttaaaatacttagattgatcgataaaagaaagtaaagcaaaagataaggagtgggagaatttcaacagaaaattagaagctataaaaaatcagtgggaccaggcacagtggctcatgcctgtaatctcagcactttgggaggccgaggcaggtggatcacaaggtcaggagtttgagatcagcctgaccaacgtggtgaaaccccatttctactaaaaatacaaaaattagccaggcatggtggtgcgctcctgtaatccaagctactcaggaggctgaggcaggagaatcgcttgaacccaggaagtggaggttgcagtgaaccgagatcatgccactgtactccagcctgggtgagagagtgagactctgtctcaaa

SEQ ID NO: 132489 - DNA, 582 bp, Homo sapiens
aatttttttttctggagaggacattttgatcttcaaaatatttggctacagttttacttttatacagttgaacagttacaccaaagttgcagactaagaacacagatgataaaggtttcgacaatgaaatgttcttatatcattaagtcttgacttattaaaagccctctttacaaataaatggaggagggaaatttctcagatttcttaacttggaacacagactttttgcaaaggcaaaaagacaaagggagaagtccttacttctccacccgccttgcaaggacagagaaatcttacactggagctgtgaacacccagctaactcaatagccactagagataggatgctaaaggcagagcgtcatagcagcaatacaaaaaatggcaattttttgtaatggaaacactatagtttgtccatactttaagcatgtcatggattaattaggctcttatccaatcaccttggacaccaagaagtgaaacagtctttctaaacgaaaatatcttctgagttccgaataatcattccacaaataaacttatggatgttttttataaacttatgattatttgatg

SEQ ID NO: 132490 - DNA, 323 bp, Homo sapiens
ggaggtaatgtggaaaacaggcagaacccagctcttcatgggcaggcctatttgggggtcaggggtgggctgtgacacaaaggcaggatcacacagctcctctgaagtctcagtaagatgttcttagagaccttcaccctgtgcacacaaagccaaatgatgtaatcatcatcacttcagtaaacttatttccattgcttaaaaagtaacccatattcactgtatgggatttacaaaacccaacaaactttctaaaagcaaaaaagaaggaagaaaaagacgagaaagagaaagaaaaaaaaggagctacgggagagaagaag

SEQ ID NO: 132491 - DNA, 320 bp, Homo sapiens
tttggccgctctcaggccagctgtcagctgcctctcccaggggtgtgagctgacgagagcttcaggtgggagcctctcccggcagtgaatctgagggttgggagggatttccggacccagagggaagatattttggggccgagggcctttccagaacccatgaaatcacacaccctgctgcgaccagactgaccctccctagttgatggttcttttttggacatcctaggcctgcttgggattctggccccatgatttagggtttctttggagcccatctgagcctggggggccctgtggtggtggaagaggtccagcct

SEQ ID NO: 132492 - DNA, 266 bp, Homo sapiens
tctgtggccaattccaattcaaccatagctggtgctccgtgctgcctgctctgagatgcattttccaggtaatgcccgggcttgtccaggagaagcaaaatatccgattaataatgtctgatgtgagcaagatgctcgttgtgtagcaacttgcagaatattttatattcccgaaatgtcatttcttagctatcagggtgaactaagtgaaaaatgacaggtccaagagaccagcctatgtcaaaaaataattaagacaaaaggaa

SEQ ID NO: 132493 - DNA, 437 bp, Homo sapiens
atttgttcaaagcctctgagtgaatgatggagccaggatttgaactctggatgtcagactccaaatcccgcatgttttcctcctgcaatgctgcaccttgttgatgagtggggttgattgccccttgtcgtctcaccatgcacaagggcagtgctggcttaaaggatttcattttaaatcccttaaaattaaaggattttatttcaaagaaattaaactttcctccatttctttgaataaattaggactacccatgctgggtcagcagtccacccatcgggcatggatggtgggtggggtgggatgtttcctccagggctgtctttgaaggtcagaagcgtccagtgcccctgtttcctgtcatggcccttgtgtctctctccctggtgagtttatcaaagtcctctggatcttagccatgtttttatcctgtgcca

SEQ ID NO: 132494 - DNA, 677 bp, Homo sapiens
gggatgtgctatttaaatattgtcaaaaatattagcaggtctgagaatataattgatgtctctgtttaactctgccacattgtgtattgttctaacgccagctaaaaggatgcatgctattaaacctgaataatctctaatagctctggttcatttcctattgcatgattcctgtttaagtgaagagaaaaaaaaagaactgtgactgtgtgtcaatgatctgtcaaatgcaaattctcaagtagtgtcctcactgtcacctagtcatcactgctaatcactacagggcttaatgcgtattcatgacaaaaatccagctattgtgggggaaataaacacgttagcagtttaataatagaaacttgtcagccttgaggatattggatttgcatatttattctatgaagtttctccagtccagtataggtggatgctactctcttgattaattaattgcgttgccttaagaattgaccagtggcactaaattaatctttttaccctgaattatctgtaggaaaactgagaattaaaatgattaatttcaatagaaatttaggaccaatacttaaaaatcgacattgctaagattatttttaaagctatggcaacagagaccaattccaagattggagaaataatgtagatgactcaggctgcaaaagctgcttagatgg

SEQ ID NO: 132495 - DNA, 626 bp, Homo sapiens
ggtcacacatgtggatctatgtcttcatgggtaatatgcttcgtggcataggggaaacccccatagtaccattggggatttcttacattgatgattttgcaaaagaaggacattcttccttgtatttaggtactgtgaatgtaatgggaatgactggtctagtttttgcctttatgctgggatctctgtttgctaaaatgtatgtggatatcggatatgtggatctgagcactatcaggataactcctaaggactctcgttgggttggagcttggtggcttggtttccttgtgtctggaatagtatccattatttcttctataccattctttttcttgcctctaaatccaaataaaccacagaaagaaaggaaagtttcactatttttgcatgtgctaaaaactaatgataaaaggaatcaaatagctaatttgaccaaccgaagaaaatatattaccaaaaatgtgactggctttttccagtctttgaaaagcatccttaccaatcccctgtatgttatatttgtaatttttacattgttacacatgagcagctacattgcttctcttacttatatcattaaaatggtggagcaacagtatggttggtctgcatctaagactaac

SEQ ID NO: 132496 - DNA, 653 bp, Homo sapiens
ttatgagtttcttcataattattactaagatactgagatgtttgccatccctaattctacaacttaattgtctatgtcattaatttgtgttttaaactcccttgtttttagactccatataaaaatgtgaagctgctagagggaaactcccttatatctgttgccagttttctgcagcaatggccacttcataatttaacagggtatttaatgtcaacttgttggttaatttatctactgatatatcactgaataaatgccgtacacctaaggaatatgactttgtaacagtactaaatggaacttaatatttttatgtaaatttttactaatatcctcacgtcaactttatttttaacagtagtaaatgaaatgtactaattggtgacagcaactttaaaatatccaagattttacttctttcaattttagctaaatctgttctaccctacagatgcatattgaactgaatgacaccaccagattatccagtcaattttgtgtcaggaacatgctaatcctcacatagttctgatcatgttttattattacccccattttgcagataatgataacattggaaatcaaaggcaatatggaaagtactcaaatgtggatagctactgtgaaagattagaatactattcagcaaa

SEQ ID NO: 132497 - DNA, 395 bp, Homo sapiens
taagagaatttgaaatagcatgttagacagtcctccctccaggggatgaggcttagttcagctgctaccatcctctttctgggtaggctagacacttccaaataacagagtatggaaacggaaaaagagtaactagtagagaaacctggtagatactacctttaacccagtgatgaaggtgagcatcaccagtgtggatgtaatgcaccctctaataggttgtgataagaagggtgctcctcctctgtagtgtgcttccccccaacctgtaaccccagtctaatcgtgagaaaaacatgagacagacttagactgggggacattctacaggatgcctgaccagtactcctcaaaactgttgaggtcattaaaattaaggaaaaactcaaaaactg

SEQ ID NO: 132498 - DNA, 112 bp, Homo sapiens
tgtggctctccaaatccctcagagtccttcattgtctgagcaggcacactcatcttctgtagtttaaaaggtggcagtggctgggcgcagtggctcacgcctgtaatcccag

SEQ ID NO: 132499 - DNA, 181 bp, Homo sapiens
tctcttttccattcaagcctgcactacctcctgtgttttctgtcttgactaatgctgtggcttcatgtgcaggctcctgagagagaccaacattgaccccttctttcactgtgtctccaccagatcctgttcattcacctcagacatgcatttccaaaagtctactttttaccacctctgc

SEQ ID NO: 132500 - DNA, 397 bp, Homo sapiens
tgtgctggctttaggtctgacccagtgtagtttcagtggtggggtggccacaggggtgcttgtgtaacctctcccctagctccaggtagctcagcatagacggacaaattccagttgtttgggagagagtaagaggagagaacaagagtctctccctggtaatccagagaattattctggattttacctaaaaccaccaaggtggtacctctatgagtctgcaagagccacagttttactacacttggggtgccacctaatgtagatacaaatgcagtgacaagagacctggatcacaacactcaagtccctttgaatactcggaaagccttcgcaagaaagatgggtaaaaacaagcccagactgtaaagactataataaatacctaactctccaa

SEQ ID NO: 132501 - DNA, 379 bp, Homo sapiens
tcctgcacattgcttgtagcctatggaaggaagacatgacttgagaagcaatttaataaagaatggtaggggctgtcgggggaattacacgtgccgtagaagtacatagaaggagcatccagctttgtctggtgtatggtggggggctcaggaaagcttgtctgaataatagtatataagccaagacttgaggaatgaactggtaaaggggagaaggagtttttcaggcagagggagcagcatgtaccaaggcctgaggcaagagaaagcaagacagggagggcagagaactgaaagaacacatttcagcatggctgggtcacgccacaatgaggccagtcacagatgagctagagagccagccaggggtcagggccga

SEQ ID NO: 132502 - DNA, 740 bp, Homo sapiens
gtcatgggaatagtgcaggagtaagatccaaaacccatagtcaagagtaaatagttacatttttaaacaagtgcttctcaataaacatagacttacaactttacgacttttgaggagaggagaaagttgctaatttcacctcatgtgtgggtaaggcttcaccagggaactatgcttgagcctggaaaatgaagaggagtttgcaaggtgggtaggaggggtgggggcctaccaggcagaaaagaatgcctatatcggaacacacaactccattctactttgcctactatccaaacaacctggacagaagtctgtctgtcacttatatttctaaaaatctccaaaacaggaaatacagcttgacccttgttatctgaagaacttagcagtggtgaaatttccaatcatggtattcaaactgccaaataaaattttgcagtcagcatttctcttaatccaacaaccttttcaccttcaagtgacttcccagcctcaaagagcctctcatcttttgtgggtctctggtgctccagaatttgcacagataatagttttttgctgtctttggaagacaagcttttggaccaggtagccagttttgggccctatttggggacataactggcaactctgggccccgagagaaagtcagaggtgctccactgcaaaattcacctggtgagaagaggggagggaatccagttttctttttctccactgcctttgttctttcccagtgt

SEQ ID NO: 132503 - DNA, 442 bp, Homo sapiens
caagctgaggtcagaaagcttctcaaacatacttatttctgggcatagccagtggctgtccctgaagcactaaaaagaacaagacccttagcaacataccagactgctgataagaggggctggagcgcagtgctgtgatcatagctcctgcaatctttaactcctgagctcaagcaatcctctcgcttcagcctcgtagtagctgcgactacaggtgtgtgctgccatcccccattaattaaaaaatattttttgtagagatggggtcttgttatgtttctcagcctggtcttgaactcctggcccttcccatttcagcctccccatgacgtggggaggtttacagacatgacccaggcccattcttctgattttgttttcctcttcatctaaaagaactcctttcaagattttatgagacagaagtaaacatcagcatctc

SEQ ID NO: 132504 - DNA, 253 bp, Homo sapiens
tctcacatggcatgcctgtgtcctgtgctttctttggaagccctgagctccactacctcccttgctaatcctcatcttcccttgaagctctgtctaacacatgtgttcttccctgggagcctgtcttcctctgagcaggtctcaggcttttctgctcagctctttcacagacccgtaattcacttttctgtttcccctacagactttgatctcttgagacctctacatctcgggagtctgacacacacatata

SEQ ID NO: 132505 - DNA, 348 bp, Homo sapiens
ttctcaaatcctgactcctttgcaaactacagacatgaagttgttcccatttttaaaacagggaggctgagtgtgaagctggaagaggcaggaatatccgctaagtcctccgtgggtgaggtgtcagggaggtgttcacattaaaacttcttctgtgcctttctttcactttggaaatgactcactgtgattctagtctcttgggggggctgacgggggctccccagggacccctgatgacagctgacccttcctaggtctctccattggtgcagtgtctgtgggtctttgttcaatggttttttttgagctatccaaatcccagtccttgcctgctgcctgcctagc

SEQ ID NO: 132506 - DNA, 425 bp, Homo sapiens
cggaagcaatccagttgctcccatctgaactcccagggctttcctccacttcctctgaattgctctactctctgtgctcatcacatttctgccctctccccctccacctctctaaatcttgcactagtttctcggtgacctattttctgattcctcaagtctacaccagtctctcagaatgtttataacagttatatttacttggtgcttattgtaaattaccatttgcctttttatgtgtgtgttcctccacctccattttgatagtagatttttttggagggcagtcactatctcctgtgggatttttttattctttaaacaccaacttactactttacccaaagcagaatttggatataaatttgtaattaaccattgtaattcccaactattgctgcataaacaggcacagctgacagctc

SEQ ID NO: 132507 - DNA, 376 bp, Homo sapiens
tgaaataccctggacattatatataaaataaacatttaaaaattctgaccagcctggccaacatggcgaaaccccgtctctactaaaaatacaaaaattagccgggcgtggtggcacacacctgtaatcccagctactcaggaggctgaggcacgagaatcgcttgaatccgggagggagaggttacagtgagctgagattgtgtcactgcactccaacctaggtgacagagtgagaccctgtctcaaaaataaaaataaaaattctgaaaggtggagaaggaagaagactggctagggaccttggggtctgaggaatgacacagctgtgagtctgctgagtttgttttttcttatttgtttgtttgtttgtctca

SEQ ID NO: 132508 - DNA, 470 bp, Homo sapiens
tatctcccagattctaaggagaagacagttgtgtcttcaaaagaaaaagattccagacactcctccctaatggaattcttctgatcccatagttcaaatcaaatgaaatctctctaacagcatcagagatgaaacataaatgtttggtagaaagagagtcaggcagggcattatggctcaagcctgcaatcccagcactttgagagactgaggcagaaggatcgaatgtgcttagagaccagcctgggtaacaaagtgagaccttgtctctatttaataagaaatattttttaggccaggcacagtggctgacgcctataatcccagcactttgggaggccgaggcggacggatctcttgaagtcaggagtttgagaccagcctggccaacatggtggaacccccatctctactaaaattataaaaaaaattagccaggcacggtggcgggtgcttataatcccagctat

SEQ ID NO: 132509 - DNA, 380 bp, Homo sapiens
tatctcccagattctaaggagaagacagttgtgtcttcaaaagaaaaagattccagacactcctccctaatggaattcttctgatcccatagttcaaatcaaatgaaatctctctaacagcatcagagatgaaacataaatgtttggtagaaagagagtcaggcagggcattatggctcaagcctgcaatcccagcactttgagagactgaggcagaaggatcgaatgtgcttagagaccagcctgggtaacaaagtgagaccttgtctctatttaataagaaatattttttaggccaggcacagtggctgactaattttttttataattttagtagagatgggggttccaccatgttggccaggctggtctcaaactcc

SEQ ID NO: 132510 - DNA, 269 bp, Homo sapiens
atagaaacattaaaagtaactagctattgaacatggcaacaaaaatagttaagaaccactttatctcataaaacataaatttcagcctccagtggcatgtctgctattatttcataattctgggtcccactccctattaagtccaaggctgtgtcaggatgatttaggaagataaagcaatgttacaccacatattttcaacccaggtacctttaggcatacatccaaatgtgaatatcagatctgtacaaatgtaaatggagttgtca

SEQ ID NO: 132511 - DNA, 496 bp, Homo sapiens
ttacaagattttaatcagctattttaaacgtgttcaatgaactacagaaagtcacatttaatgaactaaagaaaactatgagaacgctatctcaccaaatagagactaatatacaggactttaaagaaattaatccaaaaagaattctggagttgaaaaatataactgcaatgaaaaagtatccagaggagctcaacagcaaatatgagtaggcagaagaaagaaccagtgaacttgaagaaaaaatcaacaaacatgaagacaggtcaattgactctcgtctaaggaacagaagaaaaaataaaatggagaccacaaggtctcagagacctgtgggacaccattaaaaagactcctatggcaggcacggtggctcacacctataatgccagcactttgggaggtggaggtgggtggatcacctgaggtcaggagtttaaggcagctcacgcttataaccccagtactttgggaggcagaggtgggtggatcacct

SEQ ID NO: 132512 - DNA, 175 bp, Homo sapiens
cgcatctattcgaggcaaataaataatgtttactagcaatgtcaagaataggagaagggttgggaggtgtttctatgttttagaagcaagatttttttcctacctctagattgccaaagttttattttgtttttatctctgtactatgactcatgttatgaccttatatgaagaa

SEQ ID NO: 132513 - DNA, 502 bp, Homo sapiens
gaggaatccaaggatgttgtggaactaccacttgctaaagagattaccatgactaaatggaagccaggcgctaatagtcaagactatgggtaaaaggcccaatcacaggcccagagacctaagaagacagaatggttttgggagccaggcccaggttctgctgtcctgtgctgtctcaggatgttccttcctacatccccaccacttcggctccagctgtggctcaaagggccccaggtactgctcaagctactgctccagaggacgcaagctgtaagccttggtggcatgcatatggtgttatatccacaggtgctcagaatgcaataggggttggagtccccacaactggtgcctactagggcagtgcttaccaccctccagactccagaattattagagcccctgggaagtgttgcgactgcagcctcgttaaaactgttaagcttgggactgcaacccatgaggagcagccacgttgggtgcacctagcagaaccatg

SEQ ID NO: 132514 - DNA, 438 bp, Homo sapiens
tcctttcatctttagggggtctcaagtcccctttcctgtgtgtagcagattctgccagccttggctgtgtgtcagggagaagaggggagctacagagtcttccctgtccttctctctcccaggtgacctctacagggctctggggccacttgcttaagggagacccgacttctgcacccggtcatatcctccccagggcatgaccacttcccctaccagacgtagtaggccagtttcagccttagtaatctaagaaatatgtgagcaatttgatgcggatctcagagagcctcgtggaagtaatggcgctgagagatggcgcctggggaagaaagaggagacaaggatagtattctggccccagaagaaactatgaggtgggatataatctttttaggtgtatgggagattgcttcatatagggtggggaagaactag

SEQ ID NO: 132515 - DNA, 116 bp, Homo sapiens
ctaatggataggtgtttttcaaattccaggactctgtttagaacgaggagatagaatcacaaccagggtaagtcttcctgtgttctgagcagtggagaagagatgtatgtacacag

SEQ ID NO: 132516 - DNA, 183 bp, Homo sapiens
ggaagcctgagagccctgttttctcaaagagcccagagttcaaattgagtgatataagctgagtacaaatagctgttgtattgtatgacatagagtgggtgagagttgcacagtccaatatggtagttcctagcaacatgtgcctacttaaatttaaatcagtcaaagttaaataaaactcaa

SEQ ID NO: 132517 - DNA, 293 bp, Homo sapiens
catacctggaccttctactgataattcccttaacccgagcgctaccaggcatacctggaccttctagttatggcttcagcacttctgtccttgattagcttatagccttcatcttgctaatataaccattttcttgagaccattggattttgagtgagttgcctgttacttgacatacttctacgactattgattctatatgttactgttaaattttggtaacttcatattagaaaatattgttttctataagaaatattgtattccatatttctgatagtcaatttaatatc

SEQ ID NO: 132518 - DNA, 384 bp, Homo sapiens
cctgctgctccctcttcatctgtgactgtacatccgttcattcctcaccaaagatcactgggcacctgctgtatgccaggcactgtgccctggacactgggcatggggacagagcaggggaacagcccccaccctcctggagctgacattcctccagtcctggggacaaacaggacaaaagatgaaatgaaatatcagcagggggctggggctcaagcctgtaatcccaacattttgggaggctgaggcgggaggattccttgaggtcaggagttcgagaccatcctggccaacatggtgaaacccccgtctctactaaaaatacaaaaaaaattagctgggcatggtggcaggtgcctgtaatcccaactaatcaggaggctg

SEQ ID NO: 132519 - DNA, 562 bp, Homo sapiens
cacctgcagcgggagcttatcatcatcactcaccgaccaaaaaaaaaaaagaaaaaaaggtgggggggtggggcggaggggaagaaggtcgaatcagatcacccctagaggtctctctgccctcgcaatcactctcaagtcctagagtaccaaacttaactgcagagggagcacgaaatggtgggtattttgaagcgctaatttttagggatcccctcccatccaaaacagggatgaatagttgaggaacaccggagcggggccctggcccttctcggaacgttgagcagacctaacatgacgctggtccgttcaaacgtcgcagttgtggcccacacagagcccagtctgttcccaggggcgcgccctgcacccctctgcctgcccgaggtcttccctcccctccgctccccagaaacgcacccactgagacatgtgcggggagggggcacgcttactcccacatcccgcccgagacccgcggagcagccaagacccggccaaaaaggggagggcgtggcaggcaagggccgggggcgggagcgcgggcggccgcggactc

SEQ ID NO: 132520 - DNA, 199 bp, Homo sapiens
gccagaaagatataaagcaggtgatggtttctaaaagactgctgtaaacagattatagatcattcctgaattatgcacaagcataattccttatttttgcctcctttcctcccctcctctctcctgattaattcagcacatatttattgagcacctactgtgtgctaggaactgtgttgggtgttgatacacagaattg

SEQ ID NO: 132521 - DNA, 358 bp, Homo sapiens
tctgattttttttgaaactgttagcttttgagtaaagatataagtctcccagtgagcctctgccgatactcgtgaaaccacatggcttatgtgctgcagcagctgtagcgccccattcattctgctgttagccatagtagacaatgaaggtgtcaggttatatgctccctataggctgaaaccatgtctcattcacctttattcctcagtgcctcctgagcccagcacatagtaattgcatggtagacaggttgtgtggctcaacacctgtaatcccagtgctgtgggaggattgtttgaggccaggactttgcaaccagcctgtgcaataaagccatatcccatctcttaaaaaaaa

SEQ ID NO: 132522 - DNA, 440 bp, Homo sapiens
cctcccaggttcaagccattctcctgcctcagccttccgggtagctgggactacaggcgcgtgccaacatgcccggctagttttttgtgttttcagtagagatggggtttcaccaagctggcgaggctggtctcgaactcctgacctcaagtgatcctcccaccttggcctcccaaggtgctgggattacaggcgtgattcaccgcgcccggccagttgtacgctagatctcctgaaggtaatcctcctgtctagttgatattttgtaactttcagcaacatctttccagcccctggtaaccaccattttcctcttcgattcaagtttcttggcaatgaatagtcttgaacagatatttggaattaccttttgaaggaagtacgattcttggctcagtgtaacttactcaagtatccgaaagggctgatttataagggag

SEQ ID NO: 132523 - DNA, 487 bp, Homo sapiens
tgatctagaggatcccgagaagagacagaagggcactgtagagatagagctttcttggtgatgaaagacatagagtgttctctataagcacctcctagagggggcctaagtgcagctcatggtacctgtcttagtctgttttgtgctgctgtagcagaatgcctgagagtgggtaatgtatacagaacaaaaatgtatttggttcacagttttgaaggctaagtccaagatcagggtgccagcgtcttacaagggccttcttgctgcaccactccatggtggaaggcgagagggcaagagagagcagagcacaagaggggactagattcattttttcctaaggaacccactcccttgagaacgacattaatccacgcgtgagggcacagcccccatgacccaaacacctcccaagaggccccacctcccaacactgctgcattaagatcaagtttccaacacaggaactttgggggacacatttaaa

SEQ ID NO: 132524 - DNA, 443 bp, Homo sapiens
tggcggtcccccgctctcgggaggtcagcatattgatgccgaacttagtgcggacacccgatcggcatagcgcactacaacccagaacccttaggattcaagaaaaacatgcatggaaagaacctgctttgggcaagatctcccatcccccaccaactaccagccagtaccctgaaggcaaaatggaggataatgccccttatactgcagtccccagacaagggagaatactttttgtgtcctaaatcagaaaaatccctaaggtccatttagttcaaaactcctgtaagtctccctggtattaagggctcttaaagtaggaaaagctataacttagtggcaaaccagatagatcaaggctagaaatctggctgtgtcatttaccagctagaccttagacaaaggaccaagcatatccaagctttaggttcctcatctgcaaa

SEQ ID NO: 132525 - DNA, 341 bp, Homo sapiens
tataaataattaaattggaaataagaaaaaaggtgtttagctgtcataaatattcaagttttgatgtttcaaattcatattagcattaagaaggtggatttacagttcttgcttatgtcttctttttaaaaaaatattaatttaagaaaagtttcagggcaggtctagtggctcacatctgtaatcccagcattttggaaggctgaggcagttggattgcctgagcacaggagttcaagtccagcctgggaaacatgccaaaaccctgtctctaccaaaaacagaaaaaattagcagggcgtggtggtgcacgcctgttgtcctagctactctggaagctg

SEQ ID NO: 132526 - DNA, 148 bp, Homo sapiens
cagcctcccaaagtgctgtgattagaggcatgacccaccatgcctggccactgaaaatatttcaaatttgactaaaactgtatttacaaagatctagagatttcaactataagtaagaggagaaaaatgaaggaaatggcatcaagac

SEQ ID NO: 132527 - DNA, 434 bp, Homo sapiens
tgaggtgtgaggtgaatgcaagtgtaccatcccacagtcagggatatccagcataacaacaggcctcccaggaagcaagagccccccaggattggagtgtgggcagggatcccaatgccccatgcccgcctgcttgcatgggaggggcccatgggccatatagctctctgccccctgcatgaggactgctgcagccaaccctggcagaggccttgaggcaggaggaagactgcgaccgccaaggatgcctctagtcaccacccacccaacctggtcattctgtccccaattcctcatttctatgccaaatattttcttcctctcatccttttcctcatcaggacctcagaggaaagcccactaaatgcgttctctctgaagatagtttataataaagcaagatcggggtggctttccaatggtggaatttcagg

SEQ ID NO: 132528 - DNA, 471 bp, Homo sapiens
tggagattaggatggaaggtattcatgggacagtatatgtgataaagaagctctttcaattaaataaaaagaagacagcactagcttgcttgaaaaaacacaattatatttgaattcttcacatgtcaatatgttagtctttggcaacctacagaaaaccatcatcatactttttttataccaatagtgatgactccactttgaccaaaaggcgaatcaatgtagaaaaaagtccattgtcttcactgtggaaagtacatcgaatctggagtcagatggattagcattcaggcctcttggtagttttctgatattggacaatttacttactctgtatttgtttcagttaaaaaatggggaatttgtcttaacatttttgtgagtattaaaataagagattttaaaggtgcctggcacagtgcctgggacagagtatgtgctcaattatattagtcacgttcctgccttgtc

SEQ ID NO: 132529 - DNA, 550 bp, Homo sapiens
aattaataaatctttatcgcgtgtttctttataaagactatagttctcaatgttaaatgtttgggaaataagcagagtaaaggtctcccactgtgtaaagactggctcccacttcttgggaaggctagacagaccctgagtgtattcaatgcagtataaaagtcaagggcaggaactttggagccaggtgagctgggtgtaaatcgctgctctctgactttgaaggtcaatgaccaggagcaaattacttcccatctctgtggctaggtgatgttcattccaatggtttcctactcctgccttctgcattatagcttatgtgaaataagcaagaaggagcaggagcaagccttggccgcggcgcttgctggcatcctgtgggctgcaggagcagctcagaaggccaccatctgtcttgtcactgaggacatttacgttgcgtcgactccggactactctgtggacaatttcactgagcgagtaagtgcagttctccctgtcctggcagatgaaaggccagtgaagcctgagcatgtaatagacttaccat

SEQ ID NO: 132530 - DNA, 819 bp, Homo sapiens
  misc_feature (819)..(819): n is a, c, g, or t
ctacaggcagttggttaatgtttggattagcggtatctgttaccagtttagataatttggcattgctctgttggagtgtttaatgagttaactcattaaagttaacagggaaagaaacactttggagatcctgcatcacaggctacttaggttgcaagcaaatgtcttagaaataagagcaggaaggataaaatcctagaatattactaaggtgaccggtaaagaagtttctccttcagaatgaaaggactatttttgacctggaaaaaaagttttttgataggggagggaggtgatcaacaaaaagcttttgatagggtacatcctaggattttgccaatagtttgaatttcttttatgacaagtttccccaaccaaacaatcattctatgtcgaagagcagaggactcagttaaaaagaggtatgaaataggatgttaataatggcacaacatggcagagtggatccagtagagcaacagtttacaaatgaatagctctctcacatgtcagttaagacattctccttgatttagaggagattccagttttggaaattatagtaaaagttttttaaaaaaaatttaagtaaaattgctatccttggcagatacctgatgtgatcacaaaaagaaaaaataaaaaaaaaaaactttttgggggcccgcgaccggaaaatttagaccaatctgtggggcgcggccaaggtattgatcggtcacttctcaggaaccggccagacggcgggtccccaaaaaacccgggcccggcgttgacaaccaggtgcggctaggctcacaggcagctacccccgcgcan

SEQ ID NO: 132531 - DNA, 553 bp, Homo sapiens
gggctgaggcttgaatgaagaaccagccacacaaagatctagggtcagagtgttccagagagagggaacagcaagtacaaaacccctaaaatgggatgaatttggcagaatgaacctcaagggctcaaggaacagaaagaaataaaatgtggctgataaagagggaggggagaagagtaagagaagaggtaaagaggcaagagtgggagctaatttatgatgaggagtctggattttattacaagtacaatgaaatcccccctcgggtttttaagctggagaataacatgatctgacttacatttttaaaagatccctctgcttgcctatgtgggaaatcaactgtaggaagcaagaattgaatcagagaaacaaggacagtgaagatggaagccaagcagcagttgagtaactcaagcttccctctgccatttaacattatctcagcccagagcaactggcttgtttcctttttgcttcttttcctgagtttacttgtcctgctgatggagtcacttgctctaggttacagtaagacccagagaagagctga

SEQ ID NO: 132532 - DNA, 693 bp, Homo sapiens
taacttgttactgtcaccccttggtccaacaactggtagaatcattccaaaggagcctttaaagaacaattgacagagctgagacccagcgtagagtagcgcaggccaggtgttgtggctcacgcctgtaatcccaacactttggaaggcttagcctggaggattgcttgaggccaagagtttgataccagcctgagcaacatagcaagaccccacctctacaaaaaataatggtggcacatgtctgtagtcccaactgctagggagcctgaggcaggtgaatcgcttgagcacagaaggttgaggctgcagtgagctgcaatcatgtcacttcactccagcctgggtgacaaactgagaccctatatctaaaaaaaagaaaattaaaaaaaaaaaaaaattttgggggggcttgggcccgaaaaaatttttaaacccttcgttgggggccggcggggcgcccagatgtggatacggcaacactggggcataaagcttgtgtcccccagaaggaagacccgggggccaacagaatctacgggggctgtgggtttcctcccccaattaaaaaaaaccgcgccggggggggccgacgcgcgttttctggacaaattcccaaggggagtgtcccgaaggggcctaagcggggtctttcaagcagggggttcccaagaggagacttccgaattatca

SEQ ID NO: 132533 - DNA, 364 bp, Homo sapiens
cggacgcgtgggtcgacccacgcgtctctttaatgtgatcactttcaaatttaaaagatccaggtggaaatatttttactatagtaataattctacaaaatacctgaattcttaacactgttatatttcagtataagtggtggctttttcttttcatgtctttgatctggttttattcctgtaattcagccacctgattttgtgaggggggggaataatatgtggtttttgtacaaacatgtttctcagtgtgttgttattttggaaaaaatgaggggagggagtttggcaagaatggagaaaatgaatgaagaaggcctaatctctctctttttcagtgaataaatggaacaccatttctgga

SEQ ID NO: 132534 - DNA, 385 bp, Homo sapiens
acatatttgtttttgtaagctcctttatagcacagagcgtgtctcagacatctataaatttcccataacgtaagtacttagtaggtactaggaagtaagccaacattttctcctgcaaaaattgtactagtttttgaatgcctgtctttatcttgcagtatgttcatgcggatgctcctaccaataaaacactggctgggctggtggtgcagcttcttcagttccaggaagatgcctttgggaagcatgtcaccaacccggccttcaccaaactccctgtaagtacatcagcttactgttatttgggcatcctcagttgctgtatacttttaggtgtagcatccagcttttttcctttgctgctgctagcgtgtagaatttaaaa

SEQ ID NO: 132535 - DNA, 875 bp, Homo sapiens
  misc_feature (601)..(601): n is a, c, g, or t
  misc_feature (804)..(804): n is a, c, g, or t
  misc_feature (806)..(806): n is a, c, g, or t
  misc_feature (833)..(833): n is a, c, g, or t
  misc_feature (850)..(850): n is a, c, g, or t
  misc_feature (866)..(866): n is a, c, g, or t
aaacaggtcttgctctgttacccaggctgcagtgcagtggcatgaaaacagctcaagggatcctccaacctcagcctccctgggggctggcactacgggcacgtgccacccatagctatgatacttgggtccatagtaatgatgttgatgctgaaattgaagatccaccaattccagaaaaaccatggaaggttcatgtgaaatggattttggacactgatattttcaatgaatggatgaatgaggaggattatgaggtggatgaaaataggaagcctgtgagttttcgtcagcggatttcaaccaagaatgaagagccagtcagaagtccagaaagaagagatagaaaagcatcagctaatgctcgaaagaggaaacattcgccttcgcctccccctccgacaccaacagaatcacggaagaagagtgggaagaaaggccaagctagcctttatgggaagcgcagaagtcagaaagaggaagatgagcaagaagatctaaccaaggatatggaagacccaacacctgtacccaatatagaagaagtagtacttcccaaaaatgtgaacctaaagaaagatagtgaaaatacacctgttanaggaggaactgtagcggatctagatgagcaggatgaagaaacagtcacagcaggaggaaaggaagatgaagatcctgccaaaggtgatcagagtcgatcagttgaccttggggaagataatgtgacagaccaaaccaatcacatttatttattcccaagttatgcatccaagggtttgattaaaaactgtattcaatgtgaantngaaaggggcgttgcctccttccctgangttccctccaatggggnaaaaaaaccaaaattncaaaggact

SEQ ID NO: 132536 - DNA, 338 bp, Homo sapiens
cttttggggtctttgctcttttggggtctttgcgcttttggggtctttgctgggagggtagaatgccattccagaggacaagccacaaaaatgccttaatttgagctcgtatttacccctgctgataagtgacttgagagttcccggttttttcctcttgtccttccctcccttctgtccttccatgtgtggggaaagggtgttttggtagagcttggtttccaaagcgcctggctttctcacttcacattctcaagtggcagtttcattatttagaatgcaaggtggacatcttttggatatctttttcagtgaataaatggaacaccatttctgga

SEQ ID NO: 132537 - DNA, 541 bp, Homo sapiens
gctgggcggggccgggaagcggcagtggcggctacgcgcgcgggggtgcgcgcgggaacgaccgggaaacaccgcgagggccggggtgggccaggctgtggggacgacgggctgcgacgatggccgcagcggcgggcggcggcgggccggggacagcggtaggcgccacgggctcggggattgcggcggcagccgcaggcctagctgtttatcgacggaaggatgggggcccggccaccaagttttgggagagcccggagacggtgtcccagctggattcggtgcgggtctggctgggcaagcactacaagaagtatgttcatgcggatgctcctaccaataaaacactggctgggctggtggtgcagcttcttcagttccaggaagatgcctttgggaagcatgtcaccaacccggccttcaccaaactccctgtaagtacatcagcttactgttatttgggcatcctcagttgctgtatacttttaggtgtagcatccagcttttttcctttgctgctgctagcgtgtagaatttaaaa

SEQ ID NO: 132538 - DNA, 278 bp, Homo sapiens
tcttcagcatttaaaaatgagcaaataatttctgatttgtttccttagagtaagggtgctagtgctggaagagaatggactgaacgaggagacccttctactcctggaggtaagcagattaatgcatatgggatgtgtgctaagattctttgactagcattttattttgtttggttttatttagaggcagggtctcgctgtgtcacccaggctggagtgcagtggcctgatggtagctcagtgcagcctctacctcccaggctcagtcgaacggactg

SEQ ID NO: 132539 - DNA, 6346 bp, Homo sapiens
gctgggcggggccgggaagcggcagtggcggctacgcgcgcgggggtgcgcgcgggaacgaccgggaaacaccgcgagggccggggtgggccaggctgtggggacgacgggctgcgacgatggccgcagcggcgggcggcggcgggccggggacagcggtaggcgccacgggctcggggattgcggcggcagccgcaggcctagctgtttatcgacggaaggatgggggcccggccaccaagttttgggagagcccggagacggtgtcccagctggattcggtgcgggtctggctgggcaagcactacaagaagtatgttcatgcggatgctcctaccaataaaacactggctgggctggtggtgcagcttcttcagttccaggaagatgcctttgggaagcatgtcaccaacccggccttcaccaaactccctgcaaagtgtttcatggatttcaaagctggaggcgccttatgtcacattcttggggctgcttacaagtataaaaatgaacagggatggcggaggtttgacctacagaacccatctcgaatggatcgtaatgtggaaatgtttatgaacattgaaaaaacattggtgcagaacaattgtttgaccagacccaacatctacctcattccagacattgatctgaagttggctaacaaattgaaagatatcatcaaacgacatcagggaacatttacggatgagaagtcaaaagcttcccaccacatttacccatattcttcctcacaagacgatgaagaatggttgagaccggtgatgagaaaagagaagcaagtgttagtgcattggggcttttacccagacagctatgatacttgggtccatagtaatgatgttgatgctgaaattgaagatccaccaattccagaaaaaccatggaaggttcatgtgaaatggattttggacactgatattttcaatgaatggatgaatgaggaggattatgaggtggatgaaaataggaagcctgtgagttttcgtcagcggatttcaaccaagaatgaagagccagtcagaagtccagaaagaagagatagaaaagcatcagctaatgctcgaaagaggaaacattcgccttcgcctccccctccgacaccaacagaatcacggaagaagagtgggaagaaaggccaagctagcctttatgggaagcgcagaagtcagaaagaggaagatgagcaagaagatctaaccaaggatatggaagacccaacacctgtacccaatatagaagaagtagtacttcccaaaaatgtgaacctaaagaaagatagtgaaaatacacctgttaaaggaggaactgtagcggatctagatgagcaggatgaagaaacagtcacagcaggaggaaaggaagatgaagatcctgccaaaggtgatcagagtcgatcagttgaccttggggaagataatgtgacagagcagaccaatcacattattattcctagttatgcatcatggtttgattataactgtattcatgtgattgaacggcgtgctcttcctgagttcttcaatggaaaaaacaaatccaagactccagaaatatacttggcatatcgaaattttatgattgacacgtatcgtctaaacccccaagagtatttaactagcactgcttgtcggaggaacttgactggagatgtgtgtgctgtgatgagggtccatgcctttttagagcagtggggactcgttaattaccaagttgacccggaaagtagacccatggcaatgggacctcctcctactcctcattttaatgtattagctgataccccctctgggcttgtgcctctgcatcttcgatcacctcaggttcctgctgctcaacagatgctaaattttcctgagaaaaacaaggaaaaaccagttgatttgcagaactttggtctccgtactgacatttactccaagaaaacattagcaaagagtaaaggtgctagtgctggaagagaatggactgaacaggagacccttctactcctggaggccctggagatgtacaaggatgattggaacaaagtgtcggaacatgttggaagtcgtactcaggatgaatgcatcctccactttttgagacttcccattgaggacccataccttgagaattcagatgcttcccttgggcctttggcctaccagcctgtccccttcagtcagtcaggaaatccagttatgagtactgttgcttttttggcatctgtggtggaccctcgcgtggcatctgctgcagcaaaagcggctttggaggagttttctcgggtccgggaggaggtaccactggaattggttgaagctcatgtcaagaaagtacaagaagcagcacgagcctctgggaaagtggatcccacctacggtctggagagcagctgcattgcaggcacagggcccgatgagccagagaagcttgaaggagctgaagaggaaaaaatggaagccgaccctgatggtcagcagcctgaaaaggcagaaaataaagtggaaaatgaaacggatgaaggtgataaagcacaagatggagaaaatgaaaaaaatagtgaaaaggaacaggatagtgaagtgagtgaggataccaaatcagaagaaaaggagactgaagagaacaaagaactcactgatacatgtaaagaaagagaaagtgatactgggaagaagaaagtagaacatgaaatttccgaaggaaatgttgccacagccgcagcagctgctcttgcctcagcggctaccaaagccaagcacctggctgcagtggaagaaagaaagatcaagtccctggtagctctcttggttgagacacaaatgaagaaactagagatcaaacttcgacattttgaagagctggaaactatcatggacagagagaaagaagctctagaacaacagaggcagcagttgcttactgaacgccaaaacttccacatggaacagctgaagtatgctgaattacgagcacgacagcaaatggaacagcagcagcatggccagaaccctcaacaggcacaccagcactcaggaggacctggcctggccccacttggagcagcagggcaccctggcatgatgcctcatcaacagccccctccctaccctctgatgcaccaccagatgccaccacctcatccaccccagccaggtcagataccaggcccaggttccatgatgcccgggcagcacatgccaggccgcatgattcccactgttgcagccaacatccacccctctgggagtggccctacccctcctggcatgccaccaatgccaggaaacatcttaggaccccgggtacccctgacagcacctaacggcatgtatccccctccaccacagcagcagccaccgccaccaccacctgcagatggggtccctccgcctcctgctcctggcccgccagcctcagctgctccttagcctggaagatgcagggaacctccacgcccaccaccatgagctggagtggggatgacaagacttgtgttcctcaactttcttgggtttctttcaggatttttcttctcacagctccaagcacgtgtcccgtgcctccccactcctcttaccacccctctctctgacactttttgtgttgggtcctcagccaacactcaaggggaaacctgtagtgacagtgtgccctggtcatccttaaaataacctgcatctcccctgtcctggtgtgggagtaagctgacagtttctctgcaggtcctgtcaactttagcatgctatgtctttaccatttttgctctcttgcagttttttgctttgtcttatgcttctatggataatgctatataatcattatctttttatctttctgttattattgttttaaaggagagcatcctaagttaataggaaccaaaaaataatgatgggcagaagggggggaatagccacaggggacaaaccttaaggcattataagtgaccttatttctgcttttctgagctaagaatggtgctgatggtaaagtttgagacttttgccacacacaaatttgtgaaaattaaacgagatgtggaaggagaacctcagtgattttattccctagtgaggcctctgagggcctccacactgcctggcagaacataccactgaactagtatgtgctagaggagggcacaaacatccgctccttccctaggcctgctggctctggttttctatgcagatgattcattggattgggggtgagtgttttgtttttctgggggcagtgtgagctttgagggttggaatattgggaggcattccttagtttcctcaactagcctggaaagttaggagtctagggtaattaccccccaatgagtctagcctactattcactgctttgtgtgcatttttttctccctctttaaaaaaccctttaaaagaaaaaaaaaagtagatagtgctaaatattttagctcatgaaacttggttaggatggctgggggtacaagtccccaaactacctcttgttacagtagccagggagtggaatttcgtcaaccggtacttttaaggttaggatgggacgggaaaagtgaagcaggatattagctccttataccttctcccttccatttctgagatctcacattccatctatcacagggttttcaaagagatgctgagggtaacaaggaactcacttggcagtcagagcatcatgctttgaggtttggggtgctcaggctgggagggtagaatgccattccagaggacaagccacaaaaatgccttaatttgagctcgtatttacccctgctgataagtgacttgagagttcccggttttttcctcttgtccttccctcccttctgtccttccatgtgtggggaaagggtgttttggtagagcttggtttccaaagcgcctggctttctcacttcacattctcaagtggcagtttcattatttagaatgcaaggtggacatcttttggatatctttttctatatattttctaaagctttacatatgagagggtatagggaggtgtttataaaacacttgagaacttttttccttaatatcagaaagcaaaaaaataaaaccacaattgagatttgcctttcaaaccctcaggtttgcctctaaccaggtgtccctggtcaccatcagagtactggaatacgggaaccgaggagaccttggtccttttgtttttgttctggactcttgggagtggaaatgagaatgagtttattcctactggagcttagttccaatgcatttggctccagaaagaccccagtgccttttgacaatggccagggttttacctacttcctgccagtctttcccaaaggaaactcattccaaatacttcttttttcccctggagtccgagaaggaaaatggaattctggttcatactgtggtcccttgtaacctcaggtctttaatgtgatcactttcaaatttaaaagatccaggtggaaatatttttactatagtaataattctacaaaatacctgaattcttaacactgttatatttcagtataagtggtggctttttcttttcatgtctttgatctggttttattcctgtaattcagccacctgattttgtgaggggggggaataatatgtggtttttgtacaaacatgtttctcagtgtgttgttattttggaaaaaatgaggggagggagtttggcaagaatggagaaaatgaatgaagaaggcctaatctctctctttttcagtgaataaatggaacaccatttctggaaaaaaaaaaaaaaaaaaaaaaaaaacaactaaaaacaagaaagaagcaaagaaaaataaagaaaaccacaaaaataaagaaaaagaaagataaagacaacagaaaaaaaaaactaatgataataacccacagaatcaggaggggggggcggcactaaaatttatataaactgcaggaggaatttagttgactcacacatcttatagttgtaaaagaggagtcaactatttattgaatttgatttaatatcaaggaggtgcgtcggcgtcttaaaaacaatgaaggaatcagagaaacaagcgcaggtcataacattgatggaagcaaccccaatgtgggggggggagaaaaagagaaaacaaccaagaaagaaagagccgaggaaaaaaaaaaatgtgaggtgttggaaatcacaacccatcatcatcgcggaaagaggttaggtcgtattttaaaataacgcaggcccagatcaaaagagaggacgatagcgaagaagcagaggatagagaccgacgcgcaatacaatcgtccgacgaccgtggaacaagcacggacggacaacaaccaacgacgagccaatcggtgagaaa

SEQ ID NO: 132540 - DNA, 5559 bp, Homo sapiens
gctgggcggggccgggaagcggcagtggcggctacgcgcgcgggggtgcgcgcgggaacgaccgggaaacaccgcgagggccggggtgggccaggctgtggggacgacgggctgcgacgatggccgcagcggcgggcggcggcgggccggggacagcggtaggcgccacgggctcggggattgcggcggcagccgcaggcctagctgtttatcgacggaaggatgggggcccggccaccaagttttgggagagcccggagacggtgtcccagctggattcggtgcgggtctggctgggcaagcactacaagaagtatgttcatgcggatgctcctaccaataaaacactggctgggctggtggtgcagcttcttcagttccaggaagatgcctttgggaagcatgtcaccaacccggccttcaccaaactccctgcaaagtgtttcatggatttcaaagctggaggcgccttatgtcacattcttggggctgcttacaagtataaaaatgaacagggatggcggaggtttgacctacagaacccatctcgaatggatcgtaatgtggaaatgtttatgaacattgaaaaaacattggtgcagaacaattgtttgaccagacccaacatctacctcattccagacattgatctgaagttggctaacaaattgaaagatatcatcaaacgacatcagggaacatttacggatgagaagtcaaaagcttcccaccacatttacccatattcttcctcacaagacgatgaagaatggttgagaccggtgatgagaaaagagaagcaagtgttagtgcattggggcttttacccagacagctatgatacttgggtccatagtaatgatgttgatgctgaaattgaagatccaccaattccagaaaaaccatggaaggttcatgtgaaatggattttggacactgatattttcaatgaatggatgaatgaggaggattatgaggtggatgaaaataggaagcctgtgagttttcgtcagcggatttcaaccaagaatgaagagccagtcagaagtccagaaagaagagatagaaaagcatcagctaatgctcgaaagaggaaacattcgccttcgcctccccctccgacaccaacagaatcacggaagaagagtgggaagaaaggccaagctagcctttatgggaagcgcagaagtcagaaagaggaagatgagcaagaagatctaaccaaggatatggaagacccaacacctgtacccaatatagaagaagtagtacttcccaaaaatgtgaacctaaagaaagatagtgaaaatacacctgttaaaggaggaactgtagcggatctagatgagcaggatgaagaaacagtcacagcaggaggaaaggaagatgaagatcctgccaaaggtgatcagagtcgatcagttgaccttggggaagataatgtgacagagcagaccaatcacattattattcctagttatgcatcatggtttgattataactgtattcatgtgattgaacggcgtgctcttcctgagttcttcaatggaaaaaacaaatccaagactccagaaatatacttggcatatcgaaattttatgattgacacgtatcgtctaaacccccaagagtatttaactagcactgcttgtcggaggaacttgactggagatgtgtgtgctgtgatgagggtccatgcctttttagagcagtggggactcgttaattaccaagttgacccggaaagtagacccatggcaatgggacctcctcctactcctcattttaatgtattagctgataccccctctgggcttgtgcctctgcatcttcgatcacctcaggttcctgctgctcaacagatgctaaattttcctgagaaaaacaaggaaaaaccagttgatttgcagaactttggtctccgtactgacatttactccaagaaaacattagcaaagagtaaaggtgctagtgctggaagagaatggactgaacaggagacccttctactcctggaggccctggagatgtacaaggatgattggaacaaagtgtcggaacatgttggaagtcgtactcaggatgaatgcatcctccactttttgagacttcccattgaggacccataccttgagaattcagatgcttcccttgggcctttggcctaccagcctgtccccttcagtcagtcaggaaatccagttatgagtactgttgcttttttggcatctgtggtggaccctcgcgtggcatctgctgcagcaaaagcggctttggaggagttttctcgggtccgggaggaggtaccactggaattggttgaagctcatgtcaagaaagtacaagaagcagcacgagcctctgggaaagtggatcccacctacggtctggagagcagctgcattgcaggcacagggcccgatgagccagagaagcttgaaggagctgaagaggaaaaaatggaagccgaccctgatggtcagcagcctgaaaaggcagaaaataaagtggaaaatgaaacggatgaaggtgataaagcacaagatggagaaaatgaaaaaaatagtgaaaaggaacaggatagtgaagtgagtgaggataccaaatcagaagaaaaggagactgaagagaacaaagaactcactgatacatgtaaagaaagagaaagtgatactgggaagaagaaagtagaacatgaaatttccgaaggaaatgttgccacagccgcagcagctgctcttgcctcagcggctaccaaagccaagcacctggctgcagtggaagaaagaaagatcaagtccctggtagctctcttggttgagacacaaatgaagaaactagagatcaaacttcgacattttgaagagctggaaactatcatggacagagagaaagaagctctagaacaacagaggcagcagttgcttactgaacgccaaaacttccacatggaacagctgaagtatgctgaattacgagcacgacagcaaatggaacagcagcagcatggccagaaccctcaacaggcacaccagcactcaggaggacctggcctggccccacttggagcagcagggcaccctggcatgatgcctcatcaacagccccctccctaccctctgatgcaccaccagatgccaccacctcatccaccccagccaggtcagataccaggcccaggttccatgatgcccgggcagcacatgccaggccgcatgattcccactgttgcagccaacatccacccctctgggagtggccctacccctcctggcatgccaccaatgccaggaaacatcttaggaccccgggtacccctgacagcacctaacggcatgtatccccctccaccacagcagcagccaccgccaccaccacctgcagatggggtccctccgcctcctgctcctggcccgccagcctcagctgctccttagcctggaagatgcagggaacctccacgcccaccaccatgagctggagtggggatgacaagacttgtgttcctcaactttcttgggtttctttcaggatttttcttctcacagctccaagcacgtgtcccgtgcctccccactcctcttaccacccctctctctgacactttttgtgttgggtcctcagccaacactcaaggggaaacctgtagtgacagtgtgccctggtcatccttaaaataacctgcatctcccctgtcctggtgtgggagtaagctgacagtttctctgcaggtcctgtcaactttagcatgctatgtctttaccatttttgctctcttgcagttttttgctttgtcttatgcttctatggataatgctatataatcattatctttttatctttctgttattattgttttaaaggagagcatcctaagttaataggaaccaaaaaataatgatgggcagaagggggggaatagccacaggggacaaaccttaaggcattataagtgaccttatttctgcttttctgagctaagaatggtgctgatggtaaagtttgagacttttgccacacacaaatttgtgaaaattaaacgagatgtggaaggagaacctcagtgattttattccctagtgaggcctctgagggcctccacactgcctggcagaacataccactgaactagtatgtgctagaggagggcacaaacatccgctccttccctaggcctgctggctctggttttctatgcagatgattcattggattgggggtgagtgttttgtttttctgggggcagtgtgagctttgagggttggaatattgggaggcattccttagtttcctcaactagcctggaaagttaggagtctagggtaattaccccccaatgagtctagcctactattcactgctttgtgtgcatttttttctccctctttaaaaaaccctttaaaagaaaaaaaaaagtagatagtgctaaatattttagctcatgaaacttggttaggatggctgggggtacaagtccccaaactacctcttgttacagtagccagggagtggaatttcgtcaaccggtacttttaaggttaggatgggacgggaaaagtgaagcaggatattagctccttataccttctcccttccatttctgagatctcacattccatctatcacagggttttcaaagagatgctgagggtaacaaggaactcacttggcagtcagagcatcatgctttgaggtttggggtgctcaggctgggagggtagaatgccattccagaggacaagccacaaaaatgccttaatttgagctcgtatttacccctgctgataagtgacttgagagttcccggttttttcctcttgtccttccctcccttctgtccttccatgtgtggggaaagggtgttttggtagagcttggtttccaaagcgcctggctttctcacttcacattctcaagtggcagtttcattatttagaatgcaaggtggacatcttttggatatctttttctatatattttctaaagctttacatatgagagggtatagggaggtgtttataaaacacttgagaacttttttccttaatatcagaaagcaaaaaaataaaaccacaattgagatttgcctttcaaaccctcaggtttgcctctaaccaggtgtccctggtcaccatcagagtactggaatacgggaaccgaggagaccttggtccttttgtttttgttctggactcttgggagtggaaatgagaatgagtttattcctactggagcttagttccaatgcatttggctccagaaagaccccagtgccttttgacaatggccagggttttacctacttcctgccagtctttcccaaaggaaactcattccaaatacttcttttttcccctggagtccgagaaggaaaatggaattctggttcatactgtggtcccttgtaacctcaggtctttaatgtgatcactttcaaatttaaaagatccaggtggaaatatttttactatagtaataattctacaaaatacctgaattcttaacactgttatatttcagtataagtgttcctgtcgggatcctcagagctaccctcag

SEQ ID NO: 132541 - DNA, 5719 bp, Homo sapiens
gctgggcggggccgggaagcggcagtggcggctacgcgcgcgggggtgcgcgcgggaacgaccgggaaacaccgcgagggccggggtgggccaggctgtggggacgacgggctgcgacgatggccgcagcggcgggcggcggcgggccggggacagcggtaggcgccacgggctcggggattgcggcggcagccgcaggcctagctgtttatcgacggaaggatgggggcccggccaccaagttttgggagagcccggagacggtgtcccagctggattcggtgcgggtctggctgggcaagcactacaagaagtatgttcatgcggatgctcctaccaataaaacactggctgggctggtggtgcagcttcttcagttccaggaagatgcctttgggaagcatgtcaccaacccggccttcaccaaactccctgcaaagtgtttcatggatttcaaagctggaggcgccttatgtcacattcttggggctgcttacaagtataaaaatgaacagggatggcggaggtttgacctacagaacccatctcgaatggatcgtaatgtggaaatgtttatgaacattgaaaaaacattggtgcagaacaattgtttgaccagacccaacatctacctcattccagacattgatctgaagttggctaacaaattgaaagatatcatcaaacgacatcagggaacatttacggatgagaagtcaaaagcttcccaccacatttacccatattcttcctcacaagacgatgaagaatggttgagaccggtgatgagaaaagagaagcaagtgttagtgcattggggcttttacccagacagctatgatacttgggtccatagtaatgatgttgatgctgaaattgaagatccaccaattccagaaaaaccatggaaggttcatgtgaaatggattttggacactgatattttcaatgaatggatgaatgaggaggattatgaggtggatgaaaataggaagcctgtgagttttcgtcagcggatttcaaccaagaatgaagagccagtcagaagtccagaaagaagagatagaaaagcatcagctaatgctcgaaagaggaaacattcgccttcgcctccccctccgacaccaacagaatcacggaagaagagtgggaagaaaggccaagctagcctttatgggaagcgcagaagtcagaaagaggaagatgagcaagaagatctaaccaaggatatggaagacccaacacctgtacccaatatagaagaagtagtacttcccaaaaatgtgaacctaaagaaagatagtgaaaatacacctgttaaaggaggaactgtagcggatctagatgagcaggatgaagaaacagtcacagcaggaggaaaggaagatgaagatcctgccaaaggtgatcagagtcgatcagttgaccttggggaagataatgtgacagagcagaccaatcacattattattcctagttatgcatcatggtttgattataactgtattcatgtgattgaacggcgtgctcttcctgagttcttcaatggaaaaaacaaatccaagactccagaaatatacttggcatatcgaaattttatgattgacacgtatcgtctaaacccccaagagtatttaactagcactgcttgtcggaggaacttgactggagatgtgtgtgctgtgatgagggtccatgcctttttagagcagtggggactcgttaattaccaagttgacccggaaagtagacccatggcaatgggacctcctcctactcctcattttaatgtattagctgataccccctctgggcttgtgcctctgcatcttcgatcacctcaggttcctgctgctcaacagatgctaaattttcctgagaaaaacaaggaaaaaccagttgatttgcagaactttggtctccgtactgacatttactccaagaaaacattagcaaagagtaaaggtgctagtgctggaagagaatggactgaacaggagacccttctactcctggaggccctggagatgtacaaggatgattggaacaaagtgtcggaacatgttggaagtcgtactcaggatgaatgcatcctccactttttgagacttcccattgaggacccataccttgagaattcagatgcttcccttgggcctttggcctaccagcctgtccccttcagtcagtcaggaaatccagttatgagtactgttgcttttttggcatctgtggtggaccctcgcgtggcatctgctgcagcaaaagcggctttggaggagttttctcgggtccgggaggaggtaccactggaattggttgaagctcatgtcaagaaagtacaagaagcagcacgagcctctgggaaagtggatcccacctacggtctggagagcagctgcattgcaggcacagggcccgatgagccagagaagcttgaaggagctgaagaggaaaaaatggaagccgaccctgatggtcagcagcctgaaaaggcagaaaataaagtggaaaatgaaacggatgaaggtgataaagcacaagatggagaaaatgaaaaaaatagtgaaaaggaacaggatagtgaagtgagtgaggataccaaatcagaagaaaaggagactgaagagaacaaagaactcactgatacatgtaaagaaagagaaagtgatactgggaagaagaaagtagaacatgaaatttccgaaggaaatgttgccacagccgcagcagctgctcttgcctcagcggctaccaaagccaagcacctggctgcagtggaagaaagaaagatcaagtccctggtagctctcttggttgagacacaaatgaagaaactagagatcaaacttcgacattttgaagagctggaaactatcatggacagagagaaagaagctgccaaaacttccacatggaacagctgaagtatgctgaattacgagcacgacagcaaatggaacagcagcagcatggccagaaccctcaacaggcacaccagcactcaggaggacctggcctggccccacttggagcagcagggcaccctggcatgatgcctcatcaacagccccctccctaccctctgatgcaccaccagatgccaccacctcatccaccccagccaggtcagataccaggcccaggttccatgatgcccgggcagcacatgccaggccgcatgattcccactgttgcagccaacatccacccctctgggagtggccctacccctcctggcatgccaccaatgccaggaaacatcttaggaccccgggtacccctgacagcacctaacggcatgtatccccctccaccacagcagcagccaccgccaccaccacctgcagatggggtccctccgcctcctgctcctggcccgccagcctcagctgctccttagcctggaagatgcagggaacctccacgcccaccaccatgagctggagtggggatgacaagacttgtgttcctcaactttcttgggtttctttcaggatttttcttctcacagctccaagcacgtgtcccgtgcctccccactcctcttaccacccctctctctgacactttttgtgttgggtcctcagccaacactcaaggggaaacctgtagtgacagtgtgccctggtcatccttaaaataacctgcatctcccctgtcctggtgtgggagtaagctgacagtttctctgcaggtcctgtcaactttagcatgctatgtctttaccatttttgctctcttgcagttttttgctttgtcttatgcttctatggataatgctatataatcattatctttttatctttctgttattattgttttaaaggagagcatcctaagttaataggaaccaaaaaataatgatgggcagaagggggggaatagccacaggggacaaaccttaaggcattataagtgaccttatttctgcttttctgagctaagaatggtgctgatggtaaagtttgagacttttgccacacacaaatttgtgaaaattaaacgagatgtggaaggagaacctcagtgattttattccctagtgaggcctctgagggcctccacactgcctggcagaacataccactgaactagtatgtgctagaggagggcacaaacatccgctccttccctaggcctgctggctctggttttctatgcagatgattcattggattgggggtgagtgttttgtttttctgggggcagtgtgagctttgagggttggaatattgggaggcattccttagtttcctcaactagcctggaaagttaggagtctagggtaattaccccccaatgagtctagcctactattcactgctttgtgtgcatttttttctccctctttaaaaaaccctttaaaagaaaaaaaaaagtagatagtgctaaatattttagctcatgaaacttggttaggatggctgggggtacaagtccccaaactacctcttgttacagtagccagggagtggaatttcgtcaaccggtacttttaaggttaggatgggacgggaaaagtgaagcaggatattagctccttataccttctcccttccatttctgagatctcacattccatctatcacagggttttcaaagagatgctgagggtaacaaggaactcacttggcagtcagagcatcatgctttgaggtttggggtgctcaggctgggagggtagaatgccattccagaggacaagccacaaaaatgccttaatttgagctcgtatttacccctgctgataagtgacttgagagttcccggttttttcctcttgtccttccctcccttctgtccttccatgtgtggggaaagggtgttttggtagagcttggtttccaaagcgcctggctttctcacttcacattctcaagtggcagtttcattatttagaatgcaaggtggacatcttttggatatctttttctatatattttctaaagctttacatatgagagggtatagggaggtgtttataaaacacttgagaacttttttccttaatatcagaaagcaaaaaaataaaaccacaattgagatttgcctttcaaaccctcaggtttgcctctaaccaggtgtccctggtcaccatcagagtactggaatacgggaaccgaggagaccttggtccttttgtttttgttctggactcttgggagtggaaatgagaatgagtttattcctactggagcttagttccaatgcatttggctccagaaagaccccagtgccttttgacaatggccagggttttacctacttcctgccagtctttcccaaaggaaactcattccaaatacttcttttttcccctggagtccgagaaggaaaatggaattctggttcatactgtggtcccttgtaacctcaggtctttaatgtgatcactttcaaatttaaaagatccaggtggaaatatttttactatagtaataattctacaaaatacctgaattcttaacactgttatatttcagtataagtggtggctttttcttttcatgtctttgatctggttttattcctgtaattcagccacctgattttgtgaggggggggaataatatgtggtttttgtacaaacatgtttctcagtgtgttgttattttggaaaaaatgaggggagggagtttggcaagaatggagaaaatgaatgaagaaggcctaatctctctctttttcagtgaataaatggaacaccatttctgga

SEQ ID NO: 132542 - DNA, 4014 bp, Homo sapiens
cgaatttgcgtcaggaccgctacggacctccatcctactcctcattttaatgtattagctgataccccctctgggcttgtgcctctgcatcttcgatcacctcaggttcctgctgtctcaacagatgctaaatttcctgagaaaacaaaggaaaaaccagttgatttgcagaactttggtctccgtactgacatttactccaagaaaacattagccaaagagtaaggtgctagtgctggaagagaatggactgaacaggagacccttctactcctggaggccctggagatgtcaaaggatgattggaacaaagtgtcggaacatgttggaagtcgtactcaggatgaatgcatcctccactttttgagacttcccattgaggacccataccttgagaattcagatgcttcccttgggcctttggcctaccagcctgtccccttcagtcagtcaggaaatccagttatgagtactgttgcttttttggcatctgtggtggaccctcgcgtggcatctgctgcagcaaaagcggctttggaggagttttctcgggtccgggaggaggtaccactggaattggttgaagctcatgtcaagaaagtacaagaagcagcacgagcctctgggaaagtggatcccacctacggtctggagagcagctgcattgcaggcacagggcccgatgagccagagaagcttgaaggagctgaagaggaaaaaatggaagccgaccctgatggtcagcagcctgaaaaggcagaaaataaagtggaaaatgaaacggatgaaggtgataaagcacaagatggagaaaatgaaaaaaatagtgaaaaggaacaggatagtgaagtgagtgaggataccaaatcagaagaaaaggagactgaagagaacaaagaactcactgatacatgtaaagaaagagaaagtgatactgggaagaagaaagtagaacatgaaatttccgaaggaaatgttgccacagccgcagcagctgctcttgcctcagcggctaccaaagccaagcacctggctgcagtggaagaaagaaagatcaagtccctggtagctctcttggttgagacacaaatgaagaaactagagatcaaacttcgacattttgaagagctggaaactatcatggacagagagaaagaagctctagaacaacagaggcagcagttgcttactgaacgccaaaacttccacatggaacagctgaagtatgctgaattacgagcacgacagcaaatggaacagcagcagcatggccagaaccctcaacaggcacaccagcactcaggaggacctggcctggccccacttggagcagcagggcaccctggcatgatgcctcatcaacagccccctccctaccctctgatgcaccaccagatgccaccacctcatccaccccagccaggtcagataccaggcccaggttccatgatgcccgggcagcacatgccaggccgcatgattcccactgttgcagccaacatccacccctctgggagtggccctacccctcctggcatgccaccaatgccaggaaacatcttaggaccccgggtacccctgacagcacctaacggcatgtatccccctccaccacagcagcagccaccgccaccaccacctgcagatggggtccctccgcctcctgctcctggcccgccagcctcagctgctccttagcctggaagatgcagggaacctccacgcccaccaccatgagctggagtggggatgacaagacttgtgttcctcaactttcttgggtttctttcaggatttttcttctcacagctccaagcacgtgtcccgtgcctccccactcctcttaccacccctctctctgacactttttgtgttgggtcctcagccaacactcaaggggaaacctgtagtgacagtgtgccctggtcatccttaaaataacctgcatctcccctgtcctggtgtgggagtaagctgacagtttctctgcaggtcctgtcaactttagcatgctatgtctttaccatttttgctctcttgcagttttttgctttgtcttatgcttctatggataatgctatataatcattatctttttatctttctgttattattgttttaaaggagagcatcctaagttaataggaaccaaaaaataatgatgggcagaagggggggaatagccacaggggacaaaccttaaggcattataagtgaccttatttctgcttttctgagctaagaatggtgctgatggtaaagtttgagacttttgccacacacaaatttgtgaaaattaaacgagatgtggaaggagaacctcagtgattttattccctagtgaggcctctgagggcctccacactgcctggcagaacataccactgaactagtatgtgctagaggagggcacaaacatccgctccttccctaggcctgctggctctggttttctatgcagatgattcattggattgggggtgagtgttttgtttttctgggggcagtgtgagctttgagggttggaatattgggaggcattccttagtttcctcaactagcctggaaagttaggagtctagggtaattaccccccaatgagtctagcctactattcactgctttgtgtgcatttttttctccctctttaaaaaaccctttaaaagaaaaaaaaaagtagatagtgctaaatattttagctcatgaaacttggttaggatggctgggggtacaagtccccaaactacctcttgttacagtagccagggagtggaatttcgtcaaccggtacttttaaggttaggatgggacgggaaaagtgaagcaggatattagctccttataccttctcccttccatttctgagatctcacattccatctatcacagggttttcaaagagatgctgagggtaacaaggaactcacttggcagtcagagcatcatgctttgaggtttggggtgctcaggctgggagggtagaatgccattccagaggacaagccacaaaaatgccttaatttgagctcgtatttacccctgctgataagtgacttgagagttcccggttttttcctcttgtccttccctcccttctgtccttccatgtgtggggaaagggtgttttggtagagcttggtttccaaagcgcctggctttctcacttcacattctcaagtggcagtttcattatttagaatgcaaggtggacatcttttggatatctttttctatatattttctaaagctttacatatgagagggtatagggaggtgtttataaaacacttgagaacttttttccttaatatcagaaagcaaaaaaataaaaccacaattgagatttgcctttcaaaccctcaggtttgcctctaaccaggtgtccctggtcaccatcagagtactggaatacgggaaccgaggagaccttggtccttttgtttttgttctggactcttgggagtggaaatgagaatgagtttattcctactggagcttagttccaatgcatttggctccagaaagaccccagtgccttttgacaatggccagggttttacctacttcctgccagtctttcccaaaggaaactcattccaaatacttcttttttcccctggagtccgagaaggaaaatggaattctggttcatactgtggtcccttgtaacctcaggtctttaatgtgatcactttcaaatttaaaagatccaggtggaaatatttttactatagtaataattctacaaaatacctgaattcttaacactgttatatttcagtataagtggtggctttttcttttcatgtctttgatctggttttattcctgtaattcagccacctgattttgtgaggggggggaataatatgtggtttttgtacaaacatgtttctcagtgtgttgttattttggaaaaaatgaggggagggagtttggcaagaatggagaaaatgaatgaagaaggcctaatctctctctttttcagtgaataaatggaacaccatttctgga

SEQ ID NO: 132543 - DNA, 3729 bp, Homo sapiens
ctgtctagaggatccgctcggatgcaagtgtcggaacatgttggaagtcgtactcaggatgaatgcatcctccactttttgagacttcccattgaggacccataccttgagaattcagatgcttcccttgggcctttggcctaccagcctgtccccttcagtcagtcaggaaatccagttatgagtactgttgcttttttggcatctgtggtggaccctcgcgtggcatctgctgcagcaaaagcggctttggaggagttttctcgggtccgggaggaggtaccactggaattggttgaagctcatgtcaagaaagtacaagaagcagcacgagcctctgggaaagtggatcccacctacggtctggagagcagctgcattgcaggcacagggcccgatgagccagagaagcttgaaggagctgaagaggaaaaaatggaagccgaccctgatggtcagcagcctgaaaaggcagaaaataaagtggaaaatgaaacggatgaaggtgataaagcacaagatggagaaaatgaaaaaaatagtgaaaaggaacaggatagtgaagtgagtgaggataccaaatcagaagaaaaggagactgaagagaacaaagaactcactgatacatgtaaagaaagagaaagtgatactgggaagaagaaagtagaacatgaaatttccgaaggaaatgttgccacagccgcagcagctgctcttgcctcagcggctaccaaagccaagcacctggctgcagtggaagaaagaaagatcaagtccctggtagctctcttggttgagacacaaatgaagaaactagagatcaaacttcgacattttgaagagctggaaactatcatggacagagagaaagaagctctagaacaacagaggcagcagttgcttactgaacgccaaaacttccacatggaacagctgaagtatgctgaattacgagcacgacagcaaatggaacagcagcagcatggccagaaccctcaacaggcacaccagcactcaggaggacctggcctggccccacttggagcagcagggcaccctggcatgatgcctcatcaacagccccctccctaccctctgatgcaccaccagatgccaccacctcatccaccccagccaggtcagataccaggcccaggttccatgatgcccgggcagcacatgccaggccgcatgattcccactgttgcagccaacatccacccctctgggagtggccctacccctcctggcatgccaccaatgccaggaaacatcttaggaccccgggtacccctgacagcacctaacggcatgtatccccctccaccacagcagcagccaccgccaccaccacctgcagatggggtccctccgcctcctgctcctggcccgccagcctcagctgctccttagcctggaagatgcagggaacctccacgcccaccaccatgagctggagtggggatgacaagacttgtgttcctcaactttcttgggtttctttcaggatttttcttctcacagctccaagcacgtgtcccgtgcctccccactcctcttaccacccctctctctgacactttttgtgttgggtcctcagccaacactcaaggggaaacctgtagtgacagtgtgccctggtcatccttaaaataacctgcatctcccctgtcctggtgtgggagtaagctgacagtttctctgcaggtcctgtcaactttagcatgctatgtctttaccatttttgctctcttgcagttttttgctttgtcttatgcttctatggataatgctatataatcattatctttttatctttctgttattattgttttaaaggagagcatcctaagttaataggaaccaaaaaataatgatgggcagaagggggggaatagccacaggggacaaaccttaaggcattataagtgaccttatttctgcttttctgagctaagaatggtgctgatggtaaagtttgagacttttgccacacacaaatttgtgaaaattaaacgagatgtggaaggagaacctcagtgattttattccctagtgaggcctctgagggcctccacactgcctggcagaacataccactgaactagtatgtgctagaggagggcacaaacatccgctccttccctaggcctgctggctctggttttctatgcagatgattcattggattgggggtgagtgttttgtttttctgggggcagtgtgagctttgagggttggaatattgggaggcattccttagtttcctcaactagcctggaaagttaggagtctagggtaattaccccccaatgagtctagcctactattcactgctttgtgtgcatttttttctccctctttaaaaaaccctttaaaagaaaaaaaaaagtagatagtgctaaatattttagctcatgaaacttggttaggatggctgggggtacaagtccccaaactacctcttgttacagtagccagggagtggaatttcgtcaaccggtacttttaaggttaggatgggacgggaaaagtgaagcaggatattagctccttataccttctcccttccatttctgagatctcacattccatctatcacagggttttcaaagagatgctgagggtaacaaggaactcacttggcagtcagagcatcatgctttgaggtttggggtgctcaggctgggagggtagaatgccattccagaggacaagccacaaaaatgccttaatttgagctcgtatttacccctgctgataagtgacttgagagttcccggttttttcctcttgtccttccctcccttctgtccttccatgtgtggggaaagggtgttttggtagagcttggtttccaaagcgcctggctttctcacttcacattctcaagtggcagtttcattatttagaatgcaaggtggacatcttttggatatctttttctatatattttctaaagctttacatatgagagggtatagggaggtgtttataaaacacttgagaacttttttccttaatatcagaaagcaaaaaaataaaaccacaattgagatttgcctttcaaaccctcaggtttgcctctaaccaggtgtccctggtcaccatcagagtactggaatacgggaaccgaggagaccttggtccttttgtttttgttctggactcttgggagtggaaatgagaatgagtttattcctactggagcttagttccaatgcatttggctccagaaagaccccagtgccttttgacaatggccagggttttacctacttcctgccagtctttcccaaaggaaactcattccaaatacttcttttttcccctggagtccgagaaggaaaatggaattctggttcatactgtggtcccttgtaacctcaggtctttaatgtgatcactttcaaatttaaaagatccaggtggaaatatttttactatagtaataattctacaaaatacctgaattcttaacactgttatatttcagtataagtggtggctttttcttttcatgtctttgatctggttttattcctgtaattcagccacctgattttgtgaggggggggaataatatgtggtttttgtacaaacatgtttctcagtgtgttgttattttggaaaaaatgaggggagggagtttggcaagaatggagaaaatgaatgaagaaggcctaatctctctctttttcagtgaataaatggaacaccatttctgga

SEQ ID NO: 132544 - DNA, 3232 bp, Homo sapiens
  misc_feature (21)..(21): n is a, c, g, or t
gggctaggtacgaggctgggntgttagagaaaatgaaaaaaatagtgaaaaggaacaggatagtgaagtgagtgaggataccaaatcagaagaaaaggagactgaagagaacaaagaactcactgatacatgtaaagaaagagaaagtgatactgggaagaagaaagtagaacatgaaatttccgaaggaaatgttgccacagccgcagcagctgctcttgcctcagcggctaccaaagccaagcacctggctgcagtggaagaaagaaagatcaagtccctggtagctctcttggttgagacacaaatgaagaaactagagatcaaacttcgacattttgaagagctggaaactatcatggacagagagaaagaagctctagaacaacagaggcagcagttgcttactgaacgccaaaacttccacatggaacagctgaagtatgctgaattacgagcacgacagcaaatggaacagcagcagcatggccagaaccctcaacaggcacaccagcactcaggaggacctggcctggccccacttggagcagcagggcaccctggcatgatgcctcatcaacagccccctccctaccctctgatgcaccaccagatgccaccacctcatccaccccagccaggtcagataccaggcccaggttccatgatgcccgggcagcacatgccaggccgcatgattcccactgttgcagccaacatccacccctctgggagtggccctacccctcctggcatgccaccaatgccaggaaacatcttaggaccccgggtacccctgacagcacctaacggcatgtatccccctccaccacagcagcagccaccgccaccaccacctgcagatggggtccctccgcctcctgctcctggcccgccagcctcagctgctccttagcctggaagatgcagggaacctccacgcccaccaccatgagctggagtggggatgacaagacttgtgttcctcaactttcttgggtttctttcaggatttttcttctcacagctccaagcacgtgtcccgtgcctccccactcctcttaccacccctctctctgacactttttgtgttgggtcctcagccaacactcaaggggaaacctgtagtgacagtgtgccctggtcatccttaaaataacctgcatctcccctgtcctggtgtgggagtaagctgacagtttctctgcaggtcctgtcaactttagcatgctatgtctttaccatttttgctctcttgcagttttttgctttgtcttatgcttctatggataatgctatataatcattatctttttatctttctgttattattgttttaaaggagagcatcctaagttaataggaaccaaaaaataatgatgggcagaagggggggaatagccacaggggacaaaccttaaggcattataagtgaccttatttctgcttttctgagctaagaatggtgctgatggtaaagtttgagacttttgccacacacaaatttgtgaaaattaaacgagatgtggaaggagaacctcagtgattttattccctagtgaggcctctgagggcctccacactgcctggcagaacataccactgaactagtatgtgctagaggagggcacaaacatccgctccttccctaggcctgctggctctggttttctatgcagatgattcattggattgggggtgagtgttttgtttttctgggggcagtgtgagctttgagggttggaatattgggaggcattccttagtttcctcaactagcctggaaagttaggagtctagggtaattaccccccaatgagtctagcctactattcactgctttgtgtgcatttttttctccctctttaaaaaaccctttaaaagaaaaaaaaaagtagatagtgctaaatattttagctcatgaaacttggttaggatggctgggggtacaagtccccaaactacctcttgttacagtagccagggagtggaatttcgtcaaccggtacttttaaggttaggatgggacgggaaaagtgaagcaggatattagctccttataccttctcccttccatttctgagatctcacattccatctatcacagggttttcaaagagatgctgagggtaacaaggaactcacttggcagtcagagcatcatgctttgaggtttggggtgctcaggctgggagggtagaatgccattccagaggacaagccacaaaaatgccttaatttgagctcgtatttacccctgctgataagtgacttgagagttcccggttttttcctcttgtccttccctcccttctgtccttccatgtgtggggaaagggtgttttggtagagcttggtttccaaagcgcctggctttctcacttcacattctcaagtggcagtttcattatttagaatgcaaggtggacatcttttggatatctttttctatatattttctaaagctttacatatgagagggtatagggaggtgtttataaaacacttgagaacttttttccttaatatcagaaagcaaaaaaataaaaccacaattgagatttgcctttcaaaccctcaggtttgcctctaaccaggtgtccctggtcaccatcagagtactggaatacgggaaccgaggagaccttggtccttttgtttttgttctggactcttgggagtggaaatgagaatgagtttattcctactggagcttagttccaatgcatttggctccagaaagaccccagtgccttttgacaatggccagggttttacctacttcctgccagtctttcccaaaggaaactcattccaaatacttcttttttcccctggagtccgagaaggaaaatggaattctggttcatactgtggtcccttgtaacctcaggtctttaatgtgatcactttcaaatttaaaagatccaggtggaaatatttttactatagtaataattctacaaaatacctgaattcttaacactgttatatttcagtataagtggtggctttttcttttcatgtctttgatctggttttattcctgtaattcagccacctgattttgtgaggggggggaataatatgtggtttttgtacaaacatgtttctcagtgtgttgttattttggaaaaaatgaggggagggagtttggcaagaatggagaaaatgaatgaagaaggcctaatctctctctttttcagtgaataaatggaacaccatttctgga

SEQ ID NO: 132545 - DNA, 3041 bp, Homo sapiens
cgggtgcctctacctctccggtgcctcttgcctcagcggctacccaacccaagcacctggctgcagtggaagaaagaaagatcaagtccctggtagctctcttggttgagacacaaatgaagaaactagagatcaaacttcgacattttgaagagctggaaactatcatggacagagagaaagaagctctagaacaacagaggcagcagttgcttactgaacgccaaaacttccacatggaacagctgaagtatgctgaattacgagcacgacagcaaatggaacagcagcagcatggccagaaccctcaacaggcacaccagcactcaggaggacctggcctggccccacttggagcagcagggcaccctggcatgatgcctcatcaacagccccctccctaccctctgatgcaccaccagatgccaccacctcatccaccccagccaggtcagataccaggcccaggttccatgatgcccgggcagcacatgccaggccgcatgattcccactgttgcagccaacatccacccctctgggagtggccctacccctcctggcatgccaccaatgccaggaaacatcttaggaccccgggtacccctgacagcacctaacggcatgtatccccctccaccacagcagcagccaccgccaccaccacctgcagatggggtccctccgcctcctgctcctggcccgccagcctcagctgctccttagcctggaagatgcagggaacctccacgcccaccaccatgagctggagtggggatgacaagacttgtgttcctcaactttcttgggtttctttcaggatttttcttctcacagctccaagcacgtgtcccgtgcctccccactcctcttaccacccctctctctgacactttttgtgttgggtcctcagccaacactcaaggggaaacctgtagtgacagtgtgccctggtcatccttaaaataacctgcatctcccctgtcctggtgtgggagtaagctgacagtttctctgcaggtcctgtcaactttagcatgctatgtctttaccatttttgctctcttgcagttttttgctttgtcttatgcttctatggataatgctatataatcattatctttttatctttctgttattattgttttaaaggagagcatcctaagttaataggaaccaaaaaataatgatgggcagaagggggggaatagccacaggggacaaaccttaaggcattataagtgaccttatttctgcttttctgagctaagaatggtgctgatggtaaagtttgagacttttgccacacacaaatttgtgaaaattaaacgagatgtggaaggagaacctcagtgattttattccctagtgaggcctctgagggcctccacactgcctggcagaacataccactgaactagtatgtgctagaggagggcacaaacatccgctccttccctaggcctgctggctctggttttctatgcagatgattcattggattgggggtgagtgttttgtttttctgggggcagtgtgagctttgagggttggaatattgggaggcattccttagtttcctcaactagcctggaaagttaggagtctagggtaattaccccccaatgagtctagcctactattcactgctttgtgtgcatttttttctccctctttaaaaaaccctttaaaagaaaaaaaaaagtagatagtgctaaatattttagctcatgaaacttggttaggatggctgggggtacaagtccccaaactacctcttgttacagtagccagggagtggaatttcgtcaaccggtacttttaaggttaggatgggacgggaaaagtgaagcaggatattagctccttataccttctcccttccatttctgagatctcacattccatctatcacagggttttcaaagagatgctgagggtaacaaggaactcacttggcagtcagagcatcatgctttgaggtttggggtgctcaggctgggagggtagaatgccattccagaggacaagccacaaaaatgccttaatttgagctcgtatttacccctgctgataagtgacttgagagttcccggttttttcctcttgtccttccctcccttctgtccttccatgtgtggggaaagggtgttttggtagagcttggtttccaaagcgcctggctttctcacttcacattctcaagtggcagtttcattatttagaatgcaaggtggacatcttttggatatctttttctatatattttctaaagctttacatatgagagggtatagggaggtgtttataaaacacttgagaacttttttccttaatatcagaaagcaaaaaaataaaaccacaattgagatttgcctttcaaaccctcaggtttgcctctaaccaggtgtccctggtcaccatcagagtactggaatacgggaaccgaggagaccttggtccttttgtttttgttctggactcttgggagtggaaatgagaatgagtttattcctactggagcttagttccaatgcatttggctccagaaagaccccagtgccttttgacaatggccagggttttacctacttcctgccagtctttcccaaaggaaactcattccaaatacttcttttttcccctggagtccgagaaggaaaatggaattctggttcatactgtggtcccttgtaacctcaggtctttaatgtgatcactttcaaatttaaaagatccaggtggaaatatttttactatagtaataattctacaaaatacctgaattcttaacactgttatatttcagtataagtggtggctttttcttttcatgtctttgatctggttttattcctgtaattcagccacctgattttgtgaggggggggaataatatgtggtttttgtacaaacatgtttctcagtgtgttgttattttggaaaaaatgaggggagggagtttggcaagaatggagaaaatgaatgaagaaggcctaatctctctctttttcagtgaataaatggaacaccatttctgga

SEQ ID NO: 132546 - DNA, 2967 bp, Homo sapiens
tagaatcgagctcggtaccatggtagtcttcagctcagcacgggtttctccaagtcttcctgtaccatctgggcattctctctccactcccgggagtggagagagaaagaagctctagaacaacagaggcagcagttgcttactgaacgccaaaacttccacatggaacagctgaagtatgctgaattacgagcacgacagcaaatggaacagcagcagcatggccagaaccctcaacaggcacaccagcactcaggaggacctggcctggccccacttggagcagcagggcaccctggcatgatgcctcatcaacagccccctccctaccctctgatgcaccaccagatgccaccacctcatccaccccagccaggtcagataccaggcccaggttccatgatgcccgggcagcacatgccaggccgcatgattcccactgttgcagccaacatccacccctctgggagtggccctacccctcctggcatgccaccaatgccaggaaacatcttaggaccccgggtacccctgacagcacctaacggcatgtatccccctccaccacagcagcagccaccgccaccaccacctgcagatggggtccctccgcctcctgctcctggcccgccagcctcagctgctccttagcctggaagatgcagggaacctccacgcccaccaccatgagctggagtggggatgacaagacttgtgttcctcaactttcttgggtttctttcaggatttttcttctcacagctccaagcacgtgtcccgtgcctccccactcctcttaccacccctctctctgacactttttgtgttgggtcctcagccaacactcaaggggaaacctgtagtgacagtgtgccctggtcatccttaaaataacctgcatctcccctgtcctggtgtgggagtaagctgacagtttctctgcaggtcctgtcaactttagcatgctatgtctttaccatttttgctctcttgcagttttttgctttgtcttatgcttctatggataatgctatataatcattatctttttatctttctgttattattgttttaaaggagagcatcctaagttaataggaaccaaaaaataatgatgggcagaagggggggaatagccacaggggacaaaccttaaggcattataagtgaccttatttctgcttttctgagctaagaatggtgctgatggtaaagtttgagacttttgccacacacaaatttgtgaaaattaaacgagatgtggaaggagaacctcagtgattttattccctagtgaggcctctgagggcctccacactgcctggcagaacataccactgaactagtatgtgctagaggagggcacaaacatccgctccttccctaggcctgctggctctggttttctatgcagatgattcattggattgggggtgagtgttttgtttttctgggggcagtgtgagctttgagggttggaatattgggaggcattccttagtttcctcaactagcctggaaagttaggagtctagggtaattaccccccaatgagtctagcctactattcactgctttgtgtgcatttttttctccctctttaaaaaaccctttaaaagaaaaaaaaaagtagatagtgctaaatattttagctcatgaaacttggttaggatggctgggggtacaagtccccaaactacctcttgttacagtagccagggagtggaatttcgtcaaccggtacttttaaggttaggatgggacgggaaaagtgaagcaggatattagctccttataccttctcccttccatttctgagatctcacattccatctatcacagggttttcaaagagatgctgagggtaacaaggaactcacttggcagtcagagcatcatgctttgaggtttggggtgctcaggctgggagggtagaatgccattccagaggacaagccacaaaaatgccttaatttgagctcgtatttacccctgctgataagtgacttgagagttcccggttttttcctcttgtccttccctcccttctgtccttccatgtgtggggaaagggtgttttggtagagcttggtttccaaagcgcctggctttctcacttcacattctcaagtggcagtttcattatttagaatgcaaggtggacatcttttggatatctttttctatatattttctaaagctttacatatgagagggtatagggaggtgtttataaaacacttgagaacttttttccttaatatcagaaagcaaaaaaataaaaccacaattgagatttgcctttcaaaccctcaggtttgcctctaaccaggtgtccctggtcaccatcagagtactggaatacgggaaccgaggagaccttggtccttttgtttttgttctggactcttgggagtggaaatgagaatgagtttattcctactggagcttagttccaatgcatttggctccagaaagaccccagtgccttttgacaatggccagggttttacctacttcctgccagtctttcccaaaggaaactcattccaaatacttcttttttcccctggagtccgagaaggaaaatggaattctggttcatactgtggtcccttgtaacctcaggtctttaatgtgatcactttcaaatttaaaagatccaggtggaaatatttttactatagtaataattctacaaaatacctgaattcttaacactgttatatttcagtataagtggtggctttttcttttcatgtctttgatctggttttattcctgtaattcagccacctgattttgtgaggggggggaataatatgtggtttttgtacaaacatgtttctcagtgtgttgttattttggaaaaaatgaggggagggagtttggcaagaatggagaaaatgaatgaagaaggcctaatctctctctttttcagtgaataaatggaacaccatttctgga

SEQ ID NO: 132547 - DNA, 2749 bp, Homo sapiens
cgacttaaagcaagtaacgaaggcacaccagcactcaggaggacctggcctggccccacttggagcagcagggcaccctggcatgatgcctcatcaacagccccctccctaccctctgatgcaccaccagatgccaccacctcatccaccccagccaggtcagataccaggcccaggttccatgatgcccgggcagcacatgccaggccgcatgattcccactgttgcagccaacatccacccctctgggagtggccctacccctcctggcatgccaccaatgccaggaaacatcttaggaccccgggtacccctgacagcacctaacggcatgtatccccctccaccacagcagcagccaccgccaccaccacctgcagatggggtccctccgcctcctgctcctggcccgccagcctcagctgctccttagcctggaagatgcagggaacctccacgcccaccaccatgagctggagtggggatgacaagacttgtgttcctcaactttcttgggtttctttcaggatttttcttctcacagctccaagcacgtgtcccgtgcctccccactcctcttaccacccctctctctgacactttttgtgttgggtcctcagccaacactcaaggggaaacctgtagtgacagtgtgccctggtcatccttaaaataacctgcatctcccctgtcctggtgtgggagtaagctgacagtttctctgcaggtcctgtcaactttagcatgctatgtctttaccatttttgctctcttgcagttttttgctttgtcttatgcttctatggataatgctatataatcattatctttttatctttctgttattattgttttaaaggagagcatcctaagttaataggaaccaaaaaataatgatgggcagaagggggggaatagccacaggggacaaaccttaaggcattataagtgaccttatttctgcttttctgagctaagaatggtgctgatggtaaagtttgagacttttgccacacacaaatttgtgaaaattaaacgagatgtggaaggagaacctcagtgattttattccctagtgaggcctctgagggcctccacactgcctggcagaacataccactgaactagtatgtgctagaggagggcacaaacatccgctccttccctaggcctgctggctctggttttctatgcagatgattcattggattgggggtgagtgttttgtttttctgggggcagtgtgagctttgagggttggaatattgggaggcattccttagtttcctcaactagcctggaaagttaggagtctagggtaattaccccccaatgagtctagcctactattcactgctttgtgtgcatttttttctccctctttaaaaaaccctttaaaagaaaaaaaaaagtagatagtgctaaatattttagctcatgaaacttggttaggatggctgggggtacaagtccccaaactacctcttgttacagtagccagggagtggaatttcgtcaaccggtacttttaaggttaggatgggacgggaaaagtgaagcaggatattagctccttataccttctcccttccatttctgagatctcacattccatctatcacagggttttcaaagagatgctgagggtaacaaggaactcacttggcagtcagagcatcatgctttgaggtttggggtgctcaggctgggagggtagaatgccattccagaggacaagccacaaaaatgccttaatttgagctcgtatttacccctgctgataagtgacttgagagttcccggttttttcctcttgtccttccctcccttctgtccttccatgtgtggggaaagggtgttttggtagagcttggtttccaaagcgcctggctttctcacttcacattctcaagtggcagtttcattatttagaatgcaaggtggacatcttttggatatctttttctatatattttctaaagctttacatatgagagggtatagggaggtgtttataaaacacttgagaacttttttccttaatatcagaaagcaaaaaaataaaaccacaattgagatttgcctttcaaaccctcaggtttgcctctaaccaggtgtccctggtcaccatcagagtactggaatacgggaaccgaggagaccttggtccttttgtttttgttctggactcttgggagtggaaatgagaatgagtttattcctactggagcttagttccaatgcatttggctccagaaagaccccagtgccttttgacaatggccagggttttacctacttcctgccagtctttcccaaaggaaactcattccaaatacttcttttttcccctggagtccgagaaggaaaatggaattctggttcatactgtggtcccttgtaacctcaggtctttaatgtgatcactttcaaatttaaaagatccaggtggaaatatttttactatagtaataattctacaaaatacctgaattcttaacactgttatatttcagtataagtggtggctttttcttttcatgtctttgatctggttttattcctgtaattcagccacctgattttgtgaggggggggaataatatgtggtttttgtacaaacatgtttctcagtgtgttgttattttggaaaaaatgaggggagggagtttggcaagaatggagaaaatgaatgaagaaggcctaatctctctctttttcagtgaataaatggaacaccatttctgga

SEQ ID NO: 132548 - DNA, 4998 bp, Homo sapiens
gctgggcggggccgggaagcggcagtggcggctacgcgcgcgggggtgcgcgcgggaacgaccgggaaacaccgcgagggccggggtgggccaggctgtggggacgacgggctgcgacgatggccgcagcggcgggcggcggcgggccggggacagcggtaggcgccacgggctcggggattgcggcggcagccgcaggcctagctgtttatcgacggaaggatgggggcccggccaccaagttttgggagagcccggagacggtgtcccagctggattcggtgcgggtctggctgggcaagcactacaagaagtatgttcatgcggatgctcctaccaataaaacactggctgggctggtggtgcagcttcttcagttccaggaagatgcctttgggaagcatgtcaccaacccggccttcaccaaactccctgcaaagtgtttcatggatttcaaagctggaggcgccttatgtcacattcttggggctgcttacaagtataaaaatgaacagggatggcggaggtttgacctacagaacccatctcgaatggatcgtaatgtggaaatgtttatgaacattgaaaaaacattggtgcagaacaattgtttgaccagacccaacatctacctcattccagacattgatctgaagttggctaacaaattgaaagatatcatcaaacgacatcagggaacatttacggatgagaagtcaaaagcttcccaccacatttacccatattcttcctcacaagacgatgaagaatggttgagaccggtgatgagaaaagagaagcaagtgttagtgcattggggcttttacccagacagctatgatacttgggtccatagtaatgatgttgatgctgaaattgaagatccaccaattccagaaaaaccatggaaggttcatgtgaaatggattttggacactgatattttcaatgaatggatgaatgaggaggattatgaggtggatgaaaataggaagcctgtgagttttcgtcagcggatttcaaccaagaatgaagagccagtcagaagtccagaaagaagagatagaaaagcatcagctaatgctcgaaagaggaaacattcgccttcgcctccccctccgacaccaacagaatcacggaagaagagtgggaagaaaggccaagctagcctttatgggaagcgcagaagtcagaaagaggaagatgagcaagaagatctaaccaaggatatggaagacccaacacctgtacccaatatagaagaagtagtacttcccaaaaatgtgaacctaaagaaagatagtgaaaatacacctgttaaaggaggaactgtagcggatctagatgagcaggatgaagaaacagtcacagcaggaggaaaggaagatgaagatcctgccaaaggtgatcagagtcgatcagttgaccttggggaagataatgtgacagagcagaccaatcacattattattcctagttatgcatcatggtttgattataactgtattcatgtgattgaacggcgtgctcttcctgagttcttcaatggaaaaaacaaatccaagactccagaaatatacttggcatatcgaaattttatgattgacacgtatcgtctaaacccccaagagtatttaactagcactgcttgtcggaggaacttgactggagatgtgtgtgctgtgatgagggtccatgcctttttagagcagtggggactcgttaattaccaagttgacccggaaagtagacccatggcaatgggacctcctcctactcctcattttaatgtattagctgataccccctctgggcttgtgcctctgcatcttcgatcacctcaggttcctgctgctcaacagatgctaaattttcctgagaaaaacaaggaaaaaccagttgatttgcagaactttggtctccgtactgacatttactccaagaaaacattagcaaagagtaaaggtgctagtgctggaagagaatggactgaacaggagacccttctactcctggaggccctggagatgtacaaggatgattggaacaaagtgtcggaacatgttggaagtcgtactcaggatgaatgcatcctccactttttgagacttcccattgaggacccataccttgagaattcagatgcttcccttgggcctttggcctaccagcctgtccccttcagtcagtcaggaaatccagttatgagtactgttgcttttttggcatctgtggtggaccctcgcgtggcatctgctgcagcaaaagcggctttggaggagttttctcgggtccgggaggaggtaccactggaattggttgaagctcatgtcaagaaagtacaagaagcagcacgagcctctgggaaagtggatcccacctacggtctggagagcagctgcattgcaggcacagggcccgatgagccagagaagcttgaaggagctgaagaggaaaaaatggaagccgaccctgatggtcagcagcctgaaaaggcagaaaataaagtggaaaatgaaacggatgaaggtgataaagcacaagatggagaaaatgaaaaaaatagtgaaaaggaacaggatagtgaagtgagtgaggataccaaatcagaagaaaaggagactgaagagaacaaagaactcactgatacatgtaaagaaagagaaagtgatactgggaagaagaaagtagaacatgaaatttccgaaggaaatgttgccacagccgcagcagctgctcttgcctcagcggctaccaaagccaagcacctggctgcagtggaagaaagaaagatcaagtccctggtagctctcttggttgagacacaaatgaagaaactagagatcaaacttcgacattttgaagagctggaaactatcatggacagagagaaagaagctctagaacaacagaggcagcagttgcttactgaacgccaaaacttccacatggaacagctgaagtatgctgaattacgagcacgacagcaaatggaacagcagcagcatggccagaaccctcaacaggcacaccagcactcaggaggacctggcctggccccacttggagcagcagggcaccctggcatgatgcctcatcaacagccccctccctaccctctgatgcaccaccagatgccaccacctcatccaccccagccaggtcagataccaggcccaggttccatgatgcccgggcagcacatgccaggccgcatgattcccactgttgcagccaacatccacccctctgggagtggccctacccctcctggcatgccaccaatgccaggaaacatcttaggaccccgggtacccctgacagcacctaacggcatgtatccccctccaccacagcagcagccaccgccaccaccacctgcagatggggtccctccgcctcctgctcctggcccgccagcctcagctgctccttagcctggaagatgcagggaacctccacgcccaccaccatgagctggagtggggatgacaagacttgtgttcctcaactttcttgggtttctttcaggatttttcttctcacagctccaagcacgtgtcccgtgcctccccactcctcttaccacccctctctctgacactttttgtgttgggtcctcagccaacactcaaggggaaacctgtagtgacagtgtgccctggtcatccttaaaataacctgcatctcccctgtcctggtgtgggagtaagctgacagtttctctgcaggtcctgtcaactttagcatgctatgtctttaccatttttgctctcttgcagttttttgctttgtcttatgcttctatggataatgctatataatcattatctttttatctttctgttattattgttttaaaggagagcatcctaagttaataggaaccaaaaaataatgatgggcagaagggggggaatagccacaggggacaaaccttaaggcattataagtgaccttatttctgcttttctgagctaagaatggtgctgatggtaaagtttgagacttttgccacacacaaatttgtgaaaattaaacgagatgtggaaggagaacctcagtgattttattccctagtgaggcctctgagggcctccacactgcctggcagaacataccactgaactagtatgtgctagaggagggcacaaacatccgctccttccctaggcctgctggctctggttttctatgcagatgattcattggattgggggtgagtgttttgtttttctgggggcagtgtgagctttgagggttggaatattgggaggcattccttagtttcctcaactagcctggaaagttaggagtctagggtaattaccccccaatgagtctagcctactattcactgctttgtgtgcatttttttctccctctttaaaaaaccctttaaaagaaaaaaaaaagtagatagtgctaaatattttagctcatgaaacttggttaggatggctgggggtacaagtccccaaactacctcttgttacagtagccagggagtggaatttcgtcaaccggtacttttaaggttaggatgggacgggaaaagtgaagcaggatattagctccttataccttctcccttccatttctgagatctcacattccatctatcacagggttttcaaagagatgctgagggtaacaaggaactcacttggcagtcagagcatcatgctttgaggtttggggtgctcaggctgggagggtagaatgccattccagaggacaagccacaaaaatgccttaatttgagctcgtatttacccctgctgataagtgacttgagagttcccggttttttcctcttgtccttccctcccttctgtccttccatgtgtggggaaagggtgttttggtagagcttggtttccaaagcgcctggctttctcacttcacattctcaagtggcagtttcattatttagaatgcaaggtggacatcttttggatatctttttcagtgaataaatggaacaccatttctgga

SEQ ID NO: 132549 - DNA, 1815 bp, Homo sapiens
cccccccctcctctccctctgccacccctatttcacctaattccatactttaatcagcactccctctagtgcaaatctgccctcgagccccagacttctgcacgagatgtggaaggagaacctcagtgattttattccctagtgaggcctctgagggcctccacactgcctggcagaacataccactgaactagtatgtgctagaggagggcacaaacatccgctccttccctaggcctgctggctctggttttctatgcagatgattcattggattgggggtgagtgttttgtttttctgggggcagtgtgagctttgagggttggaatattgggaggcattccttagtttcctcaactagcctggaaagttaggagtctagggtaattaccccccaatgagtctagcctactattcactgctttgtgtgcatttttttctccctctttaaaaaaccctttaaaagaaaaaaaaaagtagatagtgctaaatattttagctcatgaaacttggttaggatggctgggggtacaagtccccaaactacctcttgttacagtagccagggagtggaatttcgtcaaccggtacttttaaggttaggatgggacgggaaaagtgaagcaggatattagctccttataccttctcccttccatttctgagatctcacattccatctatcacagggttttcaaagagatgctgagggtaacaaggaactcacttggcagtcagagcatcatgctttgaggtttggggtgctcaggctgggagggtagaatgccattccagaggacaagccacaaaaatgccttaatttgagctcgtatttacccctgctgataagtgacttgagagttcccggttttttcctcttgtccttccctcccttctgtccttccatgtgtggggaaagggtgttttggtagagcttggtttccaaagcgcctggctttctcacttcacattctcaagtggcagtttcattatttagaatgcaaggtggacatcttttggatatctttttctatatattttctaaagctttacatatgagagggtatagggaggtgtttataaaacacttgagaacttttttccttaatatcagaaagcaaaaaaataaaaccacaattgagatttgcctttcaaaccctcaggtttgcctctaaccaggtgtccctggtcaccatcagagtactggaatacgggaaccgaggagaccttggtccttttgtttttgttctggactcttgggagtggaaatgagaatgagtttattcctactggagcttagttccaatgcatttggctccagaaagaccccagtgccttttgacaatggccagggttttacctacttcctgccagtctttcccaaaggaaactcattccaaatacttcttttttcccctggagtccgagaaggaaaatggaattctggttcatactgtggtcccttgtaacctcaggtctttaatgtgatcactttcaaatttaaaagatccaggtggaaatatttttactatagtaataattctacaaaatacctgaattcttaacactgttatatttcagtataagtggtggctttttcttttcatgtctttgatctggttttattcctgtaattcagccacctgattttgtgaggggggggaataatatgtggtttttgtacaaacatgtttctcagtgtgttgttattttggaaaaaatgaggggagggagtttggcaagaatggagaaaatgaatgaagaaggcctaatctctctctttttcagtgaataaatggaacaccatttctgga

SEQ ID NO: 132550 - DNA, 612 bp, Homo sapiens
ccttccaacatctcatttctactcccttggtccttttgtttttgttctggactcttgggagtggaaatgagaatgagtttattcctactggagcttagttccaatgcatttggctccagaaagaccccagtgccttttgacaatggccagggttttacctacttcctgccagtctttcccaaaggaaactcattccaaatacttcttttttcccctggagtccgagaaggaaaatggaattctggttcatactgtggtcccttgtaacctcaggtctttaatgtgatcactttcaaatttaaaagatccaggtggaaatatttttactatagtaataattctacaaaatacctgaattcttaacactgttatatttcagtataagtggtggctttttcttttcatgtctttgatctggttttattcctgtaattcagccacctgattttgtgaggggggggaataatatgtggtttttgtacaaacatgtttctcagtgtgttgttattttggaaaaaatgaggggagggagtttggcaagaatggagaaaatgaatgaagaaggcctaatctctctctttttcagtgaataaatggaacaccatttctgga

SEQ ID NO: 132551 - DNA, 1860 bp, Homo sapiens
gctgggcggggccgggaagcggcagtggcggctacgcgcgcgggggtgcgcgcgggaacgaccgggaaacaccgcgagggccggggtgggccaggctgtggggacgacgggctgcgacgatggccgcagcggcgggcggcggcgggccggggacagcggtaggcgccacgggctcggggattgcggcggcagccgcaggcctagctgtttatcgacggaaggatgggggcccggccaccaagttttgggagagcccggagacggtgtcccagctggattcggtgcgggtctggctgggcaagcactacaagaagtatgttcatgcggatgctcctaccaataaaacactggctgggctggtggtgcagcttcttcagttccaggaagatgcctttgggaagcatgtcaccaacccggccttcaccaaactccctgcaaagtgtttcatggatttcaaagctggaggcgccttatgtcacattcttggggctgcttacaagtataaaaatgaacagggatggcggaggtttgacctacagaacccatctcgaatggatcgtaatgtggaaatgtttatgaacattgaaaaaacattggtgcagaacaattgtttgaccagacccaacatctacctcattccagacattgatctgaagttggctaacaaattgaaagatatcatcaaacgacatcagggaacatttacggatgagaagtcaaaagcttcccaccacatttacccatattcttcctcacaagacgatgaagaatggttgagaccggtgatgagaaaagagaagcaagtgttagtgcattggggcttttacccagacagctatgatacttgggtccatagtaatgatgttgatgctgaaattgaagatccaccaattccagaaaaaccatggaaggttcatgtgaaatggattttggacactgatattttcaatgaatggatgaatgaggaggattatgaggtggatgaaaataggaagcctgtgagttttcgtcagcggatttcaaccaagaatgaagagccagtcagaagtccagaaagaagagatagaaaagcatcagctaatgctcgaaagaggaaacattcgccttcgcctccccctccgacaccaacagaatcacggaagaagagtgggaagaaaggccaagctagcctttatgggaagcgcagaagtcagaaagaggaagatgagcaagaagatctaaccaaggatatggaagacccaacacctgtacccaatatagaagaagtagtacttcccaaaaatgtgaacctaaagaaagatagtgaaaatacacctgttaaaggaggaactgtagcggatctagatgagcaggatgaagaaacagtcacagcaggaggaaaggaagatgaagatcctgccaaaggtgatcagagtcgatcagttgaccttggggaagataatgtgacagagcagaccaatcacattattattcctagttatgcatcatggtttgattataactgtattcatgtgattgaacggcgtgctcttcctgagttcttcaatggaaaaaacaaatccaagactccagaaatatacttggcatatcgaaattttatgattgacacgtatcgtctaaacccccaagagtatttaactagcactgcttgtcggaggaacttgactggagatgtgtgtgctgtgatgagggtccatgcctttttagagcagtggggactcgttaattaccaagttgacccggaaagtagacccatggcaatgggacctcctcctactcctcattttaatgtattaagccagcagaagcagggttccctttggggagcaggaggccaataaaaagttcagagttcaaaaa

SEQ ID NO: 132552 - DNA, 1790 bp, Homo sapiens
gctgggcggggccgggaagcggcagtggcggctacgcgcgcgggggtgcgcgcgggaacgaccgggaaacaccgcgagggccggggtgggccaggctgtggggacgacgggctgcgacgatggccgcagcggcgggcggcggcgggccggggacagcggtaggcgccacgggctcggggattgcggcggcagccgcaggcctagctgtttatcgacggaaggatgggggcccggccaccaagttttgggagagcccggagacggtgtcccagctggattcggtgcgggtctggctgggcaagcactacaagaagtatgttcatgcggatgctcctaccaataaaacactggctgggctggtggtgcagcttcttcagttccaggaagatgcctttgggaagcatgtcaccaacccggccttcaccaaactccctgcaaagtgtttcatggatttcaaagctggaggcgccttatgtcacattcttggggctgcttacaagtataaaaatgaacagggatggcggaggtttgacctacagaacccatctcgaatggatcgtaatgtggaaatgtttatgaacattgaaaaaacattggtgcagaacaattgtttgaccagacccaacatctacctcattccagacattgatctgaagttggctaacaaattgaaagatatcatcaaacgacatcagggaacatttacggatgagaagtcaaaagcttcccaccacatttacccatattcttcctcacaagacgatgaagaatggttgagaccggtgatgagaaaagagaagcaagtgttagtgcattggggcttttacccagacagctatgatacttgggtccatagtaatgatgttgatgctgaaattgaagatccaccaattccagaaaaaccatggaaggttcatgtgaaatggattttggacactgatattttcaatgaatggatgaatgaggaggattatgaggtggatgaaaataggaagcctgtgagttttcgtcagcggatttcaaccaagaatgaagagccagtcagaagtccagaaagaagagatagaaaagcatcagctaatgctcgaaagaggaaacattcgccttcgcctccccctccgacaccaacagaatcacggaagaagagtgggaagaaaggccaagctagcctttatgggaagcgcagaagtcagaaagaggaagatgagcaagaagatctaaccaaggatatggaagacccaacacctgtacccaatatagaagaagtagtacttcccaaaaatgtgaacctaaagaaagatagtgaaaatacacctgttaaaggaggaactgtagcggatctagatgagcaggatgaagaaacagtcacagcaggaggaaaggaagatgaagatcctgccaaaggtgatcagagtcgatcagttgaccttggggaagataatgtgacagagcagaccaatcacattattattcctagttatgcatcatggtttgattataactgtattcatgtgattgaacggcgtgctcttcctgagttcttcaatggaaaaaacaaatccaagactccagaaatgtgaggccagtgttttagaaaacttgtttatttgcctgtgtgcggtaggggctcttcaagcatccacctgagttccttattgctgattcttggaagtttgcaaatactcctttcagaacagtgttcatatctcatttgcatagcattccatggtacacaggaaattgtatctagtttcgttttttgttttggggggttttttttggtgtttgtt

SEQ ID NO: 132553 - DNA, 1269 bp, Homo sapiens
gatcgaagatttatcccagcaagcacaactagcagctgctgagaaattcaaagttcaaggtgaagctgtctcaaacattcaagaaaacacacagactccaactgtacaagaggagagtgaagaggaagagttcgatgaaacaggtgtagaagttaaggacatagaattggtcatgtcacagcaaatgtgtcgagaggaaaggtaacaattcagttaagcctggtgtgagagagcttctctaagggtcctgtgtaccgaacagtagaagcactgaattggacataacccaatttttggactatgaagcccttctggtttttgaatttttttttgtttttagtttttcccctaaggaaaacaaatacaatataagaaccatttctggaaggtgtttttgttagttttttcttttgagacaggctgttggttctcactgtaaccttgacctcctgggctcaggtgatccccctcccacctcagcctcccgagtagctgagactacttgtgtgcaccactacacccaactgatttttttattttttgtagagatggagttttttatgttgcccaggctggttgcgaactcctgggctcaagcaatctgtctgcctcagcctcccaaagtgatggcattacaggtgtcagccactgcgctcggcaaaatacttgactttcttggaccccaagattttacttagaggaaatttttgtcctccctgctagtgtccctcatgtgctgtaatttctagtttcatactcccctggttgcaaggtaatattcagtgccgaccacagtatttcagatgttatccgacagtgcagatgagcaggggccatgtgttgtcttgatttttctcactgccatttctattgatgcagtgtagactttgaatcatactttgacctttcttgagccttattgcgagctacttcctgctttatgaattctgctgtagcgatacctcaatcattatgcttttggaacatgttagatttaaggtaggatttaattttttaaaaataaacggcgtcttgtttactcaggctatcatgtttgactgtgtgattaacccccaatcttcttgaaataatttccttaacttgctgaatatagattttttttttcatttgcaaagaaattccctaagatgatccttatcattgttgtatacattcaaggatgaacatatgcatgacaggatttccggaaaagtatttcaagaaactcttttcttatgactcttcacctgtattgttcttatgattaaa

SEQ ID NO: 132554 - DNA, 1595 bp, Homo sapiens
  misc_feature (1321)..(1321): n is a, c, g, or t
  misc_feature (1524)..(1524): n is a, c, g, or t
  misc_feature (1526)..(1526): n is a, c, g, or t
  misc_feature (1553)..(1553): n is a, c, g, or t
  misc_feature (1570)..(1570): n is a, c, g, or t
  misc_feature (1586)..(1586): n is a, c, g, or t
gctgggcggggccgggaagcggcagtggcggctacgcgcgcgggggtgcgcgcgggaacgaccgggaaacaccgcgagggccggggtgggccaggctgtggggacgacgggctgcgacgatggccgcagcggcgggcggcggcgggccggggacagcggtaggcgccacgggctcggggattgcggcggcagccgcaggcctagctgtttatcgacggaaggatgggggcccggccaccaagttttgggagagcccggagacggtgtcccagctggattcggtgcgggtctggctgggcaagcactacaagaagtatgttcatgcggatgctcctaccaataaaacactggctgggctggtggtgcagcttcttcagttccaggaagatgcctttgggaagcatgtcaccaacccggccttcaccaaactccctgcaaagtgtttcatggatttcaaagctggaggcgccttatgtcacattcttggggctgcttacaagtataaaaatgaacagggatggcggaggtttgacctacagaacccatctcgaatggatcgtaatgtggaaatgtttatgaacattgaaaaaacattggtgcagaacaattgtttgaccagacccaacatctacctcattccagacattgatctgaagttggctaacaaattgaaagatatcatcaaacgacatcagggaacatttacggatgagaagtcaaaagcttcccaccacatttacccatattcttcctcacaagacgatgaagaatggttgagaccggtgatgagaaaagagaagcaagtgttagtgcattggggcttttacccagacagctatgatacttgggtccatagtaatgatgttgatgctgaaattgaagatccaccaattccagaaaaaccatggaaggttcatgtgaaatggattttggacactgatattttcaatgaatggatgaatgaggaggattatgaggtggatgaaaataggaagcctgtgagttttcgtcagcggatttcaaccaagaatgaagagccagtcagaagtccagaaagaagagatagaaaagcatcagctaatgctcgaaagaggaaacattcgccttcgcctccccctccgacaccaacagaatcacggaagaagagtgggaagaaaggccaagctagcctttatgggaagcgcagaagtcagaaagaggaagatgagcaagaagatctaaccaaggatatggaagacccaacacctgtacccaatatagaagaagtagtacttcccaaaaatgtgaacctaaagaaagatagtgaaaatacacctgttanaggaggaactgtagcggatctagatgagcaggatgaagaaacagtcacagcaggaggaaaggaagatgaagatcctgccaaaggtgatcagagtcgatcagttgaccttggggaagataatgtgacagaccaaaccaatcacatttatttattcccaagttatgcatccaagggtttgattaaaaactgtattcaatgtgaantngaaaggggcgttgcctccttccctgangttccctccaatggggnaaaaaaaccaaaattncaaaggact

SEQ ID NO: 132555 - DNA, 1020 bp, Homo sapiens
  misc_feature (975)..(976): n is a, c, g, or t
gatcgaagatttatcccagcaagcacaactagcagctgctgagaaattcaaagttcaaggtgaagctgtctcaaacattcaagaaaacacacagactccaactgtacaagaggagagtgaagaggaagagttcgatgaaacaggtgtagaagttaaggacatagaattggtcatgtcacagcaaatgtgtcgagaggaaaggtaacaattcagttaagcctggtgtgagagagcttctctaagggtcctgtgtaccgaacagtagaagcactgaattggacataacccaatttttggactatgaagcccttctggtttttgaatttttttttgtttttagtttttcccctaaggaaaacaaatacaatataagaaccatttctggaaggtgtttttgttagttttttcttttgagacaggctgttggttctcactgtaaccttgacctcctgggctcaggtgatccccctcccacctcagcctcccgagtagctgagactacttgtgtgcaccactacacccaactgatttttttattttttgtagagatggagttttttatgttgcccaggctggttgcgaactcctgggctcaagcaatctgtctgcctcagcctcccaaagtgatggcattacaggtgtcagccactgcgctcggcaaaatacttgactttcttggaccccaagattttacttagaggaaatttttgtcctccctgctagtgtccctcatgtgctgtaatttctagtttcatactcccctggttgcaaggtaatattcagtgccgaccacagtatttcagatgttatccgacagtgcagatgagcaggggccatgtgttgtcttgatttttctcactgccatttctattgatgcagtgtagactttgaatcatactttgacctttcttgagccttattgcgagctacttcctgctttatgaattctgctgtagcgatacctcaatcattatnnctattgaacttctaaaactaggggtatcagctcggtcgtatcat

SEQ ID NO: 132556 - DNA, 932 bp, Homo sapiens
  misc_feature (658)..(658): n is a, c, g, or t
  misc_feature (861)..(861): n is a, c, g, or t
  misc_feature (863)..(863): n is a, c, g, or t
  misc_feature (890)..(890): n is a, c, g, or t
  misc_feature (907)..(907): n is a, c, g, or t
  misc_feature (923)..(923): n is a, c, g, or t
cgttctagaggatccctgctgaaagacatcagggaacatttacggatgagaagtcaaaagcttcccaccacatttacccatattcttcctcacaagacgatgaagaatggttgagaccggtgatgagaaaagagaagcaagtgttagtgcattggggcttttacccagacagctatgatacttgggtccatagtaatgatgttgatgctgaaattgaagatccaccaattccagaaaaaccatggaaggttcatgtgaaatggattttggacactgatattttcaatgaatggatgaatgaggaggattatgaggtggatgaaaataggaagcctgtgagttttcgtcagcggatttcaaccaagaatgaagagccagtcagaagtccagaaagaagagatagaaaagcatcagctaatgctcgaaagaggaaacattcgccttcgcctccccctccgacaccaacagaatcacggaagaagagtgggaagaaaggccaagctagcctttatgggaagcgcagaagtcagaaagaggaagatgagcaagaagatctaaccaaggatatggaagacccaacacctgtacccaatatagaagaagtagtacttcccaaaaatgtgaacctaaagaaagatagtgaaaatacacctgttanaggaggaactgtagcggatctagatgagcaggatgaagaaacagtcacagcaggaggaaaggaagatgaagatcctgccaaaggtgatcagagtcgatcagttgaccttggggaagataatgtgacagaccaaaccaatcacatttatttattcccaagttatgcatccaagggtttgattaaaaactgtattcaatgtgaantngaaaggggcgttgcctccttccctgangttccctccaatggggnaaaaaaaccaaaattncaaaggact

SEQ ID NO: 132557 - DNA, 689 bp, Homo sapiens
gtatcgctcgctaaattcataaagcaggaagtagcctcccaaagtgatggcattacaggtgtcagccactgcgctcggcaaaatacttgactttcttggaccccaagattttacttagaggaaatttttgtcctccctgctagtgtccctcatgtgctgtaatttctagtttcatactcccctggttgcaaggtaatattcagtgccgaccacagtatttcagatgttatccgacagtgcagatgagcaggggccatgtgttgtcttgatttttctcactgccatttctattgatgcagtgtagactttgaatcatactttgacctttcttgagccttattgcgagctacttcctgctttatgaattctgctgtagcgatacctcaatcattatgcttttggaacatgttagatttaaggtaggatttaattttttaaaaataaacggcgtcttgtttactcaggctatcatgtttgactgtgtgattaacccccaatcttcttgaaataatttccttaacttgctgaatatagattttttttttcatttgcaaagaaattccctaagatgatccttatcattgttgtatacattcaaggatgaacatatgcatgacaggatttccggaaaagtatttcaagaaactcttttcttatgactcttcacctgtattgttcttatgattaaa

SEQ ID NO: 132558 - DNA, 997 bp, Homo sapiens
gatcgaagatttatcccagcaagcacaactagcagctgctgagaaattcaaagttcaaggtgaagctgtctcaaacattcaagaaaacacacagactccaactgtacaagaggagagtgaagaggaagagttcgatgaaacaggtgtagaagttaaggacatagaattggtcatgtcacagcaaatgtgtcgagaggaaaggtaacaattcagttaagcctggtgtgagagagcttctctaagggtcctgtgtaccgaacagtagaagcactgaattggacataacccaatttttggactatgaagcccttctggtttttgaatttttttttgtttttagtttttcccctaaggaaaacaaatacaatataagaaccatttctggaaggtgtttttgttagttttttcttttgagacaggctgttggttctcactgtaaccttgacctcctgggctcaggtgatccccctcccacctcagcctcccgagtagctgagactacttgtgtgcaccactacacccaactgatttttttattttttgtagagatggagttttttatgttgcccaggctggttgcgaactcctgggctcaagcaatctgtctgcctcagcctcccaaagtgatggcattacaggtgtcagccactgcgctcggcaaaatacttgactttcttggaccccaagattttacttagaggaaatttttgtcctccctgctagtgtccctcatgtgctgtaatttctagtttcatactcccctggttgcaaggtaatattcagtgccgaccacagtatttcagatgttatccgacagtgcagatgagcaggggccatgtgttgtcttgatttttctcactgccatttctattgatgcagtgtagactttgaatcatactttgacctttcttgattcgtacttcctcttttgcttattacagcattttcttctctactcccttttctcttcattgctcttgaaacttctctaactagg

SEQ ID NO: 132559 - DNA, 597 bp, Homo sapiens
gagcacgacagcaaatggaacagcagcagcatggccagaaccctcaacaggcacaccagcactcaggaggacctggcctggccccacttggagcagcagggcaccctggcatgatgcctcatcaacagccccctccctaccctctgatgcaccaccagatgccaccacctcatccaccccagccaggtaagaggaaggccctgctcttggaaaaagcttatggtcactacagaggcacagagcatcattggggccaaccacacagttggtgttttctgatgaagactgctcaaaattttcattgtcatctagaaaattgtaggcatgtgagatttagggttatcgccacatgaagccttccatgttctttttctcttggtatgatgcctttttgttgagtaggtcagcctctgattggacagtaatatctcagagttcattcagaatttatcttggattattgataccgtaaaaaaaattatagacattttcaaagataaatacacacaacacagcaaactcccatgacctggtttcaacaaccatcatctttctgccacttttactttttgttacggaaatcttcaaacacagata

SEQ ID NO: 132560 - DNA, 1118 bp, Homo sapiens
cctggatacctgcgtcctggtgtattacctgtggatatctgtcagaaccactgctgtctgcgcgagggccggggtgggccaggctgtggggacgacgggctgcgacgatggccgcagcggcgggcggcggcgggccggggacagcggtaggcgccacgggctcggggattgcggcggcagccgcaggcctagctgtttatcgacggaaggatgggggcccggccaccaagttttgggagagcccggagacggtgtcccagctggattcggtgcgggtctggctgggcaagcactacaagaagtatgttcatgcggatgctcctaccaataaaacactggctgggctggtggtgcagcttcttcagttccaggaagatgcctttgggaagcatgtcaccaacccggacttcaccaaacatccctgcaaagtgtatcatggatttcaaagctggaggcgccttatgtcacattcttggggctgcttacaagtcataacacaatgagcagggatggcggacgggtcagacctacagaacccatctcgacattgcgactcgtaatgtggcaactgtccctgcacatcgcacaacaccatcgggtcgcacgaaacgaaaagaagtgaccagaccccaacaatctaccattcaattcccaggacccagcatctgaacgttggctaaacacattgtacacgcctattcaacacaacgcacctcagggcaccccatttacgcgaattaccaaagttcacaagcaattcccaacaccactttaaccccaaaaatatcttacacacacaaccacaccatccacaccacacatacagcacaccgtacatcccaaccaaccaaaacgcaccattctatacacacactatagcgggaatggcacccagcaacacgaacctaacagcacctacatcggggctccaaataacaaatgacaaatacaagaacaaaaaaacccacagaaacacacacaccatacgacaacaaacacataatgaagtacccatagcgaacacaggcactagcgcaaccacataccacaccaacctaagaggcaaaacggcgagcatctccctcccttccctcccctctcacgaatcacgctgctcg

SEQ ID NO: 132561 - DNA, 5753 bp, Homo sapiens
gctgggcggggccgggaagcggcagtggcggctacgcgcgcgggggtgcgcgcgggaacgaccgggaaacaccgcgagggccggggtgggccaggctgtggggacgacgggctgcgacgatggccgcagcggcgggcggcggcgggccggggacagcggtaggcgccacgggctcggggattgcggcggcagccgcaggcctagctgtttatcgacggaaggatgggggcccggccaccaagttttgggagagcccggagacggtgtcccagctggattcggtgcgggtctggctgggcaagcactacaagaagtatgttcatgcggatgctcctaccaataaaacactggctgggctggtggtgcagcttcttcagttccaggaagatgcctttgggaagcatgtcaccaacccggccttcaccaaactccctgcaaagtgtttcatggatttcaaagctggaggcgccttatgtcacattcttggggctgcttacaagtataaaaatgaacagggatggcggaggtttgacctacagaacccatctcgaatggatcgtaatgtggaaatgtttatgaacattgaaaaaacattggtgcagaacaattgtttgaccagacccaacatctacctcattccagacattgatctgaagttggctaacaaattgaaagatatcatcaaacgacatcagggaacatttacggatgagaagtcaaaagcttcccaccacatttacccatattcttcctcacaagacgatgaagaatggttgagaccggtgatgagaaaagagaagcaagtgttagtgcattggggcttttacccagacagctatgatacttgggtccatagtaatgatgttgatgctgaaattgaagatccaccaattccagaaaaaccatggaaggttcatgtgaaatggattttggacactgatattttcaatgaatggatgaatgaggaggattatgaggtggatgaaaataggaagcctgtgagttttcgtcagcggatttcaaccaagaatgaagagccagtcagaagtccagaaagaagagatagaaaagcatcagctaatgctcgaaagaggaaacattcgccttcgcctccccctccgacaccaacagaatcacggaagaagagtgggaagaaaggccaagctagcctttatgggaagcgcagaagtcagaaagaggaagatgagcaagaagatctaaccaaggatatggaagacccaacacctgtacccaatatagaagaagtagtacttcccaaaaatgtgaacctaaagaaagatagtgaaaatacacctgttaaaggaggaactgtagcggatctagatgagcaggatgaagaaacagtcacagcaggaggaaaggaagatgaagatcctgccaaaggtgatcagagtcgatcagttgaccttggggaagataatgtgacagagcagaccaatcacattattattcctagttatgcatcatggtttgattataactgtattcatgtgattgaacggcgtgctcttcctgagttcttcaatggaaaaaacaaatccaagactccagaaatatacttggcatatcgaaattttatgattgacacgtatcgtctaaacccccaagagtatttaactagcactgcttgtcggaggaacttgactggagatgtgtgtgctgtgatgagggtccatgcctttttagagcagtggggactcgttaattaccaagttgacccggaaagtagacccatggcaatgggacctcctcctactcctcattttaatgtattagctgataccccctctgggcttgtgcctctgcatcttcgatcacctcaggttcctgctgctcaacagatgctaaattttcctgagaaaaacaaggaaaaaccagttgatttgcagaactttggtctccgtactgacatttactccaagaaaacattagcaaagagtaaaggtgctagtgctggaagagaatggactgaacaggagacccttctactcctggaggccctggagatgtacaaggatgattggaacaaagtgtcggaacatgttggaagtcgtactcaggatgaatgcatcctccactttttgagacttcccattgaggacccataccttgagaattcagatgcttcccttgggcctttggcctaccagcctgtccccttcagtcagtcaggaaatccagttatgagtactgttgcttttttggcatctgtggtggaccctcgcgtggcatctgctgcagcaaaagcggctttggaggagttttctcgggtccgggaggaggtaccactggaattggttgaagctcatgtcaagaaagtacaagaagcagcacgagcctctgggaaagtggatcccacctacggtctggagagcagctgcattgcaggcacagggcccgatgagccagagaagcttgaaggagctgaagaggaaaaaatggaagccgaccctgatggtcagcagcctgaaaaggcagaaaataaagtggaaaatgaaacggatgaaggtgataaagcacaagatggagaaaatgaaaaaaatagtgaaaaggaacaggatagtgaagtgagtgaggataccaaatcagaagaaaaggagactgaagagaacaaagaactcactgatacatgtaaagaaagagaaagtgatactgggaagaagaaagtagaacatgaaatttccgaaggaaatgttgccacagccgcagcagctgctcttgcctcagcggctaccaaagccaagcacctggctgcagtggaagaaagaaagatcaagtccctggtagctctcttggttgagacacaaatgaagaaactagagatcaaacttcgacattttgaagagctggaaactatcatggacagagagaaagaagctctagaacaacagaggcagcagttgcttactgaacgccaaaacttccacatggaacagctgaagtatgctgaattacgagcacgacagcaaatggaacagcagcagcatggccagaaccctcaacaggcacaccagcactcaggaggacctggcctggccccacttggagcagcagggcaccctggcatgatgcctcatcaacagccccctccctaccctctgatgcaccaccagatgccaccacctcatccaccccagccaggtcagataccaggcccaggttccatgatgcccgggcagcacatgccaggccgcatgattcccactgttgcagccaacatccacccctctgggagtggccctacccctcctggcatgccaccaatgccaggaaacatcttaggaccccgggtacccctgacagcacctaacggcatgtatccccctccaccacagcagcagccaccgccaccaccacctgcagatggggtccctccgcctcctgctcctggcccgccagcctcagctgctccttagcctggaagatgcagggaacctccacgcccaccaccatgagctggagtggggatgacaagacttgtgttcctcaactttcttgggtttctttcaggatttttcttctcacagctccaagcacgtgtcccgtgcctccccactcctcttaccacccctctctctgacactttttgtgttgggtcctcagccaacactcaaggggaaacctgtagtgacagtgtgccctggtcatccttaaaataacctgcatctcccctgtcctggtgtgggagtaagctgacagtttctctgcaggtcctgtcaactttagcatgctatgtctttaccatttttgctctcttgcagttttttgctttgtcttatgcttctatggataatgctatataatcattatctttttatctttctgttattattgttttaaaggagagcatcctaagttaataggaaccaaaaaataatgatgggcagaagggggggaatagccacaggggacaaaccttaaggcattataagtgaccttatttctgcttttctgagctaagaatggtgctgatggtaaagtttgagacttttgccacacacaaatttgtgaaaattaaacgagatgtggaaggagaacctcagtgattttattccctagtgaggcctctgagggcctccacactgcctggcagaacataccactgaactagtatgtgctagaggagggcacaaacatccgctccttccctaggcctgctggctctggttttctatgcagatgattcattggattgggggtgagtgttttgtttttctgggggcagtgtgagctttgagggttggaatattgggaggcattccttagtttcctcaactagcctggaaagttaggagtctagggtaattaccccccaatgagtctagcctactattcactgctttgtgtgcatttttttctccctctttaaaaaaccctttaaaagaaaaaaaaaagtagatagtgctaaatattttagctcatgaaacttggttaggatggctgggggtacaagtccccaaactacctcttgttacagtagccagggagtggaatttcgtcaaccggtacttttaaggttaggatgggacgggaaaagtgaagcaggatattagctccttataccttctcccttccatttctgagatctcacattccatctatcacagggttttcaaagagatgctgagggtaacaaggaactcacttggcagtcagagcatcatgctttgaggtttggggtgctcaggctgggagggtagaatgccattccagaggacaagccacaaaaatgccttaatttgagctcgtatttacccctgctgataagtgacttgagagttcccggttttttcctcttgtccttccctcccttctgtccttccatgtgtggggaaagggtgttttggtagagcttggtttccaaagcgcctggctttctcacttcacattctcaagtggcagtttcattatttagaatgcaaggtggacatcttttggatatctttttctatatattttctaaagctttacatatgagagggtatagggaggtgtttataaaacacttgagaacttttttccttaatatcagaaagcaaaaaaataaaaccacaattgagatttgcctttcaaaccctcaggtttgcctctaaccaggtgtccctggtcaccatcagagtactggaatacgggaaccgaggagaccttggtccttttgtttttgttctggactcttgggagtggaaatgagaatgagtttattcctactggagcttagttccaatgcatttggctccagaaagaccccagtgccttttgacaatggccagggttttacctacttcctgccagtctttcccaaaggaaactcattccaaatacttcttttttcccctggagtccgagaaggaaaatggaattctggttcatactgtggtcccttgtaacctcaggtctttaatgtgatcactttcaaatttaaaagatccaggtggaaatatttttactatagtaataattctacaaaatacctgaattcttaacactgttatatttcagtataagtggtggctttttcttttcatgtctttgatctggttttattcctgtaattcagccacctgattttgtgaggggggggaataatatgtggtttttgtacaaacatgtttctcagtgtgttgttattttggaaaaaatgaggggagggagtttggcaagaatggagaaaatgaatgaagaaggcctaatctctctctttttcagtgaataaatggaacaccatttctgga

SEQ ID NO: 132562 - DNA, 5813 bp, Homo sapiens
gctgggcggggccgggaagcggcagtggcggctacgcgcgcgggggtgcgcgcgggaacgaccgggaaacaccgcgagggccggggtgggccaggctgtggggacgacgggctgcgacgatggccgcagcggcgggcggcggcgggccggggacagcggtaggcgccacgggctcggggattgcggcggcagccgcaggcctagctgtttatcgacggaaggatgggggcccggccaccaagttttgggagagcccggagacggtgtcccagctggattcggtgcgggtctggctgggcaagcactacaagaagtatgttcatgcggatgctcctaccaataaaacactggctgggctggtggtgcagcttcttcagttccaggaagatgcctttgggaagcatgtcaccaacccggccttcaccaaactccctgcaaagtgtttcatggatttcaaagctggaggcgccttatgtcacattcttggggctgcttacaagtataaaaatgaacagggatggcggaggtttgacctacagaacccatctcgaatggatcgtaatgtggaaatgtttatgaacattgaaaaaacattggtgcagaacaattgtttgaccagacccaacatctacctcattccagacattgatctgaagttggctaacaaattgaaagatatcatcaaacgacatcagggaacatttacggatgagaagtcaaaagcttcccaccacatttacccatattcttcctcacaagacgatgaagaatggttgagaccggtgatgagaaaagagaagcaagtgttagtgcattggggcttttacccagacagctatgatacttgggtccatagtaatgatgttgatgctgaaattgaagatccaccaattccagaaaaaccatggaaggttcatgtgaaatggattttggacactgatattttcaatgaatggatgaatgaggaggattatgaggtggatgaaaataggaagcctgtgagttttcgtcagcggatttcaaccaagaatgaagagccagtcagaagtccagaaagaagagatagaaaagcatcagctaatgctcgaaagaggaaacattcgccttcgcctccccctccgacaccaacagaatcacggaagaagagtgggaagaaaggccaagctagcctttatgggaagcgcagaagtcagaaagaggaagatgagcaagaagatctaaccaaggatatggaagacccaacacctgtacccaatatagaagaagtagtacttcccaaaaatgtgaacctaaagaaagatagtgaaaatacacctgttaaaggaggaactgtagcggatctagatgagcaggatgaagaaacagtcacagcaggaggaaaggaagatgaagatcctgccaaaggtgatcagagtcgatcagttgaccttggggaagataatgtgacagagcagaccaatcacattattattcctagttatgcatcatggtttgattataactgtattcatgtgattgaacggcgtgctcttcctgagttcttcaatggaaaaaacaaatccaagactccagaaatatacttggcatatcgaaattttatgattgacacgtatcgtctaaacccccaagagtatttaactagcactgcttgtcggaggaacttgactggagatgtgtgtgctgtgatgagggtccatgcctttttagagcagtggggactcgttaattaccaagttgacccggaaagtagacccatggcaatgggacctcctcctactcctcattttaatgtattagctgataccccctctgggcttgtgcctctgcatcttcgatcacctcaggttcctgctgctcaacagatgctaaattttcctgagaaaaacaaggaaaaaccagttgatttgcagaactttggtctccgtactgacatttactccaagaaaacattagcaaagagtaaaggtgctagtgctggaagagaatggactgaacaggagacccttctactcctggaggccctggagatgtacaaggatgattggaacaaagtgtcggaacatgttggaagtcgtactcaggatgaatgcatcctccactttttgagacttcccattgaggacccataccttgagaattcagatgcttcccttgggcctttggcctaccagcctgtccccttcagtcagtcaggaaatccagttatgagtactgttgcttttttggcatctgtggtggaccctcgcgtggcatctgctgcagcaaaagcggctttggaggagttttctcgggtccgggaggaggtaccactggaattggttgaagctcatgtcaagaaagtacaagaagcagcacgagcctctgggaaagtggatcccacctacggtctggagagcagctgcattgcaggcacagggcccgatgagccagagaagcttgaaggagctgaagaggaaaaaatggaagccgaccctgatggtcagcagcctgaaaaggcagaaaataaagtggaaaatgaaacggatgaaggtgataaagcacaagatggagaaaatgaaaaaaatagtgaaaaggaacaggatagtgaagtgagtgaggataccaaatcagaagaaaaggagactgaagagaacaaagaactcactgatacatgtaaagaaagagaaagtgatactgggaagaagaaagtagaacatgaaatttccgaaggaaatgttgccacagccgcagcagctgctcttgcctcagcggctaccaaagccaagcacctggctgcagtggaagaaagaaagatcaagtccctggtagctctcttggttgagacacaaatgaagaaactagagatcaaacttcgacattttgaagagctggaaactatcatggacagagagaaagaagctctagaacaacagaggcagcagttgcttactgaacgccaaaacttccacatggaacagctgaagtatgctgaattacgagcacgacagcaaatggaacagcagcagcatggccagaaccctcaacaggcacaccagcactcaggaggacctggcctggccccacttggagcagcagggcaccctggcatgatgcctcatcaacagccccctccctaccctctgatgcaccaccagatgccaccacctcatccaccccagccaggtcagataccaggcccaggttccatgatgcccgggcagcacatgccaggccgcatgattcccactgttgcagccaacatccacccctctgggagtggccctacccctcctggcatgccaccaatgccaggaaacatcttaggaccccgggtacccctgacagcacctaacggcatgtatccccctccaccacagcagcagccaccgccaccaccacctgcagatggggtccctccgcctcctgctcctggcccgccagcctcagctgctccttagcctggaagatgcagggaacctccacgcccaccaccatgagctggagtggggatgacaagacttgtgttcctcaactttcttgggtttctttcaggatttttcttctcacagctccaagcacgtgtcccgtgcctccccactcctcttaccacccctctctctgacactttttgtgttgggtcctcagccaacactcaaggggaaacctgtagtgacagtgtgccctggtcatccttaaaataacctgcatctcccctgtcctggtgtgggagtaagctgacagtttctctgcaggtcctgtcaactttagcatgctatgtctttaccatttttgctctcttgcagttttttgctttgtcttatgcttctatggataatgctatataatcattatctttttatctttctgttattattgttttaaaggagagcatcctaagttaataggaaccaaaaaataatgatgggcagaagggggggaatagccacaggggacaaaccttaaggcattataagtgaccttatttctgcttttctgagctaagaatggtgctgatggtaaagtttgagacttttgccacacacaaatttgtgaaaattaaacgagatgtggaaggagaacctcagtgattttattccctagtgaggcctctgagggcctccacactgcctggcagaacataccactgaactagtatgtgctagaggagggcacaaacatccgctccttccctaggcctgctggctctggttttctatgcagatgattcattggattgggggtgagtgttttgtttttctgggggcagtgtgagctttgagggttggaatattgggaggcattccttagtttcctcaactagcctggaaagttaggagtctagggtaattaccccccaatgagtctagcctactattcactgctttgtgtgcatttttttctccctctttaaaaaaccctttaaaagaaaaaaaaaagtagatagtgctaaatattttagctcatgaaacttggttaggatggctgggggtacaagtccccaaactacctcttgttacagtagccagggagtggaatttcgtcaaccggtacttttaaggttaggatgggacgggaaaagtgaagcaggatattagctccttataccttctcccttccatttctgagatctcacattccatctatcacagggttttcaaagagatgctgagggtaacaaggaactcacttggcagtcagagcatcatgctttgaggtttggggtgctcaggctgggagggtagaatgccattccagaggacaagccacaaaaatgccttaatttgagctcgtatttacccctgctgataagtgacttgagagttcccggttttttcctcttgtccttccctcccttctgtccttccatgtgtggggaaagggtgttttggtagagcttggtttccaaagcgcctggctttctcacttcacattctcaagtggcagtttcattatttagaatgcaaggtggacatcttttggatatctttttctatatattttctaaagctttacatatgagagggtatagggaggtgtttataaaacacttgagaacttttttccttaatatcagaaagcaaaaaaataaaaccacaattgagatttgcctttcaaaccctcaggtttgcctctaaccaggtgtccctggtcaccatcagagtactggaatacgggaaccgaggagaccttggtccttttgtttttgttctggactcttgggagtggaaatgagaatgagtttattcctactggagcttagttccaatgcatttggctccagaaagaccccagtgccttttgacaatggccagggttttacctacttcctgccagtctttcccaaaggaaactcattccaaatacttcttttttcccctggagtccgagaaggaaaatggaattctggttcatactgtggtcccttgtaacctcaggtctttaatgtgatcactttcaaatttaaaagatccaggtggaaatatttttactatagtaataattctacaaaatacctgaattcttaacactgttatatttcagtataagtggtggctttttcttttcatgtctttgatctggttttattcctgtaattcagccacctgattttgtgaggggggggaataatatgtggtttttgtacaaacatgtttctcagtgtgttgttattttggaaaaaatgaggggagggagtttggcaagaatggagaaaatgaatgaagaaggcctaatctctctctttttcagtgaataaatggaacaccatttctggattctagtcccattctctgcattcatacaccagtttcttcatatatcctatgaagaaccta

SEQ ID NO: 132563 - DNA, 5542 bp, Homo sapiens
  misc_feature (5426)..(5426): n is a, c, g, or t
  misc_feature (5434)..(5434): n is a, c, g, or t
gctgggcggggccgggaagcggcagtggcggctacgcgcgcgggggtgcgcgcgggaacgaccgggaaacaccgcgagggccggggtgggccaggctgtggggacgacgggctgcgacgatggccgcagcggcgggcggcggcgggccggggacagcggtaggcgccacgggctcggggattgcggcggcagccgcaggcctagctgtttatcgacggaaggatgggggcccggccaccaagttttgggagagcccggagacggtgtcccagctggattcggtgcgggtctggctgggcaagcactacaagaagtatgttcatgcggatgctcctaccaataaaacactggctgggctggtggtgcagcttcttcagttccaggaagatgcctttgggaagcatgtcaccaacccggccttcaccaaactccctgcaaagtgtttcatggatttcaaagctggaggcgccttatgtcacattcttggggctgcttacaagtataaaaatgaacagggatggcggaggtttgacctacagaacccatctcgaatggatcgtaatgtggaaatgtttatgaacattgaaaaaacattggtgcagaacaattgtttgaccagacccaacatctacctcattccagacattgatctgaagttggctaacaaattgaaagatatcatcaaacgacatcagggaacatttacggatgagaagtcaaaagcttcccaccacatttacccatattcttcctcacaagacgatgaagaatggttgagaccggtgatgagaaaagagaagcaagtgttagtgcattggggcttttacccagacagctatgatacttgggtccatagtaatgatgttgatgctgaaattgaagatccaccaattccagaaaaaccatggaaggttcatgtgaaatggattttggacactgatattttcaatgaatggatgaatgaggaggattatgaggtggatgaaaataggaagcctgtgagttttcgtcagcggatttcaaccaagaatgaagagccagtcagaagtccagaaagaagagatagaaaagcatcagctaatgctcgaaagaggaaacattcgccttcgcctccccctccgacaccaacagaatcacggaagaagagtgggaagaaaggccaagctagcctttatgggaagcgcagaagtcagaaagaggaagatgagcaagaagatctaaccaaggatatggaagacccaacacctgtacccaatatagaagaagtagtacttcccaaaaatgtgaacctaaagaaagatagtgaaaatacacctgttaaaggaggaactgtagcggatctagatgagcaggatgaagaaacagtcacagcaggaggaaaggaagatgaagatcctgccaaaggtgatcagagtcgatcagttgaccttggggaagataatgtgacagagcagaccaatcacattattattcctagttatgcatcatggtttgattataactgtattcatgtgattgaacggcgtgctcttcctgagttcttcaatggaaaaaacaaatccaagactccagaaatatacttggcatatcgaaattttatgattgacacgtatcgtctaaacccccaagagtatttaactagcactgcttgtcggaggaacttgactggagatgtgtgtgctgtgatgagggtccatgcctttttagagcagtggggactcgttaattaccaagttgacccggaaagtagacccatggcaatgggacctcctcctactcctcattttaatgtattagctgataccccctctgggcttgtgcctctgcatcttcgatcacctcaggttcctgctgctcaacagatgctaaattttcctgagaaaaacaaggaaaaaccagttgatttgcagaactttggtctccgtactgacatttactccaagaaaacattagcaaagagtaaaggtgctagtgctggaagagaatggactgaacaggagacccttctactcctggaggccctggagatgtacaaggatgattggaacaaagtgtcggaacatgttggaagtcgtactcaggatgaatgcatcctccactttttgagacttcccattgaggacccataccttgagaattcagatgcttcccttgggcctttggcctaccagcctgtccccttcagtcagtcaggaaatccagttatgagtactgttgcttttttggcatctgtggtggaccctcgcgtggcatctgctgcagcaaaagcggctttggaggagttttctcgggtccgggaggaggtaccactggaattggttgaagctcatgtcaagaaagtacaagaagcagcacgagcctctgggaaagtggatcccacctacggtctggagagcagctgcattgcaggcacagggcccgatgagccagagaagcttgaaggagctgaagaggaaaaaatggaagccgaccctgatggtcagcagcctgaaaaggcagaaaataaagtggaaaatgaaacggatgaaggtgataaagcacaagatggagaaaatgaaaaaaatagtgaaaaggaacaggatagtgaagtgagtgaggataccaaatcagaagaaaaggagactgaagagaacaaagaactcactgatacatgtaaagaaagagaaagtgatactgggaagaagaaagtagaacatgaaatttccgaaggaaatgttgccacagccgcagcagctgctcttgcctcagcggctaccaaagccaagcacctggctgcagtggaagaaagaaagatcaagtccctggtagctctcttggttgagacacaaatgaagaaactagagatcaaacttcgacattttgaagagctggaaactatcatggacagagagaaagaagctctagaacaacagaggcagcagttgcttactgaacgccaaaacttccacatggaacagctgaagtatgctgaattacgagcacgacagcaaatggaacagcagcagcatggccagaaccctcaacaggcacaccagcactcaggaggacctggcctggccccacttggagcagcagggcaccctggcatgatgcctcatcaacagccccctccctaccctctgatgcaccaccagatgccaccacctcatccaccccagccaggtcagataccaggcccaggttccatgatgcccgggcagcacatgccaggccgcatgattcccactgttgcagccaacatccacccctctgggagtggccctacccctcctggcatgccaccaatgccaggaaacatcttaggaccccgggtacccctgacagcacctaacggcatgtatccccctccaccacagcagcagccaccgccaccaccacctgcagatggggtccctccgcctcctgctcctggcccgccagcctcagctgctccttagcctggaagatgcagggaacctccacgcccaccaccatgagctggagtggggatgacaagacttgtgttcctcaactttcttgggtttctttcaggatttttcttctcacagctccaagcacgtgtcccgtgcctccccactcctcttaccacccctctctctgacactttttgtgttgggtcctcagccaacactcaaggggaaacctgtagtgacagtgtgccctggtcatccttaaaataacctgcatctcccctgtcctggtgtgggagtaagctgacagtttctctgcaggtcctgtcaactttagcatgctatgtctttaccatttttgctctcttgcagttttttgctttgtcttatgcttctatggataatgctatataatcattatctttttatctttctgttattattgttttaaaggagagcatcctaagttaataggaaccaaaaaataatgatgggcagaagggggggaatagccacaggggacaaaccttaaggcattataagtgaccttatttctgcttttctgagctaagaatggtgctgatggtaaagtttgagacttttgccacacacaaatttgtgaaaattaaacgagatgtggaaggagaacctcagtgattttattccctagtgaggcctctgagggcctccacactgcctggcagaacataccactgaactagtatgtgctagaggagggcacaaacatccgctccttccctaggcctgctggctctggttttctatgcagatgattcattggattgggggtgagtgttttgtttttctgggggcagtgtgagctttgagggttggaatattgggaggcattccttagtttcctcaactagcctggaaagttaggagtctagggtaattaccccccaatgagtctagcctactattcactgctttgtgtgcatttttttctccctctttaaaaaaccctttaaaagaaaaaaaaaagtagatagtgctaaatattttagctcatgaaacttggttaggatggctgggggtacaagtccccaaactacctcttgttacagtagccagggagtggaatttcgtcaaccggtacttttaaggttaggatgggacgggaaaagtgaagcaggatattagctccttataccttctcccttccatttctgagatctcacattccatctatcacagggttttcaaagagatgctgagggtaacaaggaactcacttggcagtcagagcatcatgctttgaggtttggggtgctcaggctgggagggtagaatgccattccagaggacaagccacaaaaatgccttaatttgagctcgtatttacccctgctgataagtgacttgagagttcccggttttttcctcttgtccttccctcccttctgtccttccatgtgtggggaaagggtgttttggtagagcttggtttccaaagcgcctggctttctcacttcacattctcaagtggcagtttcattatttagaatgcaaggtggacatcttttggatatctttttctatatattttctaaagctttacatatgagagggtatagggaggtgtttataaaacacttgagaacttttttccttaatatcagaaagcaaaaaaataaaaccacaattgagatttgcctttcaaaccctcaggtttgcctctaaccaggtgtccctggtcaccatcagagtactggaatacgggaaccgaggagaccttggtccttttgtttttgttctggactcttgggagtggaaatgagaatgagtttattcctactggagcttagttccaatgcatttggctccagaaagaccccagtgccttttgacaatggccagggttttacctacttcctgccagtctttcccaaaggaaactcattccaaatacttcttttttcccctggagtccgagaaggaaaatggaattctggttcatactgtggtcccttgtaacctcaggtgtaactcggnttaggganccttcaattaaggaccgtggaattttctagtatactccaaacggatttacgtatagacaggggctagctgggggcgataccctggggggggttggtaaaaaaaagggg

SEQ ID NO: 132564 - DNA, 5612 bp, Homo sapiens
gctgggcggggccgggaagcggcagtggcggctacgcgcgcgggggtgcgcgcgggaacgaccgggaaacaccgcgagggccggggtgggccaggctgtggggacgacgggctgcgacgatggccgcagcggcgggcggcggcgggccggggacagcggtaggcgccacgggctcggggattgcggcggcagccgcaggcctagctgtttatcgacggaaggatgggggcccggccaccaagttttgggagagcccggagacggtgtcccagctggattcggtgcgggtctggctgggcaagcactacaagaagtatgttcatgcggatgctcctaccaataaaacactggctgggctggtggtgcagcttcttcagttccaggaagatgcctttgggaagcatgtcaccaacccggccttcaccaaactccctgcaaagtgtttcatggatttcaaagctggaggcgccttatgtcacattcttggggctgcttacaagtataaaaatgaacagggatggcggaggtttgacctacagaacccatctcgaatggatcgtaatgtggaaatgtttatgaacattgaaaaaacattggtgcagaacaattgtttgaccagacccaacatctacctcattccagacattgatctgaagttggctaacaaattgaaagatatcatcaaacgacatcagggaacatttacggatgagaagtcaaaagcttcccaccacatttacccatattcttcctcacaagacgatgaagaatggttgagaccggtgatgagaaaagagaagcaagtgttagtgcattggggcttttacccagacagctatgatacttgggtccatagtaatgatgttgatgctgaaattgaagatccaccaattccagaaaaaccatggaaggttcatgtgaaatggattttggacactgatattttcaatgaatggatgaatgaggaggattatgaggtggatgaaaataggaagcctgtgagttttcgtcagcggatttcaaccaagaatgaagagccagtcagaagtccagaaagaagagatagaaaagcatcagctaatgctcgaaagaggaaacattcgccttcgcctccccctccgacaccaacagaatcacggaagaagagtgggaagaaaggccaagctagcctttatgggaagcgcagaagtcagaaagaggaagatgagcaagaagatctaaccaaggatatggaagacccaacacctgtacccaatatagaagaagtagtacttcccaaaaatgtgaacctaaagaaagatagtgaaaatacacctgttaaaggaggaactgtagcggatctagatgagcaggatgaagaaacagtcacagcaggaggaaaggaagatgaagatcctgccaaaggtgatcagagtcgatcagttgaccttggggaagataatgtgacagagcagaccaatcacattattattcctagttatgcatcatggtttgattataactgtattcatgtgattgaacggcgtgctcttcctgagttcttcaatggaaaaaacaaatccaagactccagaaatatacttggcatatcgaaattttatgattgacacgtatcgtctaaacccccaagagtatttaactagcactgcttgtcggaggaacttgactggagatgtgtgtgctgtgatgagggtccatgcctttttagagcagtggggactcgttaattaccaagttgacccggaaagtagacccatggcaatgggacctcctcctactcctcattttaatgtattagctgataccccctctgggcttgtgcctctgcatcttcgatcacctcaggttcctgctgctcaacagatgctaaattttcctgagaaaaacaaggaaaaaccagttgatttgcagaactttggtctccgtactgacatttactccaagaaaacattagcaaagagtaaaggtgctagtgctggaagagaatggactgaacaggagacccttctactcctggaggccctggagatgtacaaggatgattggaacaaagtgtcggaacatgttggaagtcgtactcaggatgaatgcatcctccactttttgagacttcccattgaggacccataccttgagaattcagatgcttcccttgggcctttggcctaccagcctgtccccttcagtcagtcaggaaatccagttatgagtactgttgcttttttggcatctgtggtggaccctcgcgtggcatctgctgcagcaaaagcggctttggaggagttttctcgggtccgggaggaggtaccactggaattggttgaagctcatgtcaagaaagtacaagaagcagcacgagcctctgggaaagtggatcccacctacggtctggagagcagctgcattgcaggcacagggcccgatgagccagagaagcttgaaggagctgaagaggaaaaaatggaagccgaccctgatggtcagcagcctgaaaaggcagaaaataaagtggaaaatgaaacggatgaaggtgataaagcacaagatggagaaaatgaaaaaaatagtgaaaaggaacaggatagtgaagtgagtgaggataccaaatcagaagaaaaggagactgaagagaacaaagaactcactgatacatgtaaagaaagagaaagtgatactgggaagaagaaagtagaacatgaaatttccgaaggaaatgttgccacagccgcagcagctgctcttgcctcagcggctaccaaagccaagcacctggctgcagtggaagaaagaaagatcaagtccctggtagctctcttggttgagacacaaatgaagaaactagagatcaaacttcgacattttgaagagctggaaactatcatggacagagagaaagaagctctagaacaacagaggcagcagttgcttactgaacgccaaaacttccacatggaacagctgaagtatgctgaattacgagcacgacagcaaatggaacagcagcagcatggccagaaccctcaacaggcacaccagcactcaggaggacctggcctggccccacttggagcagcagggcaccctggcatgatgcctcatcaacagccccctccctaccctctgatgcaccaccagatgccaccacctcatccaccccagccaggtcagataccaggcccaggttccatgatgcccgggcagcacatgccaggccgcatgattcccactgttgcagccaacatccacccctctgggagtggccctacccctcctggcatgccaccaatgccaggaaacatcttaggaccccgggtacccctgacagcacctaacggcatgtatccccctccaccacagcagcagccaccgccaccaccacctgcagatggggtccctccgcctcctgctcctggcccgccagcctcagctgctccttagcctggaagatgcagggaacctccacgcccaccaccatgagctggagtggggatgacaagacttgtgttcctcaactttcttgggtttctttcaggatttttcttctcacagctccaagcacgtgtcccgtgcctccccactcctcttaccacccctctctctgacactttttgtgttgggtcctcagccaacactcaaggggaaacctgtagtgacagtgtgccctggtcatccttaaaataacctgcatctcccctgtcctggtgtgggagtaagctgacagtttctctgcaggtcctgtcaactttagcatgctatgtctttaccatttttgctctcttgcagttttttgctttgtcttatgcttctatggataatgctatataatcattatctttttatctttctgttattattgttttaaaggagagcatcctaagttaataggaaccaaaaaataatgatgggcagaagggggggaatagccacaggggacaaaccttaaggcattataagtgaccttatttctgcttttctgagctaagaatggtgctgatggtaaagtttgagacttttgccacacacaaatttgtgaaaattaaacgagatgtggaaggagaacctcagtgattttattccctagtgaggcctctgagggcctccacactgcctggcagaacataccactgaactagtatgtgctagaggagggcacaaacatccgctccttccctaggcctgctggctctggttttctatgcagatgattcattggattgggggtgagtgttttgtttttctgggggcagtgtgagctttgagggttggaatattgggaggcattccttagtttcctcaactagcctggaaagttaggagtctagggtaattaccccccaatgagtctagcctactattcactgctttgtgtgcatttttttctccctctttaaaaaaccctttaaaagaaaaaaaaaagtagatagtgctaaatattttagctcatgaaacttggttaggatggctgggggtacaagtccccaaactacctcttgttacagtagccagggagtggaatttcgtcaaccggtacttttaaggttaggatgggacgggaaaagtgaagcaggatattagctccttataccttctcccttccatttctgagatctcacattccatctatcacagggttttcaaagagatgctgagggtaacaaggaactcacttggcagtcagagcatcatgctttgaggtttggggtgctcaggctgggagggtagaatgccattccagaggacaagccacaaaaatgccttaatttgagctcgtatttacccctgctgataagtgacttgagagttcccggttttttcctcttgtccttccctcccttctgtccttccatgtgtggggaaagggtgttttggtagagcttggtttccaaagcgcctggctttctcacttcacattctcaagtggcagtttcattatttagaatgcaaggtggacatcttttggatatctttttctatatattttctaaagctttacatatgagagggtatagggaggtgtttataaaacacttgagaacttttttccttaatatcagaaagcaaaaaaataaaaccacaattgagatttgcctttcaaaccctcaggtttgcctctaaccaggtgtccctggtcaccatcagagtactggaatacgggaaccgaggagaccttggtccttttgtttttgttctggactcttgggagtggaaatgagaatgagtttattcctactggagcttagttccaatgcatttggctccagaaagaccccagtgctctttaatgtgatcactttcaaatttaaaagatccaggtggaaatatttttactatagtaataattctacaaaatacctgaattcttaacactgttatatttcagtataagtggtggctttttcttttcatgtctttgatctggttttattcctgtaattcagccacctgattttgtgaggggggggaataatatgtggtttttgtacaaacatgtttctcagtgtgttgttattttggaaaaaatgaggggagggagtttggcaagaatggagaaaatgaatgaagaaggcctaatctctctctttttcagtgaataaatggaacaccatttctgga

SEQ ID NO: 132565 - DNA, 5700 bp, Homo sapiens
gctgggcggggccgggaagcggcagtggcggctacgcgcgcgggggtgcgcgcgggaacgaccgggaaacaccgcgagggccggggtgggccaggctgtggggacgacgggctgcgacgatggccgcagcggcgggcggcggcgggccggggacagcggtaggcgccacgggctcggggattgcggcggcagccgcaggcctagctgtttatcgacggaaggatgggggcccggccaccaagttttgggagagcccggagacggtgtcccagctggattcggtgcgggtctggctgggcaagcactacaagaagtatgttcatgcggatgctcctaccaataaaacactggctgggctggtggtgcagcttcttcagttccaggaagatgcctttgggaagcatgtcaccaacccggccttcaccaaactccctgcaaagtgtttcatggatttcaaagctggaggcgccttatgtcacattcttggggctgcttacaagtataaaaatgaacagggatggcggaggtttgacctacagaacccatctcgaatggatcgtaatgtggaaatgtttatgaacattgaaaaaacattggtgcagaacaattgtttgaccagacccaacatctacctcattccagacattgatctgaagttggctaacaaattgaaagatatcatcaaacgacatcagggaacatttacggatgagaagtcaaaagcttcccaccacatttacccatattcttcctcacaagacgatgaagaatggttgagaccggtgatgagaaaagagaagcaagtgttagtgcattggggcttttacccagacagctatgatacttgggtccatagtaatgatgttgatgctgaaattgaagatccaccaattccagaaaaaccatggaaggttcatgtgaaatggattttggacactgatattttcaatgaatggatgaatgaggaggattatgaggtggatgaaaataggaagcctgtgagttttcgtcagcggatttcaaccaagaatgaagagccagtcagaagtccagaaagaagagatagaaaagcatcagctaatgctcgaaagaggaaacattcgccttcgcctccccctccgacaccaacagaatcacggaagaagagtgggaagaaaggccaagctagcctttatgggaagcgcagaagtcagaaagaggaagatgagcaagaagatctaaccaaggatatggaagacccaacacctgtacccaatatagaagaagtagtacttcccaaaaatgtgaacctaaagaaagatagtgaaaatacacctgttaaaggaggaactgtagcggatctagatgagcaggatgaagaaacagtcacagcaggaggaaaggaagatgaagatcctgccaaaggtgatcagagtcgatcagttgaccttggggaagataatgtgacagagcagaccaatcacattattattcctagttatgcatcatggtttgattataactgtattcatgtgattgaacggcgtgctcttcctgagttcttcaatggaaaaaacaaatccaagactccagaaatatacttggcatatcgaaattttatgattgacacgtatcgtctaaacccccaagagtatttaactagcactgcttgtcggaggaacttgactggagatgtgtgtgctgtgatgagggtccatgcctttttagagcagtggggactcgttaattaccaagttgacccggaaagtagacccatggcaatgggacctcctcctactcctcattttaatgtattagctgataccccctctgggcttgtgcctctgcatcttcgatcacctcaggttcctgctgctcaacagatgctaaattttcctgagaaaaacaaggaaaaaccagttgatttgcagaactttggtctccgtactgacatttactccaagaaaacattagcaaagagtaaaggtgctagtgctggaagagaatggactgaacaggagacccttctactcctggaggccctggagatgtacaaggatgattggaacaaagtgtcggaacatgttggaagtcgtactcaggatgaatgcatcctccactttttgagacttcccattgaggacccataccttgagaattcagatgcttcccttgggcctttggcctaccagcctgtccccttcagtcagtcaggaaatccagttatgagtactgttgcttttttggcatctgtggtggaccctcgcgtggcatctgctgcagcaaaagcggctttggaggagttttctcgggtccgggaggaggtaccactggaattggttgaagctcatgtcaagaaagtacaagaagcagcacgagcctctgggaaagtggatcccacctacggtctggagagcagctgcattgcaggcacagggcccgatgagccagagaagcttgaaggagctgaagaggaaaaaatggaagccgaccctgatggtcagcagcctgaaaaggcagaaaataaagtggaaaatgaaacggatgaaggtgataaagcacaagatggagaaaatgaaaaaaatagtgaaaaggaacaggatagtgaagtgagtgaggataccaaatcagaagaaaaggagactgaagagaacaaagaactcactgatacatgtaaagaaagagaaagtgatactgggaagaagaaagtagaacatgaaatttccgaaggaaatgttgccacagccgcagcagctgctcttgcctcagcggctaccaaagccaagcacctggctgcagtggaagaaagaaagatcaagtccctggtagctctcttggttgagacacaaatgaagaaactagagatcaaacttcgacattttgaagagctggaaactatcatggacagagagaaagaagctctagaacaacagaggcagcagttgcttactgaacgccaaaacttccacatggaacagctgaagtatgctgaattacgagcacgacagcaaatggaacagcagcagcatggccagaaccctcaacaggcacaccagcactcaggaggacctggcctggccccacttggagcagcagggcaccctggcatgatgcctcatcaacagccccctccctaccctctgatgcaccaccagatgccaccacctcatccaccccagccaggtcagataccaggcccaggttccatgatgcccgggcagcacatgccaggccgcatgattcccactgttgcagccaacatccacccctctgggagtggccctacccctcctggcatgccaccaatgccaggaaacatcttaggaccccgggtacccctgacagcacctaacggcatgtatccccctccaccacagcagcagccaccgccaccaccacctgcagatggggtccctccgcctcctgctcctggcccgccagcctcagctgctccttagcctggaagatgcagggaacctccacgcccaccaccatgagctggagtggggatgacaagacttgtgttcctcaactttcttgggtttctttcaggatttttcttctcacagctccaagcacgtgtcccgtgcctccccactcctcttaccacccctctctctgacactttttgtgttgggtcctcagccaacactcaaggggaaacctgtagtgacagtgtgccctggtcatccttaaaataacctgcatctcccctgtcctggtgtgggagtaagctgacagtttctctgcaggtcctgtcaactttagcatgctatgtctttaccatttttgctctcttgcagttttttgctttgtcttatgcttctatggataatgctatataatcattatctttttatctttctgttattattgttttaaaggagagcatcctaagttaataggaaccaaaaaataatgatgggcagaagggggggaatagccacaggggacaaaccttaaggcattataagtgaccttatttctgcttttctgagctaagaatggtgctgatggtaaagtttgagacttttgccacacacaaatttgtgaaaattaaacgagatgtggaaggagaacctcagtgattttattccctagtgaggcctctgagggcctccacactgcctggcagaacataccactgaactagtatgtgctagaggagggcacaaacatccgctccttccctaggcctgctggctctggttttctatgcagatgattcattggattgggggtgagtgttttgtttttctgggggcagtgtgagctttgagggttggaatattgggaggcattccttagtttcctcaactagcctggaaagttaggagtctagggtaattaccccccaatgagtctagcctactattcactgctttgtgtgcatttttttctccctctttaaaaaaccctttaaaagaaaaaaaaaagtagatagtgctaaatattttagctcatgaaacttggttaggatggctgggggtacaagtccccaaactacctcttgttacagtagccagggagtggaatttcgtcaaccggtacttttaaggttaggatgggacgggaaaagtgaagcaggatattagctccttataccttctcccttccatttctgagatctcacattccatctatcacagggttttcaaagagatgctgagggtaacaaggaactcacttggcagtcagagcatcatgctttgaggtttggggtgctcaggctgggagggtagaatgccattccagaggacaagccacattcccggttttttcctcttgtccttccctcccttctgtccttccatgtgtggggaaagggtgttttggtagagcttggtttccaaagcgcctggctttctcacttcacattctcaagtggcagtttcattatttagaatgcaaggtggacatcttttggatatctttttctatatattttctaaagctttacatatgagagggtatagggaggtgtttataaaacacttgagaacttttttccttaatatcagaaagcaaaaaaataaaaccacaattgagatttgcctttcaaaccctcaggtttgcctctaaccaggtgtccctggtcaccatcagagtactggaatacgggaaccgaggagaccttggtccttttgtttttgttctggactcttgggagtggaaatgagaatgagtttattcctactggagcttagttccaatgcatttggctccagaaagaccccagtgccttttgacaatggccagggttttacctacttcctgccagtctttcccaaaggaaactcattccaaatacttcttttttcccctggagtccgagaaggaaaatggaattctggttcatactgtggtcccttgtaacctcaggtctttaatgtgatcactttcaaatttaaaagatccaggtggaaatatttttactatagtaataattctacaaaatacctgaattcttaacactgttatatttcagtataagtggtggctttttcttttcatgtctttgatctggttttattcctgtaattcagccacctgattttgtgaggggggggaataatatgtggtttttgtacaaacatgtttctcagtgtgttgttattttggaaaaaatgaggggagggagtttggcaagaatggagaaaatgaatgaagaaggcctaatctctctctttttcagtgaataaatggaacaccatttctgga

SEQ ID NO: 132566 - DNA, 3417 bp, Homo sapiens
gttatcggccgagggtacacagatgatgacaggcctcccagacgaattgccgatgaagacaggtgaaactggcgtcatgcggatgatgacagaccacctagacaaggagctgaagaggaaaaaatggaagccgaccctgatggtcagcagcctgaaaaggcagaaaataaagtggaaaatgaaacggatgaaggtgataaagcacaagatggagaaaatgaaaaaaatagtgaaaaggaacaggatagtgaagtgagtgaggataccaaatcagaagaaaaggagactgaagagaacaaagaactcactgatacatgtaaagaaagagaaagtgatactgggaagaagaaagtagaacatgaaatttccgaaggaaatgttgccacagccgcagcagctgctcttgcctcagcggctaccaaagccaagcacctggctgcagtggaagaaagaaagatcaagtccctggtagctctcttggttgagacacaaatgaagaaactagagatcaaacttcgacattttgaagagctggaaactatcatggacagagagaaagaagctctagaacaacagaggcagcagttgcttactgaacgccaaaacttccacatggaacagctgaagtatgctgaattacgagcacgacagcaaatggaacagcagcagcatggccagaaccctcaacaggcacaccagcactcaggaggacctggcctggccccacttggagcagcagggcaccctggcatgatgcctcatcaacagccccctccctaccctctgatgcaccaccagatgccaccacctcatccaccccagccaggtcagataccaggcccaggttccatgatgcccgggcagcacatgccaggccgcatgattcccactgttgcagccaacatccacccctctgggagtggccctacccctcctggcatgccaccaatgccaggaaacatcttaggaccccgggtacccctgacagcacctaacggcatgtatccccctccaccacagcagcagccaccgccaccaccacctgcagatggggtccctccgcctcctgctcctggcccgccagcctcagctgctccttagcctggaagatgcagggaacctccacgcccaccaccatgagctggagtggggatgacaagacttgtgttcctcaactttcttgggtttctttcaggatttttcttctcacagctccaagcacgtgtcccgtgcctccccactcctcttaccacccctctctctgacactttttgtgttgggtcctcagccaacactcaaggggaaacctgtagtgacagtgtgccctggtcatccttaaaataacctgcatctcccctgtcctggtgtgggagtaagctgacagtttctctgcaggtcctgtcaactttagcatgctatgtctttaccatttttgctctcttgcagttttttgctttgtcttatgcttctatggataatgctatataatcattatctttttatctttctgttattattgttttaaaggagagcatcctaagttaataggaaccaaaaaataatgatgggcagaagggggggaatagccacaggggacaaaccttaaggcattataagtgaccttatttctgcttttctgagctaagaatggtgctgatggtaaagtttgagacttttgccacacacaaatttgtgaaaattaaacgagatgtggaaggagaacctcagtgattttattccctagtgaggcctctgagggcctccacactgcctggcagaacataccactgaactagtatgtgctagaggagggcacaaacatccgctccttccctaggcctgctggctctggttttctatgcagatgattcattggattgggggtgagtgttttgtttttctgggggcagtgtgagctttgagggttggaatattgggaggcattccttagtttcctcaactagcctggaaagttaggagtctagggtaattaccccccaatgagtctagcctactattcactgctttgtgtgcatttttttctccctctttaaaaaaccctttaaaagaaaaaaaaaagtagatagtgctaaatattttagctcatgaaacttggttaggatggctgggggtacaagtccccaaactacctcttgttacagtagccagggagtggaatttcgtcaaccggtacttttaaggttaggatgggacgggaaaagtgaagcaggatattagctccttataccttctcccttccatttctgagatctcacattccatctatcacagggttttcaaagagatgctgagggtaacaaggaactcacttggcagtcagagcatcatgctttgaggtttggggtgctcaggctgggagggtagaatgccattccagaggacaagccacaaaaatgccttaatttgagctcgtatttacccctgctgataagtgacttgagagttcccggttttttcctcttgtccttccctcccttctgtccttccatgtgtggggaaagggtgttttggtagagcttggtttccaaagcgcctggctttctcacttcacattctcaagtggcagtttcattatttagaatgcaaggtggacatcttttggatatctttttctatatattttctaaagctttacatatgagagggtatagggaggtgtttataaaacacttgagaacttttttccttaatatcagaaagcaaaaaaataaaaccacaattgagatttgcctttcaaaccctcaggtttgcctctaaccaggtgtccctggtcaccatcagagtactggaatacgggaaccgaggagaccttggtccttttgtttttgttctggactcttgggagtggaaatgagaatgagtttattcctactggagcttagttccaatgcatttggctccagaaagaccccagtgccttttgacaatggccagggttttacctacttcctgccagtctttcccaaaggaaactcattccaaatacttcttttttcccctggagtccgagaaggaaaatggaattctggttcatactgtggtcccttgtaacctcaggtctttaatgtgatcactttcaaatttaaaagatccaggtggaaatatttttactatagtaataattctacaaaatacctgaattcttaacactgttatatttcagtataagtggtggctttttcttttcatgtctttgatctggttttattcctgtaattcagccacctgattttgtgaggggggggaataatatgtggtttttgtacaaacatgtttctcagtgtgttgttattttggaaaaaatgaggggagggagtttggcaagaatggagaaaatgaatgaagaaggcctaatctctctctttttcagtgaataaatggaacaccatttctgga

SEQ ID NO: 132567 - DNA, 1619 bp, Homo sapiens
agcgggcgggcgcgcgcccaacggctttgcgaggctcactcggtctgagaggtcggaggctgcgagtgtcgctgctgaaggctgtggtggactgggctggatcgcggattttggattagataatagatttgggatcgcggattgggggttggatcgcggatttggggttggatcggggatttggggttggataggggatttggggctgggtcggcgggggcgtggggggaggtgaaaaggtaacagggagctgccccctctcaagagccggtagttgggagtctgagaagtcaccaccatgaagttgttcggcttcaggagccgcaggggccagacggtcctgggctccatagaccacctctacacgggttccgggtaccgaatccggtactcggaactgcagaagatccacaaggcagctgtcaagggcgacgctgcggagatggagcgctgtctggcgcgcaggagcggagaccttgacgccctggacaagcagcacaggctgtccattgccaggaagaggcttgtgccgttattctgctggaacatggtgccaatccaaaccttaaggatatctacggcaacactgctctccattatgctgtgtatagtgagagcacctcactggcagaaaaactgcttttccatggtgaaaatattgaagcactggacaagtgacccatttggagcaggagtgcctgacattgacatctgggatcctgacaccattgatagaagtgaatcaagcaagtttgtgccacccagaagaaacctccacctgcattgggaagctctggcaactgtacccctaaaactcttaattcctcaaatgttaatgtttgccacaaatagtattgtcaaatggggattaggtacaattcaagagatttcttgattattggacataacatacagttttataatacttctcaaatgcagatggtcatggagtccttctcttggggtataatacttctggtaaagcaaatattctttggaatatagtttaagaaacactgctttagtgagaataatttagatcattaatttatgtaaaaaacttaaaatgtttgctactatgtcttagggttttgggggtatagagacaaaagatacagaccttgcctcaagaagctcttggtttcagtgggacacagtgaaatgattacaatgtaccatgctaagtgctgtgatcaaagcaaggattcttgggactggtaaatgtctaaagtgagttttggcaatgaccacagttaatccggggagacagaggaggattgtttgcaaggcaaagagcagcacatcagaaagcacagagtgagaaggaagggactgcttttcttttacttcctttctatattgtatgttgaagttcaaagcaccttagagaagattttcagttcagttgagaaatatgtaattttctgaattactaattttttctgctgttttataggacagtaataccccacttttattcgctataatttgcaagaaagagaaaatggtggaatttttattgaaaaacaaagcaagtacacatgccgttgataggctgagatggtacagtagttctttttttttttaaataaaaactgtgtattctagagtggtaacag

SEQ ID NO: 132568 - DNA, 588 bp, Homo sapiens
agcgggcgggcgcgcgcccaacggctttgcgaggctcactcggtctgagaggtcggaggctgcgagtgtcgctgctgaaggctgtggtggactgggctggatcgcggattttggattagataatagatttgggatcgcggattgggggttggatcgcggatttggggttggatcggggatttggggttggataggggatttggggctgggtcggcgggggcgtggggggaggtgaaaaggtaacagggagctgccccctctcaagagccggtagttgggagtctgagaagtcaccaccatgaagttgttcggcttcaggagccgcaggggccagacggtcctgggctccatagaccacctctacacgggttccgggtaccgaatccggtactcggaactgcagaagatccacaaggcagctgtcaagggcgacgctgcggagatggagcgctgtctggcgcgcaggagcggagaccttgacgccctggacaagcagcacagaactgctctacatttggcctgtgccagtggccatgtgaaagtggtcactctcctggttaacagaaaatgccagattgatatctatga

SEQ ID NO: 132569 - DNA, 793 bp, Homo sapiens
aggtttttttgccaattttattggctattatattgtcacctttacaagctatgagtcttccagttttcccttcagcataggtattcaccacagtgaagtactcactaaactttcctgaagttactttgttacattaatatgcatatgcaaatgatctaaaatgtatggcactcttccatttattatttctgaagacagccttatgtgttaattgcatagccacccctcctataatctctaactcaccctgtttcatactgagctcatcatcttcctcaaacttcatccttcttttcccattttattgaatggcaatatttgttcaaggaaactggatcttccttgtttccctccctttttaaatttctaaatttaaattctgtttattcagccttgtcagaatctcacaaatattatcccttctgttcaatctagtgtgggctgggggttaggtgcctctttccatgtgttgtctcaacaactgatttatatctctatcatagcaatttatgtgccattattatgaatccttaattttatttaacttttttccctgttgctgatggcctcctcgagtcctggaacatttatttctcaattcacagcatttataacatttctttcatataatgcataactaaaccacaaatgaataaagttagtagtgcagagatgctgacaattaaagctatgcctgataattttgttttctgaaagtaaatgacaatgtccttaaattttcgacaaggggctaactggatttgtacctagaggtagtgaaatgatctgtgta

SEQ ID NO: 132570 - DNA, 142 bp, Homo sapiens
tttcttcataaattcactgaggtgttgacagaatgaaaactggcaatgagatgtggaaagggaatgctgtggcgatgatggtattctctctaataaatagttcttcacatactcctagggatgctgtttattttcttcatgg

SEQ ID NO: 132571 - DNA, 241 bp, Homo sapiens
gttataaaatgtatactgtgggagtatctgaaagggatatctaacacacagttgtttatctttcttcatttctgagaggtgtaagggtgtgataaaaggaagatcactgtaggtatgaataaatacaaagaaggaaatgaaaggacttttgtttttaatgggaccaagttagtgatttgaggatttctggcagatcaagaaactaaaaaatcagtgaactgtcttgttgctgcaaaagttt

SEQ ID NO: 132572 - DNA, 383 bp, Homo sapiens
gctgtggcccaatgagtggcagttttttcctagccagcttctgtggccaaatttggaggattttccaacctcgtgatatggtggcccttgggtgtaaatcactaaattccctttctacctggtctcttcttcctgaaacactcagagctgacttcttccttctatcttatccgtggacccaaaactccggcgccagtcaccgactcgggaagacagtcttcccttggtgtttaatcactgcagggatgcctgcctgattattcacccacatttcattggtgtctgatcaccatggggacacgtgccttggtcagtcacccacattcccttggtggcaagtcaactgcggggatgcctgctttggctgctcacctacattacag

SEQ ID NO: 132573 - DNA, 542 bp, Homo sapiens
aaaaacagacatgtggaccaatagaagagaatagagagcccagaaatgacacatttttggttagctgaccctcaacaaaaatgctaaggacacctagtggggagtagatagtcttatcaataaatgctgctgagaaaattggatatccacatgcaaatgaacgaaattagaccctgatctcacaccataaagaaaaatcaattcaaatggattaaagacttacacataagacctgaaactgtaaactcagaagaaacaaggaaaaagcttcttgacattggtctgggcagacattatggagaaggctggatgcatcacacttcctgatgtcaaagtacatgacaaggttcagcagtaaaaacagtatggcactgatataaaaacagacatgtggaccaatagaagagaatagagagcccagaaatgacacattttgggttagctgaccctcaacaaaaatgctaaggacacctagtggggagtagatagtcttatcaataaatgctgctgagaaaatgggatatccacatgcaaatgaacga

SEQ ID NO: 132574 - DNA, 385 bp, Homo sapiens
catagatggttacagtgattttaagactgtaaaataaatatggagatcctaaagagaaaacaactattttgcctggagatatcaaaaaaaggctcatggtgaaaataacatttttgtcaagtcttgaactacaaatagaataggaaaaattaaaacatacctgtacaactaaaatgtttgtttgcagagcattatacacaaaacagaggtctttaattaagtaaataaaacattgtccagagaaataaaacgtgaaacccccatatttcattaattcattcaatagtcttcccttattcaaaatcagaataggtataaatatggattttttatagagagtataccatattttgggtcgacgcggccgcgaatttagtagtagtag

SEQ ID NO: 132575 - DNA, 342 bp, Homo sapiens
agaccaggcagcacagcatagagataaataccatttactgaagggaagaacaggaaagtaagcactagaattttcctgggacccaattaaaaccttagactagcactaggcaggcccccatggccatagacttcaggcttgtacctgtggacagagcatcctggcctgcttcagcacaggctggatcctgtagctacaggctttcctgacagacccagttacaaggccctccacaccctgaggcatgcaacagcactccctagccatcaggctggcacttgaggacccagacttcaggcccattccaagttccagatcactttggtggatccacccagtacc

SEQ ID NO: 132576 - DNA, 393 bp, Homo sapiens
gggggtctcttcctctgctgtcagtgtgccccttgccttccgtttcttccttcccttttctcctggggatgggtctgttggcagctgggggatgaggatgtgagacactggccgggtgccgaggctcatgcctggaatcccaacactgtgggaggctgaggcgggtgattacttgaacccaggaggtcaagaccagcctgggcaacgtggcaaaaccccatctctacaaaaaatgcgagaattagccgggcatggtggcacacgcctgtagtcccagctactcgggaggctggggtgagaggattgcttaggtctgggaggtttaggctctagtgagccatgatcgcaccactgcactgcaacctgggtgacagaatgagaccctgtctcaaa

SEQ ID NO: 132577 - DNA, 679 bp, Homo sapiens
gagcaatcgcgtcatagtaatgaaaataccccagcatcttagaggggccgaggctggtctcaaactcctgacctcaggtgatccacctgcctcggcctcccaaagtgctgggattacaggcatgagccaccgtgcccggcctctgttagtcttttctccctgcccagccctgtccagggtctccctgagtttgaccagccctgtgtgggtaccagccttccttacacatgggggtgcatggataaggggggtcccagaggcagaagatgggagcattgcttcagtggtctggatgctggagatgctaacagatcaaagctgtgcccttgtgggaccgacagtctaggccgggtcggggacgggcaggaaacgaggtgaccaggactccttgaggatgtggtgtgcgaccgacctcggggatcaaacaaggggaagggaaccacgtgggactcggagagtgtgcacggtgcagaccaggtgtcactggacgctctggcccgagactgtttgctcaaggggcccaggagtggggtgggggggtgccaggaggcccagggaccagtcccagctcagttcctccctgactgtgtgactttggtggaagatttcatgcctcagtctcctcctcgaggtagtgggtgcaatgatagtccccactttcatagtagacttttttttt

SEQ ID NO: 132578 - DNA, 483 bp, Homo sapiens
actcccgccacgtgagttgcctgcttctccttcaccttcaccatgattgtaagcttcctaagtcctccccagaagccgagcagatgtcagcaccatgcttcctataaagcctccagagtcatgagccaattaaacctcttctttataaattacacagtctgatgtatttcttaatagcaatgcaagaatggtctaatacaatgtatatgtgaaaatgcatcccaaattcacaatggcttactttttgtacaactgctagtaagttggtaattgctcaaacgtgaaataatatacaaaaagtcacattttaacaatgtatgtggctgtacctatggcttctaatactctctacgcatccccatattaaataccaaagatacaggcttgatcaaaactctcccatcacttcatatcagtgttcctcctgccaacaggagcctttctttttccatctcagcaccctaattttatccacaacttttt

SEQ ID NO: 132579 - DNA, 836 bp, Homo sapiens
actctctgcatttttaagcatgtgcagcaaaaattcagcactctttttgggccactgaccttgtgtccagccccactgcttggcctgggcacacctgccagctccaccattgtaacgtcggaatggtacgcactgtttctgtaaagtgacatctttcaggtacttcatggcttttcgtatatgcatacccttgatggcctgggcagtttcacgaatattcttaaagtaaacacgaagattggaacctcttgatttgcatgatatcatgaggttctccgggttaagtgaatagtgaaccattttcacagattacctcaggccgcttagggaaagagcaaatgggcccattttaaagataagagaatgagaaattatatggattgtacagagtctcacataacttggagaattaagaccatgctgccaagacaagattgtcagattacaggcatgagtcaccacgcctggccaaaaaaagttatttacataaattcaaacaataacagaagtacataaagtaaaaagaaatagtcttttcttccttacttcttatccaatccactgttaatagtatgatgtatctttttagactttgttctttatgtatacttatatgcacgtgtgaatgtttgaatgtgtgtgtatgttttatactatatattctctgaaacttgccttttacatttaacattagattttggacatctttccaaatcagtgcatttagatttatctttatttttagaatgcagttgcatagtatttcatcaaatactgggccataggatgtatgtatgtattttaaaaaacaagatgtttttagcaaaagacaacag

SEQ ID NO: 132580 - DNA, 370 bp, Homo sapiens
cacagggaaccagcaaaacatctaataataaaaatctataatgggaagaagccgaaaggcatggagctggtgcttctccagcaaggctgctctgtttgccagtttgaggccaggcaaatctccctgcacaatggggtgcatgtgagcaaggcctggtccctccagcaaggtttcctaactctccacctgacccctgacagccccagtcaagccaaggagggaggcagctctggtggcagaggttcccttccctttcccactctgcacccccagcccagtgagcccctcctcatttccttcccactgcaggggaagggaaatgccggtagggtttggagtttccttcaaagctgtgagctctgctctggga

SEQ ID NO: 132581 - DNA, 722 bp, Homo sapiens
acaggtgtttcttactgtattagtctgttttcacgctgctttaaagaactacctgagactcagcaatttataaagaaaagaagtttaattgattcacagttccacatggctgtagaggcctcaggaaacttacaaccatgacagagggtgaaggggaagcaagtcacatcttacatgatggcaggacagagaaagagagcaaggacggaagtgccacattttaaaaccttcagatctctcactgtcatgagaacagcatggggaaaatccacctccatgatccaatcacttcccaccaggttcctcccctgacccgtggagattacaacttgagacgagatttgagtggggacatagaaccaaaccatattacttactcatgccaaatattcatcaaaggtcacctgggtcatcaaaggtcatatgccacatagctcctttctctgggacccagaagtcatggacagagcagccacagtctccaaccttgctgattgctatggcaaagggagagagaaatacagacagagagagagagagacagagaaagagagaaagagagagagaaaaactatggagaatatcacattgacagttaaatgtaccctggaagtgatgcacaacatacactgtgatacacagcacttcccctcacacacataggctggagcagtggttttcaaccaggggtgattttgcctccactaggggatatttgccaa

SEQ ID NO: 132582 - DNA, 616 bp, Homo sapiens
aggagcaaggtatgtggatgttcttgtactgttcttttagctcttccgtggctttggaatttttcaaaagaaaaaggtgaggaggaagaaaaaaaaacaactttgttccatctggaattgattttgattgcaggtcctttggttgccgtggccctcctgggttattgtcctggatttctggtttctttgtccttttacagcatgtacaatagtcagtttccctctctcttaggaacttcttttttgggtgagttattcttttttcggacttggaagtttttatgattagtgtctttctggcagacttcagtgacttttctagaagcaggtaagacctagcatgctttgtcctgtgcgttgatgccttttttggttttgttttcgttttttaacattgcattatgtgctccaaggaaatttgcaaggaagttttgttctctgggacttaaacaaagtcttaatcctcagaaatcatcttaatcatcaaattaatgtgtcgtgtaattaaccctcttccagtgacccttgagataagctttttcctctcaatggagagtttttgcaggagggcaggtcctgcttacattctttggatatgggcttgtaaagactcctg

SEQ ID NO: 132583 - DNA, 551 bp, Homo sapiens
gctcagcaggaagttcagaagtcactgcaatgagcaaacagacctgagcacaccccggcgcagcctggagtccgggaaagaatcagtcaccaagttttctgatggcctggaaatattccaccctgtcccaagaatgtctctaagccaggggtgagcaaactatggcccacaggccatatccgggcctggtttttttttttttaaagttttactatacactgccataaatactgcctatggctgctttctggctacaaagtagaactgaaaagttgagacagagacagagactcacagaccaactctgcccatagggtattgtgaggattaaacatttaccatctgaccatttagacagtttgtcaactctgcctctaacccattgggattaaatgaccaaggtcactgtgttctgcttaaattgctttaaaaacttactaggaaatacacagactctcttcctctcacttccccaaaatgaacaccatcttttccccaatgctagaagctgacagtgtctaaagattaaaacttttaaaatgaatgtatag

SEQ ID NO: 132584 - DNA, 439 bp, Homo sapiens
tggggcaaagatttgtgctggttcaggcctggaaataccagaaataccagaaactgaagtcgtctctctttgggcggccacagcataaaaccaaccaacatgatcctgctattaacctcgattaactcggagaagactctgtctcaggctgtcgaggcgccattgctccagccaagccccccagtgctgacccaaaatggccaagccagggtggagagtgggcagtggagagtgggtggtgggcactatcgccagctcaagggccgaaccaagaacagggcgtcctgagtggtcggggactgagctgcctcccaccccagtgctcagcctctactgcctctgtccacagacaggggcacagagaaggtgattgtttccatctgaccacggtgactgctccctggggcagccgagagcacaggcctggatgtcacagagg

SEQ ID NO: 132585 - DNA, 153 bp, Homo sapiens
tctggcctggctgctcatcaagcttctgtgcttggaagaccccttcgcgtatttcattaaaattttactgaaactcagtagacatattttaagctaataaattaatctatactgggattttgtgttatatccttaattggcagaagcaggaag

SEQ ID NO: 132586 - DNA, 303 bp, Homo sapiens
ttaatgaacataccaccttacctcctttcagctcaccctcagacatcccccttccctctgtcaccaagccctttaccccatgtttctatgcttcaaacaccagtgggtggaagaagtcagtaggaatacggtaaactctttccacatccccagatagcttgctcaaagccatattatgaaaattccttcctcacctctgcaaaccccttctccccaccttccatttgtttcctccctcttctcttttcagagctagtgataagtaaagagagaacaggaacaagaccagtagggggtcccgct

SEQ ID NO: 132587 - DNA, 511 bp, Homo sapiens
attaatgatgtgagtgactcggggagacacgcttgttttgcagcaccctcctccgccgatcgctgaagcagaacaaatactaattaacaggggcggcctggttggcaggttggctttctccagctgatttggcaaaatggtttattcctttccctccataaaccatccctcttagttattagacattttcatactgatgtttagttaatttctaattttcttaattaggatgcatttcatctcttgcaaaaatattataacgtttatagttaacatttttaaaaatttagaggggcctaagatttaagttttaatagttgacgcttgaatttcaaaaacatttgtttctcaaaatgtagataattcttccaatggaattattccaaagaatcgttcaccatcttttttttgtattcttacagtaacactaaccccactctggaaaaattataaaatcactcatggggtagtttaatactcttgttcttctttcttgaattatttctgcaac

SEQ ID NO: 132588 - DNA, 529 bp, Homo sapiens
agctgccctcacacaccaccacacgcgtgcgcacaggagtgcccggctcacccactcctgacacacgccatgaccccgtcactcacgctcggagcgtgcccacgtgaatcgggacttgcccacgtgccccgcagcacccgccctgcctgcaacacccacaccaggcacccgggcccgctcacgctcacctgcacacctccatggcggctccctggcacctccaccaagcaggggcccctcaccgcggcccagggcttcagtgtgcagactccaggctgagaggggacggggatcagaccccaatggcaccactctccagccgtgggaccatgagccagctctcatccactctgagcctccatttcctcatctgtaaaaaggggacccccacagggctcctgggtggaattggtgaggaacacacgtgaacaccaaggacaggcctgggtcacacggaacatgcctaataccagattctcaccgcagtgacagcccctgaccgtcccgtgctgcagctcgcagatcctcc

SEQ ID NO: 132589 - DNA, 616 bp, Homo sapiens
gaaagggggactcttgagtagggagatgatcatacttttagaagatacatgaagatagctctttcttctctgagagtgttctggcatgatgaggaatgatccagacgctgagaggcaaaactagtcaaggagttaaatacattgctcttagtcctgttggtgacatccagactctttagtccactttgattccttaatctgccttgttgggcaggctgacactggcttctcagaagtttcttgtccttatgaaagaataaaccttcataatttttgtcactctcaatgagattcttagaatgctgaggagctgccactggagctgaaataatttgagacataatatgtggggttaggaataatgccatgggaaatctttttgtgaattatgacttctagatgtgagcctagataaaaccctaatgtttgtaaacattgtcatcttaaaagcacttaactctttggactgtttggttgttgggggtgggaaaaataatattcatttacagataacagagtatataaactaccagcacatttctaagaactgaagtaattatctgggatgggaattctattctgagtttattgcatactctaattaggtcacttcata

SEQ ID NO: 132590 - DNA, 288 bp, Homo sapiens
gtgcttgccagagccagtggtggggggcggacttgaagtggaacgtttacaagccgttgtgactaagtgtcaaaagtgggcaaaatggcaagggctgtgaaatcagaggtaggtggaaactccggatcctgagcccataggtcagctgcatcgaagccataaggctaagagaagtacctggagtcaggagacccaggaattcccttccagctttgccactaacctgcaggtgtccttggtgaagttgcttcattcctctgatctcagtttatccacctgtgaattggg

SEQ ID NO: 132591 - DNA, 316 bp, Homo sapiens
atattctgaccatagcaccattgcctgccctgccttcgggacttacactcttttggagctgaaggaactggctctttcttgctccacattgctccacattccccatcagcgttccccagcaggctctttcctagcagacaatctgaactgcacccaggctgcagtcatccctgagtttgggggcttctaaggctgtgtgctgagttgtgcctgaagcaggaggagcctacaattcactgagcatctccctgtgcccacgtgctggatgcctcgcaggcatggatatatcccactgcatccccagaacaatctcaaa

SEQ ID NO: 132592 - DNA, 110 bp, Homo sapiens
aatggagcaagaccctatctctttaaaaaataatttcttaaaaagagttgatcagattgagatggagcagccagtaagtggggagaagcccaagagtgttgtccctataa

SEQ ID NO: 132593 - DNA, 447 bp, Homo sapiens
aactaacacagggtggaagtcccacagggagggacagaagaaatcacaaaagggcaagagaaaacttttgggggtggtgaatatgttcactatcttcactgtggtgatggtttcatggtgtatatcaaaacttaaactgtacactttaaatattcagtttattgtatgtcaatatatttcaataaggctgattttaaaaaatccagcagatatcaggcctcttcacaaagcctcctgtgaaagaccaagccatgcaaatggaaaggtggcttagagctgaaggacaaaaacggacacaggagaaaatccttctgggatgtgggcagctagcctggaactattgttcctgatgcactcagggaaaaaaaaaatctaactacccaataaagcagcctgtctcttcaggtgtgctagggtgcaaggggcagttctgtaagggctgatgtg

SEQ ID NO: 132594 - DNA, 434 bp, Homo sapiens
gggtcgcgagaaataaatttgtttccattacaaattgccagctgtcttggtccattttgctttgctataacagaatacctgagactcagtaatttctaaagaaaatgggaggccaggcacggtggctcatgcctgttaatcccagcattctgggaggccaaggtaggaggaacaccttcaggcctgaagttcgagatctgcctgggcaacacggccagacgctatctctacaaaacatttaaaaatcagcctggcatggcagtacatccttgagctacttgggaagctcaggtgggaggatcccacctgagttcaaggctgtagtgagccatgatcgtgccactccactctcgtcggcaacagagcatcacccggtctcttaaaaaaaattaaaataaataaatcttttaaaaagaaaaagttggtctatctgg

SEQ ID NO: 132595 - DNA, 325 bp, Homo sapiens
ttctgcatattatgaaaacctttgttagttctcataatagagctattacaaaacagtttatatggagttgttaaattaagtgcctatttttcttttttgttgttgttctgcttttggtttttgttttgttttgttttgttttttgagacagagtcttgctctgttacccaggctggagtgcagtgtcatgatctcagctcactgcaacctccgcctcccgggttcaagcgattcttgtgcctcagcctccccagtagctaggattacaggcacatgccaccacacctggctaatttttgtatttgtagtagagatggggtttcac

SEQ ID NO: 132596 - DNA, 273 bp, Homo sapiens
atttgtagatgagtgtgcagtagcaatgatcatagtttattttatgaattaatagttaatgaacatcagatattggtgatacagcaataaacgagataaatatatttccttttggagttcatagttaaggtttgttacatgggttgggtatattaggttgggtatattgggtggtgctaaagtttgggcttctactaatcccatcacccaaatagtaaacatagtacccaataggtggtttttcaacccgtgccctcttccctccctgctttt

SEQ ID NO: 132597 - DNA, 318 bp, Homo sapiens
ttgctgagggtaggatgacttatagctgtagctggatatagagattcaaacaaatttcttttaggatctggttttatcctctccatctctcacctctacttttcaagggctgacttctttctcagacaacttttctttcagagtgcaaacttgtttcctccagccaatcagcgtgaggggtattgggattggatgggatgatgggcagaaggtaaaacagctggtggtgagtggccggatcaacttagaggcttttgttttcctttctttttcttcttttacttttaaaattctttttggcttttcaccacaggggca

SEQ ID NO: 132598 - DNA, 450 bp, Homo sapiens
gatgggagtcagaggacctggatgaagcccaaacactgggacagggtcccggcatcaggacgagtccttggggctgtgtcaggtctgggctcacgatgaatccaagaatcatatggggcctgaaggccgagacagcgtgagcatgcgagtgaccccctaagcctgatttgcctgggacttttccagttttagcactgaaagccctcgtcctaggaaactgctcagtcccggacaaaccaggatggttggtcactgtggtaaggaggactctggggtccaaggatcatgacatttccaagtaccttgacgaggtctcgggattacagcaggaacttaagatcatcctagctctttgggtcatgatataacacccctaggctcatgccagcactgacacaagttcaagctgaggaatgagaagctgtccagggacaaagtctaagcaggtta

SEQ ID NO: 132599 - DNA, 551 bp, Homo sapiens
aattccccaaagaatttctaacggaacaagttgcaacatgatcatctaatcctccagtcactagaggatggaggtacttcttccctcagggagagggaagtatctcttcagggagacaccaggtcatttgttgaacacatctactgtgaaaaaccagaaagctttctagattcatcaaataaatgtctgcagtctggaaatcagaacatccgggttctagtcctaggatgaccttagacaagccacggctgctctgggccctgctttccttgtgtataaaacaaagctgcagggatatatgatttctagggtctctttctagactgaaagttccataacagaaataaatgatctgagaatttaattgattttcgtgctttctttcttcctttccccccgacctttggttgttgttgtttatttggttagtaggctaaaatagaactatttttcttgaaaaatagtgcataattctctgggatgagaggcatttcttctctgtggtattttcccacagtgtaaccttccttctcttttcatttgccactagg

SEQ ID NO: 132600 - DNA, 1012 bp, Homo sapiens
gccagaaataaaccttctccagatcagaggactgtggagaaggctgtctttgcaacaaattcaacaagggagatgtggaaggatttattcaccatggatggccttctcatggattgtataccttggccttgcattactcagatggtccagggaacctcaaaaacttggtttgaaatggtcctgaactggtagtactcctaggaacctgtcagaagccaacctaaatctctctggagaaaggcatcttttatcacagtcttcaatgaatttccaaaaataatttttcaaagacaatgagtaatatacagtcaaaaatactaagtactggaggatccaggataccatgagtagaccagtaaaaacagcagatatcagaaatagacatgtaaagacttcagatattaaaattatcagacctaatcataaacatattactaaatttcatgaacatattagtaaattattaagaaataaaagcaaagcttgaatatgtccatctgcagggaagagtaaactattaaaaaatgatggaagactggacacagtggctcacatttgcaatcccagcactttgggaggccaaggtgggtggatcacctgagctcgggagtttgagaccagactgaccaacatggagaaaccctgtctctattaaaaatacaaaattagctgggtgtggtagcgcatgcctgtaatcccagctactcgggaggctgaggcaggagaatcacttgaacccggaaggtggaggttgcggtgagccgagatgtgccactgcattccaggctgggcaacaagagcgaaactccatctcgggaaaaaaaaaaaaaaaaagatgaaatatatttggaaaaagaaccaaatagaacatctagaagtgaaaaatactgtagctaaaattaaaaactcaatggacccacttaaccgtagattagacacagatgagaaaagaataaatgaactgaatgatagctcaagaagaattattcagaacgcagcagaaagagacaca

SEQ ID NO: 132601 - DNA, 899 bp, Homo sapiens
  misc_feature (898)..(898): n is a, c, g, or t
cgcagtggcttacacctgtaatcccagaactttgggaggctgaggcgggtggaccacctgaggtcaggagttcgagaccagcctagccaacatggtgaaaccccatctgtactaaaagtacaaaaaaattggccgggcacagtggctcacacctgtaatcccagcactatgggaagccgaggcaggcagatcacctgaggtcaggagttcgagaccagcctgaccaacatggagaaaccccatctctagtaaaaatacaaaattccaggcgtggtggcacatgcctgtaatcccagcactttgggaggctgagacaggtggattgcttgagctcaggagttcaagaccagtctgggcaacactggaagaccccatctctacaaaattagccaggtgtggtggcgcacacctgcagtctcagttactccagaggttgaggtgggaggatctcttgagccctggaggtggagtctgcagtgagccatgatcgcaccactgcattccagcctaggccacagagcaagaccctgtctcaaaataaataaataaaagtaaaaacatggataaacctggaagacattatgctaagtaaaccagacacaaagaaaataccacatgggccaggagtagtggctcacacctgtaatcccagcacttgggaggctagtgggaggtactggagccagagtcagaccagctagacacttgcggaccattctacggagacaaacaaaaaaaaattggggcggcgccgagaatttacttttggcggccaggatagaaggccaggcaaaccgcaacagtgggccccaaacccggcggttgaccgaggtggtcgtacgcgaacacgcgcggggggaataaggggaaagttagttccttgttctgtcctcttttna

SEQ ID NO: 132602 - DNA, 436 bp, Homo sapiens
acaagaaaaaaggaaatatctcttaaactataacattaatgtcaacagagactaaaaggactataaggcttataaggattaaattttataaaagatatgtaagactttagataaaatttgaaaactttattgaaagatataggtaatctgaaattaatctggacatctaccatattgtggatagaaagactcagtgtcataatgatgtcattttacctcagattgatctatatagttaatactaccttagtcaaatctcaactggttagttcatgtaacttgacaagttgctgccaaaactgcatggggaaccaatgagtgaagggccaagaacagttaagacactcatgaagaagaacaccatgttggtgggacttgtcctgtacagatttattataagaccatattaattaagacagtatggaaatggcacagg

SEQ ID NO: 132603 - DNA, 938 bp, Homo sapiens
gaagagtcctaagacacatcccatcctgagtgcacagccagagctgtgtaatatgtcaccagtcagcccagcttcttaagttccaagcccatcatgtctcaactctataggtgcattaaacttgaagcgtgtcaggggctgactggaaatgtcacctgaaagctgtaggaaagacacctggaactgtcacctaccagttttccttggcattgtgtcttattagctgtgtaacctggcagggcacttctcagggctcagtctccctgttttaatattacatggataaagtaaaaacaatttcaaatgtgaattataaagattataagagataatcatgtgttcttggcatatagtaacaaatcaataactgtgagcaatgattattagatttagatgtttttgttgttttcctgaaaatgttgtctattagtgagatacgttggcaggtgttcatttatcaaacccagtgtttccaagattttctccttataggaatcactgaggatatttatgagacctagagatccctgtgcccttttttagaattgtagaggatccaaaacagcccaggaactggtcttaacaagttttccaggtaattcttagggctagtaaaatgtggaaaatactggaaaagtgagtttgatttatgggaatgaagagaaaaagagggtacatttctatcatagagcgttcccggcatgagcatgttggaaatatcaatatttaggggggttccttgtttcatgtttgtttcctgacataatgagtatttgtgcaagaattccattgttgtatttttccttgacatcttctttaattatctaattcaattaggtgattgatttagtctgcctcttacttgaatttttgttattgctgcataccccattgataagtataaaaatgatacgggaatattaaaaaggacatttata

SEQ ID NO: 132604 - DNA, 201 bp, Homo sapiens
ggctctagaggctccccgcatccaggcgcacttctggggaactataggaaggccccctaaactggaactgagggattgcaaaaggattctaaacagagatatagagattaaatgggagttaggttagcaaagagaatgaagagggctggcagacccaggaaagggaagatgccagtatggatggaggagagcacaaaggag

SEQ ID NO: 132605 - DNA, 268 bp, Homo sapiens
gtttctttctgggtgttcattcacctaacgtgttttattaacatgttttattgtgcatctcttttccatgggaactgtgtgatgaaatctgtctggcagactggggaactataggaaggccccctaaactggaactgagggattgcaaaaggattctaaacagagatatagagattaaatgggagttaggttagcaaagagaatgaagagggctggcagacccaggaaagggaagatgccagtatggatggaggagagcacaaaggag

SEQ ID NO: 132606 - DNA, 147 bp, Homo sapiens
ccgagatcgcaccactgtcctccagcctgggcaacagagcgagactccatctccaaaaaaaaaaaaaaaaaaggaaaagaaaatttcctctcgcttctctggccttgtgaggttgtggacaactggaagattttgactcaggaatcc

SEQ ID NO: 132607 - DNA, 547 bp, Homo sapiens
aggatcaagtaaaaccttatttagcctcaaggtagttattaccatctcattttgacagatggggaaactgaggcccagagagattgcatcatgctcaaggagacatagcgactgacaggaaagatctaattccaaagcctataatcttcctgtgtcagaagattatgaacagtctattcatgttcactttcataagagagacagaaataagacaggggtaatttaatcagtttctctttgcttttattccctccaccttttcccctacaatctgtaaatgtattgatattaatctaattatatggttcgttatacaggggagacacacagtgcctacattatcagattcctcagaacccacttcttgttaatgcagtgacatcagtaagcatcttagagaatcattctagcatctctgaccttacttcagtattagtactggtaggttaatagagataacaggagtcagaatgagggagacagaagaccagaggaattcaaggaccaaaaagcaatgggaaactggaagtaacttagaattttttgt

SEQ ID NO: 132608 - DNA, 604 bp, Homo sapiens
ggatccccaagagggtcctcagctatccccgtgggcagaaggcccacccattgcatcttccccttgctgtggttcagccctgtattaaactgaccagtggacatgctgccctttcagactgggctgaaattccttccctgctcccatctgcctgcctcatcctaacctctctttaagcacccagccctggtgcttccttcttcatggagcttttacgtgctattccaacccacattgatgtctcccatccttgaattcacttcagaccatcagtctccctttcctagtttagtcctatttcgagtaatatattctttttattattagatgctaccattttcaagatgtgccttcatagtaacagtatattttcagggagaagaatgacacacttctgcattattagctaatggaaaacacatgctcaaatatagtgatgttaaagaaaccaagtgagcaaaagcaaggttatgtttttaataagagaatgccttaattgtggataaaccatcccagaaactcttttatttcggtattttaaaaacacttggagaactctttcttatatccggaaagcaccacaaaaatctgtcagatgaaaagt

SEQ ID NO: 132609 - DNA, 368 bp, Homo sapiens
gccaggccacttggaaaaactatggaattctttttgaatgagtctgcttgtaatgtcactctgctacttccttggtgagctatttgaactctctgcctttaacctcccctttgttcatagggctcgtcctccagtcactactgtagaggcaggaggggagctcttatatccatagctgcttgattccccctgtattttgtctttctgttaatgcacataagcacatcatagactacataacagcagtgtgaggagttcaatacatgcatgtagacatacatctcaaccaaacttagtgtcagaaaaagcaacttcaaaattcctaattcagtgaaaacaagaagaacatggttggtccaaatgccacg

SEQ ID NO: 132610 - DNA, 175 bp, Homo sapiens
agggcaagggcaagggcaggggcagggccaggttcatctaagaaccagggacaaagccaggcccagagatgggccaggacaggtacctggcagggctagggtctgggccagggccacggcagggccagggccacaaccaggtctgtgctatagccaggtccaacacagtgcccag

SEQ ID NO: 132611 - DNA, 839 bp, Homo sapiens
aacacagacgtcgttgtgagacaggcctgaatgggcccttctgaccacctgagcctggccttggctctgctctgaggatctgaaggttcagagctcacagggaccaagggaaaaagcaagtgctgggggatgtgccactctctcattgttgcaggttgctttcccagacactcactggaaggaagaacgggaattgttagtttaagctcatcactaaagtcgcatcaaatgcacggaccttctcccaggaaggcggccttttgcattatgaaccccactggaagagctccaagtcttcacttgctgtggtcaagaactgtaaccacaggagagacgggatttcactatgttggccaggctggtcttgaactcctaacctcgtgatctgcctgcctcggcctcccaaactgctgggattacaggcgtgagccaccccacccggactacaccagacctatgattcagatctgtcagcacttttggggatgtgggtcttgccctggccttcagttcctctccagattaagaacctgcatgctttgcccacagacagatggctacaacaaaactgcacaacttggtagatcccgactgccagtggtcattctatgcagccagggccctgtcactaaaatctgtaggctgttcagtgtgaacgatgaggagtgactgacagtccaacgtcagggcaaggatgacttagggatcttcacccagaggaatactatgtacaactgttaaaatgtttacagggtgtgtaggaaccacagaaaatgcttctgtttcaatgtcacaagacaaaaagcaggaatgcaaagttgcgttcacagtgtgaaaaa

SEQ ID NO: 132612 - DNA, 461 bp, Homo sapiens
gttgtgaatgacatgtccataatactgttatactatctgcataatataaaatgttagatctgctttgttttcagacctatgattcagatctgtcagcacttttggggatgtgggtcttgccctggccttcagttcctctccagattaagaacctgcatgctttgcccacagacagatggctacaacaaaactgcacaacttggtagatcccgactgccagtggtcattctatgcagccagggccctgtcactaaaatctgtaggctgttcagtgtgaacgatgaggagtgactgacagtccaacgtcagggcaaggatgacttagggatcttcacccagaggaatactatgtacaactgttaaaatgtttacagggtgtgtaggaaccacagaaaatgcttctgtttcaatgtcacaagacaaaaagcaggaatgcaaagttgcgttcacagtgtgaaaaa

SEQ ID NO: 132613 - DNA, 175 bp, Homo sapiens
tgcatctccaaagttcatatgttgaaaatgtaatcaccaatataagggcattaggtgagacatttgggagatgattagaccatgaaggcagagacctcataaattgaattagtgcccttataaaagaggccccagagagttgccttgcccccttttcttccatgtgaggttagag

SEQ ID NO: 132614 - DNA, 664 bp, Homo sapiens
tcccagctacttaggaggctgaggtgggaggatcatttggtctctggaggtcaaggctgcagtgagccatggttgtgccactgcactccagcctgggtgacagagcaagaccctgtctcaaaaagtgtctttggacattccatctcaaccttatgcacagctacttggcagattcccacataaacgtgttctgctcgccttatgcaaagaacttcatgcataagttggcctgtcatccatcctctgctcaccactttgaggaagcccttccatgtctgtgagcctcccctgcccccctggatagcccttattctgttataaacattctcacctgggaaactcacacagggaactttagtgtgtgcacaggaagtacctcaacatcgagcaagtgtagtagcttatatagtccccccagcacaatacaagaaaaccctgcagtacattcaggctgataagttcacatcaaacgtacgctcagaccaggttgaatcacatttagcatgttgacttagttgtgttggtgactttcattaaacatgggatggttcactatgaatacttggaacatttctaaccgagtagtatagtcatactgatctgagcaatgttattgttaattttcttctttttttctgttaccctgtttcctgaatctgtttgt

SEQ ID NO: 132615 - DNA, 237 bp, Homo sapiens
cgtcccatctctgcctctggagtagctgggatgcaggtgtgtgccactacacccagctaatttttaaaaattttgtagagatggagtctcactatgttgctcaggcttgtcttgaaatcctgaactcaagtgatccttccacttgggcaggcatgagccaccgtgcccagcccttgattacattttgaaataatattttaaatctactgggctaaataaactatatcatgaaaatta

SEQ ID NO: 132616 - DNA, 433 bp, Homo sapiens
tcccattgctcaaacctgtcagactggtttctgcctcagaaccatcctcacatttattattcccactgcctggaatgctcttcacccagatctctccatggctctgtcatcctcatccttgcggctcaaatgtcacacccttagagaagccttccctgatcactgtatttaaagtagttgaaccctcaatcacatgtatatcccattatcctattggagtatcttcatagtacatatcattatccgaaatgaataagtattattgtctagaccaggggttattttgtgccattggccccgttagcaatctagtgaggcctatgggctcattctcaaaataatgtttttaaatgcctaaaatataccaagtatactaaaaatacagttactaaaatatttaaaaattgtgacttagcaatccatgtgcttctct

SEQ ID NO: 132617 - DNA, 322 bp, Homo sapiens
ataaaggaggccagagaactaaaaactgtctactatattccaattaagacaacgataacagaggtgaaaagaaggaacagatttgcgatttgcatcacaatctgatgatcagtttgatctgaatcaacaagaaaatattcatttatagatcttgagattcagattcgggaggaaaaaaacaaagggatatcacagagaatatggaggtgtcactgacacaacttactgaataaaatgaacaagggagaaggatcctgatagcaacaaagtttcaaatacctggaagggaccactggatgccatctcagaaacaggtacacaa

SEQ ID NO: 132618 - DNA, 1011 bp, Homo sapiens
cagaatcaaatgagaaaagaatgacaggcataacataatgtaagttacaggcagaacaaagcgacacctcaaatttaatttggccaataagggcacctgaaggccaggagaagtggggcagctcactgggggccagggcatgaatgggctgggggggatcagacctctttcctttgattcaggtagatgactttacaacagatgacacgccaacattcccagaaagctgaatttatttatttaccattataagccaatttttttcttgtgaacttaggactagaactcaatagatttaatactcaacctaaaggtttattgaataaataccttgactatgttctcaactttattttataactcagcgaagtacatcccttgacagaaacaaaaaacttttattttaagaaatctattaagtatttgatcaataaataattgtcaatcaataactggctagtttaacaaatttttttgtagagatggggtcttgctatctagagatggggtcttgctttttgtagagatggggtgttgcacaggcaggtagtttcaaactcttggcctcaagtgatcctcccacctgggcctcccaaagtgttgagataacaggcatgagccactgcacctggccaccctaggaaatttagagcagcccaagaaaactgcagagtgggtcagggccagaggcagctggacaggtcttggtgtacaaagtgcccccatcctgaaggggagagcaatgttttataagacagcagagggaaggtattaatagattacagcggtattagtccaatttcacactgttataaagatactacccaagactgggtaatttataaacaaaggaggtttaattggctcacagttctgcattgctggagaggcctcaggaaacttacaatcatggcggaaagggaagcaggcactttcttcacaaggcagcaggagagacagagaagagcccaggggaactgccatttataaaaccatcagatctcgtgagaa

SEQ ID NO: 132619 - DNA, 253 bp, Homo sapiens
actttccgtggttctcaaatgtaggtcatactgtcccctcagagggccactgcaaatctggaagagtgagttgaattgatatgttgcatgggaattagtactggcatttagaggatgtaaacagggatattaaaaatcctgcaaatcagcaaggcatggtggcgcacgcctgtagtcccagctagtccagaggctgaggcaggagagttgcttgagcccagaagttgaaggctttagtgcactatgaatgtgc

SEQ ID NO: 132620 - DNA, 782 bp, Homo sapiens
cactggtatgaggcatccatgtggcagacgtgtaccagtgattgctgagcatgtggattccaggtcctggccctaatgcccatcatgttgctactctaggaagatgctgccctttccaaatcatgcatcctaagttagagatgcctcctataaggtgaggaaaatcatgcctctacatcttctcatgcttcctaagcaggcttaaggtttcgttttgtgccctttgtgttggtgacagtgtgttcatttggcgtgtcggtaagctttgcagacattgtgtgttctatataaagtttcttttatgctcaatagaaggcccttaccttgtcataaaagtgtacagcataaatcagaatatctctttgccaactgttgaaagggcccatttaacactggaacaagtataactggctgtgattcatctactatgtcgacatatttgaagtgcatttaccctcactttttcctttctggaacttatatttctttcacgtggtatatttcttttgcaggtttggcttcttcgtggcatttgtagaaaactagcaaaatatgagctttgcattcccccggatccagaagccaaatgggcagactagactttgttggcactctggccctcccagcacacctctctgggcccactctccgctgggtagtggcacaatgctttctcctgcctctcccttccttctgcctttctcggttctcttcctcaaaatctacctctgcagtcacttccccagggtttacaataaacgatgggaatggccagtggggaa

SEQ ID NO: 132621 - DNA, 535 bp, Homo sapiens
ggatctactgagtcacagtgcctggtagcagttggatgttgtaagagtgaagtctgagtgggagaaaagggttgaggaatctcagctgagtgtccctgagcaagctgcataacatctccaagccttggttttcacatctgacaaatggcatgagacctgctctttagggttgtattagagattaaatagtcacataaggagtactgagactgtagtatgtgctcagtaaatattctcttttctctctccctctttttgggtatgaaggtagttgtagttgtaaaattttcttccacacttaggaacagatatttctctaaatgtaagccccctgggcttattctagtttgttcgtacatcttaaaaatggaaacctcagactaaatatagtattcaagtataaatcccactactgcctagataatggtaaagacattacttcatagtctttgcgtgccttgttcccattaatacatatcatgtcatgttagctgttttataagacagttcattgctgattcatctcaccaattca

SEQ ID NO: 132622 - DNA, 293 bp, Homo sapiens
ccttcctcccattgctctagcgattctcctgtctcagcctcccgagtagctggaactacaggcattagctactgtgcccagccttggtttttcttttgacgcagagttttgctctgtcacccaggctggagtgcagtggtgcagtcatagctcactgcagcctcaaagtcctgagttcaagcaatcctcttgcctcagcctcccaacgtgctgggatctcaggcgggagccacagcgcctggcccaaaaccaagctttcttatcccaagcaccgacctttatcaagtctacct

SEQ ID NO: 132623 - DNA, 414 bp, Homo sapiens
ggcttgaattgtgcccctccaaaaagacatgctgaagtcctaaccctgtgaatgtggccttattggaaatagggtctttgcagctgtaaccaagttaggaggtcacaaggttgggccccaatccaacatgactgtgtccttatgagaagaggaagacgccacgtgaagacagacacgcagggaggggaccgtgcgacggtggaggcagacattggagtgatgcatccacaagccaaggagccccaagtgtcgatggccgccaccagaagccagggaggggcaaggaaggactcttctcagagcgtcagaggaggcgtggccctgctgagcttaactttggactcctcgtctctaaaactgcgagaggatacatttctgtggttttaagccactcagtttgtgatactttgttac

SEQ ID NO: 132624 - DNA, 654 bp, Homo sapiens
gcctgggcaacaggacaggaccctgtctcaaaaaaaagacgaaaagcaaatcccatttctaactcaaaaatccccttgcaggaaggaagcaacacttgctaccagatttccaggcatccttccagagagactgtataaataaacatatagaggataaggaatgctggacagttgcttcttttctccttttctgtaccatgtttgtttccacttgctggtataccttgtagatcctcccatatcaggacacaaaaaccatctcatcgtttttaacagctacagaatattccactgtatggaattcctaccattaatttagccaaccccctatctggacatgtgattgctacattctgttgttatcttacaaacagccattaattgaaaatccataggtgcaagaacatctgtaggataaaatcctacatataaagttcaggggtcattttttctatatacattttccaacaactatttgatgatgggctataatctataatctgcttttgctagttcatgacttttattagattaaaatcagctggtcttgaactcctgacctcagttgatgctcccaccttggtcttccaaagtgctgggactgcaggcctgagccacgcacctggccttcacaggatttagataatttactag

SEQ ID NO: 132625 - DNA, 288 bp, Homo sapiens
  misc_feature (16)..(16): n is a, c, g, or t
ctgtgtgttcacacanttccccacccagctgtggtctttctaatccaaaaataagagtattcaccttcaaaaacaacttcccgtggctgtaaacttcaattataacaacaacaaaaaaatcaaccacctttctgtgattgtcattcctccctctgtgaccccatctcacaccacttcctcctgctgcctgttctttcaccacaagcccttcagtttatccacctgtctaaaggccttgtatgctcccttctctgtggctggaaggcctttagacaaggtagagccgag

SEQ ID NO: 132626 - DNA, 434 bp, Homo sapiens
gtaaagtggacgtacatgcggggttagagagcaacccagaagcaggaagcatgagccagagtccagggtgctttggaaagatttagatagggggtagggcccatccttctctgtcataggaagcaggatgtaaatggagtttctctggttggctggaggttgaggaagtttgcttcctatggcttctattctcatctactgaaatgtgagaagaggcagtgggaatggaaaagctaccatgggagtgagaggagaaactcaagataaatgaaggaatttctgcaagcagtgtggaaagctgaactgaggctggagccatgcatttggggtgacatcagatcttcagcggagtgctttttttttttccagcttcacttaataatgtgaataaagatgattttggtataggaatttgcaggatggctaatagtgga

SEQ ID NO: 132627 - DNA, 278 bp, Homo sapiens
agaagggctggaacttcaggcatcacttaggacttggtcagccaagtatgagttgtaatcaagaaacagagatcacacgagggcaaacagaagagcctgtcagtgaagaaagacatgaaagaaacagcaaaagaaaaaaaatctttcagattatttgcagcatcaccgtatctcctgtggacctggtgggcagctagctggacctgggcagatcaccatggcaggaagccttgcccttgaggagagccaaagagtttgtagtgctcttgagactttta

SEQ ID NO: 132628 - DNA, 555 bp, Homo sapiens
cagtgctcaagtcacacatcttatgaaaattaaataaagcaaaaccatgtcctccatcctgtgtttatccagttatttcctagtcctcctatctatcagtaaacttcttgaaaggatattatttttacttatatcaaacagacaaaagtcttctgtctggcttctttaatggcttcaagaaagttgttcttgcttaagtttctaatggccttttaaataccaaatacagtaattacttctcaaaatttacattacttagtctctttgtgacaactgaggttcatagtcattaattccttttactggctgtgcctggtttttgaatgtcattctttggaattaactccttgattactttcatttcttagtctagacattttccttgggtgattttgtccactcacatggattctactaacacctttgattttgcttctaaatttcaattttcctctcagatctactaatgcctaactcagttgcttcccggacacatctgtctcaaatgtccttcaaacttaatatgaccaaaactgaacttgctatctttcctcc

SEQ ID NO: 132629 - DNA, 698 bp, Homo sapiens
gctcacaaggattaactcactgattcaggttagagcttgcgactcaaccacagtcaggattgactgagattcacacagatgggcagaaaacatagtgagtctcctgcacaaacactgaaaggccttttccaccaggcttatttaccaaaaaagcagtggcctgctaaagaagatatttatcctagaagcagtctttaaaagatcaaattcaaaagatcgttctctcacaaatcttattattgctaggcacaaaaaaatgtatttgcataagtaaatatagtcagcactgaagcagtatgaaaatgtaagcttttactggcaagtagtcaacaaaacaaaaagcaaatgaaagctaaacctctgttgctcaggtgcaaacaagaatactagaataaaaggtcaatagaacttttgttactgcccgtgtaaactaaggcttcctaccaaaatgttaggcttacagagccgtctactatactgaaagcatcgtatcatgttgatttgagtgcattttctcaaaggtaagcaagtgaaaagtatagtcctgagggtcagctgaatggagctgtgacaaatatcctgctggaaggtaatcttcaatagctgctgttatcagttcagtatatccaaaagtgttcccacagattaaaaggcaaagacatatatgtgttattttagactcaattactcctacttaa

SEQ ID NO: 132630 - DNA, 490 bp, Homo sapiens
taagctagattcattatgccatccaatcagatggatagggattgttaataaataaaacataaagacaaggcggtcttttcatggaagaatctgattttttttaaagaaaatttccagaaatagcactggacttccatttcagttaagctgcactcaattcacccaaaacaaccccacattgattgagcatcagtattgtatgccaggtactatgtgacatggacacaaacacaatgtgagatgtgtttgtgagatggacaaacaaaaatgtgagacacaaaaatgtgagatggacacgaacacaagtaagaagtaatgttgccattaaaccacaggctctttgagggcaggggattttttcttattcgccattgttttcccagaacccattcctgcctggcacatagtaggtgctcagttaataagggacaactgatgaaatgaccagctcaagcagttcgtggtctcctgctagttaaaattaagtgac

SEQ ID NO: 132631 - DNA, 239 bp, Homo sapiens
gaacaataatagctaatgtgaacaaatcctcccattaattccaaagaattttacaaagaatttccaaaatatttgataaacaagatttctttctccaatgtttttaaactgttagaaccagccagaggtccaagaagcctacttcattaggtatttcctctccaagtcatttgtaacaaaagtacataagacagatggatgaaggccaggtgcggtggatcaagcctgtaatcccagca

SEQ ID NO: 132632 - DNA, 574 bp, Homo sapiens
cactattaaaatctttccacatgctccagcacaattggataaaatccagatttcttcatagaatataaaagaccctttattatcatacctaccttagtaacctctgttcctgtcagtacttcctagtctttcagccaagctgaatttactggtaattccctgaacacatcatggtttctacatgatttctacatgctattcttcctaactgtaatactcttttacttcccacctatccctctaattgtacgtcatttttaaatcaccttatgtcaccacctacaaaattttatattagaatttgttatcatacttgtattgtattatagtcattttgcttatatgtcattttttcctattgtgagctgtttgaggtcaggaactgtgtctttctttgtattcccagtacttatcaagggtgaggcatacagtagtcatttaataaatgtttgagtgtttaaatgaactccataaaaactgaaaatacaaattaattccatggtatttcattttcttttccaatatagttctcagagttgctaattaataataaaaaaggccacagatgagaaga

SEQ ID NO: 132633 - DNA, 668 bp, Homo sapiens
gatgtagccacttgagtgcgccactgggaggaaaatccttagcaggattaagtttattttaggatttggctgtgtgtatgtgtctgagtgggtatatcatgtgggatctcattttccagaataagagctaggcctaggccatttccgcatcttttacatacctaggtttttacccattttttgaaattgggctgatattaagtcccatttagcttttacaaaaataaatatgttgacttggtgtgcaatataaacagaatggcccatttaaaacagcaccatagtttcctaggtcttgatatctgctatttttactttattagatatgaattactgactcagaatccatttaatattttataccgttattactcagaaaacctaatttgcattcttgtctctcatgttttaaatttttctctggtggtaactggcatgtattaatattttaagcatcaccgactggctgcaagccgaaatgaccccaaacattctggaactacctgttctgcctaatttgccagtgagggataacttaagcccagagagggctgcatataggacagattttttccttaagcacccataactttcttttttaacttttattttaagttcagggtacaaatgcaggtttgttacataggtaaatgtgtgtcatgggggtt

SEQ ID NO: 132634 - DNA, 496 bp, Homo sapiens
gctggtctcgaactcctgacctcaggtaatccacccacctcggcctcccacagtgctgggattataggcatgagccaccgcacccggccgagggtttatttttctcacctaaaaagaagttgggaggcaggtggctgcagggttgatttattagctcagtgaaggccaaggaccatgctcagccgtcctcttgctcttgctctactggcctccgtctatcagtaatgtctcccctcctggccacaagatggctgccctggatccaggcatcacatcctcacacagaaaaacatgctagacaggctctccttcccttttacagagaggaaaatctcttctagaagtgcccccgaaagaccaactttatgactcttgagccagaacttggtcacatgtccatccctccagcacatttcctgaacgtctccacttccttactgcctaagtttcctcaaaccactgtaaactagaatcagtacctccctcccaagaattg

SEQ ID NO: 132635 - DNA, 738 bp, Homo sapiens
atttatcagctgtgttaagatataatttgcataccataactttcacccattttatgaatacagttcaatgattgtttagaatatttacagagttgtgcagggtcaccacaatctaattttaaaatattctcatccttgcagaaagaaacattgtacctattagcagtctaggactttctttgtggccacattctcacacttaggatttgactttcatcttcttaagtgaatttctttttccttttctttcctccatatttatgcagtactgaggagctctttgtgtattattttgtgaagccccagaagcttcttctttcctcaagttgctttttttttcctaagtagcataagtaggaaagagcagatggagctccaaaaattttggaagtaataagtgcaatccagtgctgaggtatttgctttcatatgaaattgctgcactgaatctatatcaagaagaaaaagcattcctgacctttgccctgccactaactctgatgcgctgagtgacagtatatatctttcctcatatatctgctattgcaaaaattaaaatgtaaatgctaggattctgtaagattatgcagatttggaacaatctctagacaatgctaggtcaataaaaaacatttttgacagcttgtgacagatataatctgactactgtgtgttttagactctttaaaggtgacctataattattttccagcaaactaaatatatttttatcagcta

SEQ ID NO: 132636 - DNA, 686 bp, Homo sapiens
cctgcctcagcctccagagtagctggattataggtgtaccccaccacaccgggtcaatttttaggttatttttttataggtcttgctatgttgcctaggctggtctcaaactcctagcttcaagcgatcctctcaccttgacctcccaaagtgttggcattataggcatgagccactgcttctggcctaaaatgcttttaaatttgtttctcctcgaatcagtgaaaaatcctttgccacagagttttgaaaaaagtatcagaagcagtgtgtatgcacacactgttttgatttcctctgtgggatggttcttggctaatccctttgaaaggaagtatcagaacctgtctgtccattgcatgcaaggctgggaaggaaagcagtagccacacaataggttacaattagaacactgaataagaaacaaggaagaattccttccatgcctaagagagatgcataaccttagggtgaccatatgtctacttgcctaggaaagtcctggtctaaatgttgtccctcccataggattgcaatacactaatgcttttttctgagtgtttctccctcacataggattccagaacaatcctgctgtggtctgattgtttgtccctcacatagggttccagacactgctgctagttctgagtgtttgtccatcacagagcattccagacaccggc

SEQ ID NO: 132637 - DNA, 778 bp, Homo sapiens
gctcactcttgggtgctgaccctgcgattgcacaacactaaaagtcagtacctcaaaccaggcagcgattcagggcagacctccttatgctgcttcagtggaagaagtggccaaagaacctaagtcaaaatctgggggatcgaagtcctctgctatgtcttcagacaggtccctggctgaaaatggagcgatggccgaggagaagccaactccccagatgaacgggaccccaggtgatgacagggctcccagccactctgaaagtgccttgaataatgactctaaaatgtgcaatacaaatcctcattgaaatgcactaagtacagacagcccttgccacacagaagctgctctggaggcagctgtcttaaataaagaagagtaaacttactttttatagagagtgaaggatgctggaagggtaaggtatttaggaatatctggagagaaagaacctgcagttatgtacattttgtcctttctgtaagagaaaaatgaggactttggaaattcagatccctctttgatatcagagatttaaatgatacatttttaattttaaccagttatagtcaaaatgctacaataaaacaaaaaagagaaagaaaatgaagagcatttgactcccactcttaaaatgaagtacacataagctttaaactggttatgacaaaagcctatagttgtgtttcttgaagtataaagaaaacaaattttggcagtctttaagtatatatagcttaaaatataatttgtagcatttggcaccatatgtatg

SEQ ID NO: 132638 - DNA, 205 bp, Homo sapiens
gccctttacacaaaagggaacctcctcggccgctgtgaacaaaggctccgctctccgaaatgtttgatttgtttactcgggagcgtgagcctggtcaggcacatgtctgatactggggctatttctctgcggccatatgtagagctgtccaggtctctgcaatttaaccctgcgcttcatgccagaatcccatttcctaacttcc

SEQ ID NO: 132639 - DNA, 604 bp, Homo sapiens
caaaaacaaacaaacaaacaaaaaaattatctggacatgatggcatgcacctgtgtagtcccagttacttgggaggctgaggcaggaagatcattgagcccaggaggtcaaggctgcagtgtaccatgatcacaccactgcactccagcctggtctgggcaacagagtgagaccctgcctcaaataaacaacaacaacaacaacagaattggagtattagtgactaagatatgcatgcatctgacaatctttgattgactctctaggcctggcttccttataaatttctttgtttcttttagttttctatggaaactggatcagatcaaatctctctcctgagatccaaaggggtctacagggtgtgtcagtgacagggtgacatttcaccagacttcttggtaatccagtagctgaataagttggattgaactagatatctatctgcctttgctgaaatataaatgaaggcaaggaaattcggagtttggtcttccgattcatacccctagcagctgatgtaatatttggacttggatctcaaattcatgaggatagaccctaagaataagattcttctagctgtgggaagaaacaaagagtg

SEQ ID NO: 132640 - DNA, 646 bp, Homo sapiens
gtcacatatatgatacctctctggatcattttatattctcttcatttttgttttctcattttgccttccctactagccccttttattctttttcaatttttattattattattatttttgctattcagtttcttgtaatttattgttgggctttaaaaatgttttctttctaccaggaaaatgaaggcagaggaaaggtatgataggaccagttgattgtgttactttttaaagaacctctggagctttagtttttatgaaccagattccttttcagcacaccatcccaccgtcaagtttggtaacaaatgagaaaacaaatatcttcagtagtggttctacttggctcagtcttgctccagtttatatttagtttgtcctgggttttagtttttcagaaacaaaagcttttagccaaataatgaaatttctcttgtttgggctataggggtgtgagataagtcttaggagctataattttatgtgaaattggcccagaatctagcataaggggcaagcttttaaaaaaagcaacagtccttactaatctatcagcagtgaacacaaatgccacacaaagactacattcatttattgtgtcctggagaacaattactttacaaagtcgtgtggctcaaagtggtat

SEQ ID NO: 132641 - DNA, 445 bp, Homo sapiens
ctgggtttgggatggatcaattctgagactggaaaatggccaaatctttgcaaatgagaaatatttttcttataagttcttattgtaggcaaataattacatagattattcatcagagaatttttaaatgctcataatctcaactctttcatttacaacttgtatttccaatagtttatgggtcatctctgcatagatgtcagaagtcacctcaagtttagtgtgtccaaaatctaactcacaggtctgtttctgacctcccaacttgctttccttgtgtttttcctatgctaatgatccaccataatcaaaataattaacatttatccagtgcctactatgtactattccctgtcctgttttacatttactcatttaaagtccataagaaacattaaatctcatctgccttctgaagaagatacaaccatgctctcttttacaa

SEQ ID NO: 132642 - DNA, 245 bp, Homo sapiens
aggaactttttgtttgtttctttgtgggttgtctgtttatcttaaggaaattgattaactctttgagtcaccatgggatggtgaatcgggtttgaaattcagcttccaggagccatccccaaaatcacaccgcagaactgaactgatgagggaaccattgggagtgaccctgagctctggacacttcaattggcccctccactttaacacaaggaacttcacccaccctgccactactactgctg

SEQ ID NO: 132643 - DNA, 395 bp, Homo sapiens
agtgttgcagagaagtcagacaactgatagttattataaagaaaaatgttctgagagtgaggtaaccgcttaagggaaggaagcctccttctgtcttattcactaatttacaagaagataattgtgttacacttccttaggagtcattcatttgtatatttgacacttttgctttatgaacatgtgaagattattcaaaagtaagctgttggtgatttttttcttccaagaaagcatgccacagggcaacttctagggttggttctcatctagtcctgtgctccacactatctgcatctgcacttaagtttcaatattagataactcacatgtttaaactatgaagaaagagttaaaacatcctgagaatgctagtaagtatgtatttttgaaag

SEQ ID NO: 132644 - DNA, 297 bp, Homo sapiens
tctcatcagctggagttgacaagccctgggccaaagaactaaaggttctacttaggtggagatgtaacggtgtgccaatcattggaacgtgcaaatctgttagcacagatgtctcaacatgcatcaatgcaacacacacatgatgtcatctttaagatgtgaggaggaacgggaagaagaatacgagaggaggagtggggcctgcagtcaaggagaggctaattcggtttgggtgggtggaaagcggggctcgtgcttgcaccaagcctccatctccctggactgggagtcagcaag

SEQ ID NO: 132645 - DNA, 420 bp, Homo sapiens
ccttattcagagcagtgttcctgttttcagctttagagacttgatttatgtaccccccagcctgcttagagccaaggggttgcagcagcctgctcccatctgcagcccccaccatcctcccacagtgggctctggctctaggtgggtccagggctgggcatcgcgggtctgcagcacatcctcctcagtattccagtgcagctgtctgaagttttttctgctgcgcctgaactgatgtcatttcccccttggcagacagcttcggctttgctgcgtctgagatatgtcacgagaaggtgggggtgggccagagccaggcagggggagtagcgaggagagcaggagacagtgtgcctgctcggtcccaggactctgtttactttgtctgctttgctaaagaaggccggtgaaccaggacca

SEQ ID NO: 132646 - DNA, 568 bp, Homo sapiens
tgagtccatgtctcacatccaggtcacgctgatgcaagatgtggtctcccatggcctttggcacctatgtactgttacttgatggcaccttcagaaattgacatcaagcttagtctttgatttgctttgactaatgggatagtaacaaaattgaagcaagcagaggcctgaaaaaaaaaaaaaaaaaaaaaaaaaaaaaaaaaactgtggtggggcgcgcgccccgcggccccccggaaaagagctttttgtaagaacccaatgtgcgctgtggggccgcgcgcgggcccccagaagaggtgtagaggggcacagtgtggcgccatgaggcgggttcccaagggaagaaaccgggggtcctaggaactaaggggcgggggattttctctcccccaataaaaaaaaacgcgcccggggggaaacccagagagggggtttttgggaaacaaatcccagaaaggggaggttctaggaggggcacaataacaggggatctctttctaaaagggggagtccacaaagggggagctccgagattttcagaatttacgccccgggttgtgtgtga

SEQ ID NO: 132647 - DNA, 256 bp, Homo sapiens
attcaatttatagactcatcacactttgtcaccaaatcgggtagtacctacagctgagaaggaacattacaaagtctttgtattacggtgcttctttaccttctatttacaaagaaaagtgttggagtaagactttaactttattatggatatcaattcctgaaaaagctctgtgagttagtctctagtgcaaaattcaaagctcaaaaaatttacaagttttttgtttttgtttttaccatgataattttgatca

SEQ ID NO: 132648 - DNA, 608 bp, Homo sapiens
gaaatgtaactagaaccctgaggcctttttgttatctgatcccttagctcccacccaccttcacatctgtgactttctctcattctttctctccagccctgagactgttgttcctctgatgaaggccccacactctccgggcagccacatctctagccattttctctgcctgaaatgattggtcaattatttttccttctaataaatgcttttgcacccttaatctgcccatttaatggcctcgcttccctgctcttcagatccccccgtatgtgcctttgctgtgtggttgtgttgttccatagctccgttctgtgtgctcccctggagagggaggggccgtgtctctcctgtatgtcctgtagttaacacagggcctgtcacttggtagacactgactcaataactaactgtacattttcttttgtttaaaacaaatgaatgcttctcttagtattagacaagagcaaatattggtaaattgatattgtaggtctataggataaatacatttttaagccctttctagaacagttttacctttggtaagtatcattcagccattgctaagaggcttgcacaataaccctggctactttctttatagt

SEQ ID NO: 132649 - DNA, 225 bp, Homo sapiens
cttccttccttctttttttttaaattatcgtcttttaaatttagatggataattaagaatgcttccaatttaaggttctaagcacaaactccagatacgtcatgttatggacttgcttcctgaagatgaaatcagcagttgatggaaagaatccacaacacgcctacagaacagcaaatcacaaatggctgtgtctccacgaagccaggagctttgcatttgaag

SEQ ID NO: 132650 - DNA, 411 bp, Homo sapiens
tttgtatttttagtagagatggggtttcaccacgttggccaggctgattttaaacttctgacctcaggtaatccacctgcttcagcttcccaaagtgctgggattataggcgtgagccaccgcgcccaaccagtggcaccttttttttgtcttcctcaagggatctcagggttgtcagaagtcccatctagacccctttaagggttatcaaaggtggcaaaaggaagaagtagaaatacatggaacaaccagttttggagaagccaatttggagagattttaagcttccccaaaaggctaatgaaattttacattttcaaggcagggtgcagtagttcatgcctatagtcccagcactttgggaggctgagggaaaatgtaccacttgagcccaggagttcaagatcagcc

SEQ ID NO: 132651 - DNA, 112 bp, Homo sapiens
ctaaacaataaagggaaaaatcaaagaaagaatagtcttctaggggtgacagttggtgttttagcacctgcctttatacctgggaggcagagatcacaggtggttacatctc

SEQ ID NO: 132652 - DNA, 338 bp, Homo sapiens
aaaataaaattttgattaagcctactcataactgagattggtcttccctctaaggcatcaaatttggggaatttttattataagttatatataagaaaatgacatctttcagtgggaagtaaatgagcactttgatatctgtggaataggagtgtctccttcttaaatatttgagtgtgcacataacaacactcaatatctcttccctatattggaaccttgaggtccaatgaccagaatgtatgaacaaacagaaatcaccagattccatcccggcaataagaagggttctcataagactttcagtgcttctatcctcacatgctgtgtgagctagg

SEQ ID NO: 132653 - DNA, 224 bp, Homo sapiens
atcagaattatatggtttattaaaattttaatatggatataataatagcaaaataataactgaaattattgaggtctgaattaattgttgagacctaaggtctggcctaatcgactcaaataatttaaattgaacatcattaggcagtaaatgtgaaatcactattgttgttttattattgatagaatcactctttcttcccaaactttggagttttaataatt

SEQ ID NO: 132654 - DNA, 834 bp, Homo sapiens
gacagggagagaccagcttgcgccccggccactgggatcgtgaaggaatctcttctgagggtgaagtaagctcggctgggtcggcactactcgccctccttgaagccacctggacctgacgctcttgcccagactcttcctgcctcctgtctctgttcttcccccttctctgcctcgcaaactcctcttcatcctgcaggacacaacttctgtcaaggagttattgcattatattatcatttatccattaatgccgactgcccctgggattatatgcaccttgaggttagacttaagatgtgttggcacaattattagagtcaatcgcagtgcctggcacattaggtgctgctccagatttgtttgcagaatgaatggcttgaagtaactggacgtataaatgatcacagcatcaccgtcatcagtcactgtgcaccaagcacctcacctccatcatctcatgtaatctttacaccaaccctgcaagggagggttttaaaatcactgtcttacaagaggaaaaactgagcctggaaaggttgaaggcttgctcaaggcggaagagctggtgaatgataggaccaggtccaaaagatgttttctttcactggcatcggttctgcctcccagggcagactgtgtggcactcatctatgtacacccctcctcccaggacccagcataatatgtgcacaaaatcaaatgactgaatgagcgaatgaataaatgaatatgtaaccactgtcattttcacatcaaccacgactgagctaaattccagggccaccgtgccaagccatattggaacccaagcaaaaggaaaaatgtgcgcct

SEQ ID NO: 132655 - DNA, 688 bp, Homo sapiens
ggaagctgtatcagacttggcaaaaatcagcagttcaaactcatccatagagaaccaaattcaaaaggagcctactgcttctgtttgttttcttttgttcatcttctctggccttctctgtggagatggcaccttcacaaatggccttagaatgccgttctgaagttcaacagaatgagacaaccatcaaatgaatatcagaggtatttattattgtcacagcttacctaatattttaaagaaaaaactagtaactaatgtttacaagtccaagtagacatccagcccatgtagaatatgtaacttacacaagggtttgcatctttcttttgtaacgagtgcggtacgcagccctgtatatattttacaatgtctttacagaaaaaaaatcatttaatgtggtgttgtacaataatgcatttttctaatttttttccattaaaatctctatggcacgtttacaaatgtatcttggtctttcttcactgagaaaggttggacaagacctgctttgatgcctcgtcttcctgcctgtaaaccacattctgaaagcagagtgcaaggtggacagtcctggctgtataccctgtttgctcttggtcttcctcattgtagacaggcctactcggaggcctttcccctaacaacctcggtcaagtaaggaatttgccttaaaatacaaaactat

SEQ ID NO: 132656 - DNA, 881 bp, Homo sapiens
ggtttctctgtcgttcgtctgtctgctgtggttttcgttcttgctgtttccgatctgtcgtctctcggctgtcggtgtgcccctggttgtcgatcgtctccagtgctgctcttcgcgttgctggggtcgcccgtttccccccgtgggggttttggctcctggcccctgtaagctccgatggcgccactcactgggtttttcaagccgcgcttccccggcctttttttttggggaacccaccaccttgtatgtagccccgggtttctctgggaaccgcttggcccagctgtccctaacacaatctgggccggggccccacgagagtgttttgaaatctcttccgccacccccaaaaattttttttttttttttttttttttttttagaatatcagaggtatttattattgtcacagcttacctaatattttaaagaaaaaactagtaactaatgtttacaagtccaagtagacatccagcccatgtagaatatgtaacttacacaagggtttgcatctttcttttgtaacgagtgcggtacgcagccctgtatatattttacaatgtctttacagaaaaaaaatcatttaatgtggtgttgtacaataatgcatttttctaatttttttccattaaaatctctatggcacgtttacaaatgtatcttggtctttcttcactgagaaaggttggacaagacctgctttgatgcctcgtcttcctgcctgtaaaccacattctgaaagcagagtgcaaggtggacagtcctggctgtataccctgtttgctcttggtcttcctcattgtagacaggcctactcggaggcctttcccctaacaacctcggtcaagtaaggaatttgccttaaaatacaaaactat

SEQ ID NO: 132657 - DNA, 693 bp, Homo sapiens
tgctgggattacaggagtgagccactgcacctggccaacaaaatgatcttcgacgatgcatagatgagttagataaatgggcattgggtgccggggggaaaaaaaccccaccttacttaaagacttcatgtgcattgaagacttggaattttttttttttttttttacattttcctctttttagccacatcttatgcaacatggtagcacacagcctgagaaataaagcaaaatacaagaggtcagaagttcccctgtggaatccagggcagaaatttcacaaagaaatggagcgatttaggacaaactcctcaccccaccccctaccgttactgtttgcttgccttgattttttttttaattgttgttgtttttgagacagcctcgctctgtcacccaggctggagtgctgtggcatgatctcggctcactgcaacctctgcctcccgggtttaagcaattctcttgtctcagcctcctgatttcaagcaattctcatgcctcagcctcccgagtagctgggattacaggcacctgccaccatgcctgggtgatttttgtattttttagtagagatggggtttcaccatgttggccaggctggtctttaattcctgacctcaagtgatccacctgcctcagccccccaaagtgctgggattataggcatgagccaccgcatctggcctcctg

SEQ ID NO: 132658 - DNA, 354 bp, Homo sapiens
agttcgacggagactctcgtactgagcaggattaccatggaggatcgaaacactgcaaggatagactatttgaagatgacaatgatgtgaacatggagacaaaggcagaggtttaaatgattatagaggaaatttgcttgataatttattatatgaatatagagagaaatcacaaaaatgagatgatgaatattggaaataataagcacagacgaactgattagaaaacaaatagaactgacaaaatcaaaaagctggatcttttagagagatgctgctcagtaaggtggccacaacccacgtgaaaattaaattaaaaattcattttctcagtcgcacgagccaagtttccac

SEQ ID NO: 132659 - DNA, 521 bp, Homo sapiens
ccctacaaatctactcaagagaaatacaaataaggtccatactaacacttgtagatagcaacattacctcgtttatagcaacattattcataatagccaagccctgggaacaattcaaatgttcatcaactggtgagtggataaataaaatgcagtacatttataaaactgtatgctactcagcaatacaaaggaacaaactactgatacatgctgcaacatggatgaacctcaaaaatgttgtgctaagtgagagatgcctgacacataaaactacatatcccaagattcctcttatttgaaatttcccagacaaggcaagagacagaaagaagttcaatggctatctggggctacaggtgggaactgattgtatactggcagagagaccagcctgaccaacaaaaaaattaggtgggcgtggtggtgcatgcctgtaatcccagctgcttgggaggctgaggcaggagaattacttgaacctggcaggtggaggttatggtgagcagattgcaccattg

SEQ ID NO: 132660 - DNA, 745 bp, Homo sapiens
ggacacccgtgcacatacacacggagaaatacacccggtcacctgggaacacacgtacacgccagcctttcccccaaccactccgggacacacatccacagaccccaaaccaaatcctacacccgaatgattaatgtagggaaaacaaaggcgctcccatgacttgattttggcgacctctgaagttccacctagcagaacgtgtttgctcgatgtcttacgaccactcgggtgaggaattcggaaagtaaagccaatcttagaggctgcaggcgttttgggggcattatctgattcagacgctggctaacgtttcacaatcgcgttcccttttttcttccaacttggtaagtaaaaaggcaaaatgagaaatttaagtgctgaacttaataaatagttggtggacgtattgcttttttttttttttggtaagggatgacacatctcgtgactacagttcttttgaggaataacttttctgctagtttccaaatcggcacgtgaccacaatcttttcataggattttagcgtcctgataaaaatcaatgggcagaatttgattgcttctttaaaaatgtgtttgtccttcggtctctggcaccattgtaatggaaaatccctacattgcctgtactctcagaagctgtccagtgtagcaaaactagagataaagaaacctggaacgattcagttaggaacttttaagaagccagcctttagtttttcctttagaagattatgaag

SEQ ID NO: 132661 - DNA, 368 bp, Homo sapiens
tggagacctaagaaagtcatgaattataaaacacctaactcaaatcacgcagttggcttgcaattataagtggtattagtgaaacaagactgtgttgggagacagtcgcctatggtcctgtcatgtttccgcatgtcttatgggtagaggcagtgactactttcgttctagactaccttttcataaacatctgtataggggacagccttggaggatagagctagcatctcccaccagagcaaatggcagggatgtgtaccataagttcaaagattcagattccctaagctctagggtcctctcctggaacaaaaaacactggctgtgcaggtgacacctggctcgctcgctctcaccctgtgggaatt

SEQ ID NO: 132662 - DNA, 325 bp, Homo sapiens
tgtggtggtacatgcctgtagtgccagctgcttgggaagctgaggcgggaggatcgcttgatcccaggaggtcaaggctgcagtaagctgagattggaccactgcactccagcctgggtgacagagtgagaccctgtctcaaacaaaaacaaaaacaaaactacaagagttatatatacatacatatttacacatagacacacatacatgtatacatgcatatgcacacagacgtacatgtgtatatctaaaatgatcttcaggaatgcacagcagaccattagggtagccacctcttgtgggaagaggggtggcagatcttcat

SEQ ID NO: 132663 - DNA, 344 bp, Homo sapiens
gagactctgtctcaaaaaaataaaaaataaaaacaaaaaaactagaatgggagctttaagttaactttggttaggcattgctaaatgatggggatacattctaggaaatacttcatttaggcaactttgtcattgtgtgaacatcatagagtgtgcttacacaaacctaggtggtatagcctgctacacatcagggtaggaatagcctgttgcttctagactacagacctgtatggtattttttttttaatctccactcttgagtatgtctttttaatattcaatgtgatgaaactgaagtatgtagaaagttgcataccaaagtatgatagctgtcttgagga

SEQ ID NO: 132664 - DNA, 416 bp, Homo sapiens
tctcaaactcctggcctcaggtagatttatttttaaaaagcagtttttcagcctcagatattttgttacatagactcgtctcagggcagtaattcatgagattgaaaatacagggccgggcgtggtggctaacgcctgtaatcccagcactttgggaggccaaggcaggtggatcaagaggtcaggagattgagaccatcctggccaacacagtgaaaccccgtctctactaaaaatacaaaaattagctgggcatggtagtgggcacctgtaatcccagctactcgggaggctgaggcaggagagtggcttgaacccgggaggcagaagttgcaatgagccgagatcgtgccactgcactccaacctggtgacagagcaagactctgtctcaaaaaaaaaaaaaaaaaaaaaaaa

SEQ ID NO: 132665 - DNA, 302 bp, Homo sapiens
gcctgggtgacagagcgagactctgtctccaaaaaaagaaaaaatttaaaaaagcatagagacagcacatggatgctagcactgaaagccccctcagacactagcccatgcactgtcccatctgtcagacaggaaaatgattaattcactcattcattccttcatctaactgcaccgggttctagggatatagcagagaagaaaaatacatgcaatccctgccctcaggaatagtaagtcagtcaacatacaagaagctcttattgcccaggctggagagctcttattgcccatgctgtagt

SEQ ID NO: 132666 - DNA, 485 bp, Homo sapiens
cctcccaggttcacatcattctcctgcctcagcctcccgagtagctgggattacaggtgaccaccaccatgcctagctaatttctccgtttctttaaatactattttattccttgaacatgtttataatgatagctatttttcctgaatagaattcatattgtcttgtttctttgcctatccctaattttatgttgacaaattcacattttagataacatattgtggcagctctggattggatttttttttcctgagagctataattgtttctattattttttgttgtttatttggtgtgtttataagtatttttcctggatttaatttgcagaatctatctctattgtagtatgcagttgctagcatgcctgatgatgtcatctgctgatagatacatatgtgggttgagaaacatatgcaaaatttcggcagttttcaattctgtcctaacttttactttccactgggcccttccaggttccc

SEQ ID NO: 132667 - DNA, 484 bp, Homo sapiens
agtacaaaatgcattacttgcattctttatttctataccctttctgccaacctcactgggccctcagagctgccaattaatcctctcatgtgtcatgtccctcttagtcctctcagctgtcattctcaaacattggtactcagccttcatctttccttaactacccttgtcgtatctctgccttcccgtatgtttttagttaagaaagagaatttggaccatcaggtagtaatgccttcatctacgtatactatcctacatcaaacgagggttcacctgctctcatacttcaatatttctcttttgtttcaccatctgttaaatgataatttgtacatacatctgaattctggatcctaactctccctgtcttatcaaagaccttccacttctttcctgtattggcaacctttctctttatttgttcttttcctatcaacagtaaacatacttgaagatttgttgggagagggaatcctaaaat

SEQ ID NO: 132668 - DNA, 744 bp, Homo sapiens
atgacatggcagtgagttacttgggtttccttattatctcctgtatattctggacaggatactgaagaaagccttcaacctggaaccaccaacaggtggcgtaaacaaaaaatacccctacaaaagcctgtttgtctagccaacagacaaggacaagggtcacctaagaggcaagaatggcttttcagcaatatttgccctactacagctaagcaccaatggaaaaactgttcagttcccttatagtttcagttgagtcaagcaggcagctgatattccacatcaccccctgccatcccacagaagtaagtggcatagttctgaatccctcacctggtggtggcagcagggctgagtagggagctattcttccatctttcacctggcagagcagatgtcactctgatttcctggctatgatattaaagttgaaaccaagcagaagttgatctatcaccagcccagtggaaacaagctgtgctccagttttcccagcagggtagtgtcagtggagtccagtgatgagctgagcctccatccccattcagtatcagtgagacttaacaaggcagcacaaagtagagctagttaccactatttcacctttcctttcccacgtaagtgaggcctggcagagaggtgaacctctacccccagctgtatcaacaaggctaagccaggtgaggctattcgtacttctgctcacaatatgagtcaaccatctactctccccgcaaccctcag

SEQ ID NO: 132669 - DNA, 274 bp, Homo sapiens
gccgacataaattcaagaaagaaaagtgagcttgaggacaaaagatgctcaagatttggtgtccatgcctgtagccaggactggctttcccattagctctagcaggcacggtatctagggaccactttacttttagggtctcacaaaatgttttaattttttcatcagaagaaaaaagttgggcttaggtcaaagacactgttttcatagatgatgttaatatttttgtatttataggagcacaactgtaaaatgtaatttttaattttaattt

SEQ ID NO: 132670 - DNA, 336 bp, Homo sapiens
atggacaggcccaaatttgtggccttattaactgtggtgccctaggaagggaatgaaggaatgttttcccgaacgagtctttctgatggcagaagtggggaagcaggtgctggaggcaggacccattcacttcagctccaggaacacaggtgccatgcacagcaaaaccagctgtggcttctgccctccaggcgcaaacgtggaaactgacacatacatgattataatcaacgtgggaagtagacagtgcttctctaattggtttgtgcttccccaaattccttcagggtagggaccgcatattctatcatttgcctttcctcaatgggaagcaca

SEQ ID NO: 132671 - DNA, 156 bp, Homo sapiens
ctaaccaaaattgtactctgggctttaaacctaactagatgcgctaccaaaacatactacttttaaagccaaggtaaaaatgtggagaacgagtgagtctattattatgttgatctctgaaataaatcagggatgggcacaatgtctcatgcctgt

SEQ ID NO: 132672 - DNA, 109 bp, Homo sapiens
tgacagaggcaacagatttctgttactgagtgtcagttagtgtgcattcgggctgccgcatttgtatttgtggactctatgctgtaaggacaatctagatgaggcagca

SEQ ID NO: 132673 - DNA, 669 bp, Homo sapiens
ctagaaatgagattattgggtcaagtggtaaatgaatatgaatatctgttagctattgctaaattcctctttataggtgttgtgccattttgcactcttaccattaatgtatgagagtgcctttctctccacagctggtagtactaaaagattttgagtttttaccaacctgataggtgagaaatgtatctcagtttggttttaatgtgcatttctctatgagtgaaattaaacatcttttcatatctgtaggatcattagtatatcttttagtgagtcatttattcatgtcttctgttcatttttccatcagatttttatccttttccccttaagaatcctttatgtattaggattctgtgatatattttacagatactttctctcagtttatcattcgcccaagtcttttgatcttattatggtgtgttttgctgtacataattttttaaataatttttttcacacatgcctgcatatatattacatatgtttaagataaatgggaatatattgtacttacagtttgataatctgcctttttcacatattaaactatatccattcacatccatttgaatttcattatatcactgggccataatttatttaaataatctcctgttaatactagcatttagattattttcaggtttttgctttttataa

SEQ ID NO: 132674 - DNA, 412 bp, Homo sapiens
ccccccatctctaccaaaaatacaaaaatttgccaggcacgctggtgcctgcctgtagtcccagctactcaggagattgaggcggcaagatcgcttgagcacgggaggttaaggtttcaatgagctatgattgcaccactgcactctagcctgggcaacagagcaagaccctgtctcaaaaagtctccagccacctcttaactcatatgatactactctgttccagttcacttcatttcagctgcaatgaccttgcttactgggtgttcctcaaatattccaggcctgctctagcctcagaacctttgaatttgctgtaccctctgcctaaaatcatctatccccagataatgtacaatacaaggcttgttctttcacctgcatcaggcatttttttttttttttttttgga

SEQ ID NO: 132675 - DNA, 772 bp, Homo sapiens
ggcctttactatagcctttgaaaacaaagtattaacattattttaagcctttgagtttttgccattcagccttaaattggcatactctgtcaacaacgtcagtgtggcatattaacaagactaactgctccagaaaataggctgggctactaccagttatgtagaaggtttcattgagttctaaaatttcagagcaagaaaggtgaaacttagtctcaaaaagatatggggatcatctctgcttagtcttaattaagtgaagactttggcaccctgaaagcctaaggagtgaggtctctgttggtatactgctatttcaggttcatttgaattaatctctgaggttgttaactagatagctgtaactccaaaaagacaacttaaatgtgccggctagctatttggctactccttaaacttggcttcattttaatgtttcgatggtacaagatttttttttttcctgattccggtaaggtagaaaaggattatttaatgatttattaaaaggccagtcattagactgttcaaaaacaaactccctatttgatccgtttctgcctatcccttcagatttgactgttgtgatcttctaggtcacattctactgggtgagaaggcagttttctataatagatgcactagaagtttaatctagtgtcgtagggtaattctgaatagcagatttgggaagataggagtgttgtcactttacctttaaagcaagtctttgaattgccctgtgtcacacagtaagaatatatgcaaatta

SEQ ID NO: 132676 - DNA, 1033 bp, Homo sapiens
tccttctcccctccctgtgtatcctccttgcgtctcacttcctggatcttgcaaatatttccttcggcaataacctgggagtgtctgtttctcttggagcagtcttacttggctgctgagggaagggaaaggcgagacgggttgggcttgtgtgctgttgctactgagattctagaatgccaagctattgtggtgagcttaaaaataaagtttccaaacaagaaacttcaaaagggccgaggaagaggtaggaggagatttttcagtctctgcaaatattggttttcattttcaattcctattaggccaaaaaaaaatattttaacaaaaagggaaaatccgttcttcagaagaaaaggcaacccatggaagcggaaaagagatgaacaaccctggttttggcaggcaatttacttttgtttttgagatgtagtctccttgctgatgtcaacaaagccctttctcatagtttgctttcatgcttcctctgctttcctcagtgaggcgctaaagccttcatggacgcccgaggatgaatgtagcacaagtaccttttgctgtaccccaggagtccctgcttccctgcgattatctctcagagacagacaaggcaggtctggacactgtgctttttactagctgggaaaatgatttatcctttttaagcctcaggagtctcatctgcaaactgacaataatggttgttgtgaagattaatggaaatacatacgtgaaagtgcctaacacggggcccaacacttggcaaccagagtagtcgactgggtgcggtggctcacgcctgtaatcccagaactttgggaggccaaggtggatagatcacttgaggtcaggagttcgagaccaacctggccaacatggcaaaaaccagtttctactaaaaatacaaaaattagctaggcatggtggcacacggggaggctgaggcatgagaatcacttgaacctgggaggcagaggttgcagtcggccaagattgcgccactgcactctagactgggcaagacactgtctca

SEQ ID NO: 132677 - DNA, 186 bp, Homo sapiens
acctggtccttttgttgctgcctgaggttagttagctctctcaatgggctagggcagcagcatttccagaaatagaatttgtggacctaaacagaagctggattcatttctcttgctgtgtaacaaatgaccacaaatttagtagcttaaaacaacaccctcttattatctcacagttctccaggt

SEQ ID NO: 132678 - DNA, 163 bp, Homo sapiens
ctttagagcagtgagagaacggactgatacagcatccatcataaaaatgttttaatgaacatgatgacaactcttgaaacaaatgaaaactcaaaacaatataaagaagaaacaaatggatgggtcatgcctgtaatcctagcaattttggaggccaaggtgg

SEQ ID NO: 132679 - DNA, 468 bp, Homo sapiens
gggcatcaggcagcaaaacggctgcttttttcagagagaatcaggtgtatgcataagaccgtatgaagggcgtgactttaaagaaaaggggcccattcatacgtgagacatttacaaattcgttatttgtaaacctttgccttgatttgaagatagccaaatggtgtctatggccacaaacacattctttgccaaatataaacaacttcaaaataaaaagcgatgctgattttactgttttctcctttagaccacatcagtctcatttaagaatacgttaaaagcagacgttggatttcactttttggcactgtaactggacgtgctatcataaagtcatatctaggcaatgaatggaatgtttttcctttttttcagtcacagcacgcctggaaattggaaacaaaagcagaatgtccctgaggtccccttctatttattcctcctgaggtccccttctgtttattc

SEQ ID NO: 132680 - DNA, 824 bp, Homo sapiens
ttgctcataacaccttgttcctcacctggcttaatcctgataaaaaccgggcttttaaactggaagcccccatgtactttcaagtgggagtaccctgtgcttcggcaagaattggtttcagcaccttggagagcacctgtttccgctcccccaccaaaatagagacagggtctctctctgtcacccaggctggaatgcagtggcaccatcacagctcactgcagccttgacctcctgagctcaagcagtcctcccacctcagcctcccaagtagcttggactataggtaattgttctattttttgtagagaggaggcctcactatgttgcccaggctggtctcaaactcttggcctcccaaagtgctgagattacaggcatgagccactgcacctggcccttgcctctatttcaaagctactttggtgcctctaccttctcccttctagtctcataattttctaaagaagttagacatttctccagaaatagaagttccttcttggatttctacaaagaaatccataggtcagggacactcatcccagcttggggtgccaggtttatggtgctctggtgagctgctattgagcagatttactgactctcagacatgatataagacaattaccatgcatttcgtctcttagagggaaaagaatttgcagtgggttaatagtacttttatttcattatctaatggcaaaagtgtttcattgtgtgtgcaagaggcatgtgtattagtgatgacaaatggggtctttcaacacggtgccgggcctcatcatacatatgttagattaaagagttcaccctagaaatac

SEQ ID NO: 132681 - DNA, 362 bp, Homo sapiens
aatttttgcatgagaaaatttgcaaaaaagaatttgcaatacaatccagcctgggtgacagaacaagactccctctcaataaaaaaaaaaaaaaagaaaagaaaagaaagtaagacaacttgtgctcttatttttaaaatattatatacttctagccccatacaaatattctcagattagactaaccaattacacattggaatacctggacagttttaaaatacaactaaaactgaacagaagcatccaaaggtcaaccactgttttactggacataccttttactttgctattttatgtattttatattaaagttagacctttgaggccaggtgcagtggctcacacctgtaatcccagca

SEQ ID NO: 132682 - DNA, 377 bp, Homo sapiens
gagaattgcttgaacacaggaggcggaagttgcagtgaaccaagatcgtgccactgcactccagcctgggtgacagaacaagactccctctcaataaaaaaaaaaaaaaagaaaagaaaagaaagtaagacaacttgtgctcttatttttaaaatattatatacttctagccccatacaaatattctcagattagactaaccaattacacattggaatacctggacagttttaaaatacaactaaaactgaacagaagcatccaaaggtcaaccactgttttactggacataccttttactttgctattttatgtattttatattaaagttagacctttgaggccaggtgcagtggctcacacctgtaatcccagca

SEQ ID NO: 132683 - DNA, 6404 bp, Homo sapiens
tacgcttctagcttgagggaaagaggccgaggcctgggccaagcccggagccgccgctcgccggagcctcctggagcctccgcgccggctcagcctgggggcgggctccggtccggcccgccgccgcacccaggacggaggctgcatgcccgaggaccaggccggcgcagccatggaggaggcgtctccctattccttacttgatatctgcttgaatttcttgactactcaccttgagaagttctgttcagccagacaagatggaacattgtgtctgcaggaacctggagtattcccacaggaggtggctgatcgactgcttcggaccatggcttttcatggtctattgaatgatggaactgtgggtatttttaggggcaaccagatgcgcttaaagcgagcctgcattcgcaaagcaaagatctctgctgttgctttccggaaagctttctgccaccacaagttagtggaacttgatgccacaggtgtgaatgctgatatcacgattacagacattatcagtgggcttggcagtaacaaatggatccagcagaatctccagtgcctggtgctgaattcattaactctctccctcgaggatccttacgagcgctgcttcagccggctttctggccttcgagctttaagcatcacgaatgttctcttttacaatgaagacctggctgaagttgcctcattgccaagattagagagcttggatatttctaacacctcaatcacagacatcactgctctactggcctgcaaagaccgactcaagtctctaaccatgcaccacttgaaatgtttaaaaatgacaactacccagatactggatgtagttcgggaactcaaacatctgaatcatcttgatatctcagatgataaacagtttacatcagacatagctcttcgcttactagaacaaaaagacatcctacctaaccttgtttctctggatgtttctgggagaaagcacgtgacagataaagccgttgaagcctttatacaacaacgtccaagcatgcaatttgtaggtttgctggctactgatgctggttactctgaattcctcacaggcgaaggacatttgaaggtgtctggggaagccaatgaaactcagattgcagaagcactgaagcgttacagtgaacgggcattctttgttcgggaagctctatttcatctttttagtctgactcatgtgatggaaaaaacaaagccagaaattttaaagcttgtggttactgggatgagaaaccaccctatgaatttgccagtgcaactggctgcaagcgcctgtgtatttaacttaaccaagcaggatcttgctgcaggaatgcctgtccgactcctggctgatgtgacccatttgctgctcaaagccatggaacattttcccaatcaccagcagttacagaagaattgcctcctttcactttgcagtgaccggatccttcaagatgttccatttaacaggtttgaagcagccaagcttgtcatgcagtggctttgcaaccatgaggatcaaaacatgcaaaggatggcagttgctatcatttctatcctggctgccaagctttctacagaacaaactgcacagcttggtactgagctcttcattgtcaggcaacttcttcaaatagtgaagcagaaaaccaatcaaaattcagtggacactacattgaaatttactttgagtgcactttggaacctcacagatgaatctccaaccacttgtagacactttattgaaaaccaagggttagaactcttcatgagggttctagagtctttcccaactgagtcatccattcagcagaaagttctaggacttttgaacaatatagctgaagtacaagaattacattctgaattaatgtggaaagattttatagaccacatcagtagtctcctacacagtgtggaagtggaagtcagttactttgcagctggaattattgcccatttaatatccagaggtgaacaagcttggacattgagtcgtagccagaggaattctctgctggatgatttgcattcagctattttgaaatggccaactccagagtgtgagatggtagcatacaggtcctttaatccatttttcccattacttggctgtttcacaacaccaggagttcagctatgggcagtttgggccatgcaacatgtctgcagcaagaatccttcaaggtattgcagcatgctgattgaagaaggaggattgcagcatttatacaacatcaaagatcatgaacatactgatccccatgtccaacagattgctgtggccattctggatagcttagaaaaacacattgtgcgccatgggaggccacctccctgtaaaaaacagccccaagccagactaaattgatagccataagtattggatagttgaatcacaggaatcctttttgtgattggtccatttggaatatcttaccctccctgatgttttgggggtttctatgacaagagtcataaaatcagtttgggattgataatgtgtagtactgcccatgtgaacagtctctaatttgtcttgtgattttaaacttatgagtcaagaagggtctcttcctttatcattgccttttaggaaattttccacatctttcagtgtttgaacttacttgtgcttgagattctacagttttatggtaaagtttgcacgaacccttaggccagacttttctgatctcagagtcccttccaatcaatttgcagcttcacataagctgttgacctgatttctgacactgcttcagttgtaaattttatactgcttctgtataaaatgcctttcttctctatctgtgtatattttataagatgtccttcttagtgtgaaagaagggaaatgtggatcatcttgtggaagctaatcactggcaggagcctggatggctggcggaaagatatatgagaaagaaaaattatgaaggtagaacagagtgtaggaactgggaattggtttcatggtataggttttaaaatgagacaggctacccttcgggagtccacctctcttgaggcggtgagcagaagcttgtcctccatatttatacctagaagtgtggactgctggttcctgcacagactgccggttattcactaggaatatttccccaagcaccacagtataaaatactacagcactctgtgttaaagactaactgtctacatctccatatgttgtagtgttgtgaaaatgtgattttaaaaaattatcgccagttaaaactggctattcttttcctctatttcaaagtcatttttgttcagtggaatagagacagcaacatggtgttaacctctcaattaaaatacaattgacaccagtaaattttgccataaaaagttaaaatctcttgttcaaaatatgtgtatcttcttaatgtgttcatgttagagaaagtgtccccatctcactgccaaaaatgaaagaaaataattaaactctttaaatgattaaatgtaatgattctactcgcagtgcataacagcacatatttttgacagattattttttaggcaattacctttccttaaggtatctgatacagtatagtaaagaatcacttatatcagtaatagcacttgagagatagcaagtcaccaagaaacttaattttcatttaaaattttattttgtgaataaggtcaatctacaatcccagataactacattttttttcatagatggccagtgttttcaacagagatttaaaatggaatattaaaattatagtgattattcagaagcattttaatttagaaaggagctggtttgttagttcactgatgacattttttgacaaacattttataccattatcacaataatcagacttgaattttttttggagttccttcatgtgaatgaaaactgagttaaaagaaagtaggcatttaggtctggatgcagtggctcgtgcttgtgatcccagcactttgggaagctgaagcaggaggattgcttgagcccggaagttcgagactagcctgggcaacatagtgagactcggtctctaccaaaaaaaaaaatttttttttttttaaattagctgggtgtggtggcacctgggaaacagagcgagacgctgactcaaataaatatctaaatagatatttagaatcactgaaaaccatattaaatgctgggttaatgctgacttaattggcttaaggaatttttataggcgtaagataaattttcacagactaagtttatttcagacaaaatagagaattcttttaaaagtttttttttttttttcctttttcgaatgttaatgtctaagacaaagttcagaaaacgagatggcctgtggtagtttggaaattgctagatatgttgaccgtttccaggtcttttatctagtgtagttaagggaaagcctatttaagaagtttggcttcaagtttctgttttataagacaaaagtgcatatttctttacaggctaatgctaggtttttgtctttacaaattattttcagaaatggctaaaagtgtacagaaaacagtaaatcccttctttactcagaataacttcttaatagttgaagcatccaaaatatgtaaaagcaagggtgggcgtagtggctcttgcctgtgatcccagcattctgggaggccggggcgggcagatcacttgagatcaggagttcgagaccaccctggccaacgtggtgaaaccccgtctctactaaaaatacaaaaactagctgggcatggtggcttttttgcacgcctgtggtcccagctactcgggaggctgaggcacgagaatcacttgaacccaggaagtggaggttgcagtgagctaggatcgtgccactgcactccagcctggacaacggagtgagactctggggaaaaaaaaaattaaacttcctactttttttctttttgtagagacggagtttcactctgtcgcccaagctggagtgcagtggcacaatcatacctcactgcagcctcttgggcttatgtgatcttaccccctcagcctctggagtagctggaactacaggctaaatttcctactttgtaaacatcagtagtggccagatacttctgagtcttaaaagcataataggccgggcgcggtggctcacgcctgtaatcccagcactttgggaggccgaggtgggtggatcacaaggtcaggagttcaagaccagcctggcccaaatggtgaaaccctgtctctactaaatatacaaaaattagctgggtgtggtggcgggcacctgtaatcccagctactcaggaggctgaggcaggagaatcgcttgaacctgggaggtggaggttgtggtgagccaatatcatgccactgcactccagcctgggtgacggagtgagactccgtctcaaaaaaaaaaaaagcataataatttattacatcccaaatatataaaaatttgagtgcctttgcagttgggatggttcctaaaattgcgtatagaattaaggcacagaattgtgtgtaaggtcctgaatctggctaaaatacagtggatgtatgtattggaattatgaggcataagtagccagtatctatagttagaatctacaaggcctcctttttgcacctgtagactagaatataactgttattggtgcctttgagtgttatctctcagtggctagaggtgctgtttcaagcacaatttagactagggttgaaccactcattgttcaaatcattggtgggctccaatgtaaaatatcactacatcagtccacaagcaacattaaggaaatctaaaggaaatggaatttgactttttagagtataatgatgttctagggcataatgaggaaaatttttaaaaaatagattataatgatacatattggtatcattaagacaacagatttgagcaaatacaattaaggtgtcttattttttgcatcaagtaattattgctgtggtctttctactccacaaaataattttttctttttgcagttgaaaattaactgcattattaactaattaataaaataaatcaagtggtataagggattagtttaccctcaagccgatgactccatggctactgatattagttagtttaggatttttaaaaagcatatcagacccccagtttcaggaattgagtataaatattgcttcttgtcaccctgggacagtaatgccttatagtggcactagtcaccttaagtagattacacatggttgaggtgaataaagctgcatgggaatttgctttcgtgatatatttcatttgcaaacttctacataatcaagttttatgtttaaaaccatcggttctatatatctagctttaggaagttgcccttacaggtgggaccttttgtgttaatctgttttctccccagtcatcttatttggctatgtt

SEQ ID NO: 132684 - DNA, 2218 bp, Homo sapiens
tacgcttctagcttgagggaaagaggccgaggcctgggccaagcccggagccgccgctcgccggagcctcctggagcctccgcgccggctcagcctgggggcgggctccggtccggcccgccgccgcacccaggacggaggctgcatgcccgaggaccaggccggcgcagccatggaggaggcgtctccctattccttacttgatatctgcttgaatttcttgactactcaccttgagaagttctgttcagccagacaagatggaacattgtgtctgcaggaacctggagtattcccacaggaggtggctgatcgactgcttcggaccatggcttttcatggtctattgaatgatggaactgtgggtatttttaggggcaaccagatgcgcttaaagcgagcctgcattcgcaaagcaaagatctctgctgttgctttccggaaagctttctgccaccacaagttagtggaacttgatgccacaggtgtgaatgctgatatcacgattacagacattatcagtgggcttggcagtaacaaatggatccagcagaatctccagtgcctggtgctgaattcattaactctctccctcgaggatccttacgagcgctgcttcagccggctttctggccttcgagctttaagcatcacgaatgttctcttttacaatgaagacctggctgaagttgcctcattgccaagattagagagcttggatatttctaacacctcaatcacagacatcactgctctactggcctgcaaagaccgactcaagtctctaaccatgcaccacttgaaatgtttaaaaatgacaactacccagatactggatgtagttcgggaactcaaacatctgaatcatcttgatatctcagatgataaacagtttacatcagacatagctcttcgcttactagaacaaaaagacatcctacctaaccttgtttctctggatgtttctgggagaaagcacgtgacagataaagccgttgaagcctttatacaacaacgtccaagcatgcaatttgtaggtttgctggctactgatgctggttactctgaattcctcacaggcgaaggacatttgaaggtgtctggggaagccaatgaaactcagattgcagaagcactgaagcgttacagtgaacgggcattctttgttcgggaagctctatttcatctttttagtctgactcatgtgatggaaaaaacaaagccagaaattttaaagcttgtggttactgggatgagaaaccaccctatgaatttgccagtgcaactggctgcaagcgcctgtgtatttaacttaaccaagcaggatcttgctgcaggaatgcctgtccgactcctggctgatgtgacccatttgctgctcaaagccatggaacattttcccaatcaccagcagttacagaagaattgcctcctttcactttgcagtgaccggatccttcaagatgttccatttaacaggtttgaagcagccaagcttgtcatgcagtggctttgcaaccatgaggatcaaaacatgcaaaggatggcagttgctatcatttctatcctggctgccaagctttctacagaacaaactgcacagcttggtactgagctcttcattgtcaggcaacttcttcaaatagtgaagcagaaaaccaatcaaaattcagtggacactacattgaaatttactttgagtgcactttggaacctcacagatgaatctccaaccacttgtagacactttattgaaaaccaagggttagaactcttcatgagggttctagagtctttcccaactgagtcatccattcagcagaaagttctaggacttttgaacaatatagctgaagtacaagaattacattctgaattaatgtggaaagattttatagaccacatcagtagtctcctacacagtgtggaagtggaagtcagttactttgcagctggaattattgcccatttaatatccagaggtgaacaagcttggacattgagtcgtagccagaggaattctctgctggatgatctggtaggtcattccataccacacacgacattctaggggttaactaacaaagcctctatgtaggaaataacgccggcaaatcacatattggatcccttaacacaaaaaaagggggcgcgcaaaattccccgggcccagataggtacccgtttgtgaaagggcctagggcggttaaacagcagc

SEQ ID NO: 132685 - DNA, 509 bp, Homo sapiens
caaggattggcctttcagaggtactacagggatagtagcctctggtccagggctggagccatcggtctctcctgtttcttgcagtccagtgggctctgtggcataaagcttgccactcggcggttgtgggattagaccagatgagactgactgacgagctctgcctctggccgaggactagagctgtccatctttcctgtttcctgcagtccaatgggctttgtggcgtaaagcttgccacctgggggttgtcgaacttgaccagatgagacttaccgacaagctcccaaatcagccaggagcaccaggcttcgctgtgatatgaggcaggatttttccctggtgtctccctgcctcttgatcccagtaccaggcttcatgccatagtcagtgcagatattgtgggtgatatgtttgtttcataaccgttcctaaatatagagtgcatgctaagtgatatctagaagccatgtaaaagaaaacgtttgaaatgtttgcaaagaggatga

SEQ ID NO: 132686 - DNA, 508 bp, Homo sapiens
tcattcatctgcaccctcccttattgagcatctttgaggtcagtggggtatcatgcctccgtctcagttctgggctgcaaggtaactgaacagccttgggcaaggagccccagggacacctctgctgccccagtttccctcttcagaaacggacggaggggatgtgtcaggcactgcgctggcacgaagagggtgggatggagaactgtgaattctaccttcaagggggaggcaaacccacatggacagagaagacacaggaacagggcccagcggcacaggggagacttggctgatttccagcatgggaagcagatgcccctgcagtggtagagacactggagcaagatggttacagggccccagagacagactcagccctccaagcctgtgggaggggagggccactctactggggggcccatgaccacagagggggcagggcctggctgggtgggcgctgctgggctcacatctcaggggcaggtctgaggcagtctgggagcgt

SEQ ID NO: 132687 - DNA, 483 bp, Homo sapiens
tctctcctgctccatctgcactatagaagtgtaataattagacatacttggcaaaatggctaattgatttggtaacagaagcatgagccataacaatggaagatctagttatcatgactgaacagcttaacattcaattcccttctctaagagaagctgtgaaatcctacatattatttaaagttaaccaaatcaatgtaaagggagttaggagacagtgtgtacctatgcacgtatatttatgttttgcttgtgttccagtctcggtcatttgtttccattttcaagcaatttatttgaagagccattgcactagcctgatgtatactgcaatgagcttctttgataaaatgaaacttagatttttctcgaccatttcaccgtgcctcctacttcattttttgccagaaaatctcacatccaacaaaacaaaacaaaaaccctgaattagtgggctttgaaaaggaaaaagcagggctttga

SEQ ID NO: 132688 - DNA, 258 bp, Homo sapiens
ctcctacttctgcttaaattccaccgggtatcacagtgtcctgagtcactgtctgcttgaccaccactcccccaccccagcctcttggaggccccaggagaggcactgctattaatagtaggggaccaataggtacattggaggtgggaatgggaagggcttctcaagaatagcccttcctggatgacagccacctcatggggggtacagccacaaggaaacttaggtcttgaataaggtggaggcagcaggtacagg

SEQ ID NO: 132689 - DNA, 668 bp, Homo sapiens
agagtctcacaatttggatttgtctgattgtttcttcatgatttagtttgtgtattcttttcagcaaatcatatctggaggcacataatgtcagtttatgccatgattggggatgtttgatcactcggttaaggcattgtccgccagatttatccacagaaatgcaccttttcccctttgaataataagtaatatgtgagtagtactttgagactaaatgctgttccccaacaactgtcacctaatggttttagtagctgtgatgatccttgtctgagtctactctctttatttttgagattgtgcatctttggccaagactttatatcctatatttagatgagagttttaaatatatagtaacctgctgattgaaacctgatttttatatttagtaagtagatcctttctctaccttctcctttattccctcccttacccttttcccctcctccattctctgttcttcctattgtaatatgcagtgatttggctgtgacataaagattaatggcggattgtcttcccagaatactatcatctctatgttgcctgggcacatttttccttgtttgcttctttgtgagccaaatgcttttattctttctgttctcttcccatctgtttaataatgtgattttttaaaaagagaattggcttcctgattg

SEQ ID NO: 132690 - DNA, 624 bp, Homo sapiens
tctcttctaaggacacagcatttgatatagggctcacccaagtattctaggttgattttatctcaaggcttttaatctacatctgcaaagatccttttgtccaaatcaggtcagattcatgggttcaaggatttggatgtaaacttatcttttgggggcccccatttgacccactgcacccccagaatagactggcacttctcaatttttagagcagtaatgtctaagcattaatgtgtgaatcacctagtgattttgatacaattcaagttctgactctgggtgtgagtagcgcctgaggttctgcatttctaacaagctcccaggtcacactgatgctgaggtaggtggcccacattttgagtagcaaggtgagccaaaatgtgtagctgtgtgatccccagagcagtcgcagcagcaccgcctgggagtttgttgtaataggaatgcccaggccccacctggacctgctgagtccaaatctgcactgcaacaagatcctcatgcgctctggttgcatgttaaaggctgagaagcgctgatctagtctagaaggtttttttatcttcatgctttatacccaagacccctcttgatcacattctgcaccctatcttcgtggag

SEQ ID NO: 132691 - DNA, 346 bp, Homo sapiens
caggctgagaaaatgggagtggcattgagtcaaggaagcaaaatatgaacaaaagcccagaattaaaagcagaagaaagagaaggaactggagccaggcgtggtggctcaggcctgtaatcccaacactttgggaggctgaggcgggcagatcacctgaggtcaggagttcgagaccagcatggccaacatggtgaaacctcgtctctactaaaaatacaaaaattagccaggcatggtggcacatgcctgtaatcccagctagtaggtaggctgaggcagaagaattccctgaacctgggaggcggaggttgcagtgagccaagatgttgccactgcactccagt

SEQ ID NO: 132692 - DNA, 223 bp, Homo sapiens
taaaagccaaaggaatgggtatgtttagagagaggccggaggttagcactgagatgggtcacacagctttccaggattcagggtaaacatctgcgtctggacctatttcatgatttcaaaatagttcgccctataatagttcattaagccataggtttcttttgtatagttctcctgtaactgccttttattttacaataaaaattttgaaaactatttcaga

SEQ ID NO: 132693 - DNA, 539 bp, Homo sapiens
tagggcggcgctacaacggggtctgtgctctagccgtgcctgcagggaaagggcacatctcgatctgaacagatattcctgttgggctctgaggtgtgcaggctggcaccagtcttgcccgacaggaatcgtggcccccgctgcaaccgagacagctcgcccacgcaccctggttagccctgagggagaatgctaagatccttgctaacccagatggcccagccaagccttatttatttatttatttttttgagttgagatggtctggctctgttgcccaggctggagcgcagtggagcaatctcagctcactgtaacctccgcctcctgagctgaagccatcctccatcctcagcctcctcagtagctgggactacaggcgcccgccaccacgcccgggctttatccatcttcaaacccagtaatggcccatggaatgcttctcatgcctcaaatctctttgtcttcccattctgctacctgactgtaaagttctcacatgaactgtgccacaatacacatatcaaagacttggaacc

SEQ ID NO: 132694 - DNA, 390 bp, Homo sapiens
tagccaggcatgttggctggtgcctgtaatcccagctacttgggagcctgaagcaggagaatcgcttgaatctgggaggcagaggctgcagtgagcccagatcacagcactgtactctagcctgggcgacagagtgagactctgcctcgacaacaacaacaacaatattaaaaaaacctgaactagttatttcctactcgcctcctggaatggctaataaaataaacactaaagctttgcagtccccaaaaagaccatgaagccctgagagtaatggaaaggttcctgaaattgaggtcactgtggaagcctcagccgagatgtctcaccccactctctctgatgcaacaagaagcccctggggaacgtttcagtcccactctgtacttc

SEQ ID NO: 132695 - DNA, 462 bp, Homo sapiens
tccctgcagagactctcaaagcttctctcttctccctgacatctctgcaaaccccctgctgactctcagctaaagagcttgcctcctgcttcacagagaaaatagatgtatacatggcattgctgtctaacccagagaagctcatcaaagcaaaaagctgagagtttctctcaattcctttctctccttcagccagcttcgatcatccaccaggtcctatcccattgtgctacttgggtctctctttagtgggtatgcctctctccatccctgtagctactatcttagagcaaaccactcttatttttcttctgcgtaattgtggcattctcctgaatgttcttttctgtctcgcttgctccccaatttattctctatactgcattctcaaggatattttaaaaatacaaaatgttacttccttgcttgaaactcttcagtgactccccaggtgcattatca

SEQ ID NO: 132696 - DNA, 1069 bp, Homo sapiens
  misc_feature (910)..(910): n is a, c, g, or t
aagcagatgttgagccccgcctgctcctgggggtgggggcacagctgacttcaggagcccagcttgagccacctctcacagcggccttggtgaggggggctcacctgtggggggctcacctgtggagggcatccccagacttgggagtgggtggcatatgggccagggtcagggcgttagggcttggagaaaggttagggttggggttggggttagagccacggtgatggtcagggcatatgggctagggttagggcgttggggtcagggccatgggttctggctagcactgtggagacagccgtttctatcacgaagcgatggaagattccgccgttccaaccccagattcgagggaggcaggggtgtggacggtgccacacctcaatcctcacagcctctgtctcccactgcccaggctggcgaagaagtcctggtttgggaacttcatcagcctggagaaggaggagcagatcttcgtggtcatcaaagacaaacctctgagctccatcaaggctgacatcgtgcacgccttcctgtcgattcccagtctcagccacagcgtcatctcccaaacgagcttccgggccgagtacaaggccacgggggggccagccgtgttccagaagccggtcaagttccaggttgatatcacctacacggagggtggggaggcgcagaaggagaacggcatctactccgtcaccttcaccctgctctcaggccccagccgtcgcttcaagagggtggtggagaccatccaggcccagctgctgagcacacacgacccgcctgcggcccagcacttgtcagacaccactaactgtatggaaatgatgacggggcggctttccaaatgtggtaagaatcccccacgctcacctggcacctccacctgccacttcaccgntcaccctcagcccgctgtggccgccacctgccgcccgggttgtcccggcctccctgtgtagatgtaggcacccagcagcccagatgtccccggccccatcctctaccaggagcagcccaggtcgctcccctaccacagcaagcccaggcggggttcctg

SEQ ID NO: 132697 - DNA, 2196 bp, Homo sapiens
  misc_feature (1266)..(1266): n is a, c, g, or t
  misc_feature (1279)..(1279): n is a, c, g, or t
gggcgcccctggccggcgctgggccccagagcgatgacatcgacggggaaggacggcggcgcgcagcacgcgcagtatgttgggccctaccggctggagaagacgctgggcaaggggcagacaggtctggtgaagctgggggttcactgcgtcacctgccagaaggtggccatcaagatcgtcaaccgtgagaagctcagcgagtcggtgctgatgaaggtggagcgggagatcgcgatcctgaagctcattgagcacccccacgtcctaaagctgcacgacgtttatgaaaacaaaaaatatttgtacctggtgctagaacacgtgtcaggtggtgagctcttcgactacctggtgaagaaggggaggctgacgcctaaggaggctcggaagttcttccggcagatcatctctgcgctggacttctgccacagccactccatatgccacagggatctgaaacctgaaaacctcctgctggacgagaagaacaacatccgcatcgcagactttggcatggcgtccctgcaggttggcgacagctgttggagaccagctgtgggtccccccactacgcctgccccgaggtgatccggggggagaagtatgacggccggaaggggacgtgtggagctgcggcgtcatcctgttcgccttgctggtgggggctctgcccttcgacgatgacaacttgcgacagctgctggagaaggtgaagcggggcgtgttccacatgccgcactttatcccgcccgactgccagagtctgctacggggcatgagcgaggtggacgccgcacgccgcctcacgctagagcacattcagaaacacatatggtatatagggggcaagaatgagcccgaaccagagcagcccattcctcgcaaggtgcagatccgctcgctgcccagcctggaggacatcgaccccgacgtgctggacagcatgcactcactgggctgcttccgagaccgcaacaagctgctgcaggacctgctgtccgaggaggagaaccaggagaagatgatttacttcctcctcctggaccggaaagaaaggtacccgagccaggaggatgaggacctgcccccccggaacgagatagaccctccccggaagcgtgtggactccccgatgctgaaccggcacggcaagcggcggccagaacgcaaatccatggaggtgctcagcgtgacggacggcggctccccggtgcctgcgcggcgggccattgagatggcccagcacggccagaggtctcggtncatcagcggtgcntcctcaggcctttccacagcccactcagcagcccccgggtgacccctcacccctcaccaaggggcagtcccctccccacccccaagggacacctgtccacacgccaaaggagagcccggctggcacgcccaaccccacgcccccgtccagccccagcgtcggaggggtgccctggagggcgcggctcaactccatcaagaacagctttctgggctcaccccgcttccaccgccggaaactgcaagttccgacgccggaggagatgtccaacctgacaccagagtcgtccccagagctggcgaagaagtcctggtttgggaacttcatcagcctggagaaggaggagcagatcttcgtggtcatcaaagacaaacctctgagctccatcaaggctgacatcgtgcacgccttcctgtcgattcccagtctcagccacagcgtcatctcccaaacgagcttccgggccgagtacaaggccacgggggggccagccgtgttccagaagccggtcaagttccaggttgatatcacctacacggagggtggggaggcgcagaaggagaacggcatctactccgtcaccttcaccctgctctcaggccccagccgtcgcttcaagagggtggtggagaccatccaggcccagctgctgagcacacacgacccgcctgcggcccagcacttgtcagaaccccccccaccagcgccaggactaagctggggtgctgggcttaagggccagaaggtggccaccagctacgagagtagcctctgacgctggcagacaccactaactgtatggaaatgatgacggggcggctttccaaatgtgacgagaagaacgggcaggcggcccaggcccccagcacgcccgccaagcggagtgcccacggcccactcggtgactccgcggccgc

SEQ ID NO: 132698 - DNA, 2381 bp, Homo sapiens
agctaggtacgaggctgggtttgaatcggccgaggggagagcccggctggcacgcccaaccccacgcccccgtccagccccagcgtcggaggggtgccctggagggcgcggctcaactccatcaagaacagctttctgggctcaccccgcttccaccgccggaaactgcaagttccgacgccggaggagatgtccaacctgacaccagagtcgtccccagagctggcgaagaagtcctggtttgggaacttcatcagcctggagaaggaggagcagatcttcgtggtcatcaaagacaaacctctgagctccatcaaggctgacatcgtgcacgccttcctgtcgattcccagtctcagccacagcgtcatctcccaaacgagcttccgggccgagtacaaggccacgggggggccagccgtgttccagaagccggtcaagttccaggttgatatcacctacacggagggtggggaggcgcagaaggagaacggcatctactccgtcaccttcaccctgctctcaggccccagccgtcgcttcaagagggtggtggagaccatccaggcccagctgctgagcacacacgacccgcctgcggcccagcacttgtcagacaccactaactgtatggaaatgatgacggggcggctttccaaatgtggaattatcccgaaaagttaacatgtcacctccacgaggccatcctctgtgaccgaaggcagctgctgcggacccgccctccctccgctcctgctgttgctgccgggcagtgaggcccagcccagcgccccgtccaccccgcggcagctcctcgcctcagctccgcacggcccgtgggaggaaggccaggctcgggggagcctcctccagcccggccgacccggactcccggtcacctgacccctcagcaagaacagcctgcctggtggccttctggggccaggacccccggtgggcaacgtagccacaggaacaggccccgtccaccgcctccacgccgcacctggaggcctcctcgcaggcccgtgccccgcctccctggccgcgccgcctccgtgtagtcttggcctcctcaggctgcctcccgtcctctcgtctcacccgcgcctcccttgcctcatctggggcggctgtgggctctggcgctcctctctggctgaggtggaaacagagacaccctgtggcaccagagccttcccagcaggccaggccgctgggctgggatcagtgttatttatttgccgttttaatttatggattctccgcacctctgttcagggaagggcggcggccacatcccctgccgtctgcgcgtctcaggcagtgggggggctggggccagggcgccctctgaggacagagctggtggggcgcgggggggctggcgagctactgtaaactttaaagaattcctgcaagatatttttataaacttttttttcttggtggtttttggaaaagggtgtgggggtgggggcgccgctggggcagggccaggttttgtgttttagtcccttgctcctgcttctttctacacacacatctaaagacggtgcggctcgctctgtcatgggttccgtctctctctgtggagaagcagctccacctctgggggggctcggggcagaggggcggtgtctcgtagcgggcggcagcgccagtccccctctgtcaggctggggcaatcttggttttgtgtccaaaggtgaaggggtaggaggagggccctcagctggccctccccacacacaggacggcaggggcactgtgaggcttttcttattaaaatgaaaaaattgaaaaaaaaggacaaagagtcggtggcgctcctctgcagggcgttctgtgcagagcgaggcccagggcgcactcaggagggctcaggccaccctgcccagtgcccgccgccgtgcttcaccccagctccagcttctgtgttcccttccgcccatgtgcccagccctcccaggcgggcacagcccgggtgcggcggccgtgggggacggcgggtctgatgcatgcctctgccatggagtcgtctgtctgcttcggtgcctgcccctgcctcccacccacctcgtgtatagattttaacgcttctgttaacattagacctctgccacaggctgggatttctatacataagaacaaaagcaaacacctaggacagcaaacgccaggcggtacaggcgggaaggggctctccacggagatcgaggacacgaagcaaactgcctcttgcttgccttccccttttgtgcttcggacacacgcggactccagcaggcgccacggaaatgggcaagcccctgcagtgtacccctgtcataactgtgagcagctgcagctccggaacaataaatcccttccgcaaagac

SEQ ID NO: 132699 - DNA, 3668 bp, Homo sapiens
  misc_feature (1266)..(1266): n is a, c, g, or t
  misc_feature (1279)..(1279): n is a, c, g, or t
gggcgcccctggccggcgctgggccccagagcgatgacatcgacggggaaggacggcggcgcgcagcacgcgcagtatgttgggccctaccggctggagaagacgctgggcaaggggcagacaggtctggtgaagctgggggttcactgcgtcacctgccagaaggtggccatcaagatcgtcaaccgtgagaagctcagcgagtcggtgctgatgaaggtggagcgggagatcgcgatcctgaagctcattgagcacccccacgtcctaaagctgcacgacgtttatgaaaacaaaaaatatttgtacctggtgctagaacacgtgtcaggtggtgagctcttcgactacctggtgaagaaggggaggctgacgcctaaggaggctcggaagttcttccggcagatcatctctgcgctggacttctgccacagccactccatatgccacagggatctgaaacctgaaaacctcctgctggacgagaagaacaacatccgcatcgcagactttggcatggcgtccctgcaggttggcgacagctgttggagaccagctgtgggtccccccactacgcctgccccgaggtgatccggggggagaagtatgacggccggaaggggacgtgtggagctgcggcgtcatcctgttcgccttgctggtgggggctctgcccttcgacgatgacaacttgcgacagctgctggagaaggtgaagcggggcgtgttccacatgccgcactttatcccgcccgactgccagagtctgctacggggcatgagcgaggtggacgccgcacgccgcctcacgctagagcacattcagaaacacatatggtatatagggggcaagaatgagcccgaaccagagcagcccattcctcgcaaggtgcagatccgctcgctgcccagcctggaggacatcgaccccgacgtgctggacagcatgcactcactgggctgcttccgagaccgcaacaagctgctgcaggacctgctgtccgaggaggagaaccaggagaagatgatttacttcctcctcctggaccggaaagaaaggtacccgagccaggaggatgaggacctgcccccccggaacgagatagaccctccccggaagcgtgtggactccccgatgctgaaccggcacggcaagcggcggccagaacgcaaatccatggaggtgctcagcgtgacggacggcggctccccggtgcctgcgcggcgggccattgagatggcccagcacggccagaggtctcggtncatcagcggtgcntcctcaggcctttccacagcccactcagcagcccccgggtgacccctcacccctcaccaaggggcagtcccctccccacccccaagggacacctgtccacacgccaaaggagagcccggctggcacgcccaaccccacgcccccgtccagccccagcgtcggaggggtgccctggagggcgcggctcaactccatcaagaacagctttctgggctcaccccgcttccaccgccggaaactgcaagttccgacgccggaggagatgtccaacctgacaccagagtcgtccccagagctggcgaagaagtcctggtttgggaacttcatcagcctggagaaggaggagcagatcttcgtggtcatcaaagacaaacctctgagctccatcaaggctgacatcgtgcacgccttcctgtcgattcccagtctcagccacagcgtcatctcccaaacgagcttccgggccgagtacaaggccacgggggggccagccgtgttccagaagccggtcaagttccaggttgatatcacctacacggagggtggggaggcgcagaaggagaacggcatctactccgtcaccttcaccctgctctcaggccccagccgtcgcttcaagagggtggtggagaccatccaggcccagctgctgagcacacacgacccgcctgcggcccagcacttgtcagaaccccccccaccagcgccaggactaagctggggtgctgggcttaagggccagaaggtggccaccagctacgagagtagcctctgacgctggcagacaccactaactgtatggaaatgatgacggggcggctttccaaatgtggaattatcccgaaaagttaacatgtcacctccacgaggccatcctctgtgaccgaaggcagctgctgcggacccgccctccctccgctcctgctgttgctgccgggcagtgaggcccagcccagcgccccgtccaccccgcggcagctcctcgcctcagctccgcacggcccgtgggaggaaggccaggctcgggggagcctcctccagcccggccgacccggactcccggtcacctgacccctcagcaagaacagctgcctcccgtcctctcgtctcacccgcgcctcccttgcctcatctggggcggctgtgggctctggcgctcctctctggctgaggtggaaacagagacaccctgtggcaccagagccttcccagcaggccaggccgctgggctgggatcagtgttatttatttgccgttttaatttatggattctccgcacctctgttcagggaagggcggcggccacatcccctgccgtctgcgcgtctcaggcagtgggggggctggggccagggcgccctctgaggacagagctggtggggcgcgggggggctggcgagctactgtaaactttaaagaattcctgcaagatatttttataaacttttttttcttggtggtttttggaaaagggtgtgggggtgggggcgccgctggggcagggccaggttttgtgttttagtcccttgctcctgcttctttctacacacacatctaaagacggtgcggctcgctctgtcatgggttccgtctctctctgtggagaagcagctccacctctgggggggctcggggcagaggggcggtgtctcgtagcgggcggcagcgccagtccccctctgtcaggctggggcaatcttggttttgtgtccaaaggtgaaggggtaggaggagggccctcagctggccctccccacacacaggacggcaggggcactgtgaggcttttcttattaaaatgaaaaaattgaaaaaaaaggacaaagagtcggtggcgctcctctgcagggcgttctgtgcagagcgaggcccagggcgcactcaggagggctcaggccaccctgcccagtgcccgccgccgtgcttcaccccagctccagcttctgtgttcccttccgcccatgtgcccagccctcccaggcgggcacagcccgggtgcggcggccgtgggggacggcgggtctgatgcatgcctctgccatggagtcgtctgtctgcttcggtgcctgcccctgcctcccacccacctcgtgtatagattttaacgcttctgttaacattagacctctgccacaggctgggatttctatacataagaacaaaagcaaacacctaggacagcaaacgccaggcggtacaggcgggaaggggctctccacggagatcgaggacacgaagcaaactgcctcttgcttgccttccccttttgtgcttcggacacacgcggactccagcaggcgccacggaaatgggcaagcccctgcagtgtacccctgtcataactgtgagcagctgcagctccggaacaataaatcccttccgcaaagac

SEQ ID NO: 132700 - DNA, 2418 bp, Homo sapiens
aagcagatgttgagccccgcctgctcctgggggtgggggcacagctgacttcaggagcccagcttgagccacctctcacagcggccttggtgaggggggctcacctgtggggggctcacctgtggagggcatccccagacttgggagtgggtggcatatgggccagggtcagggcgttagggcttggagaaaggttagggttggggttggggttagagccacggtgatggtcagggcatatgggctagggttagggcgttggggtcagggccatgggttctggctagcactgtggagacagccgtttctatcacgaagcgatggaagattccgccgttccaaccccagattcgagggaggcaggggtgtggacggtgccacacctcaatcctcacagcctctgtctcccactgcccaggctggcgaagaagtcctggtttgggaacttcatcagcctggagaaggaggagcagatcttcgtggtcatcaaagacaaacctctgagctccatcaaggctgacatcgtgcacgccttcctgtcgattcccagtctcagccacagcgtcatctcccaaacgagcttccgggccgagtacaaggccacgggggggccagccgtgttccagaagccggtcaagttccaggttgatatcacctacacggagggtggggaggcgcagaaggagaacggcatctactccgtcaccttcaccctgctctcaggccccagccgtcgcttcaagagggtggtggagaccatccaggcccagctgctgagcacacacgacccgcctgcggcccagcacttgtcagacaccactaactgtatggaaatgatgacggggcggctttccaaatgtggaattatcccgaaaagttaacatgtcacctccacgaggccatcctctgtgaccgaaggcagctgctgcggacccgccctccctccgctcctgctgttgctgccgggcagtgaggcccagcccagcgccccgtccaccccgcggcagctcctcgcctcagctccgcacggcccgtgggaggaaggccaggctcgggggagcctcctccagcccggccgacccggactcccggtcacctgacccctcagcaagaacagctgcctcccgtcctctcgtctcacccgcgcctcccttgcctcatctggggcggctgtgggctctggcgctcctctctggctgaggtggaaacagagacaccctgtggcaccagagccttcccagcaggccaggccgctgggctgggatcagtgttatttatttgccgttttaatttatggattctccgcacctctgttcagggaagggcggcggccacatcccctgccgtctgcgcgtctcaggcagtgggggggctggggccagggcgccctctgaggacagagctggtggggcgcgggggggctggcgagctactgtaaactttaaagaattcctgcaagatatttttataaacttttttttcttggtggtttttggaaaagggtgtgggggtgggggcgccgctggggcagggccaggttttgtgttttagtcccttgctcctgcttctttctacacacacatctaaagacggtgcggctcgctctgtcatgggttccgtctctctctgtggagaagcagctccacctctgggggggctcggggcagaggggcggtgtctcgtagcgggcggcagcgccagtccccctctgtcaggctggggcaatcttggttttgtgtccaaaggtgaaggggtaggaggagggccctcagctggccctccccacacacaggacggcaggggcactgtgaggcttttcttattaaaatgaaaaaattgaaaaaaaaggacaaagagtcggtggcgctcctctgcagggcgttctgtgcagagcgaggcccagggcgcactcaggagggctcaggccaccctgcccagtgcccgccgccgtgcttcaccccagctccagcttctgtgttcccttccgcccatgtgcccagccctcccaggcgggcacagcccgggtgcggcggccgtgggggacggcgggtctgatgcatgcctctgccatggagtcgtctgtctgcttcggtgcctgcccctgcctcccacccacctcgtgtatagattttaacgcttctgttaacattagacctctgccacaggctgggatttctatacataagaacaaaagcaaacacctaggacagcaaacgccaggcggtacaggcgggaaggggctctccacggagatcgaggacacgaagcaaactgcctcttgcttgccttccccttttgtgcttcggacacacgcggactccagcaggcgccacggaaatgggcaagcccctgcagtgtacccctgtcataactgtgagcagctgcagctccggaacaataaatcccttccgcaaagac

SEQ ID NO: 132701 - DNA, 3733 bp, Homo sapiens
  misc_feature (1266)..(1266): n is a, c, g, or t
  misc_feature (1279)..(1279): n is a, c, g, or t
gggcgcccctggccggcgctgggccccagagcgatgacatcgacggggaaggacggcggcgcgcagcacgcgcagtatgttgggccctaccggctggagaagacgctgggcaaggggcagacaggtctggtgaagctgggggttcactgcgtcacctgccagaaggtggccatcaagatcgtcaaccgtgagaagctcagcgagtcggtgctgatgaaggtggagcgggagatcgcgatcctgaagctcattgagcacccccacgtcctaaagctgcacgacgtttatgaaaacaaaaaatatttgtacctggtgctagaacacgtgtcaggtggtgagctcttcgactacctggtgaagaaggggaggctgacgcctaaggaggctcggaagttcttccggcagatcatctctgcgctggacttctgccacagccactccatatgccacagggatctgaaacctgaaaacctcctgctggacgagaagaacaacatccgcatcgcagactttggcatggcgtccctgcaggttggcgacagctgttggagaccagctgtgggtccccccactacgcctgccccgaggtgatccggggggagaagtatgacggccggaaggggacgtgtggagctgcggcgtcatcctgttcgccttgctggtgggggctctgcccttcgacgatgacaacttgcgacagctgctggagaaggtgaagcggggcgtgttccacatgccgcactttatcccgcccgactgccagagtctgctacggggcatgagcgaggtggacgccgcacgccgcctcacgctagagcacattcagaaacacatatggtatatagggggcaagaatgagcccgaaccagagcagcccattcctcgcaaggtgcagatccgctcgctgcccagcctggaggacatcgaccccgacgtgctggacagcatgcactcactgggctgcttccgagaccgcaacaagctgctgcaggacctgctgtccgaggaggagaaccaggagaagatgatttacttcctcctcctggaccggaaagaaaggtacccgagccaggaggatgaggacctgcccccccggaacgagatagaccctccccggaagcgtgtggactccccgatgctgaaccggcacggcaagcggcggccagaacgcaaatccatggaggtgctcagcgtgacggacggcggctccccggtgcctgcgcggcgggccattgagatggcccagcacggccagaggtctcggtncatcagcggtgcntcctcaggcctttccacagcccactcagcagcccccgggtgacccctcacccctcaccaaggggcagtcccctccccacccccaagggacacctgtccacacgccaaaggagagcccggctggcacgcccaaccccacgcccccgtccagccccagcgtcggaggggtgccctggagggcgcggctcaactccatcaagaacagctttctgggctcaccccgcttccaccgccggaaactgcaagttccgacgccggaggagatgtccaacctgacaccagagtcgtccccagagctggcgaagaagtcctggtttgggaacttcatcagcctggagaaggaggagcagatcttcgtggtcatcaaagacaaacctctgagctccatcaaggctgacatcgtgcacgccttcctgtcgattcccagtctcagccacagcgtcatctcccaaacgagcttccgggccgagtacaaggccacgggggggccagccgtgttccagaagccggtcaagttccaggttgatatcacctacacggagggtggggaggcgcagaaggagaacggcatctactccgtcaccttcaccctgctctcaggccccagccgtcgcttcaagagggtggtggagaccatccaggcccagctgctgagcacacacgacccgcctgcggcccagcacttgtcagacaccactaactgtatggaaatgatgacggggcggctttccaaatgtggaattatcccgaaaagttaacatgtcacctccacgaggccatcctctgtgaccgaaggcagctgctgcggacccgccctccctccgctcctgctgttgctgccgggcagtgaggcccagcccagcgccccgtccaccccgcggcagctcctcgcctcagctccgcacggcccgtgggaggaaggccaggctcgggggagcctcctccagcccggccgacccggactcccggtcacctgacccctcagcaagaacagcctgcctggtggccttctggggccaggacccccggtgggcaacgtagccacaggaacaggccccgtccaccgcctccacgccgcacctggaggcctcctcgcaggcccgtgccccgcctccctggccgcgccgcctccgtgtagtcttggcctcctcaggctgcctcccgtcctctcgtctcacccgcgcctcccttgcctcatctggggcggctgtgggctctggcgctcctctctggctgaggtggaaacagagacaccctgtggcaccagagccttcccagcaggccaggccgctgggctgggatcagtgttatttatttgccgttttaatttatggattctccgcacctctgttcagggaagggcggcggccacatcccctgccgtctgcgcgtctcaggcagtgggggggctggggccagggcgccctctgaggacagagctggtggggcgcgggggggctggcgagctactgtaaactttaaagaattcctgcaagatatttttataaacttttttttcttggtggtttttggaaaagggtgtgggggtgggggcgccgctggggcagggccaggttttgtgttttagtcccttgctcctgcttctttctacacacacatctaaagacggtgcggctcgctctgtcatgggttccgtctctctctgtggagaagcagctccacctctgggggggctcggggcagaggggcggtgtctcgtagcgggcggcagcgccagtccccctctgtcaggctggggcaatcttggttttgtgtccaaaggtgaaggggtaggaggagggccctcagctggccctccccacacacaggacggcaggggcactgtgaggcttttcttattaaaatgaaaaaattgaaaaaaaaggacaaagagtcggtggcgctcctctgcagggcgttctgtgcagagcgaggcccagggcgcactcaggagggctcaggccaccctgcccagtgcccgccgccgtgcttcaccccagctccagcttctgtgttcccttccgcccatgtgcccagccctcccaggcgggcacagcccgggtgcggcggccgtgggggacggcgggtctgatgcatgcctctgccatggagtcgtctgtctgcttcggtgcctgcccctgcctcccacccacctcgtgtatagattttaacgcttctgttaacattagacctctgccacaggctgggatttctatacataagaacaaaagcaaacacctaggacagcaaacgccaggcggtacaggcgggaaggggctctccacggagatcgaggacacgaagcaaactgcctcttgcttgccttccccttttgtgcttcggacacacgcggactccagcaggcgccacggaaatgggcaagcccctgcagtgtacccctgtcataactgtgagcagctgcagctccggaacaataaatcccttccgcaaagac

SEQ ID NO: 132702 - DNA, 2319 bp, Homo sapiens
  misc_feature (1266)..(1266): n is a, c, g, or t
  misc_feature (1279)..(1279): n is a, c, g, or t
  misc_feature (2160)..(2160): n is a, c, g, or t
gggcgcccctggccggcgctgggccccagagcgatgacatcgacggggaaggacggcggcgcgcagcacgcgcagtatgttgggccctaccggctggagaagacgctgggcaaggggcagacaggtctggtgaagctgggggttcactgcgtcacctgccagaaggtggccatcaagatcgtcaaccgtgagaagctcagcgagtcggtgctgatgaaggtggagcgggagatcgcgatcctgaagctcattgagcacccccacgtcctaaagctgcacgacgtttatgaaaacaaaaaatatttgtacctggtgctagaacacgtgtcaggtggtgagctcttcgactacctggtgaagaaggggaggctgacgcctaaggaggctcggaagttcttccggcagatcatctctgcgctggacttctgccacagccactccatatgccacagggatctgaaacctgaaaacctcctgctggacgagaagaacaacatccgcatcgcagactttggcatggcgtccctgcaggttggcgacagctgttggagaccagctgtgggtccccccactacgcctgccccgaggtgatccggggggagaagtatgacggccggaaggggacgtgtggagctgcggcgtcatcctgttcgccttgctggtgggggctctgcccttcgacgatgacaacttgcgacagctgctggagaaggtgaagcggggcgtgttccacatgccgcactttatcccgcccgactgccagagtctgctacggggcatgagcgaggtggacgccgcacgccgcctcacgctagagcacattcagaaacacatatggtatatagggggcaagaatgagcccgaaccagagcagcccattcctcgcaaggtgcagatccgctcgctgcccagcctggaggacatcgaccccgacgtgctggacagcatgcactcactgggctgcttccgagaccgcaacaagctgctgcaggacctgctgtccgaggaggagaaccaggagaagatgatttacttcctcctcctggaccggaaagaaaggtacccgagccaggaggatgaggacctgcccccccggaacgagatagaccctccccggaagcgtgtggactccccgatgctgaaccggcacggcaagcggcggccagaacgcaaatccatggaggtgctcagcgtgacggacggcggctccccggtgcctgcgcggcgggccattgagatggcccagcacggccagaggtctcggtncatcagcggtgcntcctcaggcctttccacagcccactcagcagcccccgggtgacccctcacccctcaccaaggggcagtcccctccccacccccaagggacacctgtccacacgccaaaggagagcccggctggcacgcccaaccccacgcccccgtccagccccagcgtcggaggggtgccctggagggcgcggctcaactccatcaagaacagctttctgggctcaccccgcttccaccgccggaaactgcaagttccgacgccggaggagatgtccaacctgacaccagagtcgtccccagagctggcgaagaagtcctggtttgggaacttcatcagcctggagaaggaggagcagatcttcgtggtcatcaaagacaaacctctgagctccatcaaggctgacatcgtgcacgccttcctgtcgattcccagtctcagccacagcgtcatctcccaaacgagcttccgggccgagtacaaggccacgggggggccagccgtgttccagaagccggtcaagttccaggttgatatcacctacacggagggtggggaggcgcagaaggagaacggcatctactccgtcaccttcaccctgctctcaggccccagccgtcgcttcaagagggtggtggagaccatccaggcccagctgctgagcacacacgacccgcctgcggcccagcacttgtcagaaccccccccaccagcgccaggactaagctggggtgctgggcttaagggccagaaggtggccaccagctacgagagtagcctctgacgctggcagacaccactaactgtatggaaatgatgacggggcggctttccaaatgtggtaagaatcccccacgctcacctggcacctccacctgccacttcaccgntcaccctcagcccgctgtggccgccacctgccgcccgggttgtcccggcctccctgtgtagatgtaggcacccagcagcccagatgtccccggccccatcctctaccaggagcagcccaggtcgctcccctaccacagcaagcccaggcggggttcctg

SEQ ID NO: 132703 - DNA, 3573 bp, Homo sapiens
  misc_feature (1266)..(1266): n is a, c, g, or t
  misc_feature (1279)..(1279): n is a, c, g, or t
gggcgcccctggccggcgctgggccccagagcgatgacatcgacggggaaggacggcggcgcgcagcacgcgcagtatgttgggccctaccggctggagaagacgctgggcaaggggcagacaggtctggtgaagctgggggttcactgcgtcacctgccagaaggtggccatcaagatcgtcaaccgtgagaagctcagcgagtcggtgctgatgaaggtggagcgggagatcgcgatcctgaagctcattgagcacccccacgtcctaaagctgcacgacgtttatgaaaacaaaaaatatttgtacctggtgctagaacacgtgtcaggtggtgagctcttcgactacctggtgaagaaggggaggctgacgcctaaggaggctcggaagttcttccggcagatcatctctgcgctggacttctgccacagccactccatatgccacagggatctgaaacctgaaaacctcctgctggacgagaagaacaacatccgcatcgcagactttggcatggcgtccctgcaggttggcgacagctgttggagaccagctgtgggtccccccactacgcctgccccgaggtgatccggggggagaagtatgacggccggaaggggacgtgtggagctgcggcgtcatcctgttcgccttgctggtgggggctctgcccttcgacgatgacaacttgcgacagctgctggagaaggtgaagcggggcgtgttccacatgccgcactttatcccgcccgactgccagagtctgctacggggcatgagcgaggtggacgccgcacgccgcctcacgctagagcacattcagaaacacatatggtatatagggggcaagaatgagcccgaaccagagcagcccattcctcgcaaggtgcagatccgctcgctgcccagcctggaggacatcgaccccgacgtgctggacagcatgcactcactgggctgcttccgagaccgcaacaagctgctgcaggacctgctgtccgaggaggagaaccaggagaagatgatttacttcctcctcctggaccggaaagaaaggtacccgagccaggaggatgaggacctgcccccccggaacgagatagaccctccccggaagcgtgtggactccccgatgctgaaccggcacggcaagcggcggccagaacgcaaatccatggaggtgctcagcgtgacggacggcggctccccggtgcctgcgcggcgggccattgagatggcccagcacggccagaggtctcggtncatcagcggtgcntcctcaggcctttccacagcccactcagcagcccccgggtgacccctcacccctcaccaaggggcagtcccctccccacccccaagggacacctgtccacacgccaaaggagagcccggctggcacgcccaaccccacgcccccgtccagccccagcgtcggaggggtgccctggagggcgcggctcaactccatcaagaacagctttctgggctcaccccgcttccaccgccggaaactgcaagttccgacgccggaggagatgtccaacctgacaccagagtcgtccccagagctggcgaagaagtcctggtttgggaacttcatcagcctggagaaggaggagcagatcttcgtggtcatcaaagacaaacctctgagctccatcaaggctgacatcgtgcacgccttcctgtcgattcccagtctcagccacagcgtcatctcccaaacgagcttccgggccgagtacaaggccacgggggggccagccgtgttccagaagccggtcaagttccaggttgatatcacctacacggagggtggggaggcgcagaaggagaacggcatctactccgtcaccttcaccctgctctcaggccccagccgtcgcttcaagagggtggtggagaccatccaggcccagctgctgagcacacacgacccgcctgcggcccagcacttgtcagacaccactaactgtatggaaatgatgacggggcggctttccaaatgtggaattatcccgaaaagttaacatgtcacctccacgaggccatcctctgtgaccgaaggcagctgctgcggacccgccctccctccgctcctgctgttgctgccgggcagtgaggcccagcccagcgccccgtccaccccgcggcagctcctcgcctcagctccgcacggcccgtgggaggaaggccaggctcgggggagcctcctccagcccggccgacccggactcccggtcacctgacccctcagcaagaacagctgcctcccgtcctctcgtctcacccgcgcctcccttgcctcatctggggcggctgtgggctctggcgctcctctctggctgaggtggaaacagagacaccctgtggcaccagagccttcccagcaggccaggccgctgggctgggatcagtgttatttatttgccgttttaatttatggattctccgcacctctgttcagggaagggcggcggccacatcccctgccgtctgcgcgtctcaggcagtgggggggctggggccagggcgccctctgaggacagagctggtggggcgcgggggggctggcgagctactgtaaactttaaagaattcctgcaagatatttttataaacttttttttcttggtggtttttggaaaagggtgtgggggtgggggcgccgctggggcagggccaggttttgtgttttagtcccttgctcctgcttctttctacacacacatctaaagacggtgcggctcgctctgtcatgggttccgtctctctctgtggagaagcagctccacctctgggggggctcggggcagaggggcggtgtctcgtagcgggcggcagcgccagtccccctctgtcaggctggggcaatcttggttttgtgtccaaaggtgaaggggtaggaggagggccctcagctggccctccccacacacaggacggcaggggcactgtgaggcttttcttattaaaatgaaaaaattgaaaaaaaaggacaaagagtcggtggcgctcctctgcagggcgttctgtgcagagcgaggcccagggcgcactcaggagggctcaggccaccctgcccagtgcccgccgccgtgcttcaccccagctccagcttctgtgttcccttccgcccatgtgcccagccctcccaggcgggcacagcccgggtgcggcggccgtgggggacggcgggtctgatgcatgcctctgccatggagtcgtctgtctgcttcggtgcctgcccctgcctcccacccacctcgtgtatagattttaacgcttctgttaacattagacctctgccacaggctgggatttctatacataagaacaaaagcaaacacctaggacagcaaacgccaggcggtacaggcgggaaggggctctccacggagatcgaggacacgaagcaaactgcctcttgcttgccttccccttttgtgcttcggacacacgcggactccagcaggcgccacggaaatgggcaagcccctgcagtgtacccctgtcataactgtgagcagctgcagctccggaacaataaatcccttccgcaaagac

SEQ ID NO: 132704 - DNA, 2149 bp, Homo sapiens
  misc_feature (1266)..(1266): n is a, c, g, or t
  misc_feature (1279)..(1279): n is a, c, g, or t
gggcgcccctggccggcgctgggccccagagcgatgacatcgacggggaaggacggcggcgcgcagcacgcgcagtatgttgggccctaccggctggagaagacgctgggcaaggggcagacaggtctggtgaagctgggggttcactgcgtcacctgccagaaggtggccatcaagatcgtcaaccgtgagaagctcagcgagtcggtgctgatgaaggtggagcgggagatcgcgatcctgaagctcattgagcacccccacgtcctaaagctgcacgacgtttatgaaaacaaaaaatatttgtacctggtgctagaacacgtgtcaggtggtgagctcttcgactacctggtgaagaaggggaggctgacgcctaaggaggctcggaagttcttccggcagatcatctctgcgctggacttctgccacagccactccatatgccacagggatctgaaacctgaaaacctcctgctggacgagaagaacaacatccgcatcgcagactttggcatggcgtccctgcaggttggcgacagctgttggagaccagctgtgggtccccccactacgcctgccccgaggtgatccggggggagaagtatgacggccggaaggggacgtgtggagctgcggcgtcatcctgttcgccttgctggtgggggctctgcccttcgacgatgacaacttgcgacagctgctggagaaggtgaagcggggcgtgttccacatgccgcactttatcccgcccgactgccagagtctgctacggggcatgagcgaggtggacgccgcacgccgcctcacgctagagcacattcagaaacacatatggtatatagggggcaagaatgagcccgaaccagagcagcccattcctcgcaaggtgcagatccgctcgctgcccagcctggaggacatcgaccccgacgtgctggacagcatgcactcactgggctgcttccgagaccgcaacaagctgctgcaggacctgctgtccgaggaggagaaccaggagaagatgatttacttcctcctcctggaccggaaagaaaggtacccgagccaggaggatgaggacctgcccccccggaacgagatagaccctccccggaagcgtgtggactccccgatgctgaaccggcacggcaagcggcggccagaacgcaaatccatggaggtgctcagcgtgacggacggcggctccccggtgcctgcgcggcgggccattgagatggcccagcacggccagaggtctcggtncatcagcggtgcntcctcaggcctttccacagcccactcagcagcccccgggtgacccctcacccctcaccaaggggcagtcccctccccacccccaagggacacctgtccacacgccaaaggagagcccggctggcacgcccaaccccacgcccccgtccagccccagcgtcggaggggtgccctggagggcgcggctcaactccatcaagaacagctttctgggctcaccccgcttccaccgccggaaactgcaagttccgacgccggaggagatgtccaacctgacaccagagtcgtccccagagctggcgaagaagtcctggtttgggaacttcatcagcctggagaaggaggagcagatcttcgtggtcatcaaagacaaacctctgagctccatcaaggctgacatcgtgcacgccttcctgtcgattcccagtctcagccacagcgtcatctcccaaacgagcttccgggccgagtacaaggccacgggggggccagccgtgttccagaagccggtcaagttccaggttgatatcacctacacggagggtggggaggcgcagaaggagaacggcatctactccgtcaccttcaccctgctctcaggccccagccgtcgcttcaagagggtggtggagaccatccaggcccagctgctgagcacacacgacccgcctgcggcccagcacttgtcagacaccactaactgtatggaaatgatgacggggcggctttccaaatgtggcagcccattgagtaacttctttgacgtaattaaacaacttttttcagacgagaagaacgggcaggcggcccaggcccccagcacgcccgccaagcggagtgcccacggcccactcggtgactccgcggccgc

SEQ ID NO: 132705 - DNA, 165 bp, Homo sapiens
aacgtggatgaatctcacatgtataactttgagcaaaagaaaccagacataaaagcaaatatgtcatgtcatacacaatatatgtaaccatttacattaccttccaaaaggcaagatttatagtgctataatcaagacagtggctatgttacctttgggggaaga

SEQ ID NO: 132706 - DNA, 1420 bp, Homo sapiens
agacatatttgccttgggattaacaattgcagtggctgcaggagcagagtcattgcccaccaatggtgctgcatggcaccatatccgcaagggtaactttccggacgttcctcaggagctctcagaaagcttttccagtctgctcaagaacatgatccaacctgatgccgaacagagaccttctgcagcagctctggccagaaatacagttctccggccttccctgggaaaaacagaagagctccaacagcagctgaatttggaaaagttcaagactgccacactggaaagggaactgagagaagcccagcaggcccagtcaccccagggatatacccatcatggtgacactggggtctctgggacccacacaggatcaagaagcacaaaacgcctggtgggaggaaagagtgcaaggtcttcaagctttacctcaggagagcgtgagcctctgcattaaaggaagaaaaggaaaacagcccttggtttggcctatggattacgaggttgctgttgctgattccccaccaaagatcccagggactcgttgtacatagaaaggaatagaatttagtttagagttgaagtcacagcttacagaaaatgtgcctggatttccacagcgcttcccaggttatatgatgctgttcctaagagagaattcccagcttctttgaggaagtgggtctcctaatgtataccctttctgatattgtatttattaaataaatggtttcaccattatgtgaggtgggtaaaagttagactgcatgcaacttggacatctctgagctggttgttaacttgcagaacaaaaatgctgtggggagaggcttcagggaaaacttgatgtgcctgtggttgttctccatctatttgccctgcctctcttgctgttctggttggtttgatattctgggtctcaccaatttctcttgatttttgtgagaatttggctttgtttcctgttttttaaaatcatattttatctaaatcctttttctgtacacatttttaaaggaagagaatactgtatttttaaataaaggtttttatcttgtccaaagcctaattacaggtaaaatatcctttgtaaaatgtaactaacaaagaatgagaaatttatgtcggagaacattttatgaataaaagggtaagagaattgagtgggtcagtagtaacaggtcttggtggcaagtctcagcttcacagttccaacagttaatgatggtcaggatctgctagaaaattatgttggtcataaaggtatttgataagctctgtttgtgtcatcttagtgaatgcaacctgttaatgataatggctttttcgctgcttgattttcttcttttcctcatttttaaaagctaattaagtttttttaattgaataaaccctaatactattctttgttctgctt

SEQ ID NO: 132707 - DNA, 217 bp, Homo sapiens
tagcctcactaatactattatattcattttctctctaggttaaaggaattgaatcaggtgaatgatctagtagaggtagtgggaactctgcttcagcagattcaaggaggggcgtgtgtagtaggatctggatgtgggttcatcttcttgggctaggcctgtggtaggggaaaggggaatttagagagataactgtccgctttgagtaggctgttga

SEQ ID NO: 132708 - DNA, 366 bp, Homo sapiens
atgaagcagatgttcaggtcttgagctgtggctggtggtggaggctcattttgtctgtgagtgaatgccattgccaaagcagtgacttgaatagaataaacggggattgaagaaacccttggggaacctctgtattctagctctttggaggaaaaaaagcagccatgaccatagcagttgggaatgtcaaagaggatgggattttttcctgagtctgaaagttggtcaaaatagagaggtaaaaggaggaaaaaaggtggtgggaggcaaaggtacaaaaataagaagagtaagtttaattttatttgcttgctagggtggttaaaagtctaatgaaatggctttttttttttctttgcctttgct

SEQ ID NO: 132709 - DNA, 582 bp, Homo sapiens
agcacaaacactaaacaaatgaagactctacaccttaacaccatcttctcagtttttaactttttgtgtcactatttatatatcattgtgctgtctatatcttcaaaggttgtgggaactatttttttttgtcagttcatgatttaatttttgtactttagcgaggtttacacaccacatttacagtgttatactagtctgtgtttttctgtctccttactattaccagtgagttttatagctttaggtgattacatattgctcattaatgcccttttctttctgattgaagtaatccctttaacatttcttataggacagatctggtgtttatgaaatccctcagcttttgttggtttggaaaagtctttctctttcatgtttgaagaatattttctccagtaacactattctgggctaaaagttttttccttcagcacttctaatatgtcatgccactgtctcctggcctttttccactgagaagtctgctgccagatgtagtggagctccattgtacattatttgtttcttttcttttgctgctttagaatcctttctttatccttgaccttagggaaa

SEQ ID NO: 132710 - DNA, 310 bp, Homo sapiens
cgattaaggatcccgcattctgcttctgccctcgtcaagcacctcactctattctcctggtgatcaagcagtgtggtttccccgatgagcactcctagatgattaaggttaaggaattaagacagtagtattagctgtcgcatggcctccctaagacagaggaaagaaccaagaggaagcctggcacctacactctaagggcctaagtctgtccttgatttcgcttgggatcaggatgcgtgagcctcagagttagaacagtgccccccgctcgtaccccgtccatcagctccatggcagaagcaggaag

SEQ ID NO: 132711 - DNA, 93 bp, Homo sapiens
caggagtggccccttataaggctatgccgttgggtggtcagaaaccagtggtatggctgggggaggtggctcacgcctataatcccagcacct

SEQ ID NO: 132712 - DNA, 1086 bp, Homo sapiens
gcaaggagactggtggcagggttgatctcatatttcttgtgcctcaaaatcccttctctgaagtctgccttccctggagaagcaagatggcagaatcggattctactgactttgacctgctgtggtatctagagaatctcagtgacaaggaatttcagagttttaagaagtatctggcacgcaagattcttgatttcaaactgccacagtttccactgatacagatgacaaaagaagaactggctaacgtgttgccaatctcttatgagggacagtatatatggaatatgctcttcagcatattttcaatgatgcgtaaggaagatctttgtaggaagatcattggcagacgaaaccgcaatcaggaggcatgcaaagctgtcatgaggagaaaattcatgctgcaatgggaaagtcacacttttggaaaatttcattataaattttttcgtgacgtttcgtcagatgtgttctacatacttcaattagcctatgattctaccagctattattcagcaaacaatctcaatgtgttcctgatgggagagagagcatctggaaaaactattgttataaatctggctgtgttgaggtggatcaagggtgagatgtggcagaacatgatctcgtacgtcgttcacctcacttctcacgaaataaaccagatgaccaacagcagcttggctgagctaatcgccaaggactggcctgacggccaggctcccattgcagacatcctgtctgatcccaagaaactccttttcatcctcgaggacttggacaacataagattcgagttaaatgtcaatgaaagtgctttgtgtagtaacagcacccagaaagttcccattccagttctcctggtcagtttgctgaagagaaaaatggctccaggctgctggttcctcatctcctcaaggcccacacgtgggaataatgtaaaaacgttcttgaaagaggtagattgctgcacgaccttgcagctgtcgaatgggaagagggagatatattttaactctttctttaaagaccgccagagggcgtcggcagccctccagcttgtacatgaggatgaaatactcgtgg

SEQ ID NO: 132713 - DNA, 672 bp, Homo sapiens
aactcatagcccaattttgtctcacacatatttctacttactccccattttcaagttattttgaagcaaattagagatgtcatattattttattcataagtatttttatagttacatctaaatgttaaaagaactctttttaaaaatatttttaacccacaataccgctatcacttcttttaaaaatgtcagtaatttcttattatcaaatattcagtcatgttcaaattttttgtacctttgaaacctttagttatctgcctcatgaaaagggagattaaagtgtgctcattttttgtaaactagagtatgtcctgtatagtcaaggatgtaggttggtaagctcaaataattgtgtggcataattactgacaataaggagttaatataattctatcaatttcactacattagaaaaagaaaaacaaggagtagaaatgcatattccacctcccactcacctggacttctcagggtgttccagaaggatggcattctaaccttcccctctgttgaaatcacaaacaagagctgattacaacagaggaatgtggcagtcttacatatttttgtgctcaacactcaatttcacctctttattatgtaattactgattacttaaaactaaagctaataaataaatgctaagactctcttcctcataggagtata

SEQ ID NO: 132714 - DNA, 146 bp, Homo sapiens
gtgcagttgaactcactgggaatgtggctcgggttcctacagactcactgggcagctgctcacatggggtaaggggtgggatctgctgaagcccaggagtcgtctcccacccacccagcctccacgttcacttagatgtgcatgga

SEQ ID NO: 132715 - DNA, 536 bp, Homo sapiens
gaagaggttatatttttgccatatatagtcttcccattccagaaatatggtttctatgcttattaaaattgtcttttctatttcccagtgaagttttatttttctattttaatacaattttaaatttacagaaaacttgctgaaatattaaaaatagtttttcccctgaactatgaggataagttgccaatatgacacccttttaccattgaatattttgtgtaattctgacaaataagaaccttccatgcctggtgcggtggcttatgcttgtaatcccagcattttgggaggcggaggcgggcgaatcacctgaagtcaggagtttgatactagcctggccaacgtggtgaaaccccatctctactgaaaatacaaaaattagtcgggcgtggtagcaggcacctgtaatctcagctactcaggaggctgaagcaggagaattgcttgaacccaggagatggaggctgcagtgagccgagagatcactccactgtactccagcctgggagatagagtgagactctgtctcaaaa

SEQ ID NO: 132716 - DNA, 314 bp, Homo sapiens
atttgtaaccaaaaagtttcagaatggttggtgtagaaaaggttttagctacaggtaggattaacaaatgatatatattgagcctttttccagactaaataacaaatattctaaaatttccaaagtttttgaaaaatctttgctagggtaaactctataagaaatgtgttgatgggcttcagaaatcattcaatgtgtaactatgggatgcctactcaaggcacttgtaggatacaaagattagacatgatttctactctcagagaccttactagtaggagtaagaaaacatattcaacaatgcagcatatgat

SEQ ID NO: 132717 - DNA, 573 bp, Homo sapiens
ttctggagttgtaggaatataggctttccccccactgtactacacttgaatccagccgctcgctcccattttaagagtgggaaagtgctgcatctgggccaccacagactctgttgaggtgtgaatgggagttcttttgcatatcccaacaaagaccccagttttaggaaaggagcatccctgaagttgagctgcattctagtgtggaaagagggtttttccagataaaaggggcagtggttagagtgaagatgaaggaagaaggaatgacagaaggggactgtgggaaagagagaagaccctgggaaggagggaagactgtggggaaggatagcaagattgtgggaaagtgagcaggactgtggggaagagagaggagggccctgggaaggaaggaggactgtggaaaggcgaggtggatggtgggaaagagggaggaggaccctaggaaggaggactgtgggaaggggagaaggatcatgggaaagagagaggaggaccctgggaaggaaggagtactttgggaaggtgaggaggactgtgggaaagagggaggaggaccctgggaaggaa

SEQ ID NO: 132718 - DNA, 223 bp, Homo sapiens
ggctccttcactatgattctcagattagggactgtagctttgcagggaagaccccacgacagcatgtctgcagcgagttaccttcctaaactgccccttctgcacgtgggcctcactggccagtgtggtgcactggcaaagtaacctgtgttgtggctcagcagtgttgttctcaagtagttaatcttcaggtagtagctaaaaaatgtgaccttactgctgt

SEQ ID NO: 132719 - DNA, 224 bp, Homo sapiens
tctaaatttaacaaatacgtttgtaacagtcactgtaccatgaagtagtgcctataaatctgaaaaaactacttagaaattatcaaaaatttcataaaattcaaatagagatgtggtaaatatattaacatttcaaggataagcagattgatcagatactcataggtagggaaatgtaggaagagtccaggggaagagaacaatgctgtttatctgaagctcaa

SEQ ID NO: 132720 - DNA, 1027 bp, Homo sapiens
ggtctcaaagcaatgataccctaatggcaatgagcacacctaccacccagatcttggttggtttctttctttttttcccccgccctgggctgaagtgcagtggtacaaacacggctcactgcagcctcgacctcccaggttcaagtgatcttcccgcctgagctccctaagtagctgggactacaggtgtgtgtcaccacgtctgcttaatttttgtattctttttttagtagagacagagtgtcaccatggtgcccagccagtccttaagctcctgaggcccttgagctcctgagctgaagtgatcctcccacttcagcctcccaaagtgctggattataggtgtgagccacggcacccagccagatcttgcttactaataccttcttccacaaaaggacctggggctctttggagaaatggctcattctagggatagggcaatgaatgtacaagatgagcctagatcaccttgtacatccccccttatctgcaatttcgcttcccacagtttgttaccaaaaatattgcatggaaatttctagaagtaaggaattcataagttttaaattgcccaccattcagagtagccacagtggggtgataagtgctcagttaagatggaaaaggcattaaatttgtgggcagaagacatgcacagaaacatattcctattgagggcaatcaggttgagtactgtccatggtttcaggcattctactgggggtctttgtcataaattgtgccaatatatgtgtatgtctatttctgcctgtgtattcttactaattttatataggttctatttatgctaataccagactgtgttaattatagtatcaatgtttgctatagtattagtacatggtcccactttttttcttcggtctattattggactttgcatttccatatacattttagaatcaatttattccacaaaaagctaccaacaacaaaaaagcctgttgggattttattggaattgtgtcagatctatagatcaatttgggaggactgattttta

SEQ ID NO: 132721 - DNA, 182 bp, Homo sapiens
taaagagtcactccaaatttataagctcattaaactagtatttctgaccgtttacacatttggctgtagagaaaatacacagaatgcttccagccacacctatgcctactcaagccacttagctgacaagccacttagctttttcttctaattactcgggtgcgcgtctctgttatttacaa

SEQ ID NO: 132722 - DNA, 437 bp, Homo sapiens
tcagaatctcctttttctatcttctctttgcctgataattattatcactaatttgatgatgaggaattatttctcttagtttcatttctgtaagcagccctgttctgttgggaaagactcccagcaccaaaattaggaagacatatttgagacaaatatgtgcttccttttcctctgcatctaacttcagcctgtgccctctgatcctatatttcagtctcagggctagattgaggttgagttatggttgagatctgaccatcagtttttaaaagctgagcgtagcaccttacaatctccatctcactggttccagaccactacagagagatcacggaggcttgagatgtccttagaacacagtcaaatccagctgacctcaggatactctagctctgcctttccacctggatccatttggtctctgctcctttcct

SEQ ID NO: 132723 - DNA, 303 bp, Homo sapiens
caggcatgagttgccacacttgactctaactggggaacttcactctctgtcttttttttttttgagacgaattttcgctcttgttgcctaaagctggagtgcagtggcgcgttctcagctcactgcaacctccgcctgcctaattcaagtgattctcatgcctcagcatcctgagtagcctttcaggggttacaggtgcctgccaccaacccagctaactttttttttttttttgagacggggtttttctcttgtttcccaggctggaatgcaatggcgagatatcggcttactgcagcctct

SEQ ID NO: 132724 - DNA, 381 bp, Homo sapiens
tacgtaccacatttatttgagcatatgctctttcctttttcaaattttatgttgtaaagtttacttaaaacacatctacagagtactgaatgttaagaggaatagctgtcatcatgtaaaattctagcagagaaaaaattaccagcatagtaaaacaaatttctgctacttcaagttagattcacaagactaggaacatatccacctgtcactcagaggaagtccacaaagaagagtgcattaattttctttctcttctgaaaatagtagtgattcttggaagtggagataacttttttcttcagagagtcataatacaaaaaataataaacagtctttttgttgttgttgttacatattacgaggtttctgtgttgccca

SEQ ID NO: 132725 - DNA, 198 bp, Homo sapiens
aaaaagagacaagaatccctatagacaatgaaagcatgccacaaaaacagacaaaacctgtaactgtttatttttaaatgagctaagagatgttaagatcacacatgaagaacataaatcagaaatacaaaaatctcagaaatgagatgacagaacttagggaagacttaaaaataaaagaattcttttggaaatgaa

SEQ ID NO: 132726 - DNA, 389 bp, Homo sapiens
ggggaatgactccattgagcagggctgggcaggagtgaggagctgatgggagccaggttcgggttctgaggattagggaagagaccatctaaggggacagaatgagggcaggaatggggccccacgtagggaggaggtgagaaccagtggaagggccgaaagggaagggagaacagaatttcttcttatgtctctcccttctttccctctcctgcactcccacctccaactctatctttctgttgagagtgtgactgccaaccaacaggcttagagggctatgaaaagaggagaggggttaggggatgggacgagggatgatggcagaagtatgcagggggctgatgaagtaaaacgagaataaaatcaccaacaaagagagagaatgg

SEQ ID NO: 132727 - DNA, 310 bp, Homo sapiens
ggttatgtgggcaaaatcagaactgatacagtttgagaaggcagaccttccccccattcctcgcagcgtgaatgttcttccagtcgtcaagggatctgcctgatcccccgttggctgctcgcctggcgtctgtatctggctgctgcggcactttgtgcccccagagcctcatgtccatagtctcagattttgccctctctctgggatttcattcttacatttttgggtcctccagtttttctttaattttcaaaaaggtgaaggaaaaaatgtcaggatcctgggttttgatctcccacaccttccgagt

SEQ ID NO: 132728 - DNA, 167 bp, Homo sapiens
acggacaaaagtgccttcccatcagtccctgggttgggctccggttaccatggatcgccggttccaactcagggccctctcgggcccgctaggggtaccacaaagcgggcagaaggcccctgaggggaagttaaggtgtgagggaggggtggtgaggcagctgtagc

SEQ ID NO: 132729 - DNA, 375 bp, Homo sapiens
gttggatacatggtctggtgttcagatgtgagagtcagcctggagatttgggcttcatcatgaagtttgggaattgacacccagagaatgggtgaggttgcacaccaaggcagagagaattgagggagacacgaagaggagggcctgcaacctgtggacgccagcaacatgttggagaagaagctcttacaggaaaaagaggaggctggggttgtgatcactgatcacaggctgggtgggctacaagaaggagggattggctaggtgcagtggcttgcagctataatcctggctactcaggaggctgaggtgggaggatcgcttgaggctaggaattcaaggctagcctgggcaacatagtgagacccccatctc

SEQ ID NO: 132730 - DNA, 882 bp, Homo sapiens
gtggacctatattcaactccaaaacccatgctctttaatataccatggtactttttttttaatttttatttttgttagtaagcctcgtttttcagctattcttgctctgctgaactgacttaatgttataccagtagttttaaatgaatgctagatggaataatctggaaatggttgaaatggcaaattttatgttacatttatgttacatttattttaccacaataaaaaatagaatcatctgggaagctatttaagcatacgcatgctcaggaccctgcctggggagataaagtgggtcttgtggtaaggcctgggcatgcatattttggaagagctccccaagtgatgctgatgtatactcctttggggtattactggcacatcttattcaattagcaattaactatgtactatcttgtattactagtttgctgttgccctgtattgttatttaacttgaacagttaattaactatcatcgaacagacatttattgagtactttgtgtgtcaggcactgtgctggggcatgagataataaagaagggcacaagataataaagaagtctctgctcaagaagtataattctagtaggaaaactaattttaaaaatgccatattagtgataagtgttggcaacagaccaagccatgtgatggagactgggggacttctaggggcagctctgaatgatgcattgaccgaacctgagggcggggcctgggttttggaaccgcgtttagggaaataagtacaggccggaggaaaacctggcgtagagacaacagactattgtggaggaatattggccccgcataatatgaggggggggtgctgttagacaagcaaatatcttccagaccacgcgtgtgtttttaa

SEQ ID NO: 132731 - DNA, 436 bp, Homo sapiens
atgcccctggctttttttgtttgcactaagcaccaagtacatctgagcccccgtgcctaacaggaaaagacagactgtcaagcaaggaccgaaagcctggccttaacatcatagcacattacactgggaaatggagatggagcatccaagacaacacttaacccaaccttgtaatcttctgcagcaaaagtggtgggggaattctgatacgtgctctgtcctggttaatactagaaggttctgaggcatccataattctaaataattaaaggagtcaatcaatcactagcctttgtgagtcatcacaatccggtggttttacacctgatggaggttttacacctgatggaggtttccttggtagtgattcagcttcacatctcattcttggctaatctttaatcatagcttgcttgcttgctttttgttgttgttt

SEQ ID NO: 132732 - DNA, 729 bp, Homo sapiens
agatgcaattttcagataaaataggcctattctaatggtaatgtaaaagttacacttatactttctgtcactgctcatacctgtaaatcccatggggggaaagtcatgatttcctttagacataacagtcgtagcccacaaataagccgccatgaaatagtcaagcaacaggcctccagtagctgcagctggagaaaacactggataaggtgatccaatttctgcacaagatctagtctctcctccatagtagcgtttagcctggaagtcagtcattctcatactgtcaaaagccagggtcccagaaaagggaatctttacagaagcaaatattttatggaggacttgagagagtgtctctcaatgtttaagtatctattccatagcaaattaggaacaacaatagctagagttataaatacaattcattatgtgtattttgaaattgaattttgagcgattagcataaaaatactgaatatgcattgcaaattagcatgccaaccttgctaaatgaaataacagccctgacacgtacttaagtagaaagtggaactacacaaaaatggaggaatatcagtagataacatgtaaaccaggacgatgaaaaaagaggacacaagtaagatcactgcgggtatattattcttagctacatatagctaactgagtcaccattttctaaggaggaaaaattagaaggagtgctgaaagggaataactccagac

SEQ ID NO: 132733 - DNA, 896 bp, Homo sapiens
gagctagctgaacctaggatggctctatcctccgctgtgacagggcagcagtgaattcaatgtgaagtcccccagttgctgtgttccttatccccaaagtgtacaaattgcctttctgcaccacacggtggctgctgagggatgtgggtggggtggtatcagcaactcatgactgtctctccatccttcctcaatgcctcttttggtaatacaaagttaaaaccatgcgctgtgattgctcacctgatgtttggttcttatgacagtgtttttctttgtgcagatggttgttaaaatttggtgttccagggagtgtgggggtgtgattggtgtaggcttctattctgccatcttactctgccctctgaactttaatttataccataccagaaatcagagtgaaggtaaacaacaaggttacaatgtaactctattataaattttgatttttttttggtgacaaataccagtatatttttgtctttggatctataaattatttaatttagcaaactctaaagcttataaaatttaacttctcaagaagtctagcactttatggctattaattttactatcaaaatatccaggttactgaattcattttaataattataattcttctaaacatcatttgaagaattatttgtggacactagactcaagactacactaaatccaaacagtatacctaggacctgagttttgagtttttcatctcagttatctgtccttcaagttactacttcctcttatgctttcttttactaaccaaattttcagatttttacattggaccttctcctccaaggccctatgggacaactttgtaaatatgcatttacagcctttaaacaccaacattttaaactgagactaattcctgcaaccacatt

SEQ ID NO: 132734 - DNA, 385 bp, Homo sapiens
caccagacctggcctctctcgagagaacggggctgtgcatgattgcccgggacagcaggtgagaagcaggcctggcccggctagtgggtactggctgccctggctgtggctctggtggctcgctgcctggaaagctgttgaacccgcgtgctgtgtgaaggactctgctatggtcactccagggcagatatttatggaaaggtggagctggaagggacttagacacctccttgaccaacacactcatctagggatgaggaaactgctcccagaaggggaactacctgaggtcacggctttagggaagaaagtgggctgggcgcccattgagattcctcgcaaatgggactggaacagaagcactttctccatcatggccataagg

SEQ ID NO: 132735 - DNA, 434 bp, Homo sapiens
aacaaacctgcatgtgctgaaaaagaaaaaggaagaaagaaagaaagaaggaaggaaggaaggaaacaaatcaagtaagccaatatataaaaaaaaaaagatacttggcctgagggatcacatgatccatgtctctagtgatgtggcacccaatatgtcaatcaatatgatttagatcgggatggtaagttggcagcatgtttgaaatttcataaagattgttctgcttgccttaattttatgatgtcaatgacttaaatttcataaaatgtttattaagcaagtgactggctttttaggtcttctgttatcaaggcttagaagtggacatggctgagatctagaatgtagctatgaggcaaatcgaaagtaaagcattatgtcccacactgtgaatttgtaggaattactgtaataatttttttctaattgtt

SEQ ID NO: 132736 - DNA, 268 bp, Homo sapiens
cattaagcttattgccacataattaatattgccctctaaaattccttctttacataatgtttatgtttttaatttacctattttatgtgtttaatttatacatattatgtctttatttgtcattcaaatgagtatttgttgagggcctactgtgttaagcactgctgtaaatgctgggacatggccttgctcttgtggaacctacattctgctgggtatagaaaggcaagtaaataaaaaatcagatggtggtaagtacaaagcataa

SEQ ID NO: 132737 - DNA, 389 bp, Homo sapiens
ccactctctcctgattttctttccccactgcacccagcagttgcttcccaggactcacacccatcattatttatttagggaggcaaaatgttatagattagaaagctttaagaaatcaaaagaaagagaggtatgatatgtttttactaatttaaaaataatagaagccaatttatttaattctaaaagaaatctaaatcatagctacattgaataagaaagcagtgtgaggcagtactaagtagggtggaataatataaataattacatgtctaaaacatcaaattattttttattattttgacaggctagaggttacgcatgctatagtgttaactcaatgttaattttagtgttaactgatagaaattatcaggctaacatctaac

SEQ ID NO: 132738 - DNA, 403 bp, Homo sapiens
caccagaataaggggtttgcattttattttaagagcaataggaagactttaaagggttctaaataagatcgacttgtggttttaaaaactgacactatacatttcccagttgtctctgcaacatcaatgaaatgcaagaatttcttcagttgttgatttttttaaaagttttttagagtcagggtctttccctgtcacccaggctggagtgcaatggcacaatcacagctcactgcagcctttaacttctgggttcaagcaatcctcctgcctcaaccacctgagtagatggaaccagaggtgtgcaccaccatgcctggataattttcttattttttgtagggacagagtctcactatgttgtccaggctggtttcagacttctggccttaaatgatcctcc

SEQ ID NO: 132739 - DNA, 281 bp, Homo sapiens
ttatatccttacttgctttattaattacctgaatctatcttaaaaggaagcagtaatttctctaatagctggggtgtggctgcatcttcaggtggatgttaagctctcctaggatggtatgctcacacacaggcactcacatgtgaacacgcatacaaacatgcacctgcatgcatgcatatgtgcacatacatatgtgcgggcacacacaggtacacatgcacacatgctcatatatgtgtacacaaacttaagtccatggctctgaaatatggatttgt

SEQ ID NO: 132740 - DNA, 366 bp, Homo sapiens
ccactccgagtcaaagcaaaggctgtgtgcacagcaccaagtgcagatgtgaggatacgtgtgctccactgttgacaagagcccttccttttgtcctttagaattaaaagccaggtctcttctgctttgttatccccttccggagtggcagggaggacaaaccctcatgcagggatacagaggtgcacccaccagccatgcacacagagccagccactcctccccagcaagctctgccccggccctgcctttcggaatgtcactctccaccatcctgctgctgcccagagcaaacgggtggttctctggctttctaatagggcatcgctccaatgactggtcaagcctcgaatgtctgaggtcagg

SEQ ID NO: 132741 - DNA, 488 bp, Homo sapiens
ctgtgtatgcgtatgtgtgtgtatgtgtgtatgtgtgcgtgtatgtgtgtatgtgtacgcgtgtgtgtgtgtgtgtgtgtgtgtgtgtgtgtctatacacataccaagcctgtttggttgttcaccgttgtgttagtttgctagggctgctataacaaagtactgcaaactgggtggctcgcagttctggaggccggaagtccaggatcaagatattggtaggttggttcctcctgaggcctctcttcttggcttgatggccaccttctcactgtgtcctcacatcctcacatggtcttttacctctgtgcacctccctgatgtctctttctgtgtcctaatttcttcttcttcctcttttttttttccttgagatggagttttgctcttgttttgcccaggctggagtgcaatggcatgatcttggctcactgcaacctccacctcccaagttcaagtgattttccggcctcagcctcccaagtagc

SEQ ID NO: 132742 - DNA, 615 bp, Homo sapiens
gtatgtactcttacatctgacttctttcattcagcataattattttgagattattcacactatactgtgtaacaatacattcattctgtggataaaccacaattaacaaatttacttgttgatggaaatctggtttttgttttgctttttccagtttttggctattacaaatagaactgctgtgatccttcatgtacaagtcttggtatgggctgggatttcatttctttgggataaatacttagaagtggaatggctggattatatgataggcatatgtttaaatttttaagaaactgtcaaactgttttccaaagtgttttacagtatatgagaattccagtttctccacatccttatcttggcagtcaactctatcagccattctgacagctatgttgtggtatcttattgcagtcttattttacatttccttggtgactatttatattgactatcttctcatgtttttgtttgtcatctgtatatctttatggaaaagtatctgttcagatattttggtcgtttaaaaaattgtttttttttctttttattgagatttcagttttctttatgtattttggatacaaagctttcattaaagatatgatttac

SEQ ID NO: 132743 - DNA, 443 bp, Homo sapiens
actaccatgcatggcaccctccgtgtgcctcgcggagaagttgccctcatatggtctgtgctggaagagtgacggagcaggggaatctggcacaggcggaacgtgataattcatgcacaggcctggccaaggtctttcccacccgtttctttgggttttcagctcctcatttttagcgccaagcttctgttcctcctctggagccctagtgctcctcctctgtgccaattgtttggaagattctaaaacctctgtgtgagccattgagagctcatggggcaggagacctgtttgtatgtggaaggccccggaactagctctccttccccttccgcaggccttcaggcctcattttgagtcttggggtttgagacaccgttcctggatgttgaaagtccacagaggggaggcaagacacccttccctgcacccctggcccctgc

SEQ ID NO: 132744 - DNA, 414 bp, Homo sapiens
cccaccggcaggtgtactccaccggcgggtgtactccaccggcaggtgtactccaccggcaaaagacaaagacagctcatgaaagagaaaataacaaatatgcaaatgtctaatttcattagtaaattaaagaaattcaaactaaaacaattagataaaactttctttcttttttttttttttcaagaagcagtttcgctcttgttgcccaggctggagtgcaatggtgtgatctcagctcactgcaacctctgcctcccaggtttccgccattctcctgcctcagcctcccgagtagttgggactacaggtgcccaccaccatgcccggctaattttttctatttttagtagagatggggtttcactgtgttagccaggatgatatcgatctcctgacctcgtgatccacccg

SEQ ID NO: 132745 - DNA, 442 bp, Homo sapiens
gacaggatacagtggcgatgatatcttgcccctcaactgaaagactcaaattctggggctggaatcgtatgaaagctcattgactcacatgtcttgacaacaggtgctcactgtcagtggaacactcacacatggctctccttgttgcctgggcttcctcacaacatagcggtgggttccaagggcaagcgtatcaagagacaaagatgggctaaggctgtatccttcttctgacctagtctcagaagtcatatagcatcacttctgctgagctctgtgggttggagaaatcacaagcccctatccagatttaaaaagagaaaacatagacccccatctctctgtgtaagaagttcagtaatattataagaagagcatgttggacgggatacatgtacaagtatggccatgtttaaaaaatacaatctgccacagacacaca

SEQ ID NO: 132746 - DNA, 262 bp, Homo sapiens
ttctatcagggggtgcatccctcaggcctgcttctctttgttgtgggtatcagtagcccaatgtgggcttcactttaaatatgtattaattaggctaataaaacttacccaaaccaatgttatttcattctctttatcaataataatgtttcacatacacattggtaacattacagtaagcatattttcatgctgctgtcttgtatttgcaagctcaatatttagatggaaacctgtttgctgagccattgatttaattcaa

SEQ ID NO: 132747 - DNA, 767 bp, Homo sapiens
gaaatattcacctctttaaattatttttaattaattgtgctggaagggatggttgccagggctctcagaacctctaggtaatttagtctaagcatcctttgcaattcaaatttagggcatggactgattttaaactcttgaagttttacatgtgtctgaaagaaacaacaagactaccagctcgcaaatcaactgggaagttacagctataggtagaaactgacttggaatttagaacatacatgatgtggtaggaagactgtgggctggtgtcagaaccctgtggtcctatgggtactctctctatcactcaccagccacaagatatacatcagtctcactcccaaggccctgcttcccgcatatgtacaaggagcataataacatccatccttagttaatcccacccaaggataatgctaaaagacatgagattgatctgtatgaaaatcctttggaaaccgaagcatgctatttattttaaattattattattgagttatttttacctaagggctttgctttctgaatttattcattaatagaaattttaaaacatgacttactgctatgatacttgtagtccatatcatttatttaataacctacactgaatgactattagaaacaaagcaaaaaaaagccttaaatggaggagtctggtgatttggtgggattttatcatctctccaagtgtgcagtgatctctagtgctctagtgctcagtttgaataaagaaacccttcttgtcaatgtacaggggctcc

SEQ ID NO: 132748 - DNA, 332 bp, Homo sapiens
agagcacggctctcttaactgtatctacttaccatatgcatctgaatttcagatgcgtaaaaatgtagaaacaatgcgagtcttcaaatggaggaaataatgcctgtgtgcttatataatttgaataaaagctgtgctgtttggagccctaaacttcaaatggatgacatgttaaaagcttccaaacccacttttgatcaaaaatgggtggaacctatgtggaccagatttttcagctgtgctgaaagagtaacagcaaaccagagtcattgggcgtggttgtgccaacgatcagctcttagaagaccataccaatcacattttacaggatt

SEQ ID NO: 132749 - DNA, 735 bp, Homo sapiens
atttagtgttgataaagcatattaatgagtgcactgcaccattaaaatgaacacgtaatgaagtacctaaaccactttatcttaaatgcaagatagagtcttacagatttctggttctcatggaagaccatcaggggcccacacattaaaaacagcagagtgcaagagctgggagggtaccactctaggaacattttaaaataatattaccatttgcttgattctaatttaaataatttggagttcttataacattggtaaattttgaaaagtaggatatttacacaaagagagtataaaagaaataattttttggaattttgcaatgcatttcttttaagggacatcacattcttataggccttcactgattaaagaaactttattagataaaaatgagaagcatgtgcttctggtagtattgtacctagaggattttagttaagtcaagtctgaacttttagagcatttgaaatatacttagttggatagttaacggatcctcttcaacttaaagtagatgcttgttataagagaaaaaatgtacaaaaagagttacagagtagacaaaaatatcttaaattcttttccagtgttccaattctgatgatttttaggagttatagctgaagaagtatcgttcatccctaaaattggtttcttgcataacacattattttgaatgtcaccagtcagcccttgggcttctttaaaagaccaaagaccaagattgaa

SEQ ID NO: 132750 - DNA, 442 bp, Homo sapiens
ggcttgcacctgtaatctcagcattttgagagacagaaatgggcggatagcttgagcccaggagtttggagtttaagaccagcctgggtaacaatggtgataccctgtctttacaaaaaaagaaaagaaaaaaaaaactggcatgctcctgtagtcccagctacttgggaggatgagacaggaagatcactgagatcacactattaagctccggccttggtgacagaatgagaccctgtctcaaaaaaaaaaaaaaagaaaacaataaactaaaaattagaaggatttgttttgagatcaacaaaggaagacttttatattttgtgacataattaaaaatacagtttttctaaaaaattattattgatgtataaaaggcaagcaaaatccaaggatttttaaccttgctttaggagatacaaaagttctgtgtgatcatgaa

SEQ ID NO: 132751 - DNA, 275 bp, Homo sapiens
aatgcatttacctgggggatcagaaaggaaactagaggggtgtccactggggctactgagtggtggctgtaaagagtctcagtatgtcaatatgggtcttacatggttgtggtcagtggtagcagacctggcccaactcagtgaagacaggtgcatgagaaggtcagatggtgctactggggtttattcattttgaataaataaactgaaagccggcttggcacggtggctcacagctgtaattccaactttgggaggccaagacaagaggtccg

SEQ ID NO: 132752 - DNA, 451 bp, Homo sapiens
aagagttccaacctgatgtgccattaaatgggctgtgtgtgtctagagaaaagcatattaagagaaagaaacatccagacaaaggggccagtcagtgcagggatcgagaaaaattccctgtgtagctcgttatccaacagacacctgccattgatttgcttcatgacaggcagtgcaatggggaaagccaatggaatgcaaatgttgccattaagtgtgctcaggtcagagcagcccagtggccctgcaaaggtccctcgttacttattctgctggcaaaccctgcctgctccagcgaggacagactgttattaaagccctctcttcttggtgaatttggagtgtgtgctttgtaggacaagtaacagtaacaacaaaaccaacaagtttagcattagcctgtggtttctaggcctcttattctccaaaccaaagatggatttcaagcagg

SEQ ID NO: 132753 - DNA, 1174 bp, Homo sapiens
gattttgtatagccctcagtgacagcttaccatacccttcctaggttgtacagtattgtagttacttgttcacaggcctgtatcctcctactagactgagttgatggcagttatgaccgatggtagctgaagttttatttaaatattcaaactaaaaactctttatctgcagggacctctcctagtgtagatgcatagtcgaaacttgataattgacgtgtattgctggtggtgagggaagtgctgattgtggtgcagacagcacattcctggatgaggggatagtataggcaaaggcatgaagaatgtttgggagaatctggaatgtagacagaagagaaattgtgttttgaaaatcaaagtaagaagtttggtaggcaatgaggagtattgtttttgtttttgtttttaaatagagacagcgtctcgccatgttgcccaggctggtctcaaactcctgtgctcaagcgatcctcctgccttggcctcccaaagtgttgggattataggagtgagccaccatgaccccaagggcagtttttgatcaggggatttttcatacagcttgtgcagctggtgctcaaagtgtgatgaatgaatgaaaccaacaagatgtatctgaattactttgtgagtacattatctttggaacttgtttcatgtttacagaaagtaaattggtggtttaagtgttgggagctgcctgtgtatcctttgtgtgaaagaattagaacacacagattttattcttaagtagtttctaattttgttgaggaaacaaacatttgaaagttatgggcctttgcaaaaccattatacaagtaaataatacttagattatatgaagatatagaacaaaaaaagtatctgagtagcatagggttaatcaggaaacaattcttggaggaagtaatacaaggaaatgggaggctgaggagagcatttgcctctgcagtttatggagaggattttattaaattattcaaattcatttcaatagaatattcccagtagataacattagcatttaaaacagccagagagaggggactgaaacaggctttcctttctacgatggaataaataaatggcttttgttattgttaaatagaatccatacccggctacgggcaccgacagccaggatgggtgctggtgcttattgcctgtacca

SEQ ID NO: 132754 - DNA, 356 bp, Homo sapiens
tccacagctagaaattcagtgtgcctaaagtctaataaggaacacaggcatggccaagtatggtggctcatgcctgtaatctcagcattttggagggctgaggtgggcagatcacctgagctcaggagtttgagaccggcctaggcaacatggtaaaaccccatctctacaaaaaatataaaaattagccaggcagatggtgcacgcctgcagtcccaggtactcaggaggctgaggcacgagaattacttgaacccaggaggttgaggctgccagtgagccgagatcacactactgcactccagcccagcaacagggccagaccctgtctaaaaaaaaaagaagaagaacatagg

SEQ ID NO: 132755 - DNA, 735 bp, Homo sapiens
ggttctcatcttgctaaatgacatttagaagcagcataactgcttctaatctaggattaccacacatctaggattctaacagttttcatccattcatcaaatgtttactgagcacatgctctgtgagaggccgtttactaagtacaaattcactgaagaacatgtctgtcttcaagttcattcattttagttctgtgtgtcaaagctcatatagtaaactacaaaactaaattatgttgctgttctagaattttttttttttctcttctgagacagagtcttgctctgttacccaggctggagtgcagtggtgcaatctatgctcacttcaacctctgcctcctgggttcaagcgattctcctgcctcaaccttctgagtagctgggattacaggcactcaccaccacacaggggtactttttgtatttttagtagagacaaggtttcgccatgttggccaggctggtctcaaactcatgacctcatgtgatccacccatttgggaggctgaggcaaggggattacctgaggcagggagttagcgaccagcctggccaacatggtgaaactccatctctactaaaaatacaaaaattagccaggcagggtggtatgcacctgaaatcccagctactcgggaggctgaggcaggagaatcacatgaacccaggaggtggaggttacagtgagctaagatcatgccactgcactccagcctgggcaacagagcaaga

SEQ ID NO: 132756 - DNA, 773 bp, Homo sapiens
ggaatttttttaaagaaaaagacacaaacacaccatagggaaaacaggagaggagataatagcaatgaatttttggaagctgaaaagcagacaaaagagtgatgaatgacttagacctgagaaaactgaattataactagcagtgaggaaagccaagaagcattgaaggtctaagaaacagtcagatcccaagacaccctaccccattgagtacagtgggcaactctgcctcccaactgtggcagagactggaaatctggcaagggactcgggcacagcttagggctgaagtactgcactgaaaacaggagcatgtagtgaactatactcgatgctgagcctccagccctttcccccttttcagtttccagagcgctggcagaagagccttcaccctccaagcatgaaattgaataatccttctctccagaatcctcttgaagggaagtcctaaaatatataagtattgaatgttccctatccaaatgactcactgtcagcaaggctcacttacacacttagagcttccactcagctttaaagcctccactcttaagttatggtttaagttctcctttaaactagggattaccaaacatctaaagaaaggatctgtgaaaaaaagtgatccaaactgccccccaccccactctggaatgtacctttgttttactctgaaggctgtatctccctggtaaaaaataaataaaaatgaaaaagcaaactgcctctcccaacctcatgtacacacagaagaaacaaacaggaaaaaa

SEQ ID NO: 132757 - DNA, 441 bp, Homo sapiens
tagctctgacccagcaattcccttaaattaaccttggcactggcacagtgctcaggaccttttccataaggggcttgctcctctgactcacccctcctcatcaattcttttctccagggaaatcttcctaagaactggctgcattatagaaccagactggaatccactcatctggcacagtaaaaccagatatctacaccaaggtttttgcagcagtagaaaggcatttatttgcagggtgccaagcaaggaggaccaggaagctaaatgctcaaatcctgacctccttgatgacttgcaagcaagagtttttaaagatgcggactgaattacaccgctggctttccttgttctccagcttgcaggcagcatactgtgggacttctgggcctccataattgtgaggaagtcaagaaggagatgtgacctatgtgagaccat

SEQ ID NO: 132758 - DNA, 389 bp, Homo sapiens
tacgcttaatagagaggggaggtgaggtgctggcacctgggaatgtctttgtgtcagcttttacttaaaggtatttcaaaacttcaagaaaaatgcacatttctgagaggtgtgtatatcttagccctaccaagtatagaatgtgaaactgagagggttactgaatcttagtatctcgactgaaaagccaatgtgtcatagtatattttgctaaaatcttgactcaattgaagagaagtaaggcccttaaaattttgagaactaggtgacgtgtctgaaaattttgagaaaagtgcttttcacacctgtaggacaagaaggtttctgccttttttgcttattgggttaactttctataatttaataggaaagaatgaaaaggaatagta

SEQ ID NO: 132759 - DNA, 970 bp, Homo sapiens
tgtggtcttggtctccatctcttctgttttggagaatcgctagtaactcactgttgaaggtggggaggaggggatgtggggccgtgggcagggcctggcatccttgctgccatgtctccagctgtgtccctggtgaagagtgcccctatcatgggtttcactgcccatctgtgacatgggctgacacctccctcacagagtgagtattctgcaaatgccaagagcaatgcccggcactggcagctacaatttattgagcatttactattaataaagcaacgagtagaaatgtgagtaggggcatgagcaatggcatccagaagattctgaggccttgagctgaggcaggacagagggaggaagaggggtgaagagttatggtccctgtctcagcccatcctcaagtacctccacaataggatgcttgtcttcagcagtgactttatagaagtatctatatatatacatttagtacaaccgacctttggtttcttctctcaatccccttttcaaacgtatataaaaatatccaaaggctcctcccagcccagtgtttccaggcagcctttcaaatcccctctttgccttagttggtcaaaagcctgtggatgcagcacccttccaggaagggagaggaagaaagttagggctccttcttggcagccttgggaaaccatcggggtagagccccaagcctagaggcgggagcctgccgtccttccatcttgccacacatgggcacatactttcctgttccctcttgccctggaaggctgagcctgcagtgagggaggtgagtccttttccctgcaggggtcaagagagaactcccttcgccaggcgcggtggctcacgcctgtaatcccagcactttgggaggctgaggcaggcagatcacgaggtcaggagatcgagaccattctggctaacatggtgaaaccgcgtatatactaaaaatacaaaataaatt

SEQ ID NO: 132760 - DNA, 621 bp, Homo sapiens
  misc_feature (19)..(19): n is a, c, g, or t
caggctgtacgctccggantatggggatctggacccggcgggatgagcgaggtggaggcggcagcggtggctacagcggtccccgcggcgacggtgcccgcgacggcggcaggggtggtagcggtggtggtaccggtgcccgcaggggagccgcagaaaggcggcggggcgggcggcgggggcggagccgcctcgggccccgctgctgggaccccctcggcgccgggctcccgcacccctggcaatccggcgacggcggtctcgggaacccccgcccccccggcccggagtcaggcggacaagccggtgctggacaatccaagtccgtgggcacgtgttcaaaatgggttcaacggtcccggaatgggttacggattcatcaaccagggaatgacaccaaggagaaggatgtcttttgtttcaccatgagcaggctatttaaaaaggaaaaccaaacgccgaggaaagttctcttgggcgacaggcgttttgggacgaattgggggagagctggtggaaatttggaatgtcgtgggaaagggaggaagaaaggggcggcgaaggaaggaccaactaaaaatgtaacctgggggcttggggggaaggtaccccgttgaaggg

SEQ ID NO: 132761 - DNA, 1655 bp, Homo sapiens
tgccattggcctcggctccgggcccgctgccggcgtgtgggcgaggctcggggcgcgaggaccgagcagggcggtgggttcgcgagccggggggaggggccggggcggtggcggctgtggccggtactggacccggcgggatgagcgaggtggaggcggcagcggtggctacagcggtccccgcggcgacggtgcccgcgacggcggcaggggtggtagcggtggtggtaccggtgcccgcaggggagccgcagaaaggcggcggggcgggcggcgggggcggagccgcctcgggccccgctgctgggaccccctcggcgccgggctcccgcacccctggcaatccggcgacggcggtctcgggaacccccgcccccccggcccggagtcaggcggacaagccggtgctggcaatccaagtcctgggcactgtcaaatggttcaacgtccggaatggttacggattcatcaacaggaatgacaccaaggaagatgtctttgttcaccagacagctattaaaagaaacaaccccaggaagtttctgcgcagcgttggagatggggagactgtggaatttgatgtcgtggaaggagagaagggcgcagaagccactaatgtaactgggcctgggggagtacccgtgaagggcagccgttatgcccccaaccgacgtaagtcccgccgattcatcccccggcctccctcagttgccccaccacccatggtggcagagatcccctcggcggggacaggacctggcagtaaaggggagcgggctgaagactctgggcaacggccccgacgatggtgccccccacccttcttctaccgacggcggtttgtgcgaggcccccggcctcccaaccagcagcagcctatagagggcactgacagggtagaacccaaagagacagccccattggaggggcaccaacagcagggagatgagcgagtccccccgcccagattccggcccaggtaccgaaggcctttccgccccaggccacgccagcagcctaccacagaaggtggggatggtgagaccaagcccagccaaggtcccgctgatggttcccggcctgagccccagcgcccacgaaaccgcccctacttccagcggagacggcagcaggcccctggcccccagcaggcccctggcccccggcagcccgcagcccctgagacctcagcccctgtcaacagtggggaccccaccaccaccatcctggagtgattccaactcaactcaaaggacacccagagctgccatctggtatctgccagtttttccaaatgacctgtaccctacccagtaccctgctccccctttcccataattcatgacatcaaaacaccagcttttcaccttttccttgagactcaggaggaccaaagcagcagccttttgctttttcttttttcttccctccccttatcaagggttgaaggaagggagccatccttactgttcagagacagcaactccctcccgtaactcaggctgagaaggaaccagccagctcttacctcctcctggttgcttttcttgcccccaccccaagtttatttttgttttcccccggccccctacctctgaagccattttatgatctgtcatgtgccacctgagcctccagtaaaaacaaaaacaggc

SEQ ID NO: 132762 - DNA, 2454 bp, Homo sapiens
cggaaaaccaaaggcggcctggcccgcaggcccagagcgctaactgggctgggagctgcgcaccaaagtggattcccctggtgggaaatcctgccgtaccttcctgggagagagggcggggccggcaggttcagctaaggtcttggggtggagaataaagccccagggtccggccacgcccccgggcgggacacagtgcctagttgactgggttagaactaggcaaacctctgagcctggcaagcaggtgcactggggacccttgcattgggagggctagaaaaaccctcagttatgacctgggggcggcactttgcagaccaggtgagtacccagttctaggtgaaggggctggatttgtaggatgtggggaacgtgacttagagttggaaggctttttgaaagcctgagtccctgtgtgggtgatttcatttggtggactagggtaggaataccttgaagctactagtgaaacctggttggcttgaaggtaacctgaataggtaataaggcagtaggctagatttttttttgttttggagtgtctcaaaactgagttcaactccatctcttccccccatctcactgtccccactgcatctctgcctggcagcaatccaagtcctgggcactgtcaaatggttcaacgtccggaatggttacggattcatcaacaggaatgacaccaaggaagatgtctttgttcaccaggaagcactgaggcagttttcagagggagaaggtccttgggtgcagtggttctcaaagcgtggcccctgcaccagcggcagcagcatcacctgacatccgaattctcaggtcccaccccagacctggtgaatcaatcagagctggggctggggctccacaatcggtttaacgagctctccaggtgattctgatgcacgctacagcttgagaaccactgcttggtggaaagagctctcactgggactgaggtaagaagcacagtgcattctacccactttgcgactgaaggctgtccctgccttttgctttggagttcatatttcttgcctccctttctgaaatccctgaggggtaaagcggggcgggaggggaggtgcggggagtgcatcctggggatggtggtaactgcacaatctgctgaggccctgagttcaggacttttcccctgctaaactttgaccacctccttgctccaccctccagctctagaccccaagtcaaatgttgaaagaatgaaattgggtggtggccccagcaggggtgacagagactcctgtcttgctgtctcacttttcacatggccttttccccaatcagacagctattaaaagaaacaaccccaggaagtttctgcgcagcgttggagatggggagactgtggaatttgatgtcgtggaaggagagaagggcgcagaagccactaatgtaactgggcctgggggagtacccgtgaagggcagccgttatgcccccaaccgacgtaagtcccgccgattcatcccccggcctccctcagttgccccaccacccatggtggcagagatcccctcggcggggacaggacctggcagtaaaggggagcgggctgaagactctgggcaacggccccgacgatggtgccccccacccttcttctaccgacggcggtttgtgcgaggcccccggcctcccaaccagcagcagcctatagagggcactgacagggtagaacccaaagagacagccccattggaggggcaccaacagcagggagatgagcgagtccccccgcccagattccggcccaggtaccgaaggcctttccgccccaggccacgccagcagcctaccacagaaggtggggatggtgagaccaagcccagccaaggtcccgctgatggttcccggcctgagccccagcgcccacgaaaccgcccctacttccagcggagacggcagcaggcccctggcccccagcaggcccctggcccccggcagcccgcagcccctgagacctcagcccctgtcaacagtggggaccccaccaccaccatcctggagtgattccaactcaactcaaaggacacccagagctgccatctggtatctgccagtttttccaaatgacctgtaccctacccagtaccctgctccccctttcccataattcatgacatcaaaacaccagcttttcaccttttccttgagactcaggaggaccaaagcagcagccttttgctttttcttttttcttccctccccttatcaagggttgaaggaagggagccatccttactgttcagagacagcaactccctcccgtaactcaggctgagaaggaaccagccagctcttacctcctcctggttgcttttcttgcccccaccccaagtttatttttgttttcccccggccccctacctctgaagccattttatgatctgtcatgtgccacctgagcctccagtaaaaacaaaaacaggc

SEQ ID NO: 132763 - DNA, 1291 bp, Homo sapiens
ggttccggtccccgaatttttgggataggcggacaagccggtgctggcaatccaagtcctgggcactgtcaaatggttcaacgtccggaatggttacggattcatcaacaggaatgacaccaaggaagatgtctttgttcaccagacagctattaaaagaaacaaccccaggaagtttctgcgcagcgttggagatggggagactgtggaatttgatgtcgtggaaggagagaagggcgcagaagccactaatgtaactgggcctgggggagtacccgtgaagggcagccgttatgcccccaaccgacgtaagtcccgccgattcatcccccggcctccctcagttgccccaccacccatggtggcagagatcccctcggcggggacaggacctggcagtaaaggggagcgggctgaagactctgggcaacggccccgacgatggtgccccccacccttcttctaccgacggcggtttgtgcgaggcccccggcctcccaaccagcagcagcctatagagggcactgacagggtagaacccaaagagacagccccattggaggggcaccaacagcagggagatgagcgagtccccccgcccagattccggcccaggtaccgaaggcctttccgccccaggccacgccagcagcctaccacagaaggtggggatggtgagaccaagcccagccaaggtcccgctgatggttcccggcctgagccccagcgcccacgaaaccgcccctacttccagcggagacggcagcaggcccctggcccccagcaggcccctggcccccggcagcccgcagcccctgagacctcagcccctgtcaacagtggggaccccaccaccaccatcctggagtgattccaactcaactcaaaggacacccagagctgccatctggtatctgccagtttttccaaatgacctgtaccctacccagtaccctgctccccctttcccataattcatgacatcaaaacaccagcttttcaccttttccttgagactcaggaggaccaaagcagcagccttttgctttttcttttttcttccctccccttatcaagggttgaaggaagggagccatccttactgttcagagacagcaactccctcccgtaactcaggctgagaaggaaccagccagctcttacctcctcctggttgcttttcttgcccccaccccaagtttatttttgttttcccccggccccctacctctgaagccattttatgatctgtcatgtgccacctgagcctccagtaaaaacaaaaacaggc

SEQ ID NO: 132764 - DNA, 1373 bp, Homo sapiens
tgccattggcctcggctccgggcccgctgccggcgtgtgggcgaggctcggggcgcgaggaccgagcagggcggtgggttcgcgagccggggggaggggccggggcggtggcggctgtggccggtactggacccggcgggatgagcgaggtggaggcggcagcggtggctacagcggtccccgcggcgacggtgcccgcgacggcggcaggggtggtagcggtggtggtaccggtgcccgcaggggagccgcagaaaggcggcggggcgggcggcgggggcggagccgcctcgggccccgctgctgggaccccctcggcgccgggctcccgcacccctggcaatccggcgacggcggtctcgggaacccccgcccccccggcccggagtcaggcggacaagccggtgctggcaatccaagtcctgggcactgtcaaatggttcaacgtccggaatggttacggattcatcaacaggaatgacaccaaggaagatgtctttgttcaccagacagctattaaaagaaacaaccccaggaagtttctgcgcagcgttggagatggggagactgtggaatttgatgtcgtggaaggagagaagggcgcagaagccactaatgtaactgggcctgggggagtacccgtgaagggcagccgttatgcccccaaccgacgtaagtcccgccgattcatcccccggcctccctcagttgccccaccacccatggtggcagagatcccctcggcggggacaggacctggcagtaaaggggagcgggctgaagactctgggcaacggccccgacgatggtgccccccacccttcttctaccgacggcggtttgtgcgaggcccccggcctcccaaccagcagcagcctatagagggcactgacagggtagaacccaaagagacagccccattggaggggcaccaacagcagggagatgagcgagtccccccgcccagattccggcccaggtaccgaaggcctttccgccccaggccacgccagcagcctaccacagaaggtggggatggtgagaccaagcccagccaaggtcccgctgatggttcccggcctgagccccagcgcccacgaaaccgcccctacttccagcggagacggcagcaggcccctggcccccagcaggcccctggcccccggcagcccgcagcccctgagacctcagcccctgtcaacagtggggaccccaccaccaccatcctggagtgattccaactcaactcaaaggacacccagagctgccatctggtatctgccagtttttccaaatgacctgtaccctacctctgaagccattttatgatctgtcatgtgccacctgagcctccagtaaaaacaaaaacaggc

SEQ ID NO: 132765 - DNA, 1022 bp, Homo sapiens
tgccattggcctcggctccgggcccgctgccggcgtgtgggcgaggctcggggcgcgaggaccgagcagggcggtgggttcgcgagccggggggaggggccggggcggtggcggctgtggccggtactggacccggcgggatgagcgaggtggaggcggcagcggtggctacagcggtccccgcggcgacggtgcccgcgacggcggcaggggtggtagcggtggtggtaccggtgcccgcaggggagccgcagaaaggcggcggggcgggcggcgggggcggagccgcctcgggccccgctgctgggaccccctcggcgccgggctcccgcacccctggcaatccggcgacggcggtctcgggaacccccgcccccccggcccggagtcaggcggacaagccggtgctggcaatccaagtcctgggcactgtcaaatggttcaacgtccggaatggttacggattcatcaacaggaatgacaccaaggaagatgtctttgttcaccagacagctattaaaagaaacaaccccaggaagtttctgcgcagcgttggagatggggagactgtggaatttgatgtcgtggaaggagagaagtgattccaactcaactcaaaggacacccagagctgccatctggtatctgccagtttttccaaatgacctgtaccctacccagtaccctgctccccctttcccataattcatgacatcaaaacaccagcttttcaccttttccttgagactcaggaggaccaaagcagcagccttttgctttttcttttttcttccctccccttatcaagggttgaaggaagggagccatccttactgttcagagacagcaactccctcccgtaactcaggctgagaaggaaccagccagctcttacctcctcctggttgcttttcttgcccccaccccaagtttatttttgttttcccccggccccctacctctgaagccattttatgatctgtcatgtgccacctgagcctccagtaaaaacaaaaacaggc

SEQ ID NO: 132766 - DNA, 1048 bp, Homo sapiens
tgccattggcctcggctccgggcccgctgccggcgtgtgggcgaggctcggggcgcgaggaccgagcagggcggtgggttcgcgagccggggggaggggccggggcggtggcggctgtggccggtactggacccggcgggatgagcgaggtggaggcggcagcggtggctacagcggtccccgcggcgacggtgcccgcgacggcggcaggggtggtagcggtggtggtaccggtgcccgcaggggagccgcagaaaggcggcggggcgggcggcgggggcggagccgcctcgggccccgctgctgggaccccctcggcgccgggctcccgcacccctggcaatccggcgacggcggtctcgggaacccccgcccccccggcccggagtcaggcggacaagccggtgctggcaatccaagtcctgggcactgtcaaatggttcaacgtccggaatggttacggattcatcaacaggtatccaaggaacccagggcgggggtggaatgggtgtcttcccagctggcctgtgggactggacacccgcccaacctcatcgacccctgcggaggcacatggttgcaatgtccagctgatgctggttgaaagcctttaaccgcagcacaaatgtgtgcttcgtgacaagaggaagcctcctccgcatcttcaagggtagcggaggattaatgattcaggaacttggcaaacctggctctgaccctgccagcttctcatctcaccttctggaattgcttcattacttttactctgacatgcctttggggcagaatgtattatagggttctctgtgcctcagggcccccggctggaatcctcaactgatttcctgttatggcagcactcacaactcaactcccttaaagagctgtggctcattcgagccctccacctgttgggactgaggctgacagtgggggtcaggaggaaggagccagaggctgctgctttccttcagtaggcagccccacccctcagcaccgggagaggctgtggcagtggattctgagcagagccaggtctcccccagtg

SEQ ID NO: 132767 - DNA, 1250 bp, Homo sapiens
cggaaaaccaaaggcggcctggcccgcaggcccagagcgctaactgggctgggagctgcgcaccaaagtggattcccctggtgggaaatcctgccgtaccttcctgggagagagggcggggccggcaggttcagctaaggtcttggggtggagaataaagccccagggtccggccacgcccccgggcgggacacagtgcctagttgactgggttagaactaggcaaacctctgagcctggcaagcaggtgcactggggacccttgcattgggagggctagaaaaaccctcagttatgacctgggggcggcactttgcagaccaggtgagtacccagttctaggtgaaggggctggatttgtaggatgtggggaacgtgacttagagttggaaggctttttgaaagcctgagtccctgtgtgggtgatttcatttggtggactagggtaggaataccttgaagctactagtgaaacctggttggcttgaaggtaacctgaataggtaataaggcagtaggctagatttttttttgttttggagtgtctcaaaactgagttcaactccatctcttccccccatctcactgtccccactgcatctctgcctggcagcaatccaagtcctgggcactgtcaaatggttcaacgtccggaatggttacggattcatcaacaggtatccaaggaacccagggcgggggtggaatgggtgtcttcccagctggcctgtgggactggacacccgcccaacctcatcgacccctgcggaggcacatggttgcaatgtccagctgatgctggttgaaagcctttaaccgcagcacaaatgtgtgcttcgtgacaagaggaagcctcctccgcatcttcaagggtagcggaggattaatgattcaggaacttggcaaacctggctctgaccctgccagcttctcatctcaccttctggaattgcttcattacttttactctgacatgcctttggggcagaatgtattatagggttctctgtgcctcagggcccccggctggaatcctcaactgatttcctgttatggcagcactcacaactcaactcccttaaagagctgtggctcattcgagccctccacctgttgggactgaggctgacagtgggggtcaggaggaaggagccagaggctgctgctttccttcagtaggcagccccacccctcagcaccgggagaggctgtggcagtggattctgagcagagccaggtctcccccagtg

SEQ ID NO: 132768 - DNA, 168 bp, Homo sapiens
ggcccactgagcttagactgggcatctagggggacctcagtgaggagctgagggctttgttgaagtcccttccttaacgacccatcctgttctgcaggaatgacaccaaggaagatgtctttgttcaccaggtaagagctaggttagctttctgaggggaagaaccgg

SEQ ID NO: 132769 - DNA, 2252 bp, Homo sapiens
tgccattggcctcggctccgggcccgctgccggcgtgtgggcgaggctcggggcgcgaggaccgagcagggcggtgggttcgcgagccggggggaggggccggggcggtggcggctgtggccggtactggacccggcgggatgagcgaggtggaggcggcagcggtggctacagcggtccccgcggcgacggtgcccgcgacggcggcaggggtggtagcggtggtggtaccggtgcccgcaggggagccgcagaaaggcggcggggcgggcggcgggggcggagccgcctcgggccccgctgctgggaccccctcggcgccgggctcccgcacccctggcaatccggcgacggcggtctcgggaacccccgcccccccggcccggagtcaggcggacaagccggtgctggcaatccaagtcctgggcactgtcaaatggttcaacgtccggaatggttacggattcatcaacaggaatgacaccaaggaagatgtctttgttcaccaggaagcactgaggcagttttcagagggagaaggtccttgggtgcagtggttctcaaagcgtggcccctgcaccagcggcagcagcatcacctgacatccgaattctcaggtcccaccccagacctggtgaatcaatcagagctggggctggggctccacaatcggtttaacgagctctccaggtgattctgatgcacgctacagcttgagaaccactgcttggtggaaagagctctcactgggactgaggtaagaagcacagtgcattctacccactttgcgactgaaggctgtccctgccttttgctttggagttcatatttcttgcctccctttctgaaatccctgaggggtaaagcggggcgggaggggaggtgcggggagtgcatcctggggatggtggtaactgcacaatctgctgaggccctgagttcaggacttttcccctgctaaactttgaccacctccttgctccaccctccagctctagaccccaagtcaaatgttgaaagaatgaaattgggtggtggccccagcaggggtgacagagactcctgtcttgctgtctcacttttcacatggccttttccccaatcagacagctattaaaagaaacaaccccaggaagtttctgcgcagcgttggagatggggagactgtggaatttgatgtcgtggaaggagagaagggcgcagaagccactaatgtaactgggcctgggggagtacccgtgaagggcagccgttatgcccccaaccgacgtaagtcccgccgattcatcccccggcctccctcagttgccccaccacccatggtggcagagatcccctcggcggggacaggacctggcagtaaaggggagcgggctgaagactctgggcaacggccccgacgatggtgccccccacccttcttctaccgacggcggtttgtgcgaggcccccggcctcccaaccagcagcagcctatagagggcactgacagggtagaacccaaagagacagccccattggaggggcaccaacagcagggagatgagcgagtccccccgcccagattccggcccaggtaccgaaggcctttccgccccaggccacgccagcagcctaccacagaaggtggggatggtgagaccaagcccagccaaggtcccgctgatggttcccggcctgagccccagcgcccacgaaaccgcccctacttccagcggagacggcagcaggcccctggcccccagcaggcccctggcccccggcagcccgcagcccctgagacctcagcccctgtcaacagtggggaccccaccaccaccatcctggagtgattccaactcaactcaaaggacacccagagctgccatctggtatctgccagtttttccaaatgacctgtaccctacccagtaccctgctccccctttcccataattcatgacatcaaaacaccagcttttcaccttttccttgagactcaggaggaccaaagcagcagccttttgctttttcttttttcttccctccccttatcaagggttgaaggaagggagccatccttactgttcagagacagcaactccctcccgtaactcaggctgagaaggaaccagccagctcttacctcctcctggttgcttttcttgcccccaccccaagtttatttttgttttcccccggccccctacctctgaagccattttatgatctgtcatgtgccacctgagcctccagtaaaaacaaaaacaggc

SEQ ID NO: 132770 - DNA, 1324 bp, Homo sapiens
cggaaaaccaaaggcggcctggcccgcaggcccagagcgctaactgggctgggagctgcgcaccaaagtggattcccctgcaatccaagtcctgggcactgtcaaatggttcaacgtccggaatggttacggattcatcaacaggaatgacaccaaggaagatgtctttgttcaccagacagctattaaaagaaacaaccccaggaagtttctgcgcagcgttggagatggggagactgtggaatttgatgtcgtggaaggagagaagggcgcagaagccactaatgtaactgggcctgggggagtacccgtgaagggcagccgttatgcccccaaccgacgtaagtcccgccgattcatcccccggcctccctcagttgccccaccacccatggtggcagagatcccctcggcggggacaggacctggcagtaaaggggagcgggctgaagactctgggcaacggccccgacgatggtgccccccacccttcttctaccgacggcggtttgtgcgaggcccccggcctcccaaccagcagcagcctatagagggcactgacagggtagaacccaaagagacagccccattggaggggcaccaacagcagggagatgagcgagtccccccgcccagattccggcccaggtaccgaaggcctttccgccccaggccacgccagcagcctaccacagaaggtggggatggtgagaccaagcccagccaaggtcccgctgatggttcccggcctgagccccagcgcccacgaaaccgcccctacttccagcggagacggcagcaggcccctggcccccagcaggcccctggcccccggcagcccgcagcccctgagacctcagcccctgtcaacagtggggaccccaccaccaccatcctggagtgattccaactcaactcaaaggacacccagagctgccatctggtatctgccagtttttccaaatgacctgtaccctacccagtaccctgctccccctttcccataattcatgacatcaaaacaccagcttttcaccttttccttgagactcaggaggaccaaagcagcagccttttgctttttcttttttcttccctccccttatcaagggttgaaggaagggagccatccttactgttcagagacagcaactccctcccgtaactcaggctgagaaggaaccagccagctcttacctcctcctggttgcttttcttgcccccaccccaagtttatttttgttttcccccggccccctacctctgaagccattttatgatctgtcatgtgccacctgagcctccagtaaaaacaaaaacaggc

SEQ ID NO: 132771 - DNA, 1565 bp, Homo sapiens
tgccattggcctcggctccgggcccgctgccggcgtgtgggcgaggctcggggcgcgaggaccgagcagggcgcaatccaagtcctgggcactgtcaaatggttcaacgtccggaatggttacggattcatcaacaggaatgacaccaaggaagatgtctttgttcaccaggaagcactgaggcagttttcagagggagaaggtccttgggtgcagtggttctcaaagcgtggcccctgcaccagcggcagcagcatcacctgacatccgaattctcaggtcccaccccagacctggtgaatcaatcagagctggggctggggctccacaatcggtttaacgagctctccaggtgattctgatgcacgctacagcttgagaaccactgcttggtggaaagagctctcactgggactgagacagctattaaaagaaacaaccccaggaagtttctgcgcagcgttggagatggggagactgtggaatttgatgtcgtggaaggagagaagggcgcagaagccactaatgtaactgggcctgggggagtacccgtgaagggcagccgttatgcccccaaccgacgtaagtcccgccgattcatcccccggcctccctcagttgccccaccacccatggtggcagagatcccctcggcggggacaggacctggcagtaaaggggagcgggctgaagactctgggcaacggccccgacgatggtgccccccacccttcttctaccgacggcggtttgtgcgaggcccccggcctcccaaccagcagcagcctatagagggcactgacagggtagaacccaaagagacagccccattggaggggcaccaacagcagggagatgagcgagtccccccgcccagattccggcccaggtaccgaaggcctttccgccccaggccacgccagcagcctaccacagaaggtggggatggtgagaccaagcccagccaaggtcccgctgatggttcccggcctgagccccagcgcccacgaaaccgcccctacttccagcggagacggcagcaggcccctggcccccagcaggcccctggcccccggcagcccgcagcccctgagacctcagcccctgtcaacagtggggaccccaccaccaccatcctggagtgattccaactcaactcaaaggacacccagagctgccatctggtatctgccagtttttccaaatgacctgtaccctacccagtaccctgctccccctttcccataattcatgacatcaaaacaccagcttttcaccttttccttgagactcaggaggaccaaagcagcagccttttgctttttcttttttcttccctccccttatcaagggttgaaggaagggagccatccttactgttcagagacagcaactccctcccgtaactcaggctgagaaggaaccagccagctcttacctcctcctggttgcttttcttgcccccaccccaagtttatttttgttttcccccggccccctacctctgaagccattttatgatctgtcatgtgccacctgagcctccagtaaaaacaaaaacaggc

SEQ ID NO: 132772 - DNA, 1277 bp, Homo sapiens
tgccattggcctcggctccgggcccgctgccggcgtgtgggcgaggctcggggcgcgaggaccgagcagggcggtgggttcgcgagccggggggaggggccggggcggtggcggctgtggccggtactggacccggcgggatgagcgaggtggaggcggcagcggtggctacagcggtccccgcggcgacggtgcccgcgacggcggcaggggtggtagcggtggtggtaccggtgcccgcaggggagccgcagaaaggcggcggggcgggcggcgggggcggagccgcctcgggccccgctgctgggaccccctcggcgccgggctcccgcacccctggcaatccggcgacggcggtctcgggaacccccgcccccccggcccggagtcaggcggacaagccggtgctggcaatccaagtcctgggcactgtcaaatggttcaacgtccggaatggttacggattcatcaacaggaatgacaccaaggaagatgtctttgttcaccagacagctattaaaagaaacaaccccaggaagtttctgcgcagcgttggagatggggagactgtggaatttgatgtcgtggaaggagagaaggcctttccgccccaggccacgccagcagcctaccacagaaggtggggatggtgagaccaagcccagccaaggtcccgctgatggttcccggcctgagccccagcgcccacgaaaccgcccctacttccagcggagacggcagcaggcccctggcccccagcaggcccctggcccccggcagcccgcagcccctgagacctcagcccctgtcaacagtggggaccccaccaccaccatcctggagtgattccaactcaactcaaaggacacccagagctgccatctggtatctgccagtttttccaaatgacctgtaccctacccagtaccctgctccccctttcccataattcatgacatcaaaacaccagcttttcaccttttccttgagactcaggaggaccaaagcagcagccttttgctttttcttttttcttccctccccttatcaagggttgaaggaagggagccatccttactgttcagagacagcaactccctcccgtaactcaggctgagaaggaaccagccagctcttacctcctcctggttgcttttcttgcccccaccccaagtttatttttgttttcccccggccccctacctctgaagccattttatgatttccttgttcaattggtgctaaaacacctcaggcgggtcctattaaaacactct

SEQ ID NO: 132773 - DNA, 472 bp, Homo sapiens
cggggaggcagtgctcatgggctggaagcctggctcctggaggtggggtggggcagctgggtgagccctggggagggagtattccctggtcccctcagagccttgttccttgccttaggcctttccgccccaggccacgccagcagcctaccacagaaggtggggatggtgagaccaagcccagccaaggtcccgctgatggttcccggcctgagccccagcgcccacgaaaccgcccctacttccagcggagacggcagcaggcccctggcccccagcaggcccctggcccccggcagcccgcagcccctgaggtgaggacctcagatgtgggatgaaagaaaaggctgagaccagctccctcccccacctgctcctttttctttcctactctatcctttggctcctcccctcccctgccctggccctgccaccaccctcttccatgcagcctgctgggtccccccctggc

SEQ ID NO: 132774 - DNA, 161 bp, Homo sapiens
tcactgagtaagataaaggaaatacatcatgtagccagaaattatcagtagcttacttctctgatagtaggtaattatagtgggaatgataaaaaaaaattacatttttatgaattatacagattttaaaaatttcagttccaccagattccctgtgactt

SEQ ID NO: 132775 - DNA, 409 bp, Homo sapiens
tcccagctcaaatgtcacttctgcagagaggcttctcttagccatccaatataaagtagatagattctctaaatcaggggtctgtgtttcaaatcaggcccccttcctgtttttgtaagtaaagttttattgtcacatgaccatgcccatttgttcacctattgtccaatgcctgctttcacattacaacatcagagttgggtatttgccactgagactgtacaatccatgaagcctatatttactatctagatctttacagacaaagcctgtcaactccttgctccagatcatatcaccctttcttattgctttgttaatagacgtcggtctctgaatgtgtcttgttattcagctattaagttgtctgcatccttcactaaactgtcagctccacaaaggcagaagt

SEQ ID NO: 132776 - DNA, 245 bp, Homo sapiens
ccatagaggatccccggcatactggaccttctcaaaggcggcgtctttgagaaggtaacatctgagcatggatttcaattaagtgaggcatcaagccttatgaatatctgggagaagagtattccaggcagagggaagaataagtatgaaagtccttaagcaagaatgaactttgtgcatcaaggatttcaagaaggctgatgtttctggagttgaattgagcaaaagcagaaggtccaggtatg

SEQ ID NO: 132777 - DNA, 544 bp, Homo sapiens
ccacccctcatattgtcttatgcccaatttctgcctcaaaagaaagagtaaaaactaaaagccagaaatgaaatccacaggcagacagcccggtgccacaccctgggcctggtagttaaagatcgacccctgacctaaccggttgtgttatctatagattctagacattgcatagaaaagcactgtgaaaatccctgtcctgttctgttccgttctgattaccagtgcatgcagcccccagtcacataccccctgcttgctcaatcaatcacgaccttctcacgcagacccccttagagttgtgagcccttaaaagggacggaattgctcactcagggagcttggcttttgagacgcaagtctgctgaagttcccagctgaataaagctccttccctctttaacccggtgtctgaggagttttgtctgtggctcctcctgctacaaaaggaattgctaactagaataaccagtttagagaagaacacaaatgacctggtggacctgaaaaacacagcatgagaacttcatgaagcacacacaag

SEQ ID NO: 132778 - DNA, 173 bp, Homo sapiens
ataacaattcatattagtgtcagcataaaccatctggtaaagtacagttctgtatcgataacattttaaaattagttatgtagaaagagatactcctaaatatttagaattagggatttatctcagaaggctaaagattgtgtaattgaaccaatttcttttttttcgttttt

SEQ ID NO: 132779 - DNA, 425 bp, Homo sapiens
gcagcgaggaggcccggagcatggttcactaacacatgttataatatgtgggttatcaatacacatttataaatacacatctcataaataatgaacgctcttcctgtttcaatgtgaatggaacacagcctactgatcagaatgctactgagtacaacaaagagaaattgatgaaaaaatattgttcttccatggtaagggtaggaatatctatgcgcacgcgtgtgtgtgtgtatgagtgtgtgtctgtctctctctgtctctgtgtgtgtctttctgcctcggtctctttctgtctctctgtctctcaatttgcccctttgagacctacgctgcttcccacgcaatgatttatgcatcttatgcaagaaaaggcagctggttcttatagtgggtttttttaatgtgctcttctttgtcattca

SEQ ID NO: 132780 - DNA, 144 bp, Homo sapiens
cttcattttctgtgtttgtcgttgtacttacttatggaactgaagccagctgattttgcttccaagtcataaacccaaatggaccctctagcttcactgtttcctttcccaggcatgcccttggcttgaccacacctcttctgt

SEQ ID NO: 132781 - DNA, 335 bp, Homo sapiens
cttctggactctgtattctgttccattggtctattattctatttttgtgacactgccacactgtcttaattactgtagctttctaataactgttcatatgtgtgagtgtggatactccaaatttgtcttcaagcttgcatccgccatttgaatctctccctgggatttaagttaaaattacattgaatctagatgaatttggggaggcctgacatttctataagattcaatcttggaatccatgaatatgctgtgtgcccccatttgtttaggtcttatttagtttctttcagtattgttttccttagctatatgggctcccttccctcctggat

SEQ ID NO: 132782 - DNA, 579 bp, Homo sapiens
gtatgcagggagcagggaggatataggcctttcagtccatctccaaggcacgcagtaaattactcctatggcaaatactggagaccaggttactttggtaggggtgagggtggtggtggggtggttctgaagtttcagaagaaggaaagaaaagcatgtcctgaaaaacaagaaggatttcagagaaataagaataaaacctgatgtacttgaacttggcacctttcttggagaagggttaagagcaaggaatcatgaacaaccaggtcatttttgaaccaccatcctccttacctaccatatagggaagtgtggtcacagaacaccaggcatctgcctaaatccagtgtcactcagaaaggctgaggtcactcctgtccagggccagaatctgtcctaacttcaaaggttctgcatgggtcaagcactagagtcactggcacacttggtgctgcacatacagtgtcacacaaacataaccacacatccactcttttatttttttgagacagggtctcgctctgtcacctagactggaatgcagtggttcaaacacggctcactgcagccttgacctct

SEQ ID NO: 132783 - DNA, 732 bp, Homo sapiens
tacagtgagctaggattgtgccactgcactccatcctgggtgacagagcaagatcttatctctaattaaaagaagataaaactttccccttgctaaactaggcataaaatgaagtgttacatgttgatattttaaaagtagcttaaaatatgactgagagataatcatgaatttcatattttggaaaaaataagacagaagagaaaggaaataatttggtttgagataagtagctaagataataggaacaaactgcaagaccataaaacttttccaacaaggctaaaataatgcactatttaaaaagtatttacttttccaaggacctttatgttcttttatgcaatcttctcagtcttttttgcaaaccttctcaaagccatgcaacagactggagaaaaggcagcaaaatacaataaacttcctctgaccttcagaagtttagtaaagttgagtaattaggaaaagatgagatgaaacaacaatttctcatgatcactatttgtaaaccagtctgcacttcaacagtctgcaactactgacaaaatattaggttaaaataggcagaattaactgatagtgataatttaaaagtgctacaattggtaaatttaaatatctaatgtgaaatatctaatgtttgaaatgttgtgacatgcaaaagctatatttaaataacttattaaaacaaacaaatacatatttatgataggaaattataaaataaacaag

SEQ ID NO: 132784 - DNA, 187 bp, Homo sapiens
gaaccgcgttaaacgtccccattatgccccaggatgaggccgtcccattttacaggtggggaaactgagccccaaggaggcaaagtcgcttcccaaggtcacgcacagaggcagagctgggattcgaacctcgccctgcctgattctccaggactcacgttcaaagcagttttggctacaattactg

SEQ ID NO: 132785 - DNA, 4023 bp, Homo sapiens
tctggctcgcgcctgcctgttccctccagcccggacccccctgaaatatgttcaggggcgcttggatgtggcccgggaaagacgccgccgcgctgactatctgctgctgctgctgctgctgggctcccaggccgagcgacaaaccttgcgccgactccgagcgggcgcagcgatggcgactgtccctggcgtccctgctcttcttcaccgtgctgctcgctgaccatctgtggctgtgcgcgggggcccggccccgggccagggagctgagcagcgccatgcggcccccatggggggccggccgggagcggcagccggtgcctcctcgcgcggtgctgcccgtgccgccgccgccgcccggcgagcccagcgcgcccccaggcacctgcggccccagatacagcaacctgaccaaagccgcccccgccgccggctctcggccggtctgcggcggcgtcccagagcccacggggctggacgcagcttgcaccaaattgcaatctttgcagagacttttcgaaccgactactccggccccccctctgcggccccctgactccccttcccgtgccccggccgagttcccctccgccaaaaaaaacttgctcaaaggccactttcggaacttcactctctccttttgcgacacctacacggtctgggacttgctgctgggcatggaccgccccgacagcctggactgtagcctggacaccctgatgggggacctgctggccgtggtggccagcccgggctccggggcctgggaggcgtgtagcaactgtatcgaggcgtaccagcggctggaccgacacgctcaggaaaaatatgacgagttcgacctcgtgctgcataaatacttacaggcggaagagtactcaatccggtcctgcacgaaaggctgtaaggctgtctacaaggcctggctgtgctcagaatacttcagcgtgacccagcaggaatgccagcgctgggtgccctgcaagcaatactgcctggaggtgcagacccggtgcccctttatactccccgacaatgaggaaatggtgtacggagggctccctggctttatctgtacagggttgctggatacttcaccaaagcgtctggaaaccaagtgctgtgacgtgcagtgggtctcctgtgaggcgaagaagaagaagaagttcaaggagtctgaggcccccaaaacccaccagcagcaattccaccactcctatttccaccactaccaccaacagtaccatcactaccacccccatcatgatcccccaggccgtgtcagcaacaagcccgccctgctgccggtctctgggggctcccgcctcagccctagcaggatccggctctgcgtccttgttctcatgctcctccataccgtggtgtccttctccagcaaccagggtggtgggggattggggctggagacactgcctgccctagaggagggcctgacacgggaagagtgacagtagggagggaggacagacctccaccacactgacatcagctccagctcccccaggttgggggggaggggctcctcccatgggaggtgtaggataaggtgggggcgggggaaatgggggaatgacacatcccccccaacctacccccaccccaaaagcagctccaacagaatggccagagggcctcagggagctgcaaaactcatccaggagaaaaaggcaggagcagcaagtgacccctcccaagctcccatctatggggcttagcaaaaaaagggaggaagtgggggctggatatgcccacccctgccaaaagccctgaccccagggaaggaggctgctcacccagccttggccctgcagggaatgttggggggcacagaggggagaagctctttcccccactccacattccttttgttgccaagatccttaattccctcctgcccatatccctacaggcgacggcagacagtgcaatggccctcctgccacttcagcacaccttgccccacctgggaccatcacacgtgaagcaccaggctgggagatgaggtgcacacagttgcagctaggtcggggccccagttaagctgtgccccaccaccctaggcaatgaggggcaggaaaggggtacagaatgaatggtgaaagagagtggagatacggaagggggagaggagaggagaaatgtggacagagggcttgaagacatggccgaataggctactgccacccggctttggggagatgggcgataagtgttgaggtaggctcgagaactgctccccaaatcagtgagaattgcattaggagccctctggggaaagagcacaggaactgagttgctgggcctcaaaacaaaaggctgcaggcacatggttagactgccgctgtctgaaggaccatatcttacagaaggtgcacatactcccaagggccactcttgccctggagatcttggccttggggccaaagacatttccatttccgatctccatggggaggagggacttaagcccaagtgggtcaggcctggcccaggtccttatactcccctatcttgtcctagcccaggcctccatgaaggagaacctggtggcattgccccagagctctccagagatgagcctcccctatccccaccctgtccccgtccccagcctaccaaagagtattcacacctttccatccctgactctatgggttactgtcccaattgcgaaacacccatactcctcttcaccctgtagcagggtcttctgctccagtcaccccggcctcttgcaagagaaagtccagggactggcaagaagaccctttgactaaagataatgtgctgtcatatcttggctgagaaactgttgagtcaggctagaggactggacaagagaagaggcattgagagcccccttgggagccattagccttgctctggtctgctgtgtggggttggggagtaggggggatcccacattgcctgggacatctgaatgctgatacgaatggacaggaaagggagccagagctgtatacctgggacaggccagggagcctttagtgccagcagggcctgtgtcctgggatgtgatgctagtgagtgaatgggagggcgggcctggagctgcgtgagagtgaaaccaagaagcggatggggaagggagagctggccttggtcagcttagggatgaatggagaaggaatcattcatgggcctcggctaggtcccagactgattacatgagactggggagtccttccctgccagttttctcatttattacagcctatcccccaaccctacccctgtgccctgcctacacactcccgtttggccctcagcactttgggcctggtcacataccccatgccctagagtgctcttttcagctggggaggggaagaggtgctggctcctttctagacatgcttatgtataagtaaaggggcaggtgcttgggctccagagagaccctaggtactgccttctaactcctgcatcctcagaaggggaaaagggactgggaagtaaagggaaaccatatggccccagggaatggacccttggagactcccatcctctcttccccctcaccaagtgcccaggagacccctggctcagaccagcccaaggccttgcccagtggcaggggaaaggggcacctcactccacctcaaagtcatttgactgcccccatccaccccaccaccctaatcttccaccacctctccggctgcccctgccctccatcacagacagcagagccgggcagctttcttatgccattttctacactgtgcttcatgagtaggactttcttgcactagttcctatgactgagtctccaaactggtttcctagtagtcccccatcccttcctcccttacccagctatgattcagttgtctctgccctccctcttaccctgcctctgtgtttcggtgagagtctctgtatatgtactgctttctgttttgttgcattgtggggcagaggcctctctgctcttgtttaaccccataaagaaataaatggtaagacttgatggtaacc

SEQ ID NO: 132786 - DNA, 3777 bp, Homo sapiens
tctggctcgcgcctgcctgttccctccagcccggacccccctgaaatatgttcaggggcgcttggatgtggcccgggaaagacgccgccgcgctgactatctgctgctgctgctgctgctgggctcccaggccgagcgacaaaccttgcgccgactccgagcgggcgcagcgatggcgactgtccctggcgtccctgctcttcttcaccgtgctgctcgctgaccatctgtggctgtgcgcgggggcccggccccgggccagggagctgagcagcgccatgcggcccccatggggggccggccgggagcggcagccggtgcctcctcgcgcggtgctgcccgtgccgccgccgccgcccggcgagcccagcgcgcccccaggcacctgcggccccagatacagcaacctgaccaaagccgcccccgccgccggctctcggccggtctgcggcggcgtcccagagcccacggggctggacgcagcttgcaccaaattgcaatctttgcagagacttttcgaaccgactactccggccccccctctgcggccccctgactccccttcccgtgccccggccgagttcccctccgccaaaaaaaacttgctcaaaggccactttcggaacttcactctctccttttgcgacacctacacggtctgggacttgctgctgggcatggaccgccccgacagcctggactgtagcctggacaccctgatgggggacctgctggccgtggtggccagcccgggctccggggcctgggaggcgtgtagcaactgtatcgaggcgtaccagcggctggaccgacacgctcaggaaaaatatgacgagttcgacctcgtgctgcataaatacttacaggcggaagagtactcaatccggtcctgcacgaaaggctgtaaggctgtctacaaggcctggctgtgctcagaatacttcagcgtgacccagcaggaatgccagcgctgggtgccctgcaagcaatactgcctggaggtgcagacccggtgcccctttatactccccgacaatgaggaaatggtgtacggagggctccctggctttatctgtacagggttgctggatacttcaccaaagcgtctggaaaccaagtgctgtgacgtgcagtgggtctcctgtgaggcgaagaagaagaagaagttcaaggagtctgaggcccccaaaacccaccagcagcaattccaccactcctatttccaccactaccaccaacagtaccatcactaccacccccatcatgatcccccaggccgtgtcagcaacaagcccgccctgctgccggtctctgggggctcccgcctcagccctagcaggatccggctctgcgtccttgttctcatgctcctccataccgtggtgtccttctccagcaaccagggtggtgggggattggggctggagacactgcctgccctagaggagggcctgacacgggaagagtgacagtagggagggaggacagacctccaccacactgacatcagctccagctcccccaggttgggggggaggggctcctcccatgggaggtgtaggataaggtgggggcgggggaaatgggggaatgacacatcccccccaacctacccccaccccaaaagcagctccaacagaatggccagagggcctcagggagctgcaaaactcatccaggagaaaaaggcaggagcagcaagtgacccctcccaagctcccatctatggggcttagcaaaaaaagggaggaagtgggggctggatatgcccacccctgccaaaagccctgaccccagggaaggaggctgctcacccagccttggccctgcagggaatgttggggggcacagaggggagaagctctttcccccactccacattccttttgttgccaagatccttaattccctcctgcccatatccctacaggcgacggcagacagtgcaatggccctcctgccacttcagcacaccttgccccacctgggaccatcacacgtgaagcaccaggctgggagatgaggtgcacacagttgcagctaggtcggggccccagttaagctgtgccccaccaccctaggcaatgaggggcaggaaaggggtacagaatgaatggtgaaagagagtggagatacggaagggggagaggagaggagaaatgtggacagagggcttgaagacatggccgaataggctactgccacccggctttggggagatgggcgataagtgttgaggtaggctcgagaactgctccccaaatcagtgagaattgcattaggagccctctggggaaagagcacaggaactgagttgctgggcctcaaaacaaaaggctgcaggcacatggttagactgccgctgtctgaaggaccatatcttacagaaggtgcacatactcccaagggccactcttgccctggagatcttggccttggggccaaagacatttccatttccgatctccatggggaggagggacttaagcccaagtgggtcaggcctggcccaggtccttatactcccctatcttgtcctagcccaggcctccatgaaggagaacctggtggcattgccccagagctctccagagatgagcctcccctatccccaccctgtccccgtccccagcctaccaaagagtattcacacctttccatccctgactctatgggttactgtcccaattgcgaaacacccatactcctcttcaccctgtagcagggtcttctgctccagtcaccccggcctcttgcaagagaaagtccagggactggcaagaagaccctttgactaaagataatgtgctgtcatatcttggctgagaaactgttgagtcaggctagaggactggacaagagaagaggcattgagagcccccttgggagccattagccttgctctggtctgctgtgtggggttggggagtaggggggatcccacattgcctgggacatctgaatgctgatacgaatggacaggaaagggagccagagctgtatacctgggacaggccagggagcctttagtgccagcagggcctgtgtcctgggatgtgatgctagtgagtgaatgggagggcgggcctggagctgcgtgagagtgaaaccaagaagcggatggggaagggagagctggccttggtcagcttagggatgaatggagaaggaatcattcatgggcctcggctaggtcccagactgattacatgagactggggagtccttccctgccagttttctcatttattacagcctatcccccaaccctacccctgtgccctgcctacacactcccgtttggccctcagcactttgggcctggtcacataccccatgccctagagtgctcttttcagctggggaggggaagaggtgctggctcctttctagacatgcttatgtataagtaaaggggcaggtgcttgggctccagagagaccctaggtactgccttctaaccctgccctccatcacagacagcagagccgggcagctttcttatgccattttctacactgtgcttcatgagtaggactttcttgcactagttcctatgactgagtctccaaactggtttcctagtagtcccccatcccttcctcccttacccagctatgattcagttgtctctgccctccctcttaccctgcctctgtgtttcggtgagagtctctgtatatgtactgctttctgttttgttgcattgtggggcagaggcctctctgctcttgtttaaccccataaagaaataaatggtaagacttgatggtaacc

SEQ ID NO: 132787 - DNA, 377 bp, Homo sapiens
caagtaccaaacgatggcaaagagatactgcagaagtttgaggcaaagagctaatcactgtgaggggaacggaggtggaggagcttattaagggtagaacttgagatgtgccatccatactgagtaggtaaaaggagaagtactgatttttaaaatgtgtttgtgtgcaccttgggcatatgaaggcgaggcaggagacaaagcagggcggtaagctctcgctaacaattaaaacacagatcttgaccaggccgggtggctcacacctgtaatcccagcactttgggaggttgaggtaggcagactgcttgagcccagaagcttgagcccagcctgggccacatggtgaaactctctctaccgaaaaaacaacaaca

SEQ ID NO: 132788 - DNA, 196 bp, Homo sapiens
agaattgcctcctttcactttgcagtgaccggatccttcaagatgttccatttaacaggtttgaagcagccaagcttgtcatgcagtggctttgcaaccatgaggatcaaaacatgcaaaggatggcagttgctatcatttctatcctggctgccaagctttctacagaacaaactgcacagcttggtactgagct

SEQ ID NO: 132789 - DNA, 290 bp, Homo sapiens
ccttgcagcgtgctggagcaggaagctcccactaccctgtggagtcaatcagcgtaacaaacctatctgtacctgcgcagtaggaaagtattttaaagtaaattacaggtatccaaacacagcctttcctcacagggttggtgtgaaggccagctatgttgttttgtgtgtggaatcaatcacttggactataaatcgttgaagttactgcttctgcgaaatgtctctgctttttttttccacaaagccaccagtgatttctctttaatgggaaaatctggacctcttct

SEQ ID NO: 132790 - DNA, 308 bp, Homo sapiens
tcacagagtgggctggagagccaagctgttctttcggggtgcacagtgcaccagccataacacagcttagaaacatggatgagtatacctcaagacaggtgaacacggagtggggagcaaaagaaggcagaaactcctctgagtttcacaagcatcaggcacagatcagggcacagaggaagaagaaagaaggtttaccactggtctgtctctgtaaattgttacagagcaattttactttgtgttatttaggatcaagaaacaagtgttatttaaaagttctcttaccctccaacctttgtcatact

SEQ ID NO: 132791 - DNA, 378 bp, Homo sapiens
gagaggggtatacacagggaggccaggcagcctggagttagtcgaccgttgcgagacgttgagctgcggcagatgagtccaaagccgagagcctcgggacctccggccaaggccaaggagacaggaaagaggaagtcctctccctcagcacgagctgccgccggaggagccagtgagcgaggggacccagcacgaccccctgagtcaggagagcgagctggaggaaccactgagtaaggggcgcccatctactcccctatctccctgagcagcaactaagtttaggcccagctgccagacctcagagatctcaccagcagggtgcttcccatgttgatgacaataaaatgaatgtgttgcaaaccgaaaaaaaagaca

SEQ ID NO: 132792 - DNA, 546 bp, Homo sapiens
cccctcgcctctttcctcacaagaagcctctcctgtcctcacttggcacaaccccccaacccggcccccaccgcttctgaggacacgtccctgttcccagcctcctccatcctcgtccctaaaccagagcccttctgtgatctccctgttgtccttccagactaccaaggtggccgagaagggagaagcagttcgtggagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggggacccagcacgaccccctgagtcaggagagcgagctggaggaaccactgagtaaggggcgcccatctactcccctatctccctgagcagcaactaagtttaggcccagctgccagacctcagagatctcaccagcagggtgcttcccatgttgatgacaataaaatgaatgtgttgcaaaccgaaaaaaaagaca

SEQ ID NO: 132793 - DNA, 560 bp, Homo sapiens
gagaggggtatacacagggaggccaggcagcctggagttagtcgaccgttgcgagacgttgagctgcggcagatgagtccaaagccgagagcctcgggacctccggccaaggccaaggagacaggaaagaggaagtcctcctctcagccgagccccagtggcccgaagaagaagactaccaaggtggccgagaagggagaagcagttcgtggagggagacgcgggaagaaaggggctgcgacaaagatggcggccgtgacggcacctgaggcggagagcgggccagcggcacccggccccagcgaccagcccagccaggagctccctcagcacgagctgccgccggaggagccagtgagcgaggggacccagcacgaccccctgagtcaggagagcgagctggaggaaccactgagtaaggggcgcccatctactcccctatctccctgagcagcaactaagtttaggcccagctgccagacctcagagatctcaccagcagggtgcttcccatgttgatgacaataaaatgaatgtgttgcaaaccgaaaaaaaagaca

SEQ ID NO: 132794 - DNA, 820 bp, Homo sapiens
tgctattggctaacattacagtttcgctttaaccaatgggattgcggttttgaaaaacacttattttgattggacaaagttaatatacgtttccaggactcaccactggttaaacgcacaacttcattctctaccccacttgcgttaagaagcagtgaataagcggtaggttgacagagctaccgtcttcctgtttttttcctccaattttccggcagttactcccagtcatgcccgagccctcaaagtccgctcctgccccgaagaaaggctccaagaaggcagtgacaaaggcccagaagaaggacggcaagaagcgcaagcgcagccgcaaggagagctactccgtgtacgtgtacaaggtgctgaagcaggtccaccccgacaccggtatctcgtccaaggccatgggcatcatgaactccttcgtcaatgacatcttcgagcgcatcgccggcgaggcttcccgcctggcgcattacaacaagcgctcgaccatcacctccagggagatccagacggccgtgcgcctgctgctgccaggggagctggccaagcacgcggtgtcggagggcaccaaggccgtcaccaagtacaccagttccaagtgagcccgcccaccgcggaacgttcggaagagaaaaagaagattcacagagagcattaagaaggcccatggattcagaaagctcaagatttggctaaaattaagagtcagcaaccaatctccagatgacatttatattgcaagagattgaatgcagaaagaagaattcagctttcttttattaaacaaggcattagagagatttgcaaaatt

SEQ ID NO: 132795 - DNA, 1187 bp, Homo sapiens
tgctattggctaacattacagtttcgctttaaccaatgggattgcggttttgaaaaacacttattttgattggacaaagttaatatacgtttccaggactcaccactggttaaacgcacaacttcattctctaccccacttgcgttaagaagcagtgaataagcggtaggttgacagagctaccgtcttcctgtttttttcctccaattttccggcagttactcccagtcatgcccgagccctcaaagtccgctcctgccccgaagaaaggctccaagaaggcagtgacaaaggcccagaagaaggacggcaagaagcgcaagcgcagccgcaaggagagctactccgtgtacgtgtacaaggtgctgaagcaggtccaccccgacaccggtatctcgtccaaggccatgggcatcatgaactccttcgtcaatgacatcttcgagcgcatcgccggcgaggcttcccgcctggcgcattacaacaagcgctcgaccatcacctccagggagatccagacggccgtgcgcctgctgctgccaggggagctggccaagcacgcggtgtcggagggcaccaaggccgtcaccaagtacaccagttccaagtgagcccgcccaccgcggaacgttcggaagagaaaaagaagattcacagagagcattaagaaggcccatggattcagaaagctcaagatttggctaaaattaagagtcagcaaccaatctccagaactatctatagccaccacttttcacattaagatgatccttctcaagccatcagagaactaagtgacatctgcaatgaaatggcttcaccacttctgtcctcgggtaattctgcaatctatttttgctggatccaatccctgaagaccatcctgcctttctaagggatgcttctccctttcagctaccttcatgtcttttaatgcaattgttgcttctttctgtcctggtgttgtactttggcagtggtcacacccatggagcacagacttctacaaggcacaaggcatgactttgatttttctgttgtaatttgatggaattggccaggcgtggtagctcatgcctgtaatcccagcactttgggaagccaaggcaggcggatcacctgaggtcaggagttggagactagactggccaacatggcaaaaccctgtctctactaaaaatacaaaa

SEQ ID NO: 132796 - DNA, 2377 bp, Homo sapiens
tgctattggctaacattacagtttcgctttaaccaatgggattgcggttttgaaaaacacttattttgattggacaaagttaatatacgtttccaggactcaccactggttaaacgcacaacttcattctctaccccacttgcgttaagaagcagtgaataagcggtaggttgacagagctaccgtcttcctgtttttttcctccaattttccggcagttactcccagtcatgcccgagccctcaaagtccgctcctgccccgaagaaaggctccaagaaggcagtgacaaaggcccagaagaaggacggcaagaagcgcaagcgcagccgcaaggagagctactccgtgtacgtgtacaaggtgctgaagcaggtccaccccgacaccggtatctcgtccaaggccatgggcatcatgaactccttcgtcaatgacatcttcgagcgcatcgccggcgaggcttcccgcctggcgcattacaacaagcgctcgaccatcacctccagggagatccagacggccgtgcgcctgctgctgccaggggagctggccaagcacgcggtgtcggagggcaccaaggccgtcaccaagtacaccagttccaagtgagcccgcccaccgcggaacgttcggaagagaaaaagaagattcacagagagcattaagaaggcccatggattcagaaagctcaagatttggctaaaattaagagtcagcaaccaatctccagatgacatttatattgcaagagattgaatgcagaaagaagaattcagctttcttttattaaacaaggcattagagagatttgcaaaattgtaaaacagtgtcactctttttattttaaaaaatagctatttttcataaaatatgtatgctaacataaaatgggtttattactgttatttttaaatgaattaaccaaatttttttgttttactatataatacggtaaatgtcaatagttataacctacagaaacacaaattctttggattgcaaagctccaccacctaatatgctatagatcaaggttcaaaagagagctccctggaaaactccttggtgttttgttcactgaaatattatttaaggagaacatattttattttaatgactgtcattgctggcatccgaactctaattcccaaggcatcctcaaattatcatctgcatcacttcattactttttaagagtgtaagtgggtcatgagaccagaaggttcaagaactgctgccttagggtatataccacactagtaatgttcatttgtgttcaaatgactatttttcaaagtatttggagtatcccttcctgcacacttatgttatgatctagatatacagatccatttactttgttttgctgttgatgtctaggattggactttttaatgtttggttctatcattacataaaatatttttacatagtcccaaggtcaaatcaaattatatccaaagaaatctttctccttcatgctaatagcctctcttgccttagagtaataattttaaaggttatgatatatccttctgttgtttattataagcatatatgtatgtattcttagggaatattaacttcattttgctgttgatgtctagggattggactttttaatatttgtttctaccgttacataaaatatttttacatagtcccaaggtcaaatcaaattatatccaaagaaatctttctccttcatcctaatagcctctcttaccttagagtaataattttaaatgttatgatatatccttctgttgtttattataagcatatatatatgtattctagggaagattaactcgtatcacaggagaggagactggaagttgatactatgcaagataaactttgtcacagacagtcacctgttctttggagggcccattcatctttcccaaaaataatttcctctcccctacattgcctacatcccccttcctgtcttccctatgaagacagtatataagcttctagatctcactgggcttggggggcattcacttatttttcatgtgatacctccatgcacaaaataaaatttttttttttcgagacggagtcttgccgcgtctcccaggctggagtgcagtggcgcgatctcggctcactgcaagctccgcctccggggtttaggccattctcctgccccagcctcctgagtagctgggactacaggcgcccgccaccatgcccggctaatttttttgtgttttcagtaccgatggggtttcactgtgttagctaggatggtctcgatctcctgacctcgtgatccgcccgccttggcctcccaaagtgctgggattacaggcgtgagccaccacgcccggccacaaaataaatttttatatctttctcttatt

SEQ ID NO: 132797 - DNA, 2034 bp, Homo sapiens
caaggttcaaaagagagctccctggaaaactccttggtgctttgttcactgaaatgttatgttaggagagcttatttcatcttagtggctgtcattgctgggaatccaaactctaattcccaaggcattctcaaattatcatctgcatcagcttctgccatagccatccccaccagtgtcaccaacaatattgttactaagaaaataattttcaaaaaatgtttgcttttttttttgtcctaaggacagtgatttctataatggcaacaattgcagttaatttcaaaatgtggtctggggacccctgaggcccttgtagtgggtctgtgggctaatattatttcatactaattctgacactaatttttctttttcattattattttcagatgacatttatattgcaagagattgaatgcagaaagaagaattcagctttcttttattaaacaaggcattagagagatttgcaaaattgtaaaacagtgtcactctttttattttaaaaaatagctatttttcataaaatatgtatgctaacataaaatgggtttattactgttatttttaaatgaattaaccaaatttttttgttttactatataatacggtaaatgtcaatagttataacctacagaaacacaaattctttggattgcaaagctccaccacctaatatgctatagatcaaggttcaaaagagagctccctggaaaactccttggtgttttgttcactgaaatattatttaaggagaacatattttattttaatgactgtcattgctggcatccgaactctaattcccaaggcatcctcaaattatcatctgcatcacttcattactttttaagagtgtaagtgggtcatgagaccagaaggttcaagaactgctgccttagggtatataccacactagtaatgttcatttgtgttcaaatgactatttttcaaagtatttggagtatcccttcctgcacacttatgttatgatctagatatacagatccatttactttgttttgctgttgatgtctaggattggactttttaatgtttggttctatcattacataaaatatttttacatagtcccaaggtcaaatcaaattatatccaaagaaatctttctccttcatgctaatagcctctcttgccttagagtaataattttaaaggttatgatatatccttctgttgtttattataagcatatatgtatgtattcttagggaatattaacttcattttgctgttgatgtctagggattggactttttaatatttgtttctaccgttacataaaatatttttacatagtcccaaggtcaaatcaaattatatccaaagaaatctttctccttcatcctaatagcctctcttaccttagagtaataattttaaatgttatgatatatccttctgttgtttattataagcatatatatatgtattctagggaagattaactcgtatcacaggagaggagactggaagttgatactatgcaagataaactttgtcacagacagtcacctgttctttggagggcccattcatctttcccaaaaataatttcctctcccctacattgcctacatcccccttcctgtcttccctatgaagacagtatataagcttctagatctcactgggcttggggggcattcacttatttttcatgtgatacctccatgcacaaaataaaatttttttttttcgagacggagtcttgccgcgtctcccaggctggagtgcagtggcgcgatctcggctcactgcaagctccgcctccggggtttaggccattctcctgccccagcctcctgagtagctgggactacaggcgcccgccaccatgcccggctaatttttttgtgttttcagtaccgatggggtttcactgtgttagctaggatggtctcgatctcctgacctcgtgatccgcccgccttggcctcccaaagtgctgggattacaggcgtgagccaccacgcccggccacaaaataaatttttatatctttctcttatt

SEQ ID NO: 132798 - DNA, 2350 bp, Homo sapiens
tgctattggctaacattacagtttcgctttaaccaatgggattgcggttttgaaaaacacttattttgattggacaaagttaatatacgtttccaggactcaccactggttaaacgcacaacttcattctctaccccacttgcgttaagaagcagtgaataagcggtaggttgacagagctaccgtcttcctgtttttttcctccaattttccggcagttactcccagtcatgcccgagccctcaaagtccgctcctgccccgaagaaaggctccaagaaggcagtgacaaaggcccagaagaaggacggcaagaagcgcaagcgcagccgcaaggagagctactccgtgtacgtgtacaaggtgctgaagcaggtccaccccgacaccggtatctcgtccaaggccatgggcatcatgaactccttcgtcaatgacatcttcgagcgcatcgccggcgaggcttcccgcctggcgcattacaacaagcgctcgaccatcacctccagggagatccagacggccgtgcgcctgctgctgccaggggagctggccaagcacgcggtgtcggagggcaccaaggccgtcaccaagtacaccagttccaagaagagaaaaagaagattcacagagagcattaagaaggcccatggattcagaaagctcaagatttggctaaaattaagagtcagcaaccaatctccagatgacatttatattgcaagagattgaatgcagaaagaagaattcagctttcttttattaaacaaggcattagagagatttgcaaaattgtaaaacagtgtcactctttttattttaaaaaatagctatttttcataaaatatgtatgctaacataaaatgggtttattactgttatttttaaatgaattaaccaaatttttttgttttactatataatacggtaaatgtcaatagttataacctacagaaacacaaattctttggattgcaaagctccaccacctaatatgctatagatcaaggttcaaaagagagctccctggaaaactccttggtgttttgttcactgaaatattatttaaggagaacatattttattttaatgactgtcattgctggcatccgaactctaattcccaaggcatcctcaaattatcatctgcatcacttcattactttttaagagtgtaagtgggtcatgagaccagaaggttcaagaactgctgccttagggtatataccacactagtaatgttcatttgtgttcaaatgactatttttcaaagtatttggagtatcccttcctgcacacttatgttatgatctagatatacagatccatttactttgttttgctgttgatgtctaggattggactttttaatgtttggttctatcattacataaaatatttttacatagtcccaaggtcaaatcaaattatatccaaagaaatctttctccttcatgctaatagcctctcttgccttagagtaataattttaaaggttatgatatatccttctgttgtttattataagcatatatgtatgtattcttagggaatattaacttcattttgctgttgatgtctagggattggactttttaatatttgtttctaccgttacataaaatatttttacatagtcccaaggtcaaatcaaattatatccaaagaaatctttctccttcatcctaatagcctctcttaccttagagtaataattttaaatgttatgatatatccttctgttgtttattataagcatatatatatgtattctagggaagattaactcgtatcacaggagaggagactggaagttgatactatgcaagataaactttgtcacagacagtcacctgttctttggagggcccattcatctttcccaaaaataatttcctctcccctacattgcctacatcccccttcctgtcttccctatgaagacagtatataagcttctagatctcactgggcttggggggcattcacttatttttcatgtgatacctccatgcacaaaataaaatttttttttttcgagacggagtcttgccgcgtctcccaggctggagtgcagtggcgcgatctcggctcactgcaagctccgcctccggggtttaggccattctcctgccccagcctcctgagtagctgggactacaggcgcccgccaccatgcccggctaatttttttgtgttttcagtaccgatggggtttcactgtgttagctaggatggtctcgatctcctgacctcgtgatccgcccgccttggcctcccaaagtgctgggattacaggcgtgagccaccacgcccggccacaaaataaatttttatatctttctcttatt

SEQ ID NO: 132799 - DNA, 701 bp, Homo sapiens
tgctattggctaacattacagtttcgctttaaccaatgggattgcggttttgaaaaacacttattttgattggacaaagttaatatacgtttccaggactcaccactggttaaacgcacaacttcattctctaccccacttgcgttaagaagcagtgaataagcggtaggttgacagagctaccgtcttcctgtttttttcctccaattttccggcagttactcccagtcatgcccgagccctcaaagtccgctcctgccccgaagaaaggctccaagaaggcagtgacaaaggcccagaagaaggacggcaagaagcgcaagcgcagccgcaaggagagctactccgtgtacgtgtacaaggtgctgaagcaggtccaccccgacaccggtatctcgtccaaggccatgggcatcatgaactccttcgtcaatgacatcttcgagcgcatcgccggcgaggcttcccgcctggcgcattacaacaagcgctcgaccatcacctccagggagatccagacggccgtgcgcctgctgctgccaggggagctggccaagcacgcggtgtcggagggcaccaaggccgtcaccaagtacaccagttccaagtgagcccgcccaccgcggaacgttcggtcagtctcggcccacaccccaaaggctcttttcagagccactcagtcttcccaaagagaactggca

SEQ ID NO: 132800 - DNA, 842 bp, Homo sapiens
tgctattggctaacattacagtttcgctttaaccaatgggattgcggttttgaaaaacacttattttgattggacaaagttaatatacgtttccaggactcaccactggttaaacgcacaacttcattctctaccccacttgcgttaagaagcagtgaataagcggtaggttgacagagctaccgtcttcctgtttttttcctccaattttccggcagttactcccagtcatgcccgagccctcaaagtccgctcctgccccgaagaaaggctccaagaaggcagtgacaaaggcccagaagaaggacggcaagaagcgcaagcgcagccgcaaggagagctactccgtgtacgtgtacaaggtgctgaagcaggtccaccccgacaccggtatctcgtccaaggccatgggcatcatgaactccttcgtcaatgacatcttcgagcgcatcgccggcgaggcttcccgcctggcgcattacaacaagcgctcgaccatcacctccagggagatccagacggccgtgcgcctgctgctgccaggggagctggccaagcacgcggtgtcggagggcaccaaggccgtcaccaagtacaccagttccaagtgagcccgcccaccgcggaacgttcggaagagaaaaagaagattcacagagagcattaagaaggcccatggattcagaaagctcaagatttggctaaaattaagagtcagcaaccaatctccaggtacccttgcttctcaatctgtagactaaagaccctagaccaaaaatcctgattcccaggaagtgcttggaggatcttgatggtgcttcattacagttggtttctttaca

SEQ ID NO: 132801 - DNA, 144 bp, Homo sapiens
atgccactctctcctggcctactgggtttctgctgggaaatctgctgatagtcatattgtctcctttgtatgtgatgtgtttattatctcttgctgttctcaaaatgttttgtctttgatttttgacagctagattattgtatg

SEQ ID NO: 132802 - DNA, 562 bp, Homo sapiens
acccaaggggtggtggacagaaaaatggatcaacacactgtggtccatccacacagtggaatattactcagccatgaaaaggaagggaatcctgacgcaggctacagtgcggaggcatcttgaggacctcaggctcagtgagagaagccagacacagagggacaaatgccgtgtgattccactcctaggaagtccctggagtcatcaaattcacagagacagaaagtaggatggggatgccaggggctggggagggagatggggagtgagtgtttcatagactcaaagagtttcagtttgggaagataaagttctggagagggtggaggtgatggttgcacagccacgtgaatgtgtttttaacgctgctgaactgtgcacttagaagtaggtcacgctgggcacagtgactcacgcctgtaatcccagcacttcgggaggccaagacgggtggatcacctgaggtcaggagttcgagaccagcctggccgacatggcgaaaccccgtctctactaagaacacaaaaattagccaggcatggtggcgggcacctgtaatccc

SEQ ID NO: 132803 - DNA, 551 bp, Homo sapiens
ctaaaactgtaaacctctcagaagaaaacacaggagtaaatcatgactgtgggttagccaaagccttcttaaataaggaatcaaaagcataaatgactaaagaaacatcaaaagtaaaaacttgtatgcatcaatggatactaccaaagaaagtcaaagacaaaccacaaaacaggtgaaaatatttgtaaatcattattatctggtaaagaatttgtatctagaatatatgagcaacatttacaactcactaaaaaaaacacaaataacccaattaaaaactgggcaaaagtgggaggttgaggtggaaggatcacttgaaaccaggagtttgagaccaatctgggcaacaaagcaagacctcatctctacaaaaaatttaaaaattagctgggcacagcggcatgcacgtgtaatgtcagtcattcagcaggctgagtcagaaggatcatttgaggcctggagttgagggctgcagtgagctatgatcacaacactgcactgcagcctgtggtgacaaagaaagaccctgtctcgaaaaaaaaaaaaaa

SEQ ID NO: 132804 - DNA, 452 bp, Homo sapiens
  misc_feature (400)..(400): n is a, c, g, or t
  misc_feature (406)..(406): n is a, c, g, or t
  misc_feature (429)..(429): n is a, c, g, or t
agaaaaagggaaatgaagtttgggctacttataggagtgaaaataaactctgtgatgtgccagcaccagcacaggctcttgtagtttcctcccaactttgggctcagtggtatcatgttggtggccagtttaggagtatttatatcacaaaatccacaagtgctgcaaatcaaggcttttctattctagaatgctggttgataaataatagcctcaacatttaccagaacactataaaacaattcagtgatcataaagttattatccacagtgggaccagctcgagtctcaagtgggacaatgttatcttacagactgggagagagtgctagtgaatgcttttgtcttcaatgcccatctcttgggaaatattggaaggtgggagtaggcaaccggggcnttatantatctcttggggaaaagggaccntcaggcatggggggattttcccc

SEQ ID NO: 132805 - DNA, 736 bp, Homo sapiens
gcacgattgtatgctgttcagaagaatggactctggcaactggttgcctgggcttgggccctggctctccccctcccttgtttgacgtctgaatctttcaatcctttcatgaagattctttgtctgcaaaatgtgcagatcctaagagtactattttatgattgttttaatgattaaaaaattatacatgaaacgcatctacaaaatgcttattttacagaaatagtaaacgttagctattatggaaaatgacattcatgttggattgcataaattttatgaactttatgcttactcagagctttatgctttctttctttcttctttctcttttcttttcttgtgcttaaagtgatgtcaaacatagcacctttacaaattcttttgaccagttgtgctagtctttgaaggtgatgatttatgaagtgaccacattgaatcttctcttggaataagtgtttatggaatcttagttatctcaaagataaagagagaatgggtaacctgtcatggtttaatgcatcagaaatacgttgagattaacagatatgcagtgagacatctattatattcaggtgaagttcatctttaaagagtagagtattttaataattttgaaaattaaatagagaaatttatctacaagtctggaaatatagtttgtgcacctcatattactaactaacccagtttgtaactttgttttattccattactgacaactgaacacctgctc

SEQ ID NO: 132806 - DNA, 636 bp, Homo sapiens
tataatcccagctaatcaggaggctgaggcatgggaatccttggaacctgggaggtggaggctgcagtgagctgagatcgcgccactgcactccagcctgggtgacagagcgagactctgtctcaaaaaaaaaagatatataactactgaagagagggaattgagccattaactctgagcttaaatccctcgttacttcaacacaacagagtgagactccatcaaaaaaaaaaaatttttttttttaattaaaccttaaatttttagccccgagaaatgggctacatttggcttcctcatttaacatttggctttctcataccttcccaattaaaactcactagtttaacaagggatagttgttttcaaacttatgccttggtaaccgggaaagggtcaaaaagatcaaggaccatccgggccaaccttgatgaaaccccgtctctcctaaaatgtgcacaaaatcagcggggtgtgggggatacgcgccgtgttgtcccacctactcaggaggcctgaggcaggagaatcgctgggccccgggaaggcggaaggtttgcagttgagctgagatcacgcttatggcactcccggcctggggatagaggcaggactccggtcctcaaaattttatta

SEQ ID NO: 132807 - DNA, 381 bp, Homo sapiens
tcatttaactccacagtatgccattccctccttctctccatctctgccagttttatttcaatatttcgttttttaattgacttttacagccttgtatttaaacctctctttcttaattcaccaaactgagtttctcttaaatcctctctctgtaaaataacagattagagtccctgtatttctcttcatttcttttcccctttctacttcccaacctttctccattaattattacttttactttgtcaaggtgatatcatgttctgtactatctattttttacacgtttttaaaattggatgaataacatttacaatatgaaaattacataattgttctctgcagaaacaagtggtaagtataaatgcagagagaaagcca

SEQ ID NO: 132808 - DNA, 703 bp, Homo sapiens
gaaatcactataagattttaatagagtgttcaaagtttcatttcataagtaatattttttcaagtatctacagaaactatctgctaatgctgagaagaaaacactttaaggaatccatgattattaatttattcttcttgattatatggtttgctcctcataccctctggatgctcagtcatagaaaaaaatgtgatcctttaactacggggttagaacaaaggcccattttctgcccactgcttatagaaatcaagagacaaaattttacttagagagctgtggtctaatggaaatgtgggtattcagaagtagcttctgaatttaaagttgcatttaaagttggcatttctgtccaatctggttgagaatctgaaagcagttccacatttcttcatcaggaagtcaggctgacttgtgatgaaagatgatgaagacaaatcccaaacagggcttcctgtttgtttaaacccccaacccaggagaaaatcgcttccaagtttccctgtacaatcactgtaatatattttcttttcagattgttagcagactgctcagtttgtgcttggcatttcaattatagtgaaaaaggtgaaacccagaagactcaaggaattctcattaggagtctgaaatttgatagacttttaaaattaacctctgcttcttgttctatctttagtaggcacattattcattaaat

SEQ ID NO: 132809 - DNA, 742 bp, Homo sapiens
caattcattgtatacagtcagctaaaataaatatatcgtgtcatcttaagtgtaatgacaacctgataaaacaactaaacctagtatgaataaaaatttatttaacagataagtattgatcacccattatgaatcaggcattggctagcatcctgcagggtattgcttaagttttgtatgtcttttattgacattttacatgcaatatttaagacatacaaaaaagataagcataagccaatggtgttcatttattcgtaggccagctacatagttgaaagcccccatgcaccatacaccctggaagatataggcaacagagttctgaaggtttaaattatatatatttacatgaatatatacttaaattttgaactgtagaatactgtaaaattcattacataaaacaaagacagtgtaggcaatatttgcgtctagttcccaaggctagaatatgacagggtcaccatctgcattcagatacaaagttccagaaactggactagactgagtcaggtatttacagaataagagtttgaataatagtcacagaaggaaagctaaacaaaaatcaggaaaactggccctgaaaataagatttgaggtgtgaattaaagccataatcttataagccagaaccagaggcttaccccttttttgaatcatggactactttcaaaacccaatgaaatagttcctcttgcctataaacagtccttgtaatagtccctcttccattaaa

SEQ ID NO: 132810 - DNA, 760 bp, Homo sapiens
tggatgaaccttgcacgtatggccccaatcacaaagacaggttaataagataaagcatgacacacatctatttaacaaaaggttttatgtgacaagtgagccttcagaaacaaaaacccaaagaaacaggcaaatctgtctattttttatgcttgggtttgatgaagaatgaacagtcatgtaaaaatatgcttagacaaaaagcaggtgcaacttaatggtaataaactgggggcaacttgccaaggcccgtttgttcagattcttcttggcctctggaatgaggatcctatgacccgcttttgggggaggtaggtcagagaattctcttatggcttccttcaaggcagaaaagcaggagacggtcagagagacacaatttccttcagcttgagatactcagcatgccaaggtgccgtaatttggggtattgcattctgagccccatcactgacatctcacaaaactgtagtacaatatgacgaccattaagactggtacagtcaagacagagaacatttccatctcgaggaaacccttatgctgcccaaaaaggcataaaaataaccacatccactttcctcccacagtaacactccttaaccctggcacccaacaatttgttctgcactaatataactttgtcattttaggaacgttctataaatggaataatcctatatgtggtatcttttgcctgacatctctggaaattcatgaagactgctgtatgtgtcaatagttcattcctttgtattgc

SEQ ID NO: 132811 - DNA, 692 bp, Homo sapiens
acagtaaccgtttttatagtgtgctctatgtaacagtttcatgggctttcagagactgatgaatttattacatattattttgtgttgatttcttcaagtaaacattttccatatgaaagggttagatagtttgtttttttttaatatatacacttttgggaggaaattctttgctgctcatattcatattatttggctgctaggttctaattccattgcttttgtgtttagaaagtatttttctctagactgttggtagtaacagcagttttgggaatatgttgtctcacataccaataagggaaaatgttcttccagcctgtagatacttgtttcatgtgttaggtcaaaggaaaacgtatttaagtgtacttggcatttcttgtattttctaaattacattatcggcaggataagagtttattgaatcatagtttcagaatttagtttatttcatagcataaacgggagtgctatggaaatggaattgattctgcattcactgtaggaatcttgaggacactgtgtgttcttttcaacaggctttaatttcctgacattccattacatttctgggaaacagaattggcactgccctttcctgccctatcttgtcctttataattttggcgaggttcatggtcttccatttctttttctttttgtaactgattaataatctatagaatcac

SEQ ID NO: 132812 - DNA, 853 bp, Homo sapiens
agggcgcgggatgatagcgcctagcacctgtctccgggccttcccgatgagccgcgcttagggtccgtgggcttcagctgcatgaaccacgttccagcagttcggccctcctggccccaacgcgcctttgaaatacgcggacagtgcgctttccttcttggcccgagcggcgcttcgcaatgcgggcttgtgcactcgtgaggcccgcggacacctcccgcccctgcgcggcggagcgctccgccggctacctgctcctcagaagtggcctggaggctggatttccttggccatatctggtccctgggctctcgccgacaaagaagcattgtccgtactgtctgtgtgcccagaaatgggaagcgggtgtaaggggaggccaaacttgactttcttagtgtcgcgaggtgggtcagagcgttacattgacataaaacagattaacaacagaaaaacatacatctcttgaatatgttttacgtgaaaaagacacaaagaaatggcaaaacccaaatacttttgtgctaggcagaaccaagagcggcagctgtgggagagtaaagtgtgcggggaggctaatggaagatggaactgcttgaaccacgtctaggtagaaatctccgccttgctcggctctggtgccgagtgtttctttgttcctggtgtagggaggccatgttttacaggagttttctcttgtttcaggaagaaaagggggcagtttagagcactcttctgtttttcaagtgcttttagcttaaataatccttatgccagagacatatttttgggatggcataccctgtcacccttcacgggctatctgaacagaatctaacgtgggaggcaaaaa

SEQ ID NO: 132813 - DNA, 264 bp, Homo sapiens
attgcctcgtagatgcgcatgcttttctctcaaaggcatctcaaatcactgtgtttaaatctgtaccaatttttctttgacttcactctagtcagtgattttatatgtatgtatgtatacacacatatatatatacagatatatatatatcacatagcactatattgttattatttgtctatttttctgtctccttcactagactggccctgtcctcaaaattgagaccatgtggcactctttgtatcacataactgacacgaa

SEQ ID NO: 132814 - DNA, 323 bp, Homo sapiens
gctgggattacgggcgtgagccacagcgcccggctaaaacagcagttatcttatgccggtactgtttgctcagccccgtggccccactctgagggaggggctatgatgatgcctgcatcacagatgtagacattgaggctcagagatgtggagctacttgtccaggatctggcagtcggtggtgccgacacaggagttccagttatctgaccttggggcctgtgctgtctctgaccgaggcattggagagcttcgcagagtctaaaatattttgcctgggctgtcgagttctgtttcatttcctgcaggccttccaattgaac

SEQ ID NO: 132815 - DNA, 468 bp, Homo sapiens
tcccttctctgacagtgaaaaacctggctccttttatcctccgtatctttacttattcactcaatcctagaatatgcagaaagtaatttgagaatgctaacccacaccacggtgataaatgaacctccacccccaagtttaaactgttcaaatcagcagttagtggtcagcttctgttcagctcagtgccttgtcagttagtcatccaaacaaaacagatgaagtaatgctctgcagttccccaggggcatgtttaagaaaagagctgccagactccatcaacagcttactttctggtgatgtcggagcacaaaattgaaaaatcaggagtcgccagaaaagaaagggagattaatttcatacagtttataaaaaggacacctgttgtgggaaaaacagtttgtcatcttcatctcaatgtacaaattgccaaagagaagaaataaaaaggaaagtgttgagccagtg

SEQ ID NO: 132816 - DNA, 585 bp, Homo sapiens
gctgaaggggaaagcgggcagtaagggcaattggtgggtgtttatttcctcatatgaaatgaaatgtttgtagtcttctcttgggataatgcagagtctgactgctgtctgggatgattaccttggccatggccatcactaacatgtagatcttgtctctattggattagcatgtccaggattcccatgactccacttcttgatttctgatttcttgccagtttattttcactgtgacaactgaacattttaagtgctgtcatgggatgactaaggacatatttcctctaattctacttccacgcaaaggatcaagggaaaaatgggaaaggggattgcgtgtgtgtgtgtgtgtgtgtgtgtgtgtgtgtgtatgtgtgtgtttgggagtagagtgtctgtttctcctccagaagaagcagagttatatggagctcctaccatgctaccatgaggtctatgctgtaaggcacagtatatggatgctacagaggggatgcaggcttcccccgagacagagcagaagccaacacattcatttgaagaaatctctcttgtgcttcagctttgccatttaccaacctt

SEQ ID NO: 132817 - DNA, 675 bp, Homo sapiens
atccactatataaatacagagtaatgtgagtatataattctaataattgctacttactcataagtacagaattattagggcatttacagaagtcacacaactcaacctttaaacaagctcaaactgagtaggataatgataggattaaagacttaggaatgccatgttttagatgtgtaaaactgatacactccccacctgcttctagctgttttggaaaaaagtgagatttgctatgccaagcatgccagtgttaagtgaactcatgtgaactgtaacattttttgtcccactgttgtcatgactttgtacaaataaactaagataagattgtctggttcgggcagattctgataaagagacttgataagaaaaatgcagtagtgctggaaaatctacaagatgaaggggaaactgttaacagttaatttataaattttaatggctctctgcccaggtgcagtgtctctttgccatggggaggtatacattaaacatcagagcccttaatttaatagctattattgcggctgtgtatagtctgtttctttatagtaaggaattatttatcaaaacatagcttccatgcctctggcatttactgttaacccattattttctggactttggcctccttgacaggtattttaaaatcaatgtaactcaagtatccag

SEQ ID NO: 132818 - DNA, 1274 bp, Homo sapiens
ctgcaatggggttgctactgctgcgaattcggccaaagaggctctatgcttctctgaagacttgcagcaaggcttgctgaggctcacagaagatagccccagtgttttggagtggttttgaatgtgattctgagatcagactgactgagctggaatcctggctttatatcttaccagctacacaaccttggagtcttagaaattttttcttttcaataagcagtcatccttactttccctcaagatgacaaacagttcgttcttctgcccagtttataaagatctggagccattcacgtattttttttatttagttttccttgttggaattattggaagttgttttgcaacctgggcttttatacagaagaatacgaatcacaggtgtgtgagcatctacttaattaatttgcttacagccgatttcctgcttactctggcattaccagtgaaaattgttgttgacttgggtgtggcaccttggaagctgaagatattccactgccaagtaacagcctgcctcatctatatcaatatgtatttatcaattatcttcttagcatttgtcagcattgaccgctgtcttcagctgacacacagctgcaagatctaccgaatacaagaacccggatttgccaaaatgatatcaaccgttgtgtggctaatggtccttcttataatggtgccaaatatgatgattcccatcaaagacatcaaggaaaagtcaaatgtgggttgtatggagtttaaaaaggaatttggaagaaattggcatttgctgacaaatttcatatgtgtagcaatatttttaaatttctcagccatcattttaatatccaattgccttgtaattcgacagctctacagaaacaaagataatgaaaattacccaaatgtgaaaaaggctctcatcaacatacttttagtgaccacgggctacatcatatgctttgttccttaccacattgtccgaatcccgtataccctcagccagacagaagtcataactgattgctcaaccaggatttcactcttcaaagccaaagaggctacactgctcctggctgtgtcgaacctgtgctttgatcctatcctgtactatcacctctcaaaagcattccgctcaaaggtcactgagacttttgcctcacctaaagagaccaaggctcagaaagaaaaattaagatgtgaaaataatgcataaaagacaggattttttgtgctaccaattctggccttactggaccataaagttaattatagctttgaaagat

SEQ ID NO: 132819 - DNA, 1220 bp, Homo sapiens
ctgcaatggggttgctactgctgcgaattcggccaaagaggctctatgcttctctgaagacttgcagcaaggcttgctgaggctcacagaagatagccccagtgttttggagtggttttgaatgtgattctgagatcagactgactgagctggaatcctggctttatatcttaccagctacacaaccttggagtcttagaaattttttcttttcaataagcagtcatccttactttccctcaagatgacaaacagttcgttcttctgcccagtttataaagatctggagccattcacgtattttttttatttagttttccttgttggaattattggaagttgttttgcaacctgggcttttatacagaagaatacgaatcacaggtgtgtgagcatctacttaattaatttgcttacagccgatttcctgcttactctggcattaccagtgaaaattgttgttgacttgggtgtggcaccttggaagctgaagatattccactgccaagtaacagcctgcctcatctatatcaatatgtatttatcaattatcttcttagcatttgtcagcattgaccgctgtcttcagctgacacacagctgcaagatctaccgaatacaagaacccggatttgccatgatgattcccatcaaagacatcaaggaaaagtcaaatgtgggttgtatggagtttaaaaaggaatttggaagaaattggcatttgctgacaaatttcatatgtgtagcaatatttttaaatttctcagccatcattttaatatccaattgccttgtaattcgacagctctacagaaacaaagataatgaaaattacccaaatgtgaaaaaggctctcatcaacatacttttagtgaccacgggctacatcatatgctttgttccttaccacattgtccgaatcccgtataccctcagccagacagaagtcataactgattgctcaaccaggatttcactcttcaaagccaaagaggctacactgctcctggctgtgtcgaacctgtgctttgatcctatcctgtactatcacctctcaaaagcattccgctcaaaggtcactgagacttttgcctcacctaaagagaccaaggctcagaaagaaaaattaagatgtgaaaataatgcataaaagacaggattttttgtgctaccaattctggccttactggaccataaagttaattatagctttgaaagat

SEQ ID NO: 132820 - DNA, 1185 bp, Homo sapiens
ctgcaatggggttgctactgctgcgaattcggccaaagaggctctatgcttctctgaagacttgcagcaaggcttgctgaggctcacagaagatagccccagagtcttagaaattttttcttttcaataagcagtcatccttactttccctcaagatgacaaacagttcgttcttctgcccagtttataaagatctggagccattcacgtattttttttatttagttttccttgttggaattattggaagttgttttgcaacctgggcttttatacagaagaatacgaatcacaggtgtgtgagcatctacttaattaatttgcttacagccgatttcctgcttactctggcattaccagtgaaaattgttgttgacttgggtgtggcaccttggaagctgaagatattccactgccaagtaacagcctgcctcatctatatcaatatgtatttatcaattatcttcttagcatttgtcagcattgaccgctgtcttcagctgacacacagctgcaagatctaccgaatacaagaacccggatttgccaaaatgatatcaaccgttgtgtggctaatggtccttcttataatggtgccaaatatgatgattcccatcaaagacatcaaggaaaagtcaaatgtgggttgtatggagtttaaaaaggaatttggaagaaattggcatttgctgacaaatttcatatgtgtagcaatatttttaaatttctcagccatcattttaatatccaattgccttgtaattcgacagctctacagaaacaaagataatgaaaattacccaaatgtgaaaaaggctctcatcaacatacttttagtgaccacgggctacatcatatgctttgttccttaccacattgtccgaatcccgtataccctcagccagacagaagtcataactgattgctcaaccaggatttcactcttcaaagccaaagaggctacactgctcctggctgtgtcgaacctgtgctttgatcctatcctgtactatcacctctcaaaagcattccgctcaaaggtcactgagacttttgcctcacctaaagagaccaaggctcagaaagaaaaattaagatgtgaaaataatgcataaaagacaggattttttgtgctaccaattctggccttactggaccataaagttaattatagctttgaaagat

SEQ ID NO: 132821 - DNA, 581 bp, Homo sapiens
gtctcggtctacccctctgagaactgggaggcatggaagacccctgcagccctggcatgccaagagactgtgtcaagcccagcagaggctggagagcttcacttggtgaccacacgaggttataacagtgcatcctgcccggctgggctcgctgacagtccctctcagcaggcaacctgcagcctgactcaaccaggatgcacccttttcacagatgagaaaccagaacctgagggctcgcaggggtgtctccatagatcagagacatttccaaatcaaacagctccaaatccaccctcaggaggcaccgtctgcctgttagaacgggtggttcccaccactcctgaatgagggtgtgactcctggttttggggggacatttcttcgtaatgctgtctccccacatgttgttttaggtcataattacgctccctggcaggggtgggcaaggccctctgaccctgtttaaagacaaggaactgtgagggctatgagcaggggcacctccctggcctgggcatgtttggcgttggggtgtggctgcggagagcttgggcagaggggtgtgggaaagtattggc

SEQ ID NO: 132822 - DNA, 152 bp, Homo sapiens
catttacacctgcttgcgaaagtttgcttcccctggtgtccaaatgcctgagaagagagggacaaactgtctattcgaagctgagaatgtcaaagaatgaatcattgtcacgagtggagtccagaacgcacaaaagatgaaacttcgctaaa

SEQ ID NO: 132823 - DNA, 573 bp, Homo sapiens
gatcttcctagcaatctgtgattacggtatgcattcttccatggtttctacgtttttgtctattctataatgaaattttctaagaagccagaaattaattaagtgctacctaaaaatatcaaaatgtcaggtacaagaatttggcattttcccagtaacataactagattgttctgaataccgttattatttcccaataatacaaacatcacaatttcagttctgtagtacctggcctacctacccttcccactgccttgccccaggtaaacacagcatgcctgtcactatacattattttacatgcctggaaatatatttaaatggaatcatagaggtggtttctttttttttttttatcaacacctggcttttttcattcactccacttatttttatatttatccattttattgcatttatctattgatatacttcattctttttgattgctaaatactattgcggtatacaaccacactaaacattttattatccatccatttgtcgatggacattttggttgtttctcatttggggctcttgtaaataaagctgctatgaacatttgtg

SEQ ID NO: 132824 - DNA, 627 bp, Homo sapiens
gatcttcctagcaatctgtgattacggtatgcattcttccatggtttctacgtttttgtctattctataatgaaattttctaagaagccagaaattaattaagtgctacctaaaaatatcaaaatgtcaggtacaagaatttggcattttcaaaattagtaattacaatgtaagtttgccctattataatgatacccagctatgtccagtaacataactagattgttctgaataccgttattatttcccaataatacaaacatcacaatttcagttctgtagtacctggcctacctacccttcccactgccttgccccaggtaaacacagcatgcctgtcactatacattattttacatgcctggaaatatatttaaatggaatcatagaggtggtttctttttttttttttatcaacacctggcttttttcattcactccacttatttttatatttatccattttattgcatttatctattgatatacttcattctttttgattgctaaatactattgcggtatacaaccacactaaacattttattatccatccatttgtcgatggacattttggttgtttctcatttggggctcttgtaaataaagctgctatgaacatttgtg

SEQ ID NO: 132825 - DNA, 391 bp, Homo sapiens
tccactcaagagtttttaatgagagctttgtgtgaaactgaaaggcaattggtccttcagacttggttgtagagaactattgtttgctgcctccaggcgctgaacagccttgtgggtgattgtatagaaagtaaatactgtgctgtatagaaattaaataaactgctgagaattaattgagattcatgccacacagaacagatgtagaccttggggctggggccctctggtcagacgccctgggggagctggcctccctgcctgtcagctcagggaactgtgtcttccttcacctgcccttgtcaccacccaggccaaggctcagtgtccacttgaaccctcacaggactaccagtttctgcctcccttggctgggagctcgccattgatt

SEQ ID NO: 132826 - DNA, 206 bp, Homo sapiens
ttaaaaatctgtcatcaaaaaaaatctctataagacaactgtgtgacaagacttgcaaatatatatctactttccaaaaacatagtcccagtcataagagtttggagctctgcctatgaatgtaaagaaacaaggggcattacgttggaaatgttattgaaaggaagaaaaagtaaatggtgcaggttgtccatgatagatgtagg

SEQ ID NO: 132827 - DNA, 691 bp, Homo sapiens
tattccacggtgactctgcagcggagacacctcgggtctgaggccccttggagggccccgggaattcctgagcagctgctgagacttcacggcccagagctgtaagcctcctgcagatctcgctgaggaaggagaagcttagagggcaaagcaggacaccaccggaactgcagagaatcaagcatgcagctctgagaagggcctgccggaggagtgggaaactcatcaaaattaagagcctttgaataagcaggatgagcacaaggtgggggaggggcggggagccctaggtaagggctccaggaatgacttcactgcaaatgttaagtgacccaagaagacaactgtccccccgctgctctcagaggaagctgtgagcctgggtggatacggacggcaggggacacagtttgcctctcattgggcaatttccaccagtggagtttcaattcctgggtcgtggactctcgtctcctggtgaagtgcaacatcattcctcttgtcgccggtgcgttgtgcctgcatctttgctccagctaagccagctcctctaggcctctggctgcccaccgcagtgggctctggactggactctggaccatgcgttgctgggtttgctgctgtgatgatggaggtgctgcttttgtctgtctgatgtttatactttgtgggtgtggagtgtgctaggaac

SEQ ID NO: 132828 - DNA, 1382 bp, Homo sapiens
accccgcaccagggtggggggaggggtgggtttggggtgggaatgggaatgggagccgccactgcaaagcagtccctggctggcttcctgccctgcacccagtcatgcaaggcctcccgtcccacccctgcccctcatcacctccacccctaggctgtccagatccaggctccagaagtctcccaggatccaagaactaagggcaaccactgggctccgcagcccctagtccatgagtcagccacccctctgcaggctgacaaaccttggctgtcacttatcttccgccccaaaccagccccagccccatcctgctgcaggtctgtgtggctgctggagaggctgggctcctttcctcaccccgaggctgcctaatatgctttctggatcctggagaaaactgacccactattctcatactggtgcaacttcttccaagacctcaaaactggacaacgtgaacttgtcttgtttcttgtctcttcttgctagggctgtcattgggacagtctgagatggggagtcgggggagacaatggatgaatggatggatgaatggacagcagtccagggagatgtccctgtgtgtcctgaactgggcccttcctccagtgagaagccttcctgagtgagtttatatagtcatcccttggtatccatggaggattagttctagggtccccggggatgccaaaatccatggatgctcaagtcgctgacataacatgacctagtatttacatataagctatgcacattctcccgtatacattagaccatctctagattattcattatgtgtaatacaatgcagatgctatataaatggttgtgatactgtatttagggaatgatgacaagaacaacgtctgcacatgttcagtagagacaaccatccgatttgttttctgaatattttccatctgctgttggctgaatccacagttgcagagctcccagatacgagggccaagtgctttgagagtagggtgggtgaggttgctaatgagtacaggggagcaggtgttgatcagggggaccctgcactgggcatctggacgccctgtctcaggacttgagactccgtttggatggcacaggcagactaagcccaggtcaaagccctccccttggatgttcattttatcccaagctctttctggaccctggaatttggcatcccctaggccctgggtgggacagctgagccaggttttagataacatgtctagaaaagtgggcccctactgtgtgcctggcactttccgcacatgatcctctagctagaatatccaagggtcatggagagaaatacccagttaaaatatcagaaatgaaaaagtgataccattagagacactaaaaagacgattagagatact

SEQ ID NO: 132829 - DNA, 382 bp, Homo sapiens
caggattaaggaaggagtgagggaagaaggaaagtgagtgtgactatcaaagaacaacttcagggatccttgtggtgaatgaaatgttctgtatcttgactatatcaatgttaatatcatggctgtgatattgtactatagcttttcttttccttttttttctgtgacagcctaccattgaatgtactatagtttttctatactaaaggtactaaagatgttaccattgggagaaactgggtaaagggtgcccaagatcagtctattatttgagacttgcatgttagcaattatcttgaaatacaaagttgaattaaaaaaattaaaatcaacttaaaatgtcctaaaaggctgaccaatattttctctgggtggtaagagt

SEQ ID NO: 132830 - DNA, 214 bp, Homo sapiens
ctgggctccttaggacttgaggtgtaatttgcagaaggatagattggttcatgtgagttagctatggttcatctcttgagtgatgggggcggagttgttatagaatgtaagaatgcaaagattgaatggtcaatgtggtattttggcattcttccaaatccttgtagctcttttggagaagcataacactgctttgtaggaaagagaaaagtgt

SEQ ID NO: 132831 - DNA, 116 bp, Homo sapiens
ggaggtcatttcaacaagtaaaaaaaggagaagtcattagaacccagagctcaatggtagacctcacccccttcaagtgaccacccctttctcaagtgatcactgagaactagcca

SEQ ID NO: 132832 - DNA, 329 bp, Homo sapiens
aattggacagaaagaaagccacaggaaatacggcatcttcagatgacttcgcctggaatcaaactgacctgcaaggatcgtggaggccctgaccccaagaagacaagaaagaggggttccccgatttcctcccgcagacgggaagctgaaaggaaatcaaccagggttacctagaggataaaaggaccaggggcccggggtgacactcaccctcagataatcagaagattccgtggatccttttccattcggcagcggcttctctggaggtttcccggaaaacatgtggaggagagccttcctctgcgggtcttgttgcctgcagaaca

SEQ ID NO: 132833 - DNA, 485 bp, Homo sapiens
cgtttttcatgtagaaacagtagtcggtatcttagtttctaaaatattcagtaccatctaattaaatatgttcaacacaatttacatttcaacaacctggagaacttcgctttttacactacgtagtaattgcttttaaaaagttacttctgtgcataggcaggctattgatttgtgggagaaaatgctttgtcttgcttgtattcagagccagtactagttctacttcgatttcagttttttaatattcaaagttggctgggaacagtggctcatgcctgtaatcccagcattttgggaggccaagacgggtggatcacctgaggtcagaagtttgagaccagcctaacatggtaaaaccctgtctctactaaaaatacaaaaattagctgggcgtggtggcgggcacctgtagtcccagctactcaggaggctgagacaggagaatggcttgaacgcaggaagaggaggttgcaatgacccga

SEQ ID NO: 132834 - DNA, 484 bp, Homo sapiens
taaaaggcatggagaagacctacaggtaaagaaagctagttaacatttagaaaaggttcatatttaaataaatttcaagaaaccaagttaaatatttttccaggtaacaccaactaacattctgtgaaatctctgggaaacagtatctcatggctaattagatagccatccggtcttactaagatccaactttttttttttttttaagacggagtctcgtcctatcacccaggcgggagtgcaggggatgcaatctcaactcacggcaacctctacctcccgggttcaagtgattctcctgcctcagcctcccaagtagcggggattacaggcacctgccaccacgcccagctgatttttgtatttttagtagagacggggtttctccatgttggtcaggctggtctcaaactcctgacctcaggtgatccacccaccatggcctcccaaagtgctgggattacaggcctgagccaccatgccc

SEQ ID NO: 132835 - DNA, 265 bp, Homo sapiens
taaaaggcatggagaagacctacaggtaaagaaagctagttaacatttagaaaaggttcatatttaaataaatttcaagaaaccaagttaaatatttttccaggtaacaccaactaacattctgtgaaatctctgggaaacagtatctcatggctaattagatagccatccggtcttactaagatccaacttttttttttttttttttttttttttttattttttttatttttttctttttttttttttttttttttttttatga

SEQ ID NO: 132836 - DNA, 562 bp, Homo sapiens
ttcctgtgctggcacagagaaagtgctgggcccacaaagcccctgaactgcaggcactggactcggcctgaggggctgactcggtcaggaggtcaggccactaaagcttccacagtgtgaccctgactttcccgtaacgattccacagaaaaccccgcacactggtcaacctgctcacaagtgacaggggcatgggttctgcccacagtggattccggccggggggtgctccgttagatgcggcctgtcctccaggtcccgaggacatgcagttatggacgtgcattgcacagagcccacagctcctagatgagagcaggaatgttccaggctgtccctcatcagaaccttctaacagtaaaagtcgaggaaggcctaaaaatctagacttcattcaactcagaggagggaacggagagccagatgccagggaaaacctgcacctagaggaacaacagaagctgggcgcacaccgggcgctgtgtgctatgcgagcccctccggaaggacaccccatgcatcaagaaatgcccgggagacgggctctctcatctcactacac

SEQ ID NO: 132837 - DNA, 846 bp, Homo sapiens
gatcatgccactgaactccagcctgggtgagtgacagagtaaggccctgtctcttaaaaaacaaaaaattctagtttgatcaagtcattttctcattggacctgccatcccctcctcctccaccggttctcagccaggggcagttctgcccctaggacacactgggcaatgtctggagaactttctggttgccatactctgggttgctcctggcatctgctaggtagaggccatggatgctgcccaacaccccacagcgcacaggacagccccccaatggcaaagaattatccaaccccaagtgcaaatggcagtgaggccgaggagccctaccccagtcttttgttttttaatccatttatgctttgcgttccattattggtacaggagccccagcttctgttgagttcttggggatatgtgagccactgtgcccagatttttttttttgccctttggcttctttgtagagcacgggcactccacccgcctcggttcccagagtacggggcattgacgggcgtgagccaccaggtcgggccaacaaaagagtttggatgcccacggggtgaacagccacattgggtggccccgggaagaaacagggggcctgaagttagtttagaaccctccctgctgggttcctaccaaaggtggcacgctcctaccccttccccgaggccagttcctacaatcagaacaaattggtggcccgtgaagacggtatgaaggttagggcgacaaagacaatgggtcgtaacgccatgcgggacttcccagacgggaattggtagggtgcgtgtcaagacacgcgtgtggtcccatacacaccaagggggaaattac

SEQ ID NO: 132838 - DNA, 496 bp, Homo sapiens
gatataaacctcacctaatatgtactctcttgcctaatatgtgagcactccataaatattgcctgctattgctccatataatcttgcccaatatgtagtaagcactccataaatgccagctgctgttaatatcattcttggaagactggatatagacacagatccccaaagggcttaagaccttaccgttgttgacttttattgcaccaaaatgaatatcccctgagctcctgttcataacagcatagagctggggctgaaagtgcgttgtatttgcaaagggttttattcatttctttaagaattacataacaatcgcagattcttggagctggaaaggatcttaaaggtcatcttgcctatcccccacctaaggcttaactcccttctaccctctcctttaccctcatctgaacaccttatcttgagcctactcgagagctcttgctctgggaaagttcttccttatgcttgcctggatctattgccagccccc

SEQ ID NO: 132839 - DNA, 305 bp, Homo sapiens
agttctgcctctccaaacaagacagtgatgttcctgaaaaaaatctgtagttttcagagttgagaaatacaccttgaacggaaaaaaacagaggaccaagttatcattgtggccaaggccatggggaatagtacacaaaataaaggatatataaatgacatttccacatgttcaactagtaatacttaataatttccatacaattaagtttcacaaccattccttgctaactagataactattcaggatttcccccaaagaatttggacatacattttgtggcagataatatgcatgttacaggt

SEQ ID NO: 132840 - DNA, 563 bp, Homo sapiens
agaagtatatcttaacaattcaatcaaataactgacaattaaatatctatcaaatgaatgaatgactcctattccacacacttcatgataacagggctctgctgtttcaggctcaatttatttaccttgtcacctggcccataagtaagaagactgtcatccatggccattgttttctagttcttctgaggacttttctcctctgtcagtttaaagcctccctaatcaaccaagtttgtttctaggcacatgcactcttccctcctctcatgtgctcagcccttgggtaagagtccatccttctgtggtctcattagaaatttcacattctggccgggcacggtggctcacacctgtaatcccagcactttgggaggccgaggcgggcatatcgaggtcaggagatcaagaccatcctggctaacacggtgaaatcccatctctactaaaaatgtaaaaaattagccaggcatagtggcgggcgcctgtagtcccagccactcggggggctgaggcaggagagtggcgtgaacctgggaggcagagcttgcagtgagccaaga

SEQ ID NO: 132841 - DNA, 216 bp, Homo sapiens
caatctgtccacctcggcctcccaaagtgctgggattacagtgtcagccaccgtgcctggcccctgcattaaaatttttcaatgacttgacactgctggtattacaaaatttaaaatccagagctgggattgtgcaactgcacgccagcctgggcagcagagcaagatcctgtctctaaaataatttttaaaaaaattaaatcctcacattccctg

SEQ ID NO: 132842 - DNA, 203 bp, Homo sapiens
caaagagtaattatttgactgtcaggttctgcccagggtaaagctatcagcaggcttggcaaatatacaaagtcaaacttccctaaggcaggtacagggcaaaaccaaatacccctgcctccataatccattttttaagctttccatttatcagtaaacaacagctagtttaaaaaagaaagaaggggtatcctttgaaagaa

SEQ ID NO: 132843 - DNA, 353 bp, Homo sapiens
ctctgtcacccaggctgagtgcagtggtgcgatctcggctcgtgcaagcagggtgaggtgtgagcttatcgccttaaataccccattagaaatatgattcaatagagtaaacaggagcaagctcactgcagaaatgcactgcaaatgtttatagctatagcctccaacagcaagaaaaaactcccccaaaaaacaaaaaacacggcttagaaactgaggcaatttatttagtaacttgaaatattgcagcttcaaaaacaagactgtaagactaaaacataaaattgtgtaaaatttaaatactgaaatacactatgactcatctttggtcgaccaagagcttaatttctttt

SEQ ID NO: 132844 - DNA, 387 bp, Homo sapiens
ctcgattttctccccatgaagtctctgagtgaccttcggctaatatcaaattctgcagttgtaaaattggatttcaattttaatccccatcataaatggcattactgagattttggcttcggtgattagaaatcaccaggcattattttatagttccaaatactctttccttggaaaaaaatatataagctatatatctgtatgtgtgtgtctgtgtgtgtatatatataaggtgtatatattttatatatatacatattcatgcatatacatatatacagacacacccaaatatatatatatacacacaatgtatatatctgtatatatactaataataatatttatacatagtttgacaaatggtatcatgctttatgtgttatt

SEQ ID NO: 132845 - DNA, 266 bp, Homo sapiens
caatccagggatgggggtagcagagcggggcagtatgacaagaaacctgatgaacccacattgttctagttggatgatgggtacatgtgggttcatcaggctgttctatttttgctacaattttaaagtttccatagtaaaaaatctgaaaataatgacagagttgtaaagctggctaatgacaagaccaaaagccaaatccaggttctcctgattttaagaccagtgtcggccgggcgcagtgactcacgcctgtaatcccagca

SEQ ID NO: 132846 - DNA, 448 bp, Homo sapiens
aataaataattcccagaagtcttaccattactctttgcttcatcctgttctcttttccccttaattttttttattactttttactttattctgtcattgattctttttgaaaatatacataaaacatagcttatatatagtcatgcactgtataacatttcagtcaacagtggactgcatatatgatggtggtctcataagattataatggaggtgaaaaatttctattgcctagtgatgtgtagccatcataatgtagcacaaggcattacttacgtgtttgtggtgattctggtgtaaacagacttactgccagtcatataaaagtgtagctcacataattatgggtagtacctaatacttgataatgatgataggtgactctcttactcatttgtgaatttactatactatatttttaaatcattagagtgtactcctacttatt

SEQ ID NO: 132847 - DNA, 668 bp, Homo sapiens
taattcaattcagtactaacaactttaaaaaatacaaacaagcgtaaagatataaaatctggatggaataataatagatctaatattatttagatatttatctctctcctacagatagaaaggtattcattaaactgttaattttgaatttgttgtagatatgcatggagttgtgggaaataatactcagaggccttatgtgatctttaccctgtttaggtatatttttaattttcaagttggttgcataaactattcattagtcaacagatactggacaaaatctaccattggactgacattttttctgtttttggtagaaaaataaaatgccaaaatatatgaaatactaacaacaaatacacaaatagaatatgtattcttctatcgttggttagagagttttaaagacatcacttaattagagttggtaggtaatttgggagttctggtgttaggtgcatacacatttaggattgataattcttgatggatgggctcctttgtcactacttaatttccctctttattcctggtcacattcattgttctgatcccaggaatacaaagttgaattaacatttggaaataaatcaatataaccaccatactgccaaatacagcagaaaacccatataagcacacaaaacgtgcagagaaaaaatgtg

SEQ ID NO: 132848 - DNA, 336 bp, Homo sapiens
tgtgcagggtgtgccaccgagattaacatttgagtcagtgggctgggaaagggaggccacacttaattgggtgagcgccatctaatacgctgccgatgaatataagcaggcaggaaaacgtaaaaaggagagactggcctaagctcccagtctacatctttctcctgtgctggacgtttccagcacacaaacaccggcacacactgtcagggacgcacaggctcacacatgggcacacacgctctcagatgcacaggctcacacgcacacaggcacacatgctctcagggacacaggctcacacgcacacgggcacacacgctctctcagggatgt

SEQ ID NO: 132849 - DNA, 118 bp, Homo sapiens
cctctcattaatcagcacagaggcttggaacaaaactccaggatccatgactaccttcaaacaacaggggtgtgttgtcagccaggccacttggctcccagctcacctaggccagagg

SEQ ID NO: 132850 - DNA, 405 bp, Homo sapiens
acttatgtatcagggcttcccatcctggctgttgaattacctattctggcagctgttccagtcaatacagctgatagtaaattttaataactggcagtaaaagtcttccccagtaaccctgattttcaatgttttgttggccattttcacacattttttcaggtgtatattttttcacactatttgttcagatgatcattgtaattcatttcagaaactagatatctcttgtaatttcctgggcttctccttaccctggcgagtattctttgtaccgattttagtctgaagtctggtaggtacaaaagttagtttgtgtatttgctatttgttaggtgcccttcatccctggtatttaaaattctggcccataatagaaacatacctactactcactgctcctct

SEQ ID NO: 132851 - DNA, 233 bp, Homo sapiens
aagatcaccaaggatctcctgtcaaatcattcattctttcagtggaatcaccagggagtttatatgaagtgatggagacaaggctgagaatggaccccaatggacatcaacatttgagggaattggtgaaggaaaagataatgaaggaaattagaagccagggttgaaggagaaagccaggagagtgtggtattccaaaaagaagagagtttttaagaaggaggggaattaag

SEQ ID NO: 132852 - DNA, 377 bp, Homo sapiens
acatcatttgcatcctatttgtaaaactctattaacagagcgtataccatgactggtctaaatgatatttgatatctaatggttagagggcacagactgatatttaagtaaggttgcaccatggtaactttgatgggttattttatattgaggataaccagatatgacatttttaagaaaggtctagatcactaaagaaaatgaaaagaatggcttaattgcatcagagggaactgatctttaacataacttggattaaaaaaaagatagatatgtataaagaaagatatatagatggatagccataaagatagtttatttttgtttcaccatttttgagaagagtcatgctataaagtgtttttcaagaaatctaa

SEQ ID NO: 132853 - DNA, 734 bp, Homo sapiens
tcagtttggggagcatttccatcttaacactgttaagtcttccaacctatgaacatgggatgtctgtccattaattaggtctttaatttctttcaatgatgttttgtagttttcagtatacaaggcttctttgttaaatttaatcctacatatttattctttttgatgctgttgtaaatgaaattgttttcttaatttcatttccaaattatttattgctaatgtttagaaatacattttatatttatatatatatctggtatcctgcaaccttacaaaaatcatttgttggccgggcatggtggctcatgcctgtaatctcagcactttgggaggccaaggctggtggatcacttgagatcaggagtttgagaccagcctgggtaacatagtgaaaccccgtctctattaaaaatacaaaaaaaaaaaaaacagaaaaaaaacaaaacgaggggggcgccccggcccacagaaaaaagcaacaaaaacaaaaaaaggaacacgggcccaacaagcaacgaaacgagggcaaacaaattgcacaaaaaagcacaggggcaaaacatatagtggccgaagaacacaaaggaaatacaaatcgccagatgtgcaaacagacggagatcacgagaacaaaacaagagaagggaatataagaggaaaatacgggggcacacacaaaaacggaggactacagagaacagccagaaagacaaaaaagaccccagatgagt

SEQ ID NO: 132854 - DNA, 572 bp, Homo sapiens
tgagtctcaaccacccccacagtcacacacctctcacgccctggctctgggctttcaccaccgcctggggccctgcttggactctgcagctgtgtcccaaggctgcgccctagatttgtctactccttcccctgccccctccctgctttctcccggcctctgtagtcttcctgctcctccacctacgtggctgccttgggccccatgcagctcctcccccgggatgccccatgctctgttctgtactaagaaaaattcttctgccttgggatcctgttgatctgtgaccttacccccaaccctgtgctatctgaaacatgtgctgtatccactcagggttgaatgaattaagggcagtgcaagatgtgctttgttaaacagatgcttgaaggcagcatgctccttaagagtcatcaccactccctaatctcaagtacccagggacacaaacactgcggaaggccgcagggtcctctgcctaggaaaaccagagacctttgttcacttgtttatctgctgaccttccctccactattgtcctgtgaccctgccaaatccccctctgtgagaaa

SEQ ID NO: 132855 - DNA, 309 bp, Homo sapiens
taactgtgacttgtgcttcaaccttgagctcatgtacgagctctttgcagatgcatctcacccaggtgagtgctctttctttggggtcctgtagcaccctgcagttattttagtagagcgccaatcacagagttttatgtgaacttctccataagccctgcaagggcagagatcaagtctatcttgtttaattccacatcccagggtctaactaatagaactttttatgtattagcggcataaataaataagttgtctataggttgagtataatctcattgccaggaactggatagaggttcttggact

SEQ ID NO: 132856 - DNA, 692 bp, Homo sapiens
ggagtaatttgttaggaaaactactttctgaggtgcccccacctcccctccttccaacctgaagaggcagagaggtttgtgtaaacaaaggtcctgcaaggcacagctgttttacattctgatgttctatgactttcttaaataaaaaccttttggattttcatatctatttagctagtaggaatatttcctcctttttcggagaataaaatcctagacttaaggatattccttgggtgactgagaagtcataccagcctaagcagtacagctggccccctgtatccatggcttctgcatctgtgaattcaaccaaccatggatagaaaatatttgggaaaaaaaatccacaaagttcgaaaaagcagaagcacgatttgctgcttactgagaactgcattgaatccatgtgagtaaggtgatgtgtaggcgttgtattaggaattataagtaatctttaggtgatttaaagtatttgagaggatgtgtgtcggttttatacaaatactacaccattttatataagggacctgagcgtccatggattttggtattcataagaggtcctggaaccaattgcccatgggtagtgagggatgactgtattttctaattaaaaggttttttttttaataagcaaatgttttacttagtaccttataatattttaaaaagcgtaaaattcccaaata

SEQ ID NO: 132857 - DNA, 342 bp, Homo sapiens
gaggataagaaacaactccttgtagacaagaggaaaagagtatgtaaaaatgtaaactgcgattacctcaggtttaagaggtgcaggctgatcactgttttcttctttatactttatttttgacattcctttaatggacatgttattacttttataacaaaaattttaagttttttttctttttttctaactttatgttttgatataatctcaaatttacagaaaagtttcaagaacagtacaaataattttcatatactctcaaattcctcaaatgtgcacattttgacacgtgtgctttatccttctctctactttgccttgatatatgggaatgtgtag

SEQ ID NO: 132858 - DNA, 428 bp, Homo sapiens
aacgtaacatgtaaccaatagcaactgaaatgtttacgtttttggtgattatatcaacatcaaagaaatgcaaatcaaaaccacaataagatgccatctcacaccaatcagaatggctattattacaaagtcaaaaaataacagatgttggcaaggctgcagagaaaagggaatacttatatactgtttgtaggaatgtaaactagttcagccactgtggaaagcaatttggagatttctcaaagaatttaaaatagaactaccatttgacccagcaatctcatgactgggtatatacccaaaggacaataaataattttacacaaaagagacatgcacttgtatgctaatcacagcactattcacaatagcaaaaacgtggaatcaacctaggtgtccatcaatggtggattggataaagaaaatgt

SEQ ID NO: 132859 - DNA, 691 bp, Homo sapiens
aaatattggaactccctcacaaatttatttctcatagtcataacagaaagtgtgtcctgagctagatgtggtagctcacacctataatcccagcaccttgggtggccaaggtaggagaatcgcttgagctcaggagtttgaagcctgcttgggcaacgtagcaagaccttgcctctataaaaatttttaaaattagccaggtatgatggtgcatatagtcccagctactcaggaggctgaggcaggagggtctcttgagcccaggagtttgagggtacagtgtgctatggtcacaccactgcactccagcctgggcaatagagtgagccctgactctaaaaaataataataaatagaaaaagaaagcatgtcctcttgttaaagatttttcaatgacacttgttcaaggatggtaaggctgactttttcaagatcatcagaatagatacagggaccaatgcaatagcattttacagcgagggagagagattgggctcaactctgaatacagtttgggtaagtgggaatttattgccaaggagtagggtgggggtcagtggattgaaaattactaagaggaaacttcaagagtaaggaaagattctggcttaactgacctaacaggattcttgctgaaaacaggctggggtgttgagacactacctgggagatggtggaggatgaagccctg

SEQ ID NO: 132860 - DNA, 135 bp, Homo sapiens
tgggtaccactgggagatatgctgttcctgatgggcccaagaagatggaggagtgatacgtaatcttagcctgattctgcagctgtaagtgagtggggaaaactgttaggagtccacagctgctggaataggcca

SEQ ID NO: 132861 - DNA, 846 bp, Homo sapiens
gagattacattgaacccatctggataactcaggagaatctcctaattttaagattcttaatttagtcgtgtctgctaagtcccttttaccatgtaaggcaacgtgttcacaggttccagggattagaacatggatgatctttgggggggccgttattcagcctactacatgggggaagaacttgaatgtgcttaaaagaataaaaatagaaatggagagaaccaattgagatggagaagttgaatatacaaggaaaagagggggcaattcattgtgaatggcttctgttcagaaagtgatcaaacctgaagcgtaactaaagggaataagtaagagagttttgaagttttaggagaattgagaagttttgaaaaactcattctgagaaggagagtgaacagaccagagaaatatactaggattatttggctacagttgggggtccatttgagttttgtgatcataaacttatagagagattaatctgcactactgtgtgaatttctccaaaattgatgtgattctctagcgcaggcatgaaaaaagtaaataattgggtttctttataatgtacgaaggtctgccacgaacacacaaacacaccggcacgacaggccagtcttagaaccattgggggcacaaaaaccccagctactactttactcggtcctccttagcaccttgaactccaaagccgggctaagaacagcattcaacaggaaagaacctcagaatggctgctcatgcaacatccctttgtctaaggtgctcggtctttggggctctgaattattccccttcaggaaaattttccacacaaacaaacaaccacagacacacaacaac

SEQ ID NO: 132862 - DNA, 438 bp, Homo sapiens
ctctggatgcaagtgtctctacccgctagggtcttggggtttttataggcacaggatggtagggggcatggtaggctaggttggtcttgggaaatgcaacatttgggcccaaaggctggagtgcctgtcctcacctaggtccgtgggcacaggcctgggggtggagccctcgccagggactcacccttctttacccagcacttcccagcatcccttacatatcaactactgggttccccagtcggcttccttgttcagttgggggacagtaacccaccagctctgaaaagtggtaagggaagggacccactcccctagaaatctagccctcggttcagtcggcccctaagggagggggatgtagccggctaaagcccctcttgggtcaaaggttgggtcaaaggaaacaggagcactgcgctagccactgaagggggc

SEQ ID NO: 132863 - DNA, 564 bp, Homo sapiens
acctgtcattgtaaccaacataagggccgtaataaagggatgtgggccatgctatgggagcacacagtagagacatctaaacctacctgggaagagaggtgagcaagaaaggatttcccaagtgaccccgaaagcaaagacttcagcctgcaatggttagcgtgagcaaacataaggcgggttgggggtagtatgtgtggaaggcattctgagaagaagagtagcatgtgcaaggtaggagtaagacagaagaacccaataacaggacaggaagtaagccaacatggccaaggctacatacagcagtgaatgaacaggaagagatggtagaaaaataggtaggggagctctgggacacagtttttgtgagtaaaatccacatgccatgcagagtccctaaaagcatttgtctttcagagaatgggagtttacaaagaagattagagagaaccagcactaaaaagaaagagaggagccagaagctctaggaaacctctatcttcagtccttttggaggactcagtgggagtctaggccctctcagaatactaagagatttttctc

SEQ ID NO: 132864 - DNA, 748 bp, Homo sapiens
gagatggggtttcaccacgttggccaggtggctgcgtcggcctcccaaagtgctgggattacaggtgtaaatcaccatgcctggccacgatctgtattttaataagctctcttagtgattctgagggacagtcaagtgtgagaatcactggcttagtgtaaaacttcaaatgagatctcctccagccgtctgtgtctgacttgcactagaagggagggtggatggtgcagagttctgtcctcagcaaagacataatctggagggtatatcataagataaaggcatgtccctctcggtcctggagcttggaagaaaccaattttttttcagatagaaaagttgctaagggagctggtggagttcctagaactattattcttccaaatttgctcaccatcctatacttacagcttccagtctgcccccacctgagggcctggggcaaactcgacttttagaggagttgctttctagtgaagactgcccctgacagctgaagacctgctcccaccccactataactgtattagttagggttctctagagggacagaactcataggatggatggatagatgatagatagataaatgatgatagatagatagatagatagatagatagacagatagatagctaaagaggagtttattaaatattaactcacatgatcacaaggtcccacaataggctgtttgcaagctgaggagcaaggaagccagtccgagccccaaaacagaagaacttgg

SEQ ID NO: 132865 - DNA, 320 bp, Homo sapiens
aagcaaacagtggcagccttgtgggaatgtgctggggccaagcccactctaccacagggtgaagagcagaactcgagacctgaggtcagaacacaggaaggctggccttggcttggctgcctgctggtgactttgggcaaattaccaaatgacaatagtgcttattccatgcccacatgtaccacagactgtgtgtgcactgcctacaataaatcgtcacaatgacccctttcctccacccactttagagaccagaaaactgaggtagagaggaagaatgaccccactgtgcagttgtgcgtggctgagctggggtgaag

SEQ ID NO: 132866 - DNA, 209 bp, Homo sapiens
cactccagcctgggtgacagagcgagactctgtctcaaaaaaaaaaaaaaaaaaagcctcctgagatgccctgccccgttttcagcagttctgctccattctttcaacaattctttcttctcaactacgagcctctgcccaaagcaagagaaatgccgggtgcagtggttggtgcccatagtcccaactactcaggaggctgaggcaga

SEQ ID NO: 132867 - DNA, 286 bp, Homo sapiens
gtatgtaaactgcacccatcccaattcaaggcagagagttaaaattcacgattttattttttcttatagtgaaggttaaacagagaaccaaatatcatgtgattcttagaaagaaggttctaataacgaaagtgcaacagctttagatattagctttacccaggtggatacacctatacacaggcatatatgcccatatatatgctgtgggagggagtggaagaagagaaaaatatgccacttaatgttgggtcactatattaaaggtagagtaaaggtctgaatc

SEQ ID NO: 132868 - DNA, 491 bp, Homo sapiens
ccatccaccaagcaaagattcttcatggctttcaagggcaattgtcaatattccagaccctaaaaggcccatctgacccagtgcctaaaatcaatattaactaaaagtaggaggtgttctttcctcttccttcctccagggaaagaaaagaagaggtgaacacaaaagacaaggggatgaggaatgaaaagtagccatggaaaaaaataagataaattttgaaggataatctaaagtgatttttatctgcctggaaacaaaattaggccttcaaaaaaaaaaaagatgttatttatcctacctttagccacaactatactaattatttccaataccctcagacaattacatgttacttttgtacatttcaaattttaaaaagtttccattctaattattttttccagaaggatttcttaggagataggtgaaaagttagaggacatgggtgcctaaagaatctaataaatgcattgatccttttgccaaaa

SEQ ID NO: 132869 - DNA, 554 bp, Homo sapiens
caagttgcagcctgaagtaggaaggaaatatggagatgctggcatcctctctccaataaagcattgaggttaaagactggaatctgaaaatacacagcaatttcaggggaatctgctgaaactggaagattgtttcttgaacttctgacctcaggtgatccacccacattggcctcccaaagtgctgaggttacaggcatgagccactgcgcctggcctgccttctgtagcttttgtctgtaaaccaagtactacagtagaaagaaggtgggttttgccacctattatataataaggacatttttttcaaatggtaactcccgtgctgacaaggatgtggcaaaactcaaacttccatactttgctgatgacaatgaaatgtcaagttgaaaagcatttttagttctatgtattagaactcatgaaaatattcgtatcttttgatctagaaatcccattttggtaagtttatcttgagaattccatagacatctgtaaaaagatgttcatttcagtgttatttataaaagcaaaaaattgaagtcactctcaat

SEQ ID NO: 132870 - DNA, 443 bp, Homo sapiens
tactgtactcctcagtacaacactgtcaggctcagaaaagcttctcagtacataacaaatgaatgaaagcactgctaactaaatgaatgaaagcacaaatggagggatatcacaaacccttgatggcgggtggccacagatggcttcccaggtaatgcctgagtcttaaaggatgcataggaattacctggatggaagggggcattcctacaaaagcaaagacaaagaagcaagagagtgctacagcttatgatgttgtggagtgtgttcaggccagaggggaatggtgtgctttaacaggacacagacacaggaagagaagcccaagtcaggacacctctgaaggccctcatcaggaagcatatcaggatgaggtatttgggcccctgtagggagaacaggatggaggcaagaaaaccagtcggaaccatctgcaccgctgc

SEQ ID NO: 132871 - DNA, 510 bp, Homo sapiens
cctgtagggaggtgttgattgtagagacacacagcaggggctatataattccataatcaggaaacccagcaaaactggtatcacacgaaggaattgcaactattgtattagtccattctcacacatctataaagaactacctgagagtgcgtaattaataaagaaaagaggtttaattggctctgcagcctgtacaagtagcatggctggggaagcctacaatcatggcagaaggtgaaggggaagcaggcacttcttacatggctggagcaggaagaagagaataaagggggaggtgccacatacttttaaacaaccagatctcatgagaagtcactcactattatgagaacagcaagggagaaatctgcccgcatgataaaatcacctcccagcaggcccctcctccaacactggggattacaattcaacatgagatttgagggaggacacaaatccaaaccatatcacctatggtttgggttttggtagcacaacactggtacaacc

SEQ ID NO: 132872 - DNA, 244 bp, Homo sapiens
gagaatgtgtgataataacagtaacaaggtcctaaataaggaataaggcatctggaagagaccaaggaagcggcatgattgaagcaaatatcaatattgggaaatactgagaaatgaagtcagtgaggtacagtgttagcaaattacaaggttaaagaatttggattttatcctgcttaagtaggattttatttatggaggttcatgaacggtgttgacaacgatagtgaggagtttggagggg

SEQ ID NO: 132873 - DNA, 549 bp, Homo sapiens
gatttgtgaggatacagatcataaaattagagagcactacaaaggctggattctggaaatccatgagttccaggttattgaagtaaatcctctaatggtttttgagttgctaaatagcaatgcttttcatatctgacaggcagcacaggtttctttgtgcagggacacagagaggccaaatgttaaggtaggaagcaagtaatatcatggcattttcctgacctctttcatctctgcaggctctggccctaacaggcttttagggggaaattgtacattccttctggtatttaccagtattggcctacccatccttaaaccctcaaatcccgctgtataattacccctaggaggccaggggtcatttagaacaccaaatgtaggcaacacccagctattagaactcaaacttcagagctctacctaaattctggcctgaagcatactgaagatgggaggggggccccaaaggtggaggacctttgagcatggtgtttctttcttgaaataaaggtgtttagtttctgaggttggcctgggcaggctgtg

SEQ ID NO: 132874 - DNA, 252 bp, Homo sapiens
acttggaaaatgactgtcatttatatggggtgtgcagaaagtcttaaacatcagcagagattcagaaatataagagctgcaaggactttgtgcaaccatttggtccaatcttctcattatacagatggacggaggttaatagcacagagtaggaggaggaaattgagctggaaggtacagacctggttcagttattatcttcctctctctgtctctgtcgctgtctctgactctgtctctgtctctctcctt

SEQ ID NO: 132875 - DNA, 338 bp, Homo sapiens
ccaacacagggaggtcctggggaacttctgcaggcaggactttgagaacaaaaatctagagaactctcttcagaggacatacacttagcaaacctcacgtggtcactaaatcccaggtgaggaagacagggctcgaccttactagaccttaacaacactgggtgctgcatacgccacctgcccacgtcttcgatgaacacggcgaggagtgggggaacgtcaggactgcttgaaaggaagaaccagacgcaagtccttctggcttctttccccatagaggcagctgcaacgccacctcctcccgctgggctcacgctgctgtccggctcccctgggaa

SEQ ID NO: 132876 - DNA, 397 bp, Homo sapiens
ttggcaggctgaggtgagagaattgcctgagcccaggaagttgaggctacagtgagccatgactgcaccactgcactccagcctgggcaacagagtaagacactgtcttagtcaatcagtcaaggaggatcatgaccaggtgtgtctttgaaaaaaattacacatgtgctttgtggagaatggatgtgaaaggggaaaactgagggtagacaagtcagataaggtgctctttgagattctaggcaaaacatggaggtggtttggactagatggctggcagaggtagagtggaatgggtaggtcagaaccaccaaatgttactgaaccttgtctctcccaaccagagatttaattactcacattgacaaaggcaatatgtaaagaccatgccttaatg

SEQ ID NO: 132877 - DNA, 374 bp, Homo sapiens
tcttaatctaccccaaacttagactaatggtcattattatggtctctgaaacagtttagacatggagatagacagccctaaagtctatttccataccattacttccatctggcaaaatttgatggtttccttcacttactaaagttgattctcagaggtcaaaaaatgtgctcagatattcaaaaacttggtattcaaaatgcctaaatttggtaaagagacttaggattattactattttttttatttctggtgcttacaaaataaagtcttattttaaatcattgagctatctagttagtttataaatagaattcaggtggttcaaaatacattatttcatttaaaattttaggatccaacgtgttatgtac

SEQ ID NO: 132878 - DNA, 450 bp, Homo sapiens
tccaacccctgatctttttactgtctccgtagttctgccttatccagactgtctgtatagttggaattacaagtatatagcattttcagattggcttcacttgatctgcatctaatgatcctctatgtctttttatggtgagatagctcatttcttttcagtgctgaataatattccattgtctagatgtgccactgatgatttatccattcgatttactgaaagacatcttggttgtttccaagttttggcaattatggatacagctgctataaacatctgtgtggccgagcacggtggctaacgcctgtaatctcagcactttggggagctgaggcgggcagatcacctgaagtcaggagttcgagaccagcctggccaacatcgcgaaactgtgtctctactaaaaatacaaaaaatagccgggcatggtggcacacacctgtagtc

SEQ ID NO: 132879 - DNA, 149 bp, Homo sapiens
ggccaggctgctcctccctgggtgttgtttagggtcccacgtttagggctcttgttccaagaaaagagtggccccaacctagagatgcagctgtgctacctccacagctctccaaggattcacacgggactgcttatgagcgccggccc

SEQ ID NO: 132880 - DNA, 991 bp, Homo sapiens
cagggcttgccaaattgtataaaaagttaatccctttccaagtttttccttggctctgatttcatgagcagctgtaaatgtctttcttccaaagctctcttcacttcctgagtgtgttatctctttgacaaatttcagtgaactctttttcctgtctttacaattctagaaaaatgtgtagatgattaattaggaggtatctgtcagcacatccctctgaaaccattctgagcttcagctcaagcttcgtgttgcttgaaaaatgaaatgtacagctgatctgagtttgttagaaaaagatacataaattaaacttgaagaaaatagatgacaggaaagaataatgctaagagcagaagtcaatgaaatagaaaacaaaatagagaacattaataaaactggaagttttttttttgaaaaatattataaaattgataaccccctaacaagatcgataaggaggaaggtgaacataaattaccagtatcagaaatgaaaaagggagtgtcactacaaatcctactgaaatcaaaaggacagtaaaggaatacattatgaaaaactttatgccaataaatttaacaacttagatgaaatgaaaaagtttcttaaacacaatttaccaaaattgacacaaaaaataaacagaaaatcagaatgttctgccaggaacagtagctcatgcctgtaatcccagcattttgggaagccaaggatggcagatcgtttgagcctagaagttcgagaccagtgtgggcaacatggtgaaaccccatctctactaaaaatataaaaattacccgggtgtggtggtacacacctgtagtctcagctactcaggaggctgaggtgggagaagcatttgaacctgagaggcagaggttgcagtgagccgagatcacaccactgcactctagcctggtcaacacaaccagactcaaaaagaaagaaaagaaatcagaatgttcaagaaagaaagaaagaaagaaaa

SEQ ID NO: 132881 - DNA, 237 bp, Homo sapiens
ttttgtgtcatactaaaattgggaaaaaataggtatctttcccaaagatctgatgattttatgagagatttttatgagaaagctgaaatatcataaaccagctgcttaaagctcataaagcccaaaatcatttcatttcaaaaaaataatgtacatggatgtctgaaatcttcattagtgttttctccagtgccctctaatggccataagatgaaaaagcaaagaaaaatacatacc

SEQ ID NO: 132882 - DNA, 256 bp, Homo sapiens
tgttctcccagcttcaaaaactgcgctctgcccagtgcagaggcttgataaaatcttgtctattgattctcacattagccacttcccctactaaacaaagtgagtataaacttggtcctcccaccaccatccctcaaaataaatatttgccattgcaaagccaccagagaaatccacacacgcacacactgccctcactcaatccatggccccgcgtgtccttcctggctctggccttgtttagcactggcctttg

SEQ ID NO: 132883 - DNA, 900 bp, Homo sapiens
tggaattccaggatcagaaataatttctagacttttctcaaatttccattcaaatctgtgatatgatacaaacagtgaaggattgtcagcttttagtttcaggaatgttcttcacaaaccccttgatttttgaaaatgtttaaatgagagtcagattgtataagatgtagaaaaagtgctccctctgctgactttatggcaactgaactgcaagtcataacagtatgaagccagaaggagccacagctcatccagtcccctgcatttcgtgataggaaaaaaagaaaggaagcccagagatattaagtatcttcccaaggtcacagagctacctagagtcagcactagcactagtggccagctctattatatccctcagtcactcaactacttcccattgcagtatcttggaccaagtaagctgaacttgattgagcagcccccatgaagcttcgtaacaaaccatagaacaaaggaaattgaaatcaacactagaaaactatgtaggatttttcagcattgttaatttattgaactttagaaaaattatctgaatcagaataatgggaaaaacagcatttcaaatattttgagctatattttgatgccactactgtagtaatattagtttcataaccaaaaaggattaaaagtgaatcagaggataatacagtgtttttagcatgtgtataattttggtataatgagataaaaaaatcttcagagttgggccagattttacaagtcagttatttagtccaagtgcccatatggtaacatggtaagataaagttagaacagaaatgcaaaaataatattgtctatattgtatctgaaaatctgaaaaaactttattttagtcattgatttattttaatgaattaaaaggctgaagtcata

SEQ ID NO: 132884 - DNA, 362 bp, Homo sapiens
gcactatgacacaaggtgcccaacattcattcttcttagttcagtttggctatgagttctctcttggaatacctattgcatgtttctcctttcccttgtgcattttaaatttatttccataatttaacagcttcaaccacttatccctctcttcttttaaaaaaattttagggtgaagtgtttattaggaactttacataccttttcagaattgttcgtatttttatttggattgtttgggttttgttagtagtctggcgacaaggttgcacgagtggtctattccaaccatttttttccataagccctataagttttagtgtgcgggtatgcagaatgccaaggttttcagtgtttcatat

SEQ ID NO: 132885 - DNA, 549 bp, Homo sapiens
taagctttatctatcaaattaagatgtgcttggaaacgatgagaaggtacttacgtgcagcaggcattagcacctgctcatggtcacaactgtccagcagtggcctagctgtctctgcaaatggcaagcaccccttctcagaatgtgtgacggtgtgtcagccaagaatggccccccacagctagggcactgcatagcccaacaggggtggagaaggggagggccagagaaggcttgaggtcccttccggtggcaaaattcaggtggacaatgctcaggtggactcactccacttccacagatgaggaccacacctccctcacccaagcatcctggcctggaaagtttccaccattgcaaagctcacaaagaggctcagagagggtgtgcaatctgctcccagttgctcagcacagctaggaaacaggcagtgttgtacaaggacctccaggccagtctcagatggacttggaccatgcctattccctcaccccacaacaaaagctctccccaccagagagctcatggtgtgtgcgcgcctttacagtg

SEQ ID NO: 132886 - DNA, 615 bp, Homo sapiens
cctcttttctaaccccacacttttttttttttaagatcaaaataacgttgcatttgtgtgtgccctgcttttatttatttatttcttttgtagacacgaggtctcactatgttgcccaggctctctccaactactgagctcggtgatcctcccacctcggccttccaaagtgctaagattataggtgtgagacaccacacccagcccagccctgctttcacaaaaaacaaaataatgatgaatatattgtactaccctcactgttttcatttgtctgtgaatgcttcttattttatcaggaaaaggaaaaatttctgtttcttgactgtaattgttgaaatgtattttcaaagttttttactttatttttggactgataccataaaatcgtgtgaaatgatgtgaggattttctaatggagaaatgacttagaatatcccttggatgtcctatctgctttttaattgttttatcatcccagacatgtttctctattcctgtctattcttttatctgtaaaatgaggttattgaactagatgctgtctacaactttttttttttctttcattaacattaaatctctggtacctgagaacattgggatcaggctgat

SEQ ID NO: 132887 - DNA, 403 bp, Homo sapiens
gtaatggagagtgatcagatgagggaccagtcagaataaggatagtggtagagcagattagtttcagactttgtataatttgatgatatacatattcattgtagactgtattctgggaattgccgatagagaattcctacctgactaaattgcctgctgagaaatgtgtttcacattttgaattaataagctatcttcaatttttgattataagttgaacattttaaactaatgatttatgtcttttactaagttttgagacaaaactttttgtatacttctttttttgtactaagtttggactgtaaagataaactttattatacaatagaaactgaagaaaaattatgtttttaaggagcagaattgtaaggtagtttgattatgggtttagttcgctata

SEQ ID NO: 132888 - DNA, 442 bp, Homo sapiens
atatcctgagaatattctctatattctcaaagaaactggcataactttgcaggcaccttgcctaggagccctcttacttccatccacagagaaggtactactagttataagaaagaaatggcccaatccctgtactttagcacactaatggaaataaactacaaatttctgaaaggaagttatcaactcagcccttagtggccaagccaggacctaggggtataggaaatgaggcaaaatattttttatgaccagcagcctgatttgaagatcctaggaggtcaccccaggagaagtggctctaaagaggtatccagtgataattgctggcagcaaaaagggaggagaacccagcacttgctgctctgctctgagtgagccaaggaggtgctgttctcccggggcacccacttcaacagctgttgtccagtgctgcattgta

SEQ ID NO: 132889 - DNA, 494 bp, Homo sapiens
gctttattattttgcctctaatactcagacccataatcctagacttgttttttttaatggtatgaggtaaatgtctaatattactttttatcataaggatacccagttgtcccagtaccttttattgtaagctctgtcctttccactgttttgcagttccgtctgtgccataggcaagtgtctctaaatctacttctgaaccctccattccattttatttgtctatgtccatgggcaaatactgtcctaccttagatattatagctttgtaatgagtgttgctatagaaaatgccctcctaccttgttgttcttcttcataagtgtctttttaactcttgaacctttgcattacattttggaaactatttgccaagttctaaaaaagaagtcctattgagggttgtttaatattgtaatgaatgtatgaataaatttggcaagaatggagagctttgcaaaataaagaacattgtatacattttcacttactga

SEQ ID NO: 132890 - DNA, 302 bp, Homo sapiens
cccacaagaaaccaggtaacgccttcaacacttctcttgaaattctcctttactatgtaccaactttatcacttataccttctgttttccatatgactgcaggaagcaattttctaagttttctgttactacacaacaataatatttctctttccaataatatttttttcaatatttttctctttcttttaagccatcatcagcagagtccttgaagtctagattttttttactaaaagtcaatttgaagcaattttttttaatcatgcccctcaacatttttttagcctttacttttagtt

SEQ ID NO: 132891 - DNA, 374 bp, Homo sapiens
tcactgttcctcaccgtcttcacataatttttttctctctttacctggcttacactccatggttagtcattcttaccaccttcttgcatctactcctatgtctctttctcttctctctctccaatgaactcacttgcgaaaacatatatcctagggaaatccaaatctctacctatcctgcacttctacccaaccagatgaatgtgactgaagacaaaatataaccatgctgactgatttcactttaaaatcaacaagtgacctcaagtaagaccttagcaatacccaacaatgctactacatttcactagggactttctcctactttcatcaatgattacttcatacttcttctctctcctcaaatctataac

SEQ ID NO: 132892 - DNA, 457 bp, Homo sapiens
gtagctgggattacaggcgcacgtccagctaatttttgtatttttagtagagatggggtttcactgtgttgaccaggctggtctagaactcctgacctcaggtaatccacctgcctcggcctcccaaagtgctgggattacaggcgtgagccaccgtgcccagccccagctggagtctttcaaaataaccctattggatgaataaagagaaaattttccagcttagttataatacagcttgcctttggaaaaagctaatgagttttcagtcaaggattccaaatgtgtggttaaagaggagaatttgtagatgctctcttgcaggtctttactgaaaaaaatacctggtaggctattagaattagggttctgtagccctgcactttaagaattatgtatcatgttacctgtttcaagtgtgagatacctggcaggtgttggatatttatcagtgagt

SEQ ID NO: 132893 - DNA, 629 bp, Homo sapiens
agagggccagctgtataggcgtttagaagacagaagaggggaatttaatcttgggaggaagagtcaatgtgagctaggtcttaaagatgagtgggagttacccaaaaggacaagatatatggcttattgcatatatgacaagcaaaagaacttaggtaagagctggtatgtagtaagtgaggaaccatgtgcatttatagttcccgggcaaacagaaaaggtcaagaaatgaacctggagacagaggtatgggctagatcataaggcaccttgtattacgtttgagaaagcacagacttcgtcttggagggagcgaagactattgaaggattttaatcaaggaagttatctggaaataaggagacttattttggataatccaggtgagaggtgataaagacctaaaatagaagtagtagtgattagcaaagtgataagaggagagacttgaggatattggagaggcacagatatcttattgatgatttgacaagaatacagaagtataaggaggatgttcagtggattgacatcttacacatggggcattttgggggcggggaataaaagtggatgtgtttaattttctgagtagtcacttagcaggcggcatgatttttaaggtgaaa

SEQ ID NO: 132894 - DNA, 239 bp, Homo sapiens
ctagaggatcccgatgtactgctctgctgcttgtctctgtccctgattcctgtcagttctgagggctctttccacatggggttcccacggggcaggtacactagaggagctgtgggactgagggcacaggccgggccccgcccacagcgttcatcacggggaatgtgtgaggcaggaacatgggcagaagaatgaggtctcccagaaagagccaggacaggaggccccctcagcaagct

SEQ ID NO: 132895 - DNA, 454 bp, Homo sapiens
caattaggaacaaagtggctacagacatttgtgtgcaggttctgtgtggagttgcctgttcatttttcagtcttcacccatacaggtacagtccaaggagagcaggcctgggaacactgtccattctgggctgccgtaagatactccgtgggctccatttttctgaaagctccttaatacgtgtttggttctcagctaccatttctgattgtcaggtagcttttgcagatatattttcttaagcttggttactactagtgactgaaatgtaactatttcccttaaggctgccactaaaaatgagcagatttcctctgttgactccttagagtgccaaaactggctcagagaattaaacagggggagcaattcccatatagtaaatgcagcaactccttatttgtcccagaggcatggacattactttccaggactgtaaagctccagtggaaat

SEQ ID NO: 132896 - DNA, 700 bp, Homo sapiens
accccacctctactaaaaatacaaaaattagttaggcactgtggcaggcacttggtagccccagctactcaggaggctgaagcaggagaatcgcttgaacccaggaggaggagattacagtgagctgagattgtgccactgcactccagcctgggtgacagagcgagactctgtctccaaaaaaaattggcataatcatcaactaacacatgccttcagtgttattaacagcttattatcagtaattacaaacatatttgattttgttgtttttttttttaactccagagtgtctcaaaatatctttgctttatgtctaaggaaaccattttttcttctctctccccctacttctttccaactagtatatcattctccattgtgtggactcagtgctttcaagaaatatccgtattatttgttatttgacatcatcctttaaactgaagagtaaagcagtttctgaaagtagtcttcactgggaatgtatctagcagctttaatagtcaatagcgattagcctatattgctcacttgatgagctaatgattgcaggccttactagcgacagtgatcgcacttcagttatctactgttacagttacactactaaatgctgataactatcatcagctggttgccttttacttagcactgaaccagtctagttagatggtgtttaggatcctcagcttctgca

SEQ ID NO: 132897 - DNA, 603 bp, Homo sapiens
gtgggactacaggatgctagtgctagcatgaacagataataggaatacgaaaaaagacactagaaaacggtagagaaggggtctcaccatgttgcccaggctggtcttgaactcctggcctcaagtgagccttccacctcagcttcccaaaatactgggattataagtgtgaagccactgtgcctggcctttattttcagtatttctagtcagatatttgctaagcaatctctacagctcgcagaaggtaggttcaaccaggaacaacattgttggctatttgatggttttcttttacatgggactaagcattattgcctacatatagggccaagccaatctgccttggtctgagaattgaagttgctctgaacagaaggtaatggtgtcagtgtcgcctttccttctgcacttgtcttcctcctgacttttcttctttggctctggtgctacagaagggcttcctgagttaccctctttcctacatcttcagccaggcagctagacaagtcaagagcttaggatgaatctaggctttaaagaggttggaagacctgtttttccttttctctgactgacccaaaagtataagacttttttttc

SEQ ID NO: 132898 - DNA, 147 bp, Homo sapiens
tggtatgttttttaaaatgctgccatccaggttgcaacccctggagattctgattcatctcagattgggccctggcattagttttgttttcttgatggttcgttccctaggtgatcctaataggcagccagggttgaaaccacaggg

SEQ ID NO: 132899 - DNA, 636 bp, Homo sapiens
gattgcagttatttcatccaggttcccaagagcaaagtacagagatgagacagttggtgctcctggtttgttcaagaattattttctattaatgctttctttcacaacagccacaatatagggttatggtacataaagtgagggcaatgagaatgggaggagcaagatctccacagtgttctgaaggacccaccaaggggacttcatagttgtctatgtgagtgataggaaaaagatgtcaaataagacttcatggtttcttatctgaagttccagaaaaaacattgataatggttgaggctataagaacagaatagctctaagggagagagaacgtaagttatacattcttacagagatgataagttataactgaaaatggaatcttagataatgtccactgtcagtggtttgggaataggattttaaaaaaaagatcaaaatgtaagcaagaacagtaaacttactaggagagataaatgagtctagggaaagagtaagatttagttatgaggagatatattacatgaagcaatagtataaagtcaactgaagagagattcttgaattccagtaacaccaacttaattggtaacatagaattgatttaataggtgaatagagaaaagagactgt

SEQ ID NO: 132900 - DNA, 669 bp, Homo sapiens
gctgaagaatcgcttgaacctaggaggcagaggctgcagtgagccgagatcatgccaccgcactctggcctgggcaacagagtgagaccgtgtctcaaaaataaataaataaataaataaataaataaataaatagatttttaagccaggccaagtggctcacgcctgtagtctcagcacttcgggaggttgagacaggaggatcacttgagcccaggtgtcccaggctgcagtgagctatgattgtgcactccagcctgggcaacacagcaagagtttgtctctaaaaaaattaaaaataaatgaaacaagattttaaaaaacttatcaaaccagcaaaagaagtttaattataatacctaatgttgttgaatatacagggaactatgcattttcatttacttggaagtttaaattggttaaaagtttttttttttctgagaaacaccagcaatatattaaatgattttttaaaaaatcacacttttggttatgtgcagtggctcatgcctgtaatcccagcactctgggaggctgagactggaggatctcttgaggccaggagtttgagactagcctgagcaacatagcaagaccccatggctacaaaaaattaaaaagttagccaggtgtggttgtgcacacttgtagtcccaggtactcggaaga

SEQ ID NO: 132901 - DNA, 343 bp, Homo sapiens
cttaggggatggcacagagccaactggaagaacacgccactcgaatgtggctaaatacaaacatgctggtacactaaccacaagatgcaaaataacgtgaaatgaaacaaaatcaagaacacagagctaaagcagaaaaatgcgttatttttgccagtatttaggatgactttttttctagacagtatgagactcttatatacttagaaatccttaaaagataggaattagtcttttttttgtttttctgagacagagtttcgctcactgcccaggctggaatgcaatggtgtgatctcagctcacagcaacctccaactccagggttcaagtgattctcctg

SEQ ID NO: 132902 - DNA, 130 bp, Homo sapiens
tgtacatcatgaaaggatgtggcataaagtacggcattttaaaagaaaacaaaaagagaaaaataaataaaccatggaagcacaaagcttccattctagagccccaagccagatgactgactgaggttac

SEQ ID NO: 132903 - DNA, 279 bp, Homo sapiens
gttagtcgaggataaagccaaaattggaatctgggggtgttgacttcagatctttccatttccatggattcctctactggctgtccaggcatggccctctaggatccatgctgtgctatcctgtcatgcctaggctgtgtgtgtgtgtggactttcccgattagaggacccagactttgagattctcaaaggggctgtgactcgatagagcttaagaactttgtttctccctggtgactgcctggctcaagggaccaaaaggatgccgaaattagaggg

SEQ ID NO: 132904 - DNA, 683 bp, Homo sapiens
gtgatcagacatcgcctgggggatggtagaggatgaagaacccgattacatattgagggtgatcaggtgtgaaggatgaggattctggttaaagtgacttagcagggttatttctaaaactgcattttataaggaagaacacagatgggtctaggaaaaggttcaggagcctaaccaaagtttggtcatgcgaagaatatttttcaatatcaatggaagcttttcagataaggccaggattcctctttcttcctcagatagtccttataaagagcttatggactgaaacattaaggggttgaagttgtccagtaatgccaccaggaattacagtgcagttcaagcattccaagacaatggccacatggctaacagtgattgtaagacaccattagctctaaaacaaatttttattttgaaggttgttagacttcaaaccaacaaagatcaaaagagacaaagaaggccatcacataatggtaaaggggtcaattcaacaagaagaggtaactatcctaaatgtatatgcacccaataacaggaggacccagattcataaagcaagtccttagtgacctacaaagagacttagactcccacacaataataatgggagactttaacaccccaccgtcaacattagacagatcaacgagacagaaagtcaacaaggatatccagga

SEQ ID NO: 132905 - DNA, 500 bp, Homo sapiens
atgaaaggacagtgttctgtgggtccagagaaggaggatgggaatacatttggctaggaagattttttttaagttttcaagaaggtggcacctgagttgtctcagaaaggcagacatttaacagccagagtttgtggagacgggaacgcactccactcagtggcagaaaagcagggctgtgcagggaactgaggagtggcccaatccagctgaagcataaggcacatccaggaggacagcaggagaggaggctacaaaggaatcttgggccattctgcagaaggcaccagaagctgggtctgcagcacttcactcagtcagcagttggcttccctgaagaatgttttagaaggaataacatgactgaagctctgctctaggaagactcttctaaggtgtgtaggattgcttggaaaggaagagcattttgctggcagaattcacaggacttaacaattgattaagagagtgagtggtggctgggcgcggtagctcacacc

SEQ ID NO: 132906 - DNA, 191 bp, Homo sapiens
ctaggtgactctccaggatcttgatcagagcatacccctgatagagcatacccctaatgcttggtgtatataaaattatttaagaaacaaactttctagaggaggctgaatcagatgatgatttcttggaggtcccttcccagttctatgatttgagatgattctttaattttccttcactgtcatttata

SEQ ID NO: 132907 - DNA, 591 bp, Homo sapiens
gcttgaatccaggaggcggaggttgcagtgagccaagatcgtgccattgcactccagcctgggtgacaagaacaagactccgtctcaaaaaaaaaaaaaaatctttgaaactcttaatagctacaaaaatatacagattgtgcatctctccataagatacattcaccaaacttcagctcaaagctgtaagatcttctgtcaaacttgtgtggaagtacaaaagttataactgagtaacagtttttacccagttgcttttggcagacaatatcattttagtggcatatgaaaaaataatcacttggccagacacagtggctcacacctgtaatcctagcattttgggaggccgaggcaggcagatcgcttgagtctaggagtcagagaccagcctaggcaacagagcaaaaacccatctccatgaaaaatacaaaaattagccaggtgtggtggcgcacgcctgtggtcccagctatcaggaggctgaggtgggaggatcacttgagcccaagaggcaggggttgcagtgagccaagatggcgccactgcactccagcctgggcaacagaatgagaccctgtttcaactgaa

SEQ ID NO: 132908 - DNA, 464 bp, Homo sapiens
gactcgcctagcaacagtgctagagcatgtttcaaattattctgtcattttggttccttgtttgtcctcttctgatcattttggtgtttcaatcccttgaccaattggttaagctagattccctaaatctcacttccctgtgtgcacatggacacagacatcccaccctacccagcctactattctagattggtagactccagattgtcttcttgggaattctctgttccaagcctgagaaagtgtgttacagtaattttattgatcatagttatgaggcagaggaggggagttatgggaactgataactgggaccagaaaccaattgaccagcaatcaaaaacaacttttcaattatccctagaggcttctgctgtccacggtgctgtggaacacaaaagaaatattcgaagtggtctctgtcctcaaagaacttctgaagaagattgacatttactgttcaa

SEQ ID NO: 132909 - DNA, 183 bp, Homo sapiens
ttcactgggtactcttcactgtctactgtctctatcacaagcagcttcaagaaactaaggttgaggcccaatggctcatgcctctaatgtaatcccagcacgatgggagggtgaagcacgtggattgcttgagttcatgagtttttgaccaacctgagcaacatgacgaaaactcgtctctac

SEQ ID NO: 132910 - DNA, 272 bp, Homo sapiens
ttaaaaaattagtcaggtgtgatggtgtatgcctgtagtcccagctacctggaggctaagctgggaggatcgcctgagcccaggaggttaaggctatagtgagtagtgatcatgcctctgcactctggcctgggcaataaagtgagacatggtctaaaaaaaaactaagaaaaacaaaaccaaaaagaaaacaacccttcccctccagccccaaactcctccaggaggcatttaaaaaacctcactaagtagcgacactattatctatatcc

SEQ ID NO: 132911 - DNA, 705 bp, Homo sapiens
gggtattactgtatttgcaaagcatttttccattatcatttgagcctcacaatgacccctgtaagttaaccatatattttattatccctgctttaaaaactggtacaacttgaccaattgaaatctttatacttattagttagatgcattagctaggatggaaactaagttgctataacaaaagaactccaatatcagctgcttattaaaaaaattgttgagtgatatatattgacaggtcactcatggtcattttaaaactgaattctttctatcttgtttctccacttacctgtgagtatcttccttaactgcaaggttgaagcagagttgtggtcgtagccgtattctagctagcaggaaggaggagagagcctagtggaatacatgcccaaagtctggaactcagacttggaagtagtagattattctccattcatattctactgataggagcaaaatcaattggctatatttatctgcaagggaggctcagaaataaactctctaggtgactagtcatattccgaaacctactctatagtagaagaagaggagaacaaattttggtaaaatactgcattttctgctacagttcaactctctggccttccaaatatctccaaagcccctacttcccacatactcccaaaggagaggatatataaacaaactcatttacttcatctagctcaaagtctagga

SEQ ID NO: 132912 - DNA, 163 bp, Homo sapiens
acctggtcagtccccaccaaacaggaataggagaaatccaatctcagttgtatttaaggattccaccaaaccttcccactgtaacgaaccccagggatatgcagtccaagagatttgggaaggttcccggcttgtcatttttcatggttgcaattgactgttc

SEQ ID NO: 132913 - DNA, 660 bp, Homo sapiens
tgtctttatgctccctcccagccagcaagccagtcagcaggcacggggccttcctagtcatccaagctcttcaggatctttcactcttcattgtacataccaggcacttattaaatgtcaaatcaaattcctgtcaatatcagtgtcactagtagcttttcccaaatatagctgtttactcacataagctacgtggatagtcatgaaataaagacatggcctagcactgagtgctttctttttcttccttctttcttttttttcctctttcttttcttttctttttttttttttctgttggagacacagtctcactgtcttccgggctgaagtgcagtggcacgatcttggcttactgcaacctccacctcccaggttcaagcgattctcctgcctcagcctcccaagtggctgggattacaggcgtgagccaccatacccggctgatttttgtattttgatagggacggggtttcaccatgttggacaggctggtttcgaactcctgatctcaagtgatcctcctgcctcagcctcccaagtagctggaattacaggtggtccatgagttggaactttataacacaggatattatttaggcatgttcatgaattcttttgcagtctttcaggtatgttttgcttgctatattgaaaaga

SEQ ID NO: 132914 - DNA, 371 bp, Homo sapiens
tgcataaaaatattctctcattcctatgaccctctggggtgttgtgctcctcctgcctcaagtgagatgctggttaaaagctaattagattcagattttcaagcactttctgattatgagaatacagtacttccttctgtttttatcttttttaaaacgctgaatttccaaagatggaggttagctcctagtgagcaaacaccagttatcttggatacggccttcatgtatataggaaaatcagaaacttcttgtaaagtttttttaacttttgtaaattgggttcagtctatactgctcaggagatgggtgcgccaaaatctcagattaccactgaagaacttactcatgtaaccaaataccacctgttc

SEQ ID NO: 132915 - DNA, 440 bp, Homo sapiens
tgggctgtgggaggtgtggagcagggtcagagctggagggggagggcatagcctccagccaccataagttggtgtgttcttggtaattatattgcttgtcaaccgaaggcagaatcaggacaatgaaagtaatgagaatccctagctttgtaacagttagtggttatctaaaagtaggtgaaattgtacatgagtgagtggcatgaatttcttattactaaagtgctcagatagctggctaactttctgtcaaagatccctctgctaggatcaacatttgattaatatatttatcctgtaataagaatttgggattcttaaagcaaaatagttgtcatgtggctgactacacaaccaaagatggtccaggtgtcgctggaagaggagagactgaagagctgttgccaggttcccacgtggaccttcggcatgacccggcc

SEQ ID NO: 132916 - DNA, 232 bp, Homo sapiens
caccactgcactccagcctgacaagactctgtctcaaaaacccaaaaccaaaacaaaacaaaacaaaaaaacagtattaccaagatcatcttcagtgggaaaagaatgacttaggagtgcaagaacatcagataaataacagcaaaattatttttcctgctggaatttgaataacaacattttaaaattaaatactctaagtattaccattaaactttactttacacactga

SEQ ID NO: 132917 - DNA, 662 bp, Homo sapiens
gactccctgtctcaaaaggcgaaaataagaaaaccctaattctttgacacaagtaagttcactgttgttagcattgtgtaagatttagatttagacataaataacaaataattttaatagatttaatacaaagctatccttacggaaaaggtataactatgattttatccaggcaaaaatatgtgtaattttttttttgagttattctattctcttgcttggttcagtgagtagcaaaagtaaaagtaggatatttattggaattaaagagtttcaggtttttagtgcttgaatttcttttaaatatctgtctgaacatctatggtgattgggtgctatcctaccatcttttattagttttgactgagacaaggtttttcttcatattgtgtctttatcacaatttgctcctggtttgaccctttatactctataaaacaagtctatttttttttttcctgcatagctgtttgttaagtaaaaatggaagtggtattctagtggaggttttcatttcttgactaaatattctcagggtctttaaccattcctcacattgcagctccaccataaatagcttgtatgatcttggggagttacttaatctgtgcttggtttccttatctttaaaattaagaatgttggtactgggctcataaatt

SEQ ID NO: 132918 - DNA, 343 bp, Homo sapiens
gctaacagtgacaaaggctgctgagccaagcatgggagaacccagaagagactattctccagatttagcaacagggaagtcattggtggccttgatgagagctggttgggtggagcagtaggggccaaagcctggttggagctggtccaagagaggtggaggcaatgctttaaaggagttttcaagcgaaggagagagagtgtggcagtgctgttttttatgatagaagaaatacagcatatctgtgagatgattggaaagatccagtagaggggacagaattaaggatgtaggagaggaagttgcaggagtgacagccttgactgcagcccagccttgactg

SEQ ID NO: 132919 - DNA, 308 bp, Homo sapiens
tccaggaactctgacccatcccaggtagatgcaatgccattgctggggagtggctggaattcaaagccagtgggtcttatcctgtgaagctctatgaaagtggggtccacagactgatgctgctcagccccatggattcagctttcttcctaggggtgtttacagaggtccaaattcttgcattttctgagtagctttcacctttgccagagatcccggagccagagtatctaaggctcctgagattctgtttgtgcctgagtagttgctctgccaagaccatgcagctctgtgtgtcagaccaaaag

SEQ ID NO: 132920 - DNA, 187 bp, Homo sapiens
tgctgggattacaggcataaggcaccacgcctggccaggatctaaatttttgaaagtctgttcttcatttccctgaaggatagcttttcattagcaaggaggaatttctaagtggatgacatggtatttcagagtccacatatttctagatgaataatttattattatttgtgtacattttccaaga

SEQ ID NO: 132921 - DNA, 1205 bp, Homo sapiens
attaggaacaaatgctctttaagtctgtttcttcataaaacccaaagtggaagtgcctgagctgtgaatgcggccacagcgttcatgccagcttgttcccaagcctaggagaagcaagcagccccgtgacgggcacaggccacagtgtgggcgtgagctcaccccatgtgtagccgggtgctgggcccaggccgctgggtttctggggtcggcagagtgggccaggcaacaacctcacatgcctacctcactgccactcgtccgcctcgtccactcctggcatttgggataaacatcctgtctcagacacacccttctcgtgcgcccatgccacctgctcaggcctatgccgcccgcccgtcctcccaagcgtgcacacccgtccgccatccttctcccgtctgtgccccatgggacagaggcctccagctgcaccaccactgctcgttaacagctgccatccacaccgaggaagcctcttcgagcccagggagtggaggatggggctctgctgtgcacgtgctccctcaggccctcccagcagtggtagatggggctctgctctgtccttcttggtcatcttcctgggcctgcaacaaagctcagcccagcagccaggcagctccttacagaggctaacgccgggtctggtccctggtgaccgcaggctgctgtgagaacttgtgacccccgagatcagaacagccttcgggtcccagagcttcccgcatgatcgtgtgtggaacagaccgggagattccagcagatatgggttcaacgttgaccaccaaccttgacaacccaagggctgcctcccctgaccatgacagccaactcctcctccacagtggctctgccaggcgccgagtccataaagggcagccactgtttggcaaggagggccggtctgccgggggctcccaggccctggggtcaggctgagagaggaagatgggtgtgagggtgcaggggcaggggggcgggccctgcagggcagtgcctggcccgtcctgcacccccagcctgggaacccccggctttctcgcttgggcctctggggagcccgcgtccccaaatgtagccacatcagagcacacttctccggcagcaacttcccaggcatgtccgtggcctcctcgggggcaggcgccccctcctggacgctgagctgacctctctagcaggactctgctcatctgcaccat

SEQ ID NO: 132922 - DNA, 735 bp, Homo sapiens
  misc_feature (722)..(722): n is a, c, g, or t
  misc_feature (726)..(726): n is a, c, g, or t
gaaaatacaaagcagaaaagttgggccaggcatggtgactcattcctgtaatcccagcaccttggaaggccaaggcaggcagatcaacttgaggtcaggagttcgaaaccaacctggccaacgtggtgaaactccacctctactaaaaatacaaaaattagctggtcttaaactcctgacctcaggtgatccgcccaccttggtctcccaaagtactgggattacaggcatgagccactgcctgaccagaagtgttctaatgtaactttttgaatgctctttttctcactgatttggagtgttacttttacacactgtatgttacagaggttttttttgttcgtttgttttttgaaacagagtctaactttgtcacccaggctggagggcagtggcacgatctcagctcactgcaaactccgcctcccagattcaagtgattctcctgcctcagcatcccgagtaactgggattacaggcggccaccaccacacccagctaatttttgtatttttagtagagacagggcttcaccatgttggccaggatggtctcaatctcttgacctcgtgatctgtccaccatggcctcccaaagtgctgggattacgggtgtgagccactgcgcccggcctcttacatgtatttttcttccatgtgctcttttatagtttaaaaatcggtgtatctctttaacccttctggaagtttggcttttttgtntgtnttggtgtgt

SEQ ID NO: 132923 - DNA, 149 bp, Homo sapiens
ggagctctccgaaaatccatctaggaaggaagaggcctgggaaagaatgtctcgaagggaaacatgaacaggtcagcagcggggtcttgctgaccgcctggccaactgtggggcagagggcggagtggggagggtgtggcaaggccaga

SEQ ID NO: 132924 - DNA, 109 bp, Homo sapiens
atttactgcaaatttatcatggcccactgaactatcagctaagtagatttttcaaaatagagagctgtaagcacaaaggtaacaataaaaaccacaaaaaataaaagct

SEQ ID NO: 132925 - DNA, 498 bp, Homo sapiens
tgggtctttgaggttccctggctggtcgaggtctcactcctgccccggttttcatgtggccaccttccctccatgcttgtctgtccctgtgtctgaatttcccctttgtgtgacaccaggcttcttgggttaggacccagactcatgacttcatttcaactccattccctctataaataccctgtctctaaatgaggccacatctacggtactaggggtcaggcatgaacgtatctttttaggaaaaatcaattcattcccaatacctgagaactcgtcttttgcatccttgtaatagtattccccttttatttgaggagtgagagtgggtttctttgcttgtaaccggtgggtctccaccgcagtggtttgtgggtgctcacttccatgtgagtgaggagccggggggccctggggtgtgctcccacgggctgtgtctgtccgcaccgcacaacaggtgacggccaaagctgtgggcagaaagtagagaactggatg

SEQ ID NO: 132926 - DNA, 564 bp, Homo sapiens
ggtttatgcagaaagcatgtggtctctgttaactcttattattatccctattatggagggttagatttctgaaaactcagtaaacaccgacaatgtgacacaactactaaaaagttagtgcaggccaggcgcggtggctcacgcctgtaatcccagcactttgggaggccgaggcgggcggatcacgaggtcaggagatggagaccatcctggctaacacggtgaaaccccgtctctactaaaaatacaaaaaattaaccgggcgaggtggcgggcgcctgtagtcccagctactcgggaggctgaggcaggagaatggcgtgaacccgtggggcggagcctgcagtgagccgagatcacagcgagactccgtctcaaaaggaaaaaaaaaaaaaaaaaaaatggtagtgtaggcttaagcccaacagatatgaagacccaggtcataagaagaatgatccaactggactcttcactggcagttccagagaactttgcaatgagatgtaacagcctgagaaatcttaggtacagaatttactattttatcattgcctaccacca

SEQ ID NO: 132927 - DNA, 421 bp, Homo sapiens
gttgagttatttgcatctcacaagacagtatatactttataatttatttctgaatggtactttaaaaatatgtagttcatttcctgggttttttttactcttttttaggaagaaagtttttaaatttttttatgtttgcaagggggttgaaaagaaatatcttttttctagcagaaccattttctttattgcagttctttccattgtgatttgttttcctgggaaaatgaaggaaaaaagagaaaaattaatttgcaaattagtaattgcattaatgaatctgtaaagaacagattatataatattgttggagtgataagtattaaggattgccaaaaactgcaagtacatgatatagtaagataatagaattgagagttttagatctggaaggtgggatgaggatagagatgagagttgg

SEQ ID NO: 132928 - DNA, 534 bp, Homo sapiens
caagtgaaacggatttccccttatcaaaccatcaaatctcatgagacttattcactaccatgagaacagtataggagagaccgcccccatgattcaattatctccaactgggtccctcccacaacatgtgggaattatgggagtacaactcaagatgagagttgggtgggggacacagagccaaaccatatcaaggagttagttggaagtgaatgagaggcatgggaatggagtgatatagcgcctggtgatggattctaggctgagatatgtggaccaaaaggacaggaaaaggtaaggggtggtgaaagggtgatgggatcaatgtgttgtaagtcttggtggagttaaatgattgatggagaaatgaatattagagagagtaagctggaaactcagggggtggtggacagagtgtgacacgtgaaattgtgattatggaggagttgcagttattggcaatgacaaagcttttggattcttacctgatctcctgctctcacttttcaaaggcctgggttccttttcttcagt

SEQ ID NO: 132929 - DNA, 770 bp, Homo sapiens
gatatttgatgcacatacattcagtggctgtgtaccatgcattctgttctgtatcattatgttatatgatcatattcaactgaatactttcattttctcatttgtgaaaggcataaagggaataggaataactaacaaaaggatttaatttactcagaaaaaaaaattatgcatgaacagaagacagtttgaggagctcctagagaaaaatatatattccatagcccagaatggcatcacacatggggtcattaggaattcaacagtgtgatctgagactccccagccccagttccagacagttcttaatgttgtcttcctgcagttatccctcagttgtaaaggtgtctggtctgtatttgctttgaaaccttcagaagccgctggcctggtctgtgctctggactctccccatctctcttggcgtctgctttgtgttttgcttggcttgagtgcagctcctgagccgtgggtcattacagtctaggtcccggaggctcatttggagtcagcctctattttttattccacattatcatgacctgtgctaaaccacagggaccctagagcaagaattactgagaaggaaaggtaattcagtggcaagacacatctctaagccatttggagtgtttaaagtttctcataattgctccaccaactgaattcagctattcccgggaatagcattcacagtaggtcactgaagactagcgcaacatcatttgcttataatcagcataagctcctctactcttgtagtcagcatc

SEQ ID NO: 132930 - DNA, 326 bp, Homo sapiens
aaatatactttgatctcgtttcatgtggaatcttaaaaatatgtggaaggttttcagtggtagctgttactgtaaatttttgaacttcaggttaatgttagcttaatgttcattagcaaaacacaaaattagaggagtaaatatggcaatgtttcccctatacagataataacttgttggacatgtgtaatgtatagcaaggaattggggcctgggaaggtgggaattaatatttgctaggttttctcagttattcgtattatactttcatctatttataaaccagaatgtgtttatagatgatactgaggctcaggtggacactt

SEQ ID NO: 132931 - DNA, 534 bp, Homo sapiens
taccaagaaagggatccctgtatttctgtctgtttagagacaagaagatactatgttcattgctatgaatgcttgattcttaccctttgtccatagaggtgtgtatgtcattaatccttattaagctcattagtgatgctcttttgcaaacagattctctcaaatatagaaggcttaaggaaagtgggtgtaaagaccctcaggtggatgccaaagtgctacagagaccatgaaataataaaactacgtttcctttaaaatagttattttccttctactcactcccccctattcatttattttacaaatatttgagtttgctttatttccatgtgtcagttttaaacatggtgggcaatgcagatgagcaagacctagtccatgctttcagggacctgtttatgctcagaagaaatgggatacaaaataactacattaagaagaagaaatggatgtgggcactaggagggataaattgtttctcgaacatagaagaggaaaaaatgccttcaatttggacccaggaggatgtta

SEQ ID NO: 132932 - DNA, 735 bp, Homo sapiens
ggacagtggttaaggaaataggctgtggagttgccctgcctgggttcaaagccctgccctgccatttattagctgggagaccctgtaatcccagcacttagggaggctgaggtgggtggatcatgaggtcaggagagcgagacaatcctggctaacacagtgaagccctgtctctactaaaaatacaaaaaattagctgggtgcgatggcaggcacctgtagtcccagctactcaggaggctgaagcaggagaatcgcttgaacccaggaggtagaggttgcagtgagccaggattgcgccaccacactccagcctgggcgacagagtgagactccatctcaaaaaaaagaaaagaaaagaaaagaaactgtgtgtctgaggatggtgtaagaggaggtatcagagggacagaccaggggcctggagtttagaacggacatgtcctggctgggcacggtggctcaagcctgtaatcccagcactttgggaggccaaggcgggtggatcataaggtcaggagatggagaccatcctggctaacatggtgaaatcccatctctattaaaaatacaaaaacttagccaggcatcaggcatggtggcaggcgcctgtagtcccagctactcaggaggctgaggcaggagaatggcgtgaacccgggaggcggagcttgcagtgagccgagatcacgccactgcactccagcctgggtgacagagcaagactctgtctcc

SEQ ID NO: 132933 - DNA, 288 bp, Homo sapiens
agtgctgggattaccaggcatgagccatctacgcccagccactagtcagtctcttatcctagtgatacttttcttggcgcgagtgtcaacagaattaaaaataatctgtagtgcgcttgggaacattactagtgagtcaccagatattgcttttaataacaaaaaattggaaaacaacataatgtataataatagtagctaatatgtattgagtgtttagcatgtgccaggcactgttgtaagtgctttacatggattacagtactgtttttatattttacagctgag

SEQ ID NO: 132934 - DNA, 829 bp, Homo sapiens
cgcggtggctcacgcctgtaatcccagcatttgggaggccaaggcaggtggatcacctgaggtcggaagttcgagaccagcctgaccaacgtgcagaaaccctgtctctactaaagatacaaaattagccaggtgtggtggcacgttcttaagagaatatcaaaatacttttccagagacacaaagcattgtctcatctgggaaaacaggaagacggaaactcggagaagttaaatacttaactgagatacccagaagttcagctgccaaccaggcaaggcatctgagaaggctgttccatgagtctggcttctgtcagttacagatatttcatccaagttatgttatatctgtgttactttgtcaagtaaaatggcacactccctcagttatagtctttttaatttattttttttgtgacagtctcactctgttgtccaggctggagtgcaaagactccatctcagaacaaaaaaaaacaacgtgaaaggaaaaagaagggacaaaggaaacacggccctgaaccccacaaaggacgagagaacaccccaggaacttgggcgaccttaataaaaggcaccgaaacatcacctccgggccagtggtacaacttgaggccaccaactgtgtaaggtagcggcaggcattagggggtcaaggcctatatcccagacagtggggagggcaacaagtgattcgacttgacggcccaggatgtgggaaccacgagggggcaacaaaaggaagaacgggtcccaccagacaaggttaaacgtagcaggccagggaggtcgcccagaaccacctaacagaggtgaacgagccacgg

SEQ ID NO: 132935 - DNA, 772 bp, Homo sapiens
gctctgttgcccaggctggagtgcagtggcgcgatctctgctcactgcaacctctgcctcctgggttcaagcaattcttctgcctcagcctaccaagtagctgagactacaggcgcttgccacgaagcccaggaaatttttgtatttttagtagagatggggtttcaccatattggccaggctggtcttgaactcctgacctcaagtgatccacctgcctcagcctcctaaagtgctaggattagagccatgagccgctgcacgcagccgaaactttcttttttaaaccagataattctttatttcatttcaaaaatcagaggcaatctacacaacaaaatggaactgcctcactcccccagtagaagggagtaggggcttgggctccctttcacctggagagcagcctggagggtatcaggaggaagccatttgaaacgcagcaacagaggctcctgacagtgcctcacctgatggcgtttggactgaggagacagagttaaattgtaaaaagtgatttatttctatgtcagaatgttgggcaagatatcatttatatagatatcatttaattgtaaccaattcatgaaggtttgagtcactgccattgaaaatttgaaatgatctccacagccacagacatgtgcccacttttgtcttccttcaaaccattgcaaatttcttgattacctacaatctgaaagcaacattgtttttattctgaccatgtctcctaaaaatattttgttggttttaattttctcaaaggttt

SEQ ID NO: 132936 - DNA, 165 bp, Homo sapiens
aactgaaattttatagatcactttctatgacaaaaatggaattagagtataaaacaataatataaataattgataaatttaaaaatatttagaaatgatacaacacagtattaagcatgcacttgttgaaataactggctgggtgcggtggctcaggcctgtaat

SEQ ID NO: 132937 - DNA, 653 bp, Homo sapiens
gtaagcatgataatagaggccaactccatttgttttgtttcactggatctggattggctttctattccaacctgggataattacattcccttctttgggaatttagggagaaattatctttcttggtgcccatttgtgcttggaagttgtgtatggcattcttctactcaccacatggattgctcagcagacaaagttggtcttcagaaaaaaaaaataataataaggccaataagcagaaagaagtagccagacaaaaagaaaataatccctgggttctcaatgaccttgaaatagctgattccaattctttccaacatccggttctattggtcttcataagggactcttgtattaatatttttttctttattgcttaaactattttaggttgttttatgttatttgcaactaaagttaccatctcctaccactggaaatgtttattgctcccacagactaccactggaaatgtttattgctcccacagactaccaagcaataatgctgtactagaagcatttccatttgcaaaccataagatgtagagcgagtataatttgtcctcatgcccactgccagattacattattaacaaaaaggcaatgaaaatgtacatatttacctgatgaataacagacacagttggaaag

SEQ ID NO: 132938 - DNA, 923 bp, Homo sapiens
tcaccaggtggtacttttatttgaattcttcagttgtacagagttgcaggaggttccctggggttaggtggagtcattgctcaggaaggatgggattatctggtgcttcagtagaaatgtatgcttgaggtttgcgtctttgcctaaccagggccttagggtatggctttgaggttaagctgagtgctgtttgaagttttgggtgttgcagaactagctcttgctctttaccaaaatgtgtagtcgtggggagctctctccccaggtggagccttcaagtagagcctaaggctgggcctggaagatggctgttgggattcaagccaggcacaacttttcaccacttgggagtgaccatcttggctttgcaggtgtgctatgctgtttgctggtacctctcactgggggctgccactggaagatacacagagatatcaccagtatctgctgtgggccctgtctccttgctttgtttctaactgactccagctggtctcgccatgccgctacctcgagcattctttatgaagtgagactgaggtgggcttcctgggaaggcatctcagaatgctagagaagctagatgtctgcttctggttctccctgcccactgcagaaaccatgggccctgaggcatcctctctgtgtggcaccatgctgaatgaaaggatggagggagaagcagtgtggtcaaagtgagaccatttctcctacccttccaatgcagacttcattcatttctgtagtctaggcaggtctctcaggcttattcccaagttttggggttttgacccacatgttcctgtctgtagataattgctagttgaaatttctgtgggtgatagtaaagcctggggccacctgttccactatttttgcccacttctctttatttacaatttatctttccccttgtttagacc

SEQ ID NO: 132939 - DNA, 942 bp, Homo sapiens
gtgactctgaggacccgatagagcataccctagtatagctagtaaacttctgttgtacagagttgcaggaggttccctggggttaggtggagtcattgctcaggaaggatgggattatctggtgcttcagtagaaatgtatgcttgaggtttgcgtctttgcctaaccagggccttagggtatggctttgaggttaagctgagtgctgtttgaagttttgggtgttgcagaactagctcttgctctttaccaaaatgtgtagtcgtggggagctctctccccaggtggagccttcaagtagagcctaaggctgggcctggaagatggctgttgggattcaagccaggcacaacttttcaccacttgggagtgaccatcttggctttgcaggtgtgctatgctgtttgctggtacctctcactgggggctgccactggaagatacacagagatatcaccagtatctgctgtgggccctgtctccttgctttgtttctaactgactccagctggtctcgccatgccgctacctcgagcattctttatgaagtgagactgaggtgggcttcctgggaaggcatctcagaatgctagagaagctagatgtctgcttctggttctccctgcccactgcagaaaccatgggccctgaggcatcctctctgtgtggcaccatgctgaatgaaaggatggagggagaagcagtgtggtcaaagtgagaccatttctcctacccttccaatgcagacttcattcatttctgtagtctaggcaggtctctcaggcttattcccaagttttggggttttgacccacatgttcctgtctgtagataattgctagttgaaatttctgtgggtgatagtaaagcctggggccacctgttccactatttttgcccacttctctttatttacaatttatctttccccttgtttagacc

SEQ ID NO: 132940 - DNA, 476 bp, Homo sapiens
ggattattttaaataaccaaaaggctacggccaggagaaagcgatcccatctaccttttttttctattgcagcgtaattgccgcgttcaatcaatttccctggcattacaaatttcatcacaatcaacattaatctttattcattgtgatggctaagaaccgggccatttctcctctttttcttaactggcaaaattaatcagggaaaagattttaaacatttacccgtgcgaaagaggtcagccctgccactatattgctcagcagataagggggctaataaaaagaaaattgaattactaatgatcaccaagaacagagtatataaaacctggccatcgccagttcaggaaaagggagaatcaattttcttgggacaaggtgcgttcattttttattttggcgcatattatcagcaatttaatttgagaggcataaacaggaggaaacagggaataatgagcctggaggtgtaa

SEQ ID NO: 132941 - DNA, 674 bp, Homo sapiens
aagctctgcagggtccatgctgtgtagcaaggcaaggccagacattggggaaggtacccaggggcacaatttggaaagcaggtttgaaatctagttttgaaatcatgccatactaaactatctttagggggttattacatgctcacctatttcagtgtttaggtgtattagagtgcatctaggtgtattcctctttgcaaagatgtaaaatgcaaaatctgaatacatttagattcaaaaattccagcctagtattatatctgaatcaataaagagtaaagtatccaagaggaaaaacacaaaacaacacacaaaaaaaaaaaaaaatgtgttgtgggcgcgcgcctcttgcggccccttgagaaagagcttttcttgaacacattgcggttgtgggcgcggcgggggcccccgttggggttagtgtgtgaaccctgtggccaagaggcggttcccccagaggagaagactccgggggcccaggagacaagggcgtcgggggttctctccccaaataaaaaaaaccgccgggcggggacaacccgagaggcgttccgtagaaacaaatctccaaagggagaggcccagaaggcgccaataaccggggagcccttatccacaacggggggtccaagagagagaccgagaaataaattaagccccgccgggggatg

SEQ ID NO: 132942 - DNA, 992 bp, Homo sapiens
cctctgacactgatagatctgagggcctgtcaccctggcccaggtcaccagggaatagtcccttaggggatgagtttccgggcatgttcacttatgattatgacacagctcttcaatccaaggcagcagaatggcattgctcacttagagacttagaattttcaaatgtggacgttttacagcaaacaccaccatgttctgctgaagttccctcagatcctgataaggctgccttccatgaaagagactcagacattttaaaataagaatctttcattaaggaaatattcacagctctaaacaatattcttttaaagatcatggcaggggaaaactaaagccttcacaacaagatcctgaaggagacaacatgaattccaaccaagtggacactgatgcaaatgagggttttgtgggcccacttgagggcgatgattctagaagggttataagctaaacacacttgttaacatcctatggggatgaacctgctcttcagtgtgaaagagaaagaggggaatattttgagatcattccaagaaccatgcaccattattacaagagctccaaacaaaaccagttcactgagaacacaggagcacttcatcaataggttggggtaaatattcagaagagaatctgttgcagttaaacgaagtggttctaactttccttctcaaatacagacctggagcaatctgatgggatttggctctctgaaaagaacagctttaggatgacaaagacaaggatgttcaacttgatcatcaaagagaattcaaatgacattttttcatacatattgaagcacttaagtggaaatgctggatagattttaatgaattctgaacacacactagcacaactttttggaggctgatcgtgaaactgcaaaattggaaaagttctgagtaaatataaatgtttttaaataagttatgttaaaagagaagaggggccactttttagaataaagtgtaaattaaaaatca

SEQ ID NO: 132943 - DNA, 422 bp, Homo sapiens
actaggctaaacattattccttgccgtcacaaaataaaatcttgattgcttctctgtgagattatatttcagatgttgaaaagctgttatatctgcttgtgtctcctctcctactggctagcatccccagttctgtgcctattccttacataatattttagacttcatggtctctgcttaaacgtgctcctccaaattcacaaggcccaggactgaataacctaggtgagaaatgaccaagcatggtacagaatgactgaggctctaaccaccgtacacggaaatgctgtgtctttgttaatgaaagctttcttggggtgcaggcggggaagctttcttgggagcaccatatgctgactctcacaataagtatgtgaccaagggtctatacatttcctactgccatgttcccatactgtgca

SEQ ID NO: 132944 - DNA, 445 bp, Homo sapiens
taatgatcccactgagttgagccagagaccatggctcaaggaggcaaaagcagctagaatttgcagggcagagtcctggaaggaacagaggtatgcaaataaaaacaaaacaataacttgcatagaagtcccctccttgattctttggttgaataatctgaatatatacaacatgaaaccccatgaggccaggcaagaataacttaccatgaaagaatagtagggatctgtaggatgaacatttccttgagctcatgatgagaaagaattcacattccctctagctagagtgtagaggcattatcaactataaggggcatttagtagggaacctagaatgaccacacattagaagtacggctaaattaattctagaacaaaggctacttgatcaaccatccaaaagttcctgaaaaggcaaaacactctaaagaaaacaatccaa

SEQ ID NO: 132945 - DNA, 435 bp, Homo sapiens
cacccaggcgccttctgggcagagccgtggagagttggacgtaggccaggtgtgaggaggagaggtgtgtttggggtggccactggctcccttcctgcgtgacgtaggctggcgtgggctcttcccccagccccttgccggtgctgctacgtgagaagtgcgcctgggtgcgcacccaggcgtgcttctgggagtgctcaccccaagtctgaattagacgcaactactctctactctcctggagaaaacatactcgtaataccacttcaaacacaagctggtggtgtacttgcccagttctaccaatgaactgggatgacacaaaagtaatgaacagatgaagtttcatatcccccgtccccaagagaggatctggtgtcgtctatttagcttccttgcctctcctgtgctctctgaggactgagagattaaaag

SEQ ID NO: 132946 - DNA, 407 bp, Homo sapiens
cactccactccatggggccagttaaggtcccaatctttcccctggtcctttctgcctagaatagtcttcccttggagatgcacaaggctactttaatgcctcctttcaggctattactcaaatgtgacattctcattgacatcatccctgacaaccattttttaaattgtactcttctacaccctggcaatcctgatttaagcagatttattttcttcttactgtaaacaaaaataaaattctaagacccacccccaactatttgaatagacctctcctcttggccaagggcattccaaaattaacctgaaaaactagttcaggccatgacgggaagcagggttcgaacatgcctcattagttcttcctcccttttggaattcaggaagagccaaccagaattaaca

SEQ ID NO: 132947 - DNA, 394 bp, Homo sapiens
cagcattttacccatgataaaactttcaaaattggagtccatcctctgtaactctgttactgctttatcaactaagtttatgtaatattcagaaattactttctttgcccatctattacaaatagtttctcatccactcaagttttatcatgaaattgcagcagtgtagtcacatcttcaggctccatgtgtaattccagttttcctgctgtttccaccacatctgcaattatttcctccactgaaatattgaaccccccaaagtcatccatgagggttggaatccacttattgcaaactcctgataatgttgctaatttgccctcccatcagtcggaaacgttcttaatggcatctagaatgaattatttccagaagattctcaatttacttt

SEQ ID NO: 132948 - DNA, 587 bp, Homo sapiens
tgcagctagagaaaagcagttaagagttggactacctgggtttaaattctagtactatcacttactagttaaatgacttttgtaaatttaacctgcccttgcctgaggtccctcacttacaaagtgataataatcacaatacctacctcatatgctattgtgaagattacataagtcagtatttgtaaattacttagaaccatccttttattgcaataatgaaagttccttaaagttactgtcttgcatgctgatgcacacactgtaattttctagccctatatagaagccaaattccaaacaatagactaggacttgagactcaaactggacaaaaattgtttcaggaaaatattagtcctaaattaaacttatatccaaagtgtaaagagcagcagaatgacagagtgactttttttttttttttttggagacagagtcccactctattgcccaggctggagtgcagtggagcgatcttggctctctgcaacctgtgtctcccaggttcaaacgattctcctgcctcagcctctcgagtagctgggactacagacatgcaccatcacccctggctaatttttgta

SEQ ID NO: 132949 - DNA, 363 bp, Homo sapiens
catgagcagctttgagagttggctgtataaatgattaatagcaataatggattcttagggttaatatgcagcaggccgactgacttctgcagctatggtcagcctaactccagatggctctctgcagagggtgggaggaatttcccactaagaagatggataggtgaggaatttggaaatctccagatcatagaccatggtggtagataggataatagcctcccaaagatgcccttgtcctaatccccagaacctgtgaagatgttaccttatattgcaaaagagactgttgagtcagggttttccagagagacagaactgacatgataactatttagggagagagacgagaaggaatttatc

SEQ ID NO: 132950 - DNA, 863 bp, Homo sapiens
gtggggggaagaatagccttttcaacaaatggtgctgggtaaaagtaggtagactctacttcatcagaatattgtgcttcagaagacatcaagaaattgaaggctggccgggcatggtggtgttcatagctaatcatcagttacagattccttggttccttccccactcccactgcttcactcgtgatccacccacctcagcaagtgctgggattacaggcgtgtgagccaccacgcccggcatgaaatatttttacttaaaaattgggaataagcttttggtttttgtgggttttgtttggtttgtgtgtttttttttttggaggagggagtctggctccctgtggtgcagggctgggagtcgcagggcgcgcaggtcttgggctcatggggagccttccacctccgggggttcaacgcaattctcccttcttcagcctcccagagtaggtggggatttacagggcttgcaccaccacaccgtgggtaagttttggtgtttaggtaagaggcggggtcgctatgtggcgcgggggggttcaaactctgacctcagtggatccacccgcttaggctcccaagggcttggatacgggcgtgaaccagcgggtccgccagaatagcttggacttcccattccgatgggtgcaccgtgcggctgccttggggagaaggagtcgccctgttcccaggcgggacgaaggcgtgttcacgacctgtgccgtgttttagagatccggtccccccacgttggatttgtgtgcgcggcccggccaaggttgtttttgtaacccatgttgttctgcgggtaccaaattgcggggcggcacggatctgtaatgtgtcccaccagcgttgtctca

SEQ ID NO: 132951 - DNA, 396 bp, Homo sapiens
tcccttctccttctgccatgactgtaagtttcctgagtcctcccagtgatgcttcctgttaagtctgtggacctgtgagtcagttaaacctgttttcttcataaatcacccactctcatttagttctttatagcagcgtgagaacagactaatataagctcctatattttgtattttcatgaattgtgaacttcacttaactgatgtagtaggttgctatggaagagactgtaggatgtttctaaaacccctaagggcacagctcttcctctgtggtacacaactagcctatattttctaggcttccttgttgttaggaaagccttgtgactggttctagcccacataatataagtagaagtgatgagtgtaacttttaggcttggcccataaaga

SEQ ID NO: 132952 - DNA, 339 bp, Homo sapiens
gttatggccatagaagagcctctggccctcactcagagcctattgacctttacattacacatgtatgttatccggttctgtgttttcttggttgttcgaaaataaatgtgagaagatgtgctagacaggactagtgatggccacaggtggaaataaactttgaaaagacaaacgatctcaagaagtgtggctggctgggacaaacccagttctgaagaacctcacgaccctatggatttctgaataacgattttctaaaacattcctggcattgtttggactctgggcactgtttggactctgggcactgtttggactctgagcactgtttggactctg

SEQ ID NO: 132953 - DNA, 1023 bp, Homo sapiens
agcgtctgtccttgccaggaaaggcattccaaaggcagagagcatgccaagtaaaaaggctttgcttcaggattatggagacagttctgaaaagccagcataacttaatgatcaatcagaaaaatatagagcaaaaaaaaaaaaaaaaaaaaaaaaaaaaaaaaaaaaaaaaaaaaaaaaaaaataaaaaaaataaaaaaaaaaaaaaagaaaaaagagacgaggggactgagaaaagttgttctcgttgaggggacgaataatgtactaccgacgcccaagatttttgaagaagaaggcgcccccttttgtgagactgatattaatttaataaaagaggcgtcgctattataaaacaatcgattgctaggaggacaacaatcatcatgggagacaatattgtagaacagacaacacagcttggtgggggacacaacatatattggcacacacatcactagccattgatataaaggagccatgaagataagtttaatacgacgcgacagagtaagggtagaaccacctgcactaatattctatacaccgaaaacaaaccttggacaccagagaaaatcttgttacgaacaccatttatacaccgcagcgcctactgtagatcacgacgatgcaaacatacagactagcaatctatatagcacaagaggtcacatacaggatgacatagggaaataaaaacagactgaaggtcagagaaaaaaggacacagaagaataacgcagagacgaagactggaaacacggtgaaaaaaagcagaagggaatcaaagacggaccaaccaagaaagaggaaaagcagaatgcaagaagccaagaacaagcaggagggcacaagagagaccaagaacacagcagcagagcaacgacaaatagaagagcatcaaagcaccgcaacagcaatggacagaaagagaaagagacaaatcagaaaaagaagacaaaagagccgacagcccgagtaagaaaaagcgaacacgatagatagaggacgatgaacaagaca

SEQ ID NO: 132954 - DNA, 313 bp, Homo sapiens
aatacatgcagagagagggaaaaaatgagacagaaaagctgagaaccatatactggggacatctagcttactaaggtttttcttctgcatgaggtcctagaagaagttttgtcaaactgtctttgatcacaaacttttcacatagtattagaaagatattccttcagtatgaagtacgtttgaaacattacaggtacaagatgtgaaatccagactagaagtgccactggaggtcacaatgggggacattgcctttggaaagtaggctgtgaattagtgtggcttattccaagtcagatgaccaatgagtggg

SEQ ID NO: 132955 - DNA, 301 bp, Homo sapiens
attttccatttaatattttcagagcacaactgaccatgggtaaccacaaaaagcaaaactacaaataaaggggggactactgtaactgggagaagattcttagatttaataaaaatacaggctaaactataggctagctaatttgcaggaaagaataggagtggagaatagacttcactaaaagaacacagcagtcactaaacaaataaacaggcaaataacaatgacaagatatgggggcacagtacccagagttgctataatatataatctaaaatatctagtttccaacaaaaaatta

SEQ ID NO: 132956 - DNA, 252 bp, Homo sapiens
tactacaaaattataaaagtttttcccccatttgcctcccaccagatgacacaagagttggtattttctgtcttcatggaccacacgcgaaatcagaccaacttctaataactgttgtttcctaaatgaaccagcaaggcaccatctgaactgtgattttcttttaaacaggtgtattcatgtgggctacatatatgcataatatgtaggagagaacggaaagaagagaaaagccaaaagatacacgcatgg

SEQ ID NO: 132957 - DNA, 300 bp, Homo sapiens
gtagccaaaacgtggcaggcccacatgacttgttacctttctcttcctttgggtacattctttgccctcctgggaggctcctcccttaccccttcctaggagttggtgcattcatttatttattcattctctctcccacatcattcagtattagaaggcctgtccaagataccagatctccaggggtaggtatgcagatagtccctcctaattcccctccaccctcaataccctgcctacccagtgagaataggttaatacattgatgaggcacatagtgagtctgattcttgtcttttt

SEQ ID NO: 132958 - DNA, 852 bp, Homo sapiens
ggggtttaggtggctcacaaatcttcatgctttacaaggaacacggtaccagcatttgcttctggtaaaaggctcagactgcttccacttgtggtggaaggtgaaagggagctgatatgcacagagatcatgtagcaaaaaataggacacgagagagagggaagtaccagtctctttttaacagcaggatctcgaggatatttttatggaaattaatacagaactcaatcattaccgtgaggatggcaccaagacattcataagggatctgcccccatgatcctcacgcttcctcttaggcccacctccatcattgtgaatcagatgtcaacgtgctttctaaactatagtagactccatccagtacattaatagttcagcacttcaacatcacactctcactgttgcacagatcatctagacagtcaataaagaaacattggatataaactgtacattagaccaaataggcccaacagacatttacaaaacattttatcccacagctacagaatacatatttttctcatcagaatattattacttttccaggacagaccagatgttaggccacataaaaaaaatcaactaatttttaaaaattggcatcatatcaagcatcttctcatgccacaatggaatacaactagaaatcaatgacaagaggatctttggaaactgtacaagtacatggaaataaaacaacatgctcttggtcaaccatttactcaataaattaaggcagggcatggtggctcgtgcctgtaatctcagcactttgggattgagctgcagtgaaccatgattgcaccattgtactgcagcctgggcagcaaagcaaaagctggtctc

SEQ ID NO: 132959 - DNA, 798 bp, Homo sapiens
ggggtttaggtggctcacaaatcttcatgctttacaaggaacacggtaccagcatttgcttctggtacagagatcatgtagcaaaaaataggacacgagagagagggaagtaccagtctctttttaacagcaggatctcgaggatatttttatggaaattaatacagaactcaatcattaccgtgaggatggcaccaagacattcataagggatctgcccccatgatcctcacgcttcctcttaggcccacctccatcattgtgaatcagatgtcaacgtgctttctaaactatagtagactccatccagtacattaatagttcagcacttcaacatcacactctcactgttgcacagatcatctagacagtcaataaagaaacattggatataaactgtacattagaccaaataggcccaacagacatttacaaaacattttatcccacagctacagaatacatatttttctcatcagaatattattacttttccaggacagaccagatgttaggccacataaaaaaaatcaactaatttttaaaaattggcatcatatcaagcatcttctcatgccacaatggaatacaactagaaatcaatgacaagaggatctttggaaactgtacaagtacatggaaataaaacaacatgctcttggtcaaccatttactcaataaattaaggcagggcatggtggctcgtgcctgtaatctcagcactttgggattgagctgcagtgaaccatgattgcaccattgtactgcagcctgggcagcaaagcaaaagctggtctc

SEQ ID NO: 132960 - DNA, 235 bp, Homo sapiens
gtaagattagattccaaaccacagcttggaggttaccaattcagtaacatcccttcccttagagttaagtcaatgaagagagcccattctgagtaaagtttgctgctttaagtaaaagtgaacctcttttctaacaggctaagatggaagtttccttgctctctgtaaatttttttttaaaccctgtatttaccagaatttctgattatttactgtcagtcagagtttggacagt

SEQ ID NO: 132961 - DNA, 231 bp, Homo sapiens
tgggaaaactcactgtaattttaattttaaggggatgctttataataaagcaagaattgcaagataaaagtcacttttcagcaatttgttttacagaagctacattaggacatatctctatctttaagtgaggtgtactcatatatatatttttccctttctgtaatattagttcctctgggactacaggcgcctgccaccatagctggctaatttttgtatttttttagt

SEQ ID NO: 132962 - DNA, 248 bp, Homo sapiens
aaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggtgggtgcaaatactgatatt

SEQ ID NO: 132963 - DNA, 326 bp, Homo sapiens
gtgagaccctatctttacaaagaaaaagtaagagaaacttaagaattaacaagaaaatgaaagatatttctgaaaaacattgcaaaactttactgaagctcataaaagaattgaataaatgctaaaacatattttgttcttgaacaggatagctctcacatttgtaagatgtcagtatctgctgtaagttgctgtattttatattgttagaaagatccttttttactttttatgatttctaaagttaagatacgccttaaagctgatgacatcttccaggtacttctggccatatggtaattatgaagttaggttaggagcatctt

SEQ ID NO: 132964 - DNA, 361 bp, Homo sapiens
atattgtatgattccatttacatgaaatgtccagaatacacaaatccataaagacataaagcagattagtggtggccaggggatggggagagaagggattgggaagtgactgcttatggatactgagtttctttttagggtgataaaaaatgttagtggtgatggatgcacaaccttctgaatacactaaagaccacttaattgtacaccttaaaatggtgaatttatggcatattaactatatctcaatttttaaaattccaaaataagccgctaatataaatccattcctttagcacactagcccattttctttcctcagcagacttagagaacaagtactcttcatttaccatagcat

SEQ ID NO: 132965 - DNA, 358 bp, Homo sapiens
gcttgtcggtctctccaacaaaattgtgttcttagtgacatcaggattatattttgtttattgcttgtggtatccatggtgactagcatagtatcttgaacatgataagtgccctacaaatatttgctgagtataagaatgaatgaatgaatgaatgaatgaatgaatgaatgaatgcttcatggcatccagctacccagtcctgacattctctgagtctcagtttctctctcactaaaaacgagatgacttctttttcattgttgtactctctgcaaacctgtagaaatgaacccctagtggctatgagaagctgcctaggccaagggcgtgggattcaattgctgtttggtttctc

SEQ ID NO: 132966 - DNA, 648 bp, Homo sapiens
agggagggcactggtccctatgccgtggagcttggccttggggcatgctgtaccccaggcagttcagatgacccctgaggagtccctctttgctgaggggtgactgtgggaggccagaggccagcgctacccttgcgtgtggatgtcctgggtccctctccctgccccagcaggggaagctgcagcaaatcccctcacaggccttcgtgggtgaagttgggcactaagggtgagggatgcacgctgagccaagtcagagtgtcatctggcctagctggcttctgctgggctcagggaccctgagcctctgggacgggcacgtcagcaggtcacatgctggaaacttgcacaggtgaggcaacagggcctgtaagaagttgccccatagtcaaaataaaaaattcacaaagtggaaacaacccaaaagagggagttgaattcgacgggaggcccccagtttgctcttctgtacctccttcacttggccttccctgagcccacacctgtacttctgctcttttcgttgagagtgttttcccctgtaccactcaatttgtgtgcatgctgcatccccacacacctaggccaaatctctgtctccttccttatgcctggccttagagtcacaggctttggtcgattgcgtta

SEQ ID NO: 132967 - DNA, 509 bp, Homo sapiens
tctctctctctcccttcctcccatagagaccagtcttggggaaccacctttgaggtttgtgtggagcaaagtagtgatgatcaagagggtgtgatatgtgagcatttcttattgttctctgaacgtgtaattcgcctgtgctttctggtagtcttattgatgacaattcaaggactttgggttggtgtcaaagacgggcttcagaataatggcagtagactttatataaccaccgatgggatgtgaacttgaaaggcccaaactcgcaagagttccatttcatatagctattctcttttgggggaaaaaagaaaagaaaaacctacagtataggcagatctttatttttcctataaaagaaacccagatgcttgagggtcacggtgatcactgtgacttaggccatattgactttgtgctgtgcaccgccctgcgcccttcacccacatgaactcaaatgttccacctcttgacagacgagggcccatctttaacgcattcattcagca

SEQ ID NO: 132968 - DNA, 524 bp, Homo sapiens
accacctacaaagagtgtcacgtaatgaaccgtctggtcaatcactccttccaaagatctaagcctttcatctccttttgtcagaggaagaaacctcagggttttcatgaaaccatcacctcctctaacagctgccttttcttcatacagcacctctcagtgttgcctcattctgcctggttaggtgctctctaaccaatgggccatcaatcccaggtcactgaaaggtcctccagggttttgggagatgtttagacttctattgtggagtcctctctagatgaagagatatccatcttttcttcaacatcccttgtttcccaatctttttattgttttctggcctcccttctaatttatggatgtttttaacggtgagacgccccaaatggaaccagtatccgatggaggcgtaatcactgttgaccagaacagaataattacctcacttactctgcaaggtacttctgttaaatgctatcccatccattatgtgccttttttttttttaaactactactgca

SEQ ID NO: 132969 - DNA, 364 bp, Homo sapiens
tgcaaaggcagcaacacagccctgctgctgcaggatgctgtcctaggaaattccaccagttggctcactgacttctcgcagttcctttctgctgggttatcaagcaggtgagcaatgacagtcatcccctcttccagggaatcccagacccctccagcaactgatgactcattctctaacaaaaggtgggcggtctggacctccccttggaatctctcctttacctgtactatcatcccccgatcgactacccgtgagttgggggctgagtccccaggcagcaaaatatctgggggggtatgctctacccctcccactccgtcttccttttggagactctctgttaacttcgttagggtttcag

SEQ ID NO: 132970 - DNA, 657 bp, Homo sapiens
ggatcatgtaggtcaggaattgagaccagcctggccaacatggcaaaaccccatctctactaaaagtacaaaaattatctgggcatggttgtgggcacctgtattctcaggtacttgggagactgaggcagcagaatcgcttgaacccaggaagcagaggttgcagtgagccaagatcaggctgctgcactctagcctgagtgatagagtgagtgagactctgtctcaaaaaacaaaaaacaaaaaaacctttcgatttattttccagaggtctatttttaatttagtaacaagatttttaaaaatatttataaaattaaataacaatagaatgttagaactaggccctataaaatataaaattgtcaaaattgcttagcatgattgtagcttcaaggatcctattgttaatgtggcaacttctgaaaccaaacatcatcatgcttagcatcaagagctaaagtagtcatgagttaatggagaagaacaactaaggaattggctgccgaagtaaagtttatgctaaatttaaatgaaatgaaataacaaagtagtttgaaatgaacattccattgattatttttaaaattttatttattaacaaagtagcttatactaactgcccactgtctatcccaatagttacagcaataacat

SEQ ID NO: 132971 - DNA, 526 bp, Homo sapiens
ctctctgatttctccccacttttttctgtctcatcgccttatcagccagagcttctgcggcggtggcattgggtcaatggtttgagtgtctgcagccagctggaaatgaatgaccatttcctgtttaatctcactgggtctgggcttgcttgataattgagcagtaaatcaatgcccctgaaatgtcagcagagatgatcaggtccccctccctctgaattgcagcctgttcagtgcccagccgtacccatgggatactgctttgtgctacaactgaaatatcaaacaattgctaattgttaatggaacattaagtgcattttcccagaccacttatttaaagtgcatttcccttctgtgggttgataatgaggctgtgtttgaggtctgtgttgaggaagaaatgaggggaggtgggcttgggccccagaaatcgggcaggctgggggcatttgcacattggcagctgatgggattcttccccaagccctggctacttagcgctggtggtgtcccgctgtgaccg

SEQ ID NO: 132972 - DNA, 610 bp, Homo sapiens
gaggtggtggtggtgatggtgaaggctcaaccaagtccatgtcagtggactggaaagagagagagtatcaagaggccttctgaggttgtaaatgacatgcagaaagctgagtagggaggggacatggtaatgatattaaccaagatgggcactacaaaactggagcatgttagaggtgagggtgcagagagagacaaggagtttgcttttggtcaggcaggtaggtggaagtcagctctaggggtctaaataaaggattccagggccagagatcaaatgattgtctcagccatttgtgcattcattcataaaatatgtatcaaatgccctctctgtgccaggcactgtcctaggctctaaggataaagaaataaatgagatgtagtctcaagatacaatttaatggagaagaccaaaacaacaacaaaaaaaaaaaaaaaaaatttggggggggcccgggggcccggaaaaggttttaaaaccccttgggttggggggggggggcccccatggtgttgggagccccggggccaaggggggcccaaggggacaccggggccagaacgggggtggggtttccccccaaaaaaaaaagcgccgggggggacga

SEQ ID NO: 132973 - DNA, 357 bp, Homo sapiens
agcatctcaagccacagtgtgagaacagcaggtatttcataaacattgctgcaggatgacatagtaacatgcccacaatagctccagtgctctgaccttccttcctcagggcaactcaacccactgttcacagtaagcttccatccctgctggcaacaggtatttctttataacaacacaacaatggcctaacacaccctgcacggcgggaaggaaaggcagagaagtgacaccgtcagggggaaatgacagaaaggaaaatcaaggccttgcaaggtcagaaaggggactcagggcttccaccacagccctgccccacttggccacctcccttttgggaggtggcatcgataaaca

SEQ ID NO: 132974 - DNA, 205 bp, Homo sapiens
gagctcagaaagtgatcttcctaggttttatggcttctttcaagggagaggaattctagtttctttgacttgcttcaggagacaaaggaaggtacgaaggagggagggataagttcagagacaccttcttgcttctgtggtcctcctggtgtccttcagctcaaagtattcagcatgccaaggtagcgtacttccagatattgtg

SEQ ID NO: 132975 - DNA, 507 bp, Homo sapiens
actttgcctttattcttggatgatggtttcgttgggagaaagtaacaggttaatatgtacattttgtctgaagactctggagctgtaacactgcagtctcctggcttctgtgggtcatcaggctaattgattttcctttgtaagtgaccctccctacctctagtgacttcagaaaccttccttttgactttagtgttcagaggtttcaatgtactgtaccaaggtggtgcattatttttatttatcatgcctacactttgttgtgattcctgaatctgagggtttatgtctttcatcaaccgtggaaagtcagtaccattatgttgtagaatattgcctcccctaatgcttctgatcttttccagaaacttctatttgaccatctcattgtcttcctcagctgtctcatagattttctatctctgtctccctctgcttcattcacagaattttctatgcagtttctaactcttgagatgtttctgttccactgctttatctacccac

SEQ ID NO: 132976 - DNA, 181 bp, Homo sapiens
cctttttccccgggtcagtgcccagcggccacgtgggcctgaggccgaggtctcctggagggaccctggtttcctgccacgtgttcctcttgctgatccaccccatttctcttgaacaaaagttttgttggcttcccaaatgtaaagcaagccagaagcaagatgataaagggtgtttaaa

SEQ ID NO: 132977 - DNA, 361 bp, Homo sapiens
taaaattccaatttaaaatatgagtattcttattcttaggctatgaggccactggcaaaggaacttaagaaaataggccaaacctaatagaaataagattgtgggaaaggaacagcaacaaaaatagaaacgctgtctttggtgctgctttggaaatatactcagctactggtgctcaagagcattatttataaatcactggtcaaagcaagggtggccatgagttattgctgaagaatgcaggacaacttctgtaaaggatgtagaatagcaaaacatgctaagttctctcatttgggtaaggatatctctaagcttatcagtattttaggtgattagaggtaaaattgcagagtccaac

SEQ ID NO: 132978 - DNA, 772 bp, Homo sapiens
gggggtgggggtggggtttaagagctgcacttaatgtgagctataaaagaactgctacagcacacaaaatagctatttttattattataattataattattattattattttgtaccttaaaaaatagacacatacaccaaagacatttgtgtgagcctttaaacagtctgtctgtggttggtatcattcaccatcaatgagtcaggggttgggattcaaggttgagtagtgtggattgtgttcaggcttaaaagacctgagaagtttggtttttgactccttttacatccatgaaacaggacatttcatactggatgtacagtagttgtacactgttggatatcaagttcaatcaaattcatggaactacatgcttgtatgtgtatatatacattgcttgtgcatatgcatatctgtatgtatatatacatgtattgtaccatgtccatacacattttaagcacttcaggctgtcattttttaatgttcttaaagcaatgaatgtttgtgtgcaaaacacagtatttttaagaaggataggctatagtttttgcttttactctgaactaggtgggcgcatttcaaaaattcggatgggaaaaagcctggaaattccagtgaatattcagcaaggccctctttcattgtacagggatcaaatttcctcctcttttttgtgccccctcccacttctacaagttatcccctgtggggaaaacaggatgataatcaaaactctgggctgatgtttttccaacttagtgtctattg

SEQ ID NO: 132979 - DNA, 373 bp, Homo sapiens
tgtgccaccgtgcctggctaatttttgtattttcagtagagatggagtttcaccatgttggccagactggtctcaaactcccttggacagactggtctcaaactcctgacctcgtgattcacccaccttggcctccctaagtgctgggattacaggaatgagccaccaggcccggcccaaatatctttttttaaaaaaaaacattcatccacttctctgcctttgtgaggaagaacacaatcaaatcaaagtacctgctgcattaaaaggacactgctatctctgcccaacatttctgagggacatttctctgaaagcactggtaacataaatacttaggaaccaggtataaaggaatactgatcccagcgca

SEQ ID NO: 132980 - DNA, 384 bp, Homo sapiens
gggacaatgaactccttctggtctaagttattggtgctgcccctgctggctccgctgtccatggcccgagcctctgcctgtcagagatggtagagccaccaggacatggagtcattgctgacacagggaaatatgagatgtcttaggtttggtgtatgtgaaacatgcatgagaaatagaggccaaaagttccactgtggagcgcagacagaatggtctgaatgctcttgcagttactacgtcagtagtttgtcatctaatatatattatacatctataacctatgtatttaccttattgtgataatactgttttgttttgttttttttctaattttgctttgtgcaaagccaaatccctttcagcagcattgagctaaaaaaa

SEQ ID NO: 132981 - DNA, 389 bp, Homo sapiens
tgtgagctacaactgcctgttgttcataaaccacccagtttatggtgttttgttataacagccaggatggatgccattagtccatccattagtctgaaatacttcaagtgtgtggttcctaagaactggcatgttttcttacataaccacaggagaatgatcaactttagtatttttaatatcgatgcaatgcttttatccaattcaccgtccatatgccagtgtctccagttgacccactacagcatcctccccctctcaatatgatccagtctcgggtcaggcattgcatttgattggatctcatggagccccagacagagccgtggcttagcctcaggaaggatcagaatcagggacacagggaacccaggagttttcttcctttg

SEQ ID NO: 132982 - DNA, 625 bp, Homo sapiens
catttgttcacaagaatcaaggattggaataggcctgcaagtcatctccatctcacactctctgattttaaggtaaaactccagttactagaaagacagtatagaggagaaaccacaaattgccttggttgctgagaaacacctctgaatatactgattccctagcctgctattgctcattaagaaaaagtagaatcaagtcatgaatacttagtgtatgtatttccagaggcaaatatgacatctcaaatggatttatagcctctaaagtcggtatgggatttatatcttctaatatttattctgtggtaaaggagttcattaaaatatggagtttcagtactttttttggccaaatattaaaactgtgtgtgagagaaatctatatcatgggagaactttgtttctcaaactgccaggtgattgttcctatttgttattctcataatttcaacaaaaacaagattcctaagtctgttttgttttgttgaatttgtgcttggtttttaacgcaggctggttcagtccttccctaggggttcgttccttatggagttttagaaattaagcatagctaagtgcatgtgcacacacacacacacacacacacacacacacacacaca

SEQ ID NO: 132983 - DNA, 375 bp, Homo sapiens
ggatggagatggagggtggatggagggtggagatggtgagtggtgatggagggtggagataaatggtggtaatggacagtggagatggacagtcgaaatggagagtggtgatggatggtagtgatggatggtggagatggacagcggagatgaatggtggtgatggatggtggagatggagcgtggaaatggtgggtggtgatggaggatggagatggagggtggagatggagggtggtgatggagggtggagatgaatggtggtgatggatggtggagatggaggatggagatggagggtggatgaagggtggagatggaaggtggtgatggagggtggtgatggatggtggagatgaatggtggcgatggacg

SEQ ID NO: 132984 - DNA, 143 bp, Homo sapiens
tgctgggattataggcatgagccactgtacccggctgcagtagtgcagtgtttttgctttgagtctctgaaacatgcacacatactcccttttttaaaaaaaaattgtttgtatttttaaaatttttgtgggttcatggtagg

SEQ ID NO: 132985 - DNA, 380 bp, Homo sapiens
ggcagtgatgtcgaggtcgactctaagatccctccgtcttctggccctacaagacctgatatgaaggatgattattaaaggaaaagcagagcatgtggatgaaagtgtatagccctgtattcgaagtttccttggcatctttttgaatattcatgcaaaagtcgatgactgttccatccatgaagtcagtttcctgattatcaattcaactccacaagcatttgctgcacgactactatgtgcagaatgtggtagggatccattgaagatacaatccttgccctcctgttctttacttcccaggagggagatcataataatgtggacagaactgtaaatagaggcggaagcaggaagcaggaagcggcagaagcaggaag

SEQ ID NO: 132986 - DNA, 535 bp, Homo sapiens
gacagacctcagatgtgcctaaagccatggtcaaccaggcaagaagaggactatgacagtaacactgccaccttagcacatcagaaagtgttagagaccagcaatgatgaaacttgctgaggaacaggaaacattttaagaaaatgtgtcatcaggtcacacagggagaaagtggctaatctgaagatgggaggcactcgaaagtggcaaggcacttcagagcagagagtttttctgtcattgcagagagatcaaatcagctgtttaagagtcaggctgtcctgggctcctcctaaaggagccaacaatgtagcacagccaggctgcctccgtgaactcagattctactcccagaattaatggcctctgggtgttgtgcattctccagcctttcagctgtcaagctggggatccttgtgaatgcagccagcagtgagagttcacagccacacagccacatccagcactggctcggactggggactccatgccttggctttgctgaagctgcctcgctgcataacccgagggcagg

SEQ ID NO: 132987 - DNA, 485 bp, Homo sapiens
atgcccttagataaattgtttaatgcagttttcttttttcttccacattgtggggactagtggtttctgtgttgatgaaagagcagggagcatcttttcttgtgtgttcattcatgcaaaattttgccctcttgaaaaatgaacaaagatcatagccagaaggtatttatcatgcagttaaccacaagaaatcttgaatgagatcatcatcaagtaacttaaataaaacagttattttctgacactttatcaccagagtcattctttaggacacttagcattattatgtatgcatttttctttttcatataattgccaactattttgaagaatgggatgcttcagattaacgtcttgggagggagacacaatctacttgaccctgatttaaaggaatagtggaagtgggtggttcttcaccacacatgtgattgttactagggattcttcatagactctgtcatagcaaaagtattatatttggc

SEQ ID NO: 132988 - DNA, 303 bp, Homo sapiens
ctttcctgtgtgcaactaactgtaccttattctctctttgacaagagatcagagacattcctctgtttccatatgcatgtggctggcctacaaatctgaggttatgtgttttcccatccttctcccagtcccaattctcaaatcctgactagtatctctcagtcccaattccaaatacataggcaggagaatctgattgatcctgcttgagagagatatctgcccctatgtcctggaagtaggaggtaatatgaaataaacatgcattcacttaattgccttcaacaactatttgttgagctc

SEQ ID NO: 132989 - DNA, 405 bp, Homo sapiens
ctcttgggataatgggtctgggacagctcaattacaggtgggggcttcttatgcaattccattcccaacactgggtcaggctaggcaccgcctgtccttttgtctttgaccataccctggtcttgctcctcactcatgaaaagtatctgaaggcctccctcgagttctgttcctagccttaggtccagccatcgttccgggtaggggagatgaagccataatccactaaccattttctcctggactcctacctccaatgatttcaccattccctgcaggaaaccccacctaatcacatcctactccctccaccacaactgctatccccctcctttgtagagaccttggcttccttatccacacagcctctttctctcctcattcttcataatccagcttagagca

SEQ ID NO: 132990 - DNA, 333 bp, Homo sapiens
ggtaaaaggcagaataaaacatttaaatcaaagtctttcaaatgaatttagattcaaagaactcaagaatcattcaggggttaaaaaaggttttatattaaattacaaagtgaaattcattattaaaattctatttgctatattaagtcatgcattgcttaacaatggagatgtcttctgagaaatgcactgttaggcaaattttttttcttttttttttttgagacggagtctcactctgttgctcagactggagtgcagtggcactatctcggctcactgcaacctctgcctcctgggttcaagcaattctcctgcctcagcctcctgagt

SEQ ID NO: 132991 - DNA, 774 bp, Homo sapiens
attccaaaatctgaaatctgaaacacttctggttccaagcatttcagataagggatactcaaacctgtactgtagggatagtcataagaataacctgacaactttttcaaaaaattagattctcaggtctcacttccaaaggttgattcttaaggtctgggctggagcccaggaatccagcaagcatctcatctcaagtacatctgaacctgcagacacctttgagaaacaagctttattagtcttctgcctactccactggtggcttctcactctttctttggctccccatacaacagcctcttgagaacaggtcatctttaggatttggcgcttaccctgctgaggctctccagtctatgtagtacttatggggataatggggcttacaattcaagctgagatttggcggggacacaaaggttaacgatattattggaacaacatggatgatttcatgtttgagaaattctagaacacacagcataatctttaattacagaaagcagatttgtggttttctgggccaaagagtggggtgatgctgactgataaagaggtgaaaaattgtttgggatgatagaaatgttctatatcttgattatgatggtggtaacaagactatatacatttttccaaactcatagaactctatactgaaatagatgccttttatcatgtataaattattccttaataaagtttattttaaaataaaaacttttaagaagagttgcaaaattttcaaacataatattaatatatgaaaatctg

SEQ ID NO: 132992 - DNA, 163 bp, Homo sapiens
cagggcctggcacccacaaatccccttcctgcctctgtggattggcctctcctggacattctgtagaaatggaattacatattgtatggccttttgtgtctggcttctctcacggggtgtgatgtcctcaaggttcatccatgcagcatgtgctagagtgtaa

SEQ ID NO: 132993 - DNA, 185 bp, Homo sapiens
atccctcacttcctgtggccagtgttgggaggttgggccaactccatgctcagccatagaattttgatcttccgtcccttctccctgttagcaatataatcctgtagtcctgaaaatagattttcctgaggagccatccatttgacagacagatgaatatggaccactgctgatgattactaagt

SEQ ID NO: 132994 - DNA, 684 bp, Homo sapiens
cgtggtggcgggcacctgtagtcccagctacttgggaggctgaggcaggagaatggcccgaacccgagaggcggagcttgcagtgagccgagatcgcaccgctgcactccagcctgggcgacagagtgagactctgtctcaaaaaataaataaataaaaaataaaatgagcaaagggttagaatacacaattctccaaagaagaaacgcaaaaggccaaaaagcacaggaagggagatgcaaatcaaaaccataatgagacaccactttacacatgctacaagtaatataaaaatcaattttaagaaaaaagagacacaagtgttggtgagcacatggagggagaaagcagagccctcatacacttccggtgggaatggtaaatgatttcactctctgaaaaacaagtctggcagatcctcaaaaggaaaacacatgagttaccacgtgacccagtaattccacgcgtacgtatacacccaagaaaatacacatccacataaaaacgtgaacgtgaaatgttcataatagaattttctataaaagccaaacaataaaaaccacccaaggctgagcacggtggctcacgtctgtagtcctagcacctcgggaggccgaggcgggtggatcacgaggtcaggagtttgagaccagcctggccaacatggcgaaaccccatctctac

SEQ ID NO: 132995 - DNA, 471 bp, Homo sapiens
tccgcctcccagattcaaatgattctcctgccctcagtctcctaagtagctgggattacaggcatgtgccaccacgtccatctaagttttgtacttttagtagagacagagtttcgccgtgttggccaggttggtcttgaactcctgacctcaggtgatctgcccgcctcggcctcccaaagtgctgggattaccccggctaaagcttgtttttaatgtactttgttttccagattgatcattaccagttaacttatggtaacctactctgcccagagcagatgaagactagactcaaggcaatacctagttacttctcttccttctgtctttactgtgttctttccctctttctttctgctaagtctcgcccattataacctctccttcttcctcatcgctaaagaatacttccagtttaagccattccaggaaatcgggtggttttatgatgtgttcctccgtgaggga

SEQ ID NO: 132996 - DNA, 195 bp, Homo sapiens
gagtgtccatggtatttattttggatttgcaatgaaatttgggaattaaaggagataataatacatgtattcagcatttaatttgtgttctttatacgtcagaggaaatgtctgcaaattaatcctacgcaacaataattctgtaaagcattacatatgtgaagatgactacaccaagcattagttgaaatagag

SEQ ID NO: 132997 - DNA, 542 bp, Homo sapiens
gtgtttaaagctatgaaattgattatttcttcagccttgaaagacttctctggagatgatacagagctgatacagacattgatgatggggctgtttcttaattgctcaggagaaaataattgttgtatggttcttacaggcaactaaacttttatttagagaaacaaagtaattgggaatatgagaagtgaaatgtgtcttaatatgccttcacttattcctattctttctagtgttctattttagctgtttaaaataccacgctagaccggtgttaaaggctcatacctttgggagccaaggtgggcagatcacttgagctcaggagtttgagaccagcctggacaacttggcgaaaccctgtctttactaaaaatacaaaaattagccaggcatggtggtgcgcacctgtaatcccagctacttgggaggctgaagtgggaggatcacttgaacccgggagatggatgttgcagttagttgagatcatgccactgcactgcagcctgggtgacagagtgagacctcatctcaaaaaaaaa

SEQ ID NO: 132998 - DNA, 627 bp, Homo sapiens
tactggagaatctggggattgggagctgatgagtcttactctgttgcccaggctgcggtgcaatggcgcgatcttggctcacagtaacctccacctcccgggttcaagtgattctcctgcctcagcctcccgagtagttgggattacagacacacaccactgcgcccggtaacaactaatgttggaactatgaaaagctcttctctacttttaacaaagcttagtcacaaacagttccccagttgataagaaaaactaaaacaacagaacaattgaaagtccgaatctgcaagttcatctctgagaaccgaattttacagccactccagatttgtactccaaatggatagtttgattgtagaaatcacatcccttcagtctgccaatgtgataactgcccaagagaaagtgatgcctacattcatagataatcccctttcccccatcctatatataactggagtcaacagcagctggaggaaaatggcaagaacttggaatcaagattaggttagaataacactgctgtagacagtttatcagctcttcagcatatgtccattttccttgaaggatgagcctttagaaacctctgacaataaagtttattttgcatccaaaaaaaag

SEQ ID NO: 132999 - DNA, 607 bp, Homo sapiens
tagttgggattacagacacacaccactgcgcccggcaattattattattatcattattattattattgttattattattattgtgcgtgtgtatgtgtttttagtagagacggagttttgccatgttggtcaggctggtcttgaactcctgacctcagctgatcaaaagtaggtgaggtcaaaaaacataccctgggagaggctggcacaatgcccagaaccgctatcgctaggcctggggttttcctctgtagtggaatactagtattcatgtagtgcagggacaaaaccaattagatagttctgggagttaaaaagagatgatttacagtgccatttgagaaggggtattaaggaatttgccagggcactgacgcgtgtcaggtgtaaacctcaggttgagagagagctaagtattttctgtccatgaaggtgataagcgagggcctgaagaaagagggactggggaggacactggcaccagaaataggaaagggcttcttgggggtgggaaggatgggtcacggtgctatctagaaagttgcctggcagtggatgtaggatgtgggagtgagacatcaaacatgaagcagtcgcttaaagtctg

SEQ ID NO: 133000 - DNA, 782 bp, Homo sapiens
accctcaatttctttatatatctatagatattcagtgcatatgcaaatatatgcatataattcctctttttaattaaacacacatggtaatatctattgtaaagtatacattttttgaaatcttgctttttttcaggtagcagtattcagaatcaggtgaatagcaaggcaaataagttgttttcattctttttaaattggtccatgtgtcaaggtctgtttagtaccttttgatggatatgtaggttatttacagtattaggttgctttacacagtgctgcagtgaatattcttttatattgtcttgagttgcctgcatttctaggtcagaggatatgttcatttgcaattttgttaaatattgccagattgccttcccaccatctgtatatgtatggtgtactgttcttctatatttttcatgtctctctcatgctttcctttaaatccacaagtgtataatagctgttttaaaatttatctgttggccaagctcagtggctcatgtctgtaatttcagcactttgggaggccaagtcaggaggaggattgcttgaacccaggagttcgagaccagcctgggcaatatggcaagaccccatctctacaaaatttaaaaattagctgggcatggtggcacatatctgtggtctcagctacttgggaggctgaggtgggaggatcgtttgagctcaggaggtcgaagctgcagcaagccatgtttgtgccattgcactttagtctgggcaacaaagactgtctcaaaaaaaaagaaaaaaaa

SEQ ID NO: 133001 - DNA, 232 bp, Homo sapiens
ctctgactcaaagcacaactagcttcaaatgcagttttaccatttaactagccctgtgactttagttattaacctctctgagtctcagtgttctcactcatacaatggtaataacaacaatcttgcaaagctgctgtaaggattaataataatgcaggtggccaggcacagtggctcaagcctgtaatcccagcactttgggaggccaaggcgggtggatcacgaggtcagg

SEQ ID NO: 133002 - DNA, 469 bp, Homo sapiens
gatctgtatgctgaaaattgcaaaattctggagatggaaatcaaagaagatctaaataagtggagagacatattgttcatggattggaagactcatatagtaaatatgtgaattctccccaaactgagctatagctttaatgcaatttctatcaaaatcacagcaagggctgttgtagacatagcaagcttattttaaaatttatacgagaaagcacagaccttagcatatctaaaacaatcttcaccaagaataaattggaagaaatcacttttccatataaagcctactatgtaggtacaataatatgtagtagtatgtgaaaggatagaaacatagctcaacaaaaaaaaagatcccagaaataaacctacacaaatatgctcactttatttatggcaaaggcacaaaagcaattcaacagatggtgttagagcaactggatatcccttagaccacaaaaaaagca

SEQ ID NO: 133003 - DNA, 529 bp, Homo sapiens
atccaaacaagtccaaaattccctgacactggcaattccattgtagtaggtacttattggatgggatattgaagatgatctagatcagaaattcccaccccggctggatatcaggatcagctggagaatctttatgacacagaatcctaagttctctcggagaatctgattcagtagttctgggtggcacgtggaaatatgtattttaaaaatcttaccatcatgggtgtaacaactggaaggggggcccaagggaggcttctgagatggtggtcatattctttccttgatctgggcgttggctacacagatatatttgctttataaaaattatttgaggtgtgtacttatgatacatgaattggtttcctgtatgttttatatttcactaaaatgttaaaaaataaaaaacctcttttcaactgattctggtgatccatgagtttatctagtatttcttcaatgcaagcccttgcacctgctgcttcagaattaaatgccaattctaggactcactcagaaccttcta

SEQ ID NO: 133004 - DNA, 791 bp, Homo sapiens
attgcccaggctgttctcaaacttttggcctccagccactgccctcacacctgtaatccaagcactttaggaggccgaggcaggaggattgcttgagctcaggagttcaagctagagtgagctatgataatgccactgcactccaacccaggcaacagagccagatcctgactcaaaacaaaaacaaaaacaagacattgaatctacaattaatgaccttccaaaccaaaaagcattagacccagatggttttactggtgaattatattgaaaacataatgaagaaataacaatttcctataatcttttccagaaaatagaggcagtaggaacacttcctaactcattcaatgaaggttgtaataccttaataccaaaactagacaaagacattacaagcaaggaaaaataacacactaatatttctcaggaatgtagatataaaaatcctctacaaaaagtcagcaacccaaacctaacatgtgtaaaatgaatgatacatcacaaccaagtgggatttactccagacattcaaggctggtttaacactcacatgtaaattaatgtaattcatcacatcaatgggctaaagaagaaaaaacatgatcatatcaatagataaaggaaaagcatttgacaaaacccaacacctatttatgataacaactctagcaaggcaggaatagagtggaacttcctcaacttgatagagaacatctacaaaaaaacctacagctaatatcatacttaatgttgagaagctgaatgctttctctttaagactgggaaca

SEQ ID NO: 133005 - DNA, 412 bp, Homo sapiens
ttagtgctgttcaacataaattctcaggatattatactcgagagccagtaggaataagggcaaagaaacaagcgttaaggcaagtaaattagatgatgagagaaaacctagtctacaaagttaccatttaaatcttgaactccggacagctatttcataaatggttttctttggtcatacaaggtgaccatgggtcatataaggtaatgttaaaatcacaagtcagggtttctgtctgactgctggtgggtcagatatcttcccctcccatgaaagaaaagtcattctttagtgttaataatcttgtcatgtctgtagaaatgagcacttcctcttccaccaccaagctccccaccccaaattctgcttgggacattatactgcaggctaatgatctaaacaaaattaagat

SEQ ID NO: 133006 - DNA, 460 bp, Homo sapiens
ggtgccacatctggactgagaagcacctcatagatacgccctacccactgctggactttgagaaactacaaggctcctctgccactagcacttgggaatcccctgcatggcagcacatggtgccacagggcaggtgggcaatgatccttaaaacatcaaactcactcagcaacgaaccacagtggtaaccactctccatcctccttcctgtgccagtcgggcggggacctccacctgaaacaaggggtggagaaaccgacaggaagaccagtggcccaaggacaggctcagcatgggccatgagcacacacagctggcatcctgcttctggacggtgatgggatgccagtgagactgcagagtggacacttccttgagctagaagcctaacgaacataccagctgggcctgcaccagctgaaaacactggctgctccatggctattcactttccaaatac

SEQ ID NO: 133007 - DNA, 127 bp, Homo sapiens
aatacatgactctcataattgaaatggaatagtatatcattttttatttagttctaatgtataccaggcattatatgaatctgacaattttaggaataaaaataaattacatcccgcatttaaaagg

SEQ ID NO: 133008 - DNA, 292 bp, Homo sapiens
agactcctcccactacagggcatcatgctgcttccctacaaggtcccaccatctccacctcagggtgtcctctgggaggagtgacaaagggactgatattcacttgacactaaaagagacttggcagctgtgggcatcttggggtggccccaggcagctctgaaacccaggaccaggaaaccatagaggatgggctggggactcatcactctgtaacgtttccaaagaggaaacttaatccaaagacattctcaaaaggtgtctctgtctagggatgatgaagggaggacag

SEQ ID NO: 133009 - DNA, 277 bp, Homo sapiens
gggcccgcatgttgtacagcacagcttcctgtggtgtggcagtgggctccatccgggctgtctggtgcggccggagccccagccgcatgtggctgctggacactggaagcatggctggggagaactagagcccgactcttaaattttactggatttgtgatttcagttgagccacacatggtgggtggcttccatttgggaccaggcctctgcagaggaggccaggtctgggtggccggttcaccaggaagggaggtgaccgtgtcctcaggggaag

SEQ ID NO: 133010 - DNA, 704 bp, Homo sapiens
ggtttttaatgtaataatttttaccttatttcttaagtcttccatgaagcattatttgtaatggtggcaaaatagtccttaattctggtgcagcgtcatttattttaaccatttgtataatgtatattttgattgtttctaatttgactattctttagttttattattttcacgataaagatgaaaaatattcacttcacgaagttattgtgaaaaataaatagcataatccatggaaagttcttattgccacgtctgacaaaaagtaagcacttgataaaatgctttttttcttatcattattaaggcttttgaaaaatcagtgattaggggagttagggtagaacctgtgtttatgggcagagatttctctttacactttctgaggaaactgtattacggcagtacatcgtaggagtaaaccagcaaggagactgcaagctgactgcttgagctcaatgctggccctgccacttcttagctatgtgggcttgagcaagttacttaaactaagactcagattcatcatctgaaaaatgggttgataataatagaatctacttcctcactttgtcctgaggattaaataagaacacgcatataaagttcacacagcacagtacctgaaacatagtatgctctcaacaagtatttttttattataaacaagataaaattgattcccctcatttacatctctggtc

SEQ ID NO: 133011 - DNA, 514 bp, Homo sapiens
aattgggttatacgtagaggagattaaaccatagccacatcccatctgccctcttcactctatgagacccagagtttccaccacagaacagaggactgactggaatcaaagctcacccctttcttggaggctattctttgatgtgctggacacccttcacagccaacctttgaaaggaagagagacgcgaaagaattgggccaaatgtagacaatgcttcagaaatagaagattggtagaacttgaggagatatgggaaaatccacattccttttacccatgctctcaactttttacccatttccacaattattttatttcttggaagtaaaatagtatttgagggaactataatgcattaatctcacattcatgtgattgagtcattggaagccgtgccaggcttgagagcagagaaggaataaagagacaggaggaaatctgcattcaacctggacctagttttttcagccaaataaatggcatattgggagacactgcaattcatgaaaag

SEQ ID NO: 133012 - DNA, 642 bp, Homo sapiens
tgtagtgtacagtattataaaatccaaagaagggaacttcgaaaggaggaaatgttctagaaaacttgagaattgggtgcaaacagagccttgaagttgtagtgaataaagaggaaagtattcaaagtaggtgaaagtaaataggaatgaaccacttattttaagatttcttctgtgttgatagttaaaggagagttggcaataaagtcagttgaaggagttttattggttttcccctaagaaaattttatatttaaagcagagggaaagaagccattgaagatggaaatagctcttctgatttatttctcattctttattaacactattactctctccctcttatccaagacagatacctcagccattagcaagctctgtcagtttttttcttttcttatgcctgtcttattctttctctcttggtttatgcttcagagcacttgaaaaaccagtatcactaaaatctaatttttgtcaaattatcttcaaaaattgtatggctctttttattgtattgagtgtcccttaactttcagcattttttgtagtttggcagtagactttctgacattctctcttatttccatatcccagtgaaatcattgttccatttcagctagaacaatctatagtgtcccc

SEQ ID NO: 133013 - DNA, 273 bp, Homo sapiens
gattctcctgcctcagcctccccagtagctgggattacaggcgcctgccaccacgcccggctacttttttgtatttttagtagagatggggtttcaccatgttggccaggctggtctttaactcctgacctcgtgatctgcccgccttggcctcccaaagttctgggattacaggcgtgagccaccgcgcccagcggaaacctgattcttgactttacattttttatgcccatctaaagcagtggaggctgagactcacagaggttcagtcac

SEQ ID NO: 133014 - DNA, 833 bp, Homo sapiens
cactgcttcctaatgtactcccttgttttgactcttggggcacaggcacctttccttcagtcttccttctaaaagtcttcttgtgtggggtaacctctaggaccccactgtatcccttaagagttctgcctcctttatttcttgttctctgaagaatgtcccccattccttcttatagacagatagtgacatccatctctgtattatcacttagaatagtagattgcaaaccttacacattgtgtcaggtttgaacagcacccattagaccccaagcaaaagacatcggagtgataaggaaacaggacactaattcctctcagatcctgaatcaggagttcttcaccctcccaggagctacttggtaataaaggtgtaaagctctcaggtgctgaacttattaagcctcaagattctgaatttttattttaagctctatcaaaagtataatcttacccctcaaaaaaaagatgaataaaggaatgaaatggttcaaagaaggaatgaaatggttcaagcatgattcaagacacagagataagaaataacatgatgtggcttgcagtggtggaattccataacatgatgtagtatgcagtggtggtattcctagagcgttaaatattcagtgataagtgggcagggttgaggctgaaaagatagataggggccaggtcaaagtgggttaatttatgtgctgtttgtaccaacaagcttggactttgtatgtgacaggcagttaggaggcattcaagacttaagcagagtgacatggtgctttgttttacgttgttttccattttttaaagctatcaactactgtacatggaaag

SEQ ID NO: 133015 - DNA, 397 bp, Homo sapiens
ttttccccttagtttcaaaatggtgaggttgctagatttatgtgtgctaatttctgtatgttaaagcatcccatcagtcaggtatggaacatttagtaagcacttcttgttgcagaataatttcattcatttgaaatctcttcccttaaaaccctttgaggctgggattggtggctcatgcctgtaatttcagcacttcgggaggccaaggcgggcagattgcctgagctcaggagtttgaaaccagcctgggcaacatgctgaaaccctgtctctactaaaaatacaaaaaattatctgggcatggtggtgcacacctgtagtcctagctactcgggaagccaatgcatgagaatcacttgaacccaggaggcggaggttgcagtgagccaagatc

SEQ ID NO: 133016 - DNA, 442 bp, Homo sapiens
ggctgggatcacttaatctgtttagttttccttctccaaaggtcagatggtgtgagcagagcacacccagagttaaggagggatgagggttaacctcaatgggtgcatgaggggagcaccttggttttgagcctgtggtagctctacatgggcctcacaacaaagtctcccctgaaactacaatgatttataattgtagggaatggggcaaaagggccagagaaagtagccttacgaggagaataataagactttagtaatcagatgcttaagttgctgtgctgcgttttttaaatgggggtctgaaacaaaagaataaaagacctctttcctagaaatgttccagaccagaaagtaacaaaacaagcctctgtcacaaatttaccttttatcatttgttgctgtacagggattaacaggcaaatattatctatttgcttct

SEQ ID NO: 133017 - DNA, 306 bp, Homo sapiens
agaggtgccagcatggactccagacccatgttagggtaggaggttgggatgcaaagtggggattgtctaacaaagtaaaaagcttgctggtcacagagccatgggcagtgtgtatgtgtgtggtacatagcccaaatactagtttggtttgttctggaaaagacttgatgtcacttttaaaaatgcttgccactaaagataaatcaagtgaagatgaaaatgagacaaagggaaggttagggaagggaagataaaatgaagccagaagtgaggtttgggcacagaatccatgcagtgtgggtctgt

SEQ ID NO: 133018 - DNA, 787 bp, Homo sapiens
gcttgtctctcgctgcagctggagcgctggtctcgtcttccctgcttgtgtcccctgctcttagaggcccagcctctgtggccctctgacctgcaagcattgggagatccacagctaagacgccagggcctcccctggaagcctagaaatgggaccattgacatttatggatgtggccatagaattctctgtggaggagtggcaatgcctggacactgcacagcagaatttatataggaacgtgatgttagagaactacagaaacctggtcttcctgggtattgctgtctctaagccagacctgatcacctgtctggagcaaggcaaagagccctggaatatggagagacatgagatggtggccaaacccccaggtaggtgagagtgaatatgacagatgacacagatgagaggtccaaatgtcaaggagaaagtcagtttttgaaatacgatttggggccgggtgtggtggctcatgcctgtggtcccagcacttggagaggctaaggcgggcagatgacctagggtcgggtgttcgagaccagcctggccagcgtggagaaaccccgtctttactggaaatgcagaattggctgggtgtggtggcgcatgcctgtggtcccagctgcttgggaggctgaggcgggagagtcgcttggacctgggaggcggaggttgtggtgagctgagatcgcgccattgcactgcagcctgggaacaagagcgaaactccgtctcagataaataaataaataaacgaataaaaataagaaatacaatttgggag

SEQ ID NO: 133019 - DNA, 218 bp, Homo sapiens
tcgctcctcttctgagccgtgagctgggcagggccgcgctcacatcattcctctccccctgtcgccgggtgggaaatccgtaacaggctctgtggcaaaggctgggccaaggtgcctcgtgggcagccgatccatcaggcggccgacaggcgtgatcgagtgccgtgtcacacgcagcccaggaaacaaacacgccgcgcgaaaggtattggtgaacg

SEQ ID NO: 133020 - DNA, 527 bp, Homo sapiens
ccccaccaggcctgccccaaggtgcgtcagatcttggacatctgggccagtggttgcggtgttgtgtccctacattgcttccagcacgtggtcgctgtggaggcttatacacgggaggcgtgtattgtggaagccctagggatccagacgctcaccaaccagaagcaagggcactgctatggagtggtggcaggctggccacctgctcgtcgccggcgcttgggggtgcacctgctgcaccgtgccctccttgtcttcctggctgaaggcgagcgacagcttcatccccaggacatccaggcccggggctgagtgctggggagttggccatccagcctggggagaaatgtttgaatgttccagctgccccatgctgacagcagcccccatctctggtttcagaaggggtgtgtgtgtgtgtgtgtgtgtgtgtgtgtgtgtgtgtgtgtgtttgtgtgtgtgtgtgtgtgtgtagggagcacccaggcagatctcccccaggctgagagaggactttgttacagatg

SEQ ID NO: 133021 - DNA, 374 bp, Homo sapiens
aaaggtaatatgtaacgaaaacatatgaaagttctatggatataaatagggcacagtggattcagaataagagagaatagcctacttgagaatagctggctgggaaccaaccctgcaaatcaacaaaaggctggaaggaacacatgcaagtcagagcaaggaaacagaggttttgtgtggaggtcatgtgggtgcctccttgggttcaagtcctggcttctctacttacctgtgtgggaccctgggcacattccttaacttctctctcagttttctcatttgtaaagtggggttaacagtatcatctaccccttagggatgaagggattaatgcaggaaatcaccaacagctagtatataggatacatgttcaa

SEQ ID NO: 133022 - DNA, 402 bp, Homo sapiens
taaaaaaatattctggggtgattttaaaaagaagtgaaaagctacttgataatttaattctgccccttgagttcctgcctacgcctagttgttatgctttagttggttaaacacaatattatcactagcaaatcacttattgtgatccccaagcagtagtttgcatccaaaataacttctcctaaagaactttttagtaactccactactgatattgctattaagggaatactgagtctgaaactcaggtttaacatttagctgctgtgtaaattctgttactcaccctctcttgagtctccacttcctcatgcgacaaacagggacactgatacctaccccaccgctctcctcagctcacctccctccaccttggattctatgttctgcccacattcacgt

SEQ ID NO: 133023 - DNA, 419 bp, Homo sapiens
tactttcccacagggtgccctaaagaagacagaaacgtcaaagtgctattttttggcttatgatgtcaatttttcaggattgaagtggcgagcgtcccacagagtttattgcaaactattatgaaggtcttggagttactgttggtatgactcatttatgaaaaaaatatgatttcagtaactgcaggctgtatttgtaatgtgatagattttcatttaatctctcacctctctataatttgcccaatttaaaaatgccctgaagcttgctttctctttgtctgggagccctgttcttggtatgtgttattacaataatagtaataagaaattgtgccaatatgtgtctctcttccagctcttgctgtctccttggtcatttaattacttctggtactgatttcccccagcctgatctc

SEQ ID NO: 133024 - DNA, 121 bp, Homo sapiens
agcacatggaatatggcaggaacatgagagcttgttaagttctgggatggctagagtaccctgtggatggggagtggtggagaagtggctggaagaactcgttggccagatgatggacatt

SEQ ID NO: 133025 - DNA, 368 bp, Homo sapiens
gactttgctgcctcaccgttaatctcatttggatatctcgacttgtcatgtttcagctgttgcttcatctgcctattttatcattactgtctctaggtctatacagcaattattgtccaaaacactctactgttttctggaagtaagtttttgaaaacattttcttttttaccttttacttctgtatcagtcagtataggctacagtgtgctgcagtaataaataaccttgacttcttagtggcttagtataataaagctttttttcctcactcatgctttagctattgattggggctctgcttcaagttatcttcacttcagcatacaagctgatggggctgccaccatgtagaaggttgctatgat

SEQ ID NO: 133026 - DNA, 640 bp, Homo sapiens
acaggcatggcatttcatcatggaaaggaacccatgtcaagcagcctggaatctgcaggcgcacagcgacagaggaagaattaaatgaaggaaaaacactggaaacaaccttcaaaaccacaataataggggattttaacatggttctctgaaatttgacagactgattaggaaaaaaaagactaagggacgacttaagacacatcaccatagactcaatctgacaaggatgttctaaattctgtaccccatggagtcatcatgcttctccagtgtctgtgggacagttatgaaaatgaccaggtatgatagaacaaagaaaccctcaatatatttcaggtaacagcacataggacatgccatttgaccccaagtgcaaaaaaaaaaaaactaaaaatgagcaaaaacaagtagtcccctcacctccaaacgctgttagaaattaaagttcaatccttcaggtaactttattaactcaagcgctttgtgtatttaaggcagcaatgggtcaggcgtggtggctcacacctgtaatcctagcactttgggaggccgaggcaggtggattgcctgagctcagaagtttgaaaccagcccgggcaacacagcgaaaccccgtctctactaaaaaatacaaaaa

SEQ ID NO: 133027 - DNA, 385 bp, Homo sapiens
ggtgccgtgcctgatgtgccgaaaggtgcctctagtgctattacaatgcagacacagtttccatcaatcatatggacagcagctgccaagttctcttttacttggtgagttatggatggcaaagatgtctttcaactatgcacaaaaattggtaaagaactggctaggtgtccatccgtcaggtaggaaggagtgattataactgatctgaaggtagagtgagatacaaaatgccctctgaggatattttacttattcctgagagctgctgctgtctttgaacacctttgaacatttactttttaagacaattagatcaagggaaaaaatcatggaaagcatgattcaaagatcaaattcttcaatttgatgaagtcacacttca

SEQ ID NO: 133028 - DNA, 888 bp, Homo sapiens
  misc_feature (447)..(447): n is a, c, g, or t
ctggggacaaggccagggctaagagggacgagagagccaggaaagtccaggccaagggtgcctcttgaaccttgtggctgaggggagcaggctgttgggatgatcagcagacatggaaagtccttccagctctacccctgtgtatttcccagcgaatgctctcggattttaggacttacctcctaaaattttcacttggtctaaagcaaaaggccccaggctttctgtcaggagctgcaacttttcatctgatgaggagatgaagagatggcacatcagagaaaagtgacaaaggtggcaaaggtgtggagtggtgcgactggcatttccattccagagtgcatcacttcaaaccttacattcctgaggctgttcgtcgaaggcttctcacatctaaactgcagttcatttattgcagagccctgttcacatgggttctcagagacnttttcattctcgcttctcaccacgctggagatgagaactagatgtggttttctagatacagtctacatttccctttgaatctggaagtccggcttcaaggtgatccacaaacatccgagaaggaaagaaacttagaggtaaatgattcaatgattcttaaaacctgactgtggcactcttctccaaatacctctgttctcctccatatttctcagcccctttgaagaggcaggcccatgggatgaattctgaccaatggatttggctaagatttaagagccagtgcaccatccttcagctaactcttctctccacctgctgcaaggacataaacatttcaatggcacaaagatagagcaccttgaattgttactgcaaagaagacatcttttctggagagtcacccaagcagtggatttgtgaataaataaatcttgtgtt

SEQ ID NO: 133029 - DNA, 359 bp, Homo sapiens
tggtttcagctactggagagactgaagtgggaagatctattgagcccaggtcaagtctacagtgagccatgattgtgccatggcactccagcctgggtgacagaatgagaccttatctctttttttttctttgagacatatctacaaatgatattttgccttctttccaatacttgtttttctattttaattaaaagataattctagagtaacaaatacggaataaaagaaatactgcttgacatgtatgatacgttactgattgtattaaaaatgtttctggtctataaactgtattaagcatgacggtatatagccttttatttgagatatttacttgtcatgttgaattatcaatc

SEQ ID NO: 133030 - DNA, 588 bp, Homo sapiens
gtgtggagaacagggaggtaggagtgagggtgaggtggttagtgaaaattaaagactttcctgacagacaaggtagaaaagctgaatgagctcagatctttaaacaaaggagagactcttctacatcatttgggctggagatatgggggatggctaagatgattttcagagaactctgccatgtatcatgagatcagttgtataactgttccaatgaacatttatatttagggtagctgggagcaggaggtgattagcaggtcttaggatcaggtctgctcactgatatataagaatacactgataaaatcaccatgatgatccttatggagccccaaggagatagatcttaaaagagaggctgagctccacagtctttaccatcagtaaatccctgtcccacacaaagtcaagtcagctacataatcaaatccaaaatgtgttcaaatgatgaatcttcacttgccccaaagtggtacaaggatagctttagagaagacagctgaccctaagtgctaggacggtcactcccctaaatgaatgagaaggtgctacttggctggggtcagaaatagagctcaagcattt

SEQ ID NO: 133031 - DNA, 198 bp, Homo sapiens
ggcttacattatccctctgtcttgggagggtatcctctcctggttttagagataccagctcttgttcttctacttagggtctttttctagcaatgggttgttctctggggccttgatcttttacttttaatttttatttatttaattataaaattgagatgaggtcttgatgtgttgctcaggctggtcttgaactcc

SEQ ID NO: 133032 - DNA, 725 bp, Homo sapiens
aatctaaatctacttaattgttaatgattgctttgttttggatccattaattccattgtagactattatttaactttgaggtgacagaagaaatgatttataatggaagctggagaggaacaaatagattaattttctaaaccatttctagtcaaaacgacagtctcataagctatcaaaattcactgtattttgttaatagatctctttattttaaaatgagtaagaacatattttgaatatcagatttttatcctctcatatccaactgattccttattttactgatatgagtgagcatatattcccttaagagtgaattttgaagtattattttaaaaattaacagtaaaattcttctgatactatactggaggtttttgttcccaaagatcaataaattactctataggacataataactcaatgtgtatcctcaaatgaaattgaaattccttccatatacataaaatctgcaaaggaatttatttcagtaggataatagttaatttatagtgtgaagttcaaaaaggcagaagaagataacaactcaatttaggtaaagatgtagcacatataagctggaggaaaatcaatgtcaaatagaaaaccatatctgaaattcagatcatatttagatgcacaaaaaactgttcagagcagtagggggtgattgtattccaattcaatttcctttactcacatcaaccagtcttggtttgaaa

SEQ ID NO: 133033 - DNA, 603 bp, Homo sapiens
tagttaatgttaggaaaacatgtaaatttggatattttatttatacaatatacaaatacttgtcagattgataaaagcagaacaatgacagagacataactggaggaaaatagattggcaaataatttcataatcttgtctaacatgacatcaaaggcaaaaatcataattggagattgatagacttgattgtagatatattaaaacttctatacatataaaacagagaagagactcaaatagcatgaacctaataaatgtttgaaaattgctttttcttgattttttgaggggaaatggaattaatgaatcaataaattctgactaacattccaatatattactgtttgatggcttagtaaagcagaaatttttctgggatagtactaatttgctattttatctcctgaaggcacacagcatcacagaaatttttgtgtgaagaatacataatatatcttagttaaaaataaagatgaaggccaggtgcggtggctcatgcctgtaatcccaacactttgggaggccgaggcaggtggatcacgaggtcaggagattgagaccatcctgactaacacactgaaaccctatctctactaaaaa

SEQ ID NO: 133034 - DNA, 725 bp, Homo sapiens
aggcataaaatctaataatcaaaggagacgttggaagttatgtagtccaaccctcacttccctctctgtgcagataccttttctgtaatatcttgacatagtcattctgtgttccaaaacccttctggtaaagtgatagtcattactttataggccacccaacctattgctaagaagccccgttttagtgaagctctgtagctcacactcactggtctttgcccctggaacagtacagagggaatctgtgacagtctttaggcacattttcttcaagctcctcggcaagctgtatgtatctcagacggtttgactgtcgtgaccccattactacgtacacatttttgtttatcagtgttctacttgagatgttatttaggaacaagtacagtcccgagggtgtggtctggatggcacatagcgacaggactgtccccgttttggatgcccgtgtactatttactaatagagactaaaactattagtgtttctttggttttgtcatcaccttgtactgtcagttccttttgaatttgcttcccccaaaacctccaagtagagttctctttaactcctagatagccaggtttcttgccctgtccctcatcatttagtgtcacctacaaatttgataaagcatgcctacctggttgtccaaataacacattaacttgcttacaaaaacagagatgcatgacttttatcttttttttttttttttggaa

SEQ ID NO: 133035 - DNA, 350 bp, Homo sapiens
aaagaatagaaatcaatgatccagaaaagagacaactaggaaaatcaacacaaaaagacaaatgttggttttgactgatggaaggaaagataaaaggcttacgttactaacaacatgaaatgaaaaacaggaatcactcctgatttagaggtgttaacaggataacgaaagtcatatgaataattttatgccgatgtatttgcaaatttatatgaactagacaaattccttgaaaaacattatttaccaaaagagaaacgactaagaaacagaaaatgtgaacaatagtattatcttttttttcttctgagacagggtctcactctgttatcccggctggagtccagtga

SEQ ID NO: 133036 - DNA, 433 bp, Homo sapiens
tatgcactgcggtggttgccagtggtgccttgaaagatcccctttatctagtatgtgaacccatttcccagctgctgcaaatgttggctgctaacagctcacagctgccttcaatacccagagaattgctcttggctgataggagccactgccctggggtcaatatgcttcacacacctcatcctcaagtggtcagcaaccaatgtcccgctgacactgaagtccaaagaccagccccttgcctcaacatggggataactttatgaaatgatgatacttcagagttcacatggactgggacaagtttagagtaggagtcgggaaactttttctgtaaagggccaggtagtaagcattttagactacataggccatcagtctctgctttgactattcaactctgcctttgtagcatgaatgcagccctagacag

SEQ ID NO: 133037 - DNA, 442 bp, Homo sapiens
caccagggacggggaggcaaggctgagggaaacctccataaacaaaccttgctgaacgaatccttatcttcctagtcacttctccacaactaactgccctagcccatgctcctttgtctggtcacgttttcacaatttactttttgtccaacttcatatataagcattcagttccacctgcttctttggatcttccttttcctatgggaactccaatgtcagacatgacactgatgcttcaaattcatcataatatacgtgaaatcccattcccagtagtcccaagttactctccaaagtgatgtgtttttttattaatgtgctaagtaggcatgaattaaatggcttctctgctgggcattaaaatgtaaaaatctgtatgctttctcctgttaacctgtcttatgtccatttagttctcaggcccagccagacaccctaa

SEQ ID NO: 133038 - DNA, 401 bp, Homo sapiens
atttattttcctcccaaagagacttcatcttaatgattaatgcacattataggatggagaatgaaatacaaacacctctcccttcttgtgtaaagtaggaggagtttccttgtctagatacacagaaacttcaaaagctagcaaagaaattgtgctttaaagaaaaaaaaactacaaaggaaagtgactctggatcacacacagacttagatttccagtctgatgaggcatatccacctcagaaggatttacatgggcatatgttgccaacaggaaaaaaaaaaaagtggagttttatgaactgaaataacactagttctgcctctggtagtagaaaactgacttaccctaaattgctacgggttaactaacttaacttatatcctcttaataattagaga

SEQ ID NO: 133039 - DNA, 147 bp, Homo sapiens
ttttcaaatataagttgttcaaggaacattaggtctcttattgcttgaatcaatggggaaaaagctaaatgatttttgaaaaaggtttgaagcaaccaaaaagataatctttcttttcttctggcagtcaacttaaatgatgaacaa

SEQ ID NO: 133040 - DNA, 388 bp, Homo sapiens
acaatgtatgtgtgatttttttaaaaagaaacttacaggcaaagctgaggggtagagggaatacttggggtggagagtaatttactcttccaggggccaacaagctttaaagtcaatttcaaaaatacacatgcttagtaaaagcatccagatataaaaggtagtgtatttagaattccatttataaaatgttcagaataggcaaattcatagaggtcatgtaaattagtggatgccaggggttagtggacggaagatagggagtgactggtaaagagtacagggtttctttttggggttctaaaactgattgtggtgacagttgtacaactctgtttgaatacactacaaaacaggcaggcacggtggctcatgcctgtaatcccag

SEQ ID NO: 133041 - DNA, 171 bp, Homo sapiens
tcacatatacaggcacaagggtaatctcctcaacttccttcagcaagtcactctactactaaaacatcttcagtggctccctgctgcctacaggataaatccaaattcttttttttttgagagagagtcttgctctgtcgcccaggctggactgcagtggtgcgatctcag

SEQ ID NO: 133042 - DNA, 422 bp, Homo sapiens
aatctgataggtaaaaagaaatggtaactaagtatagttttaattagtaaatcccttttgtaataagtaaaaaatgttttcttttcatatgttctaagatatgtttactaatgtctcataggtacttaggtctatgtcaggatttttattatattctactgatgtaaaagacagtgtgctttctttataaatcatattaagaaaatatgcttctatgccccttcaacaaaaatgttttaagacccattttgtcaaatgtcttttcaggaactgtaaaggtagtcaaaagaaaaatgggcaaaggataggaacaaagaattcaaagaaaaaacagtaatggttctcaaccctcattcattagagaaatacaaattaaaaccaacccatacacaaaaattaaccatggattaacagcctaaata

SEQ ID NO: 133043 - DNA, 268 bp, Homo sapiens
cacagtcctcaacccccagagttccctaagtcaaaccattcttggcttcatgactttggtagatactgccaataatctcccaatatccatcttcccttctattttttttggtaaaagaatccccaagttttacatgagcccagctagagactaatttcttgtcttcttaagcagctagatgtgaccatgtgattctgtctgaaccaaagggactctcacttgtgccttaggtgatggctggctgaagaaatcttgggagccatatatt

SEQ ID NO: 133044 - DNA, 683 bp, Homo sapiens
gaaaaaagattaactatatttccctttttaattactgtgcttttttcttttttaaggtaatatttcattacattaaattttagtgttattctactgagctattccttaaatattatagtattttggatttcacatataaatttgtaacacatcttgagtttattatgtatagagtaaggctattttcttttttttttgttttttaaggtaaaaatcacatagtataaaattaataacaaccattttaaagcatacaatgcagttgcttttagtatattcacaatgttccaggacaatttcatcatgtcccttctaaaaacccattatccataaagttgttacaccctattctgcttccctgagccctaatgaccactaatctgatttatatcccaattgatttgccaattcctgatgtttcatctgaataaaatcaggtaatatttgtctttttgtgcacttaatgctttcaaatttcacccacattataccatgtataagtacttctttctttgttatagctaaaaattgggtgtccatttatgagtcaacaagcatatggattgtttccactttttgactgtatgattattactgctgtaaatattcatgcacatgtttgttatttgagcacctatgttttgtaagattaacagctgacttaacagaaacaatggaaggca

SEQ ID NO: 133045 - DNA, 579 bp, Homo sapiens
cacattttgtttatccatttatccattgattggttgtttctacttttttttagctattatgaataatattgctgtgaacatttgtgtacaaggttttagtggacacaagtttttatttttcttgggtatatatctaggagtggaattgctgggtcatattgtaattctgttcaactttttgaagaacttcccaactgttctccatggtggctgtgccattgtatattcctaccagcagtgtatgaagttacaaatttctccacatcctgagaacccctttattattttctgtttttctttttgattatagccatcctagtaggtgtaaagtggtatctcattgtgattttattttgcatttccctaaatgattaatgatattgagcatcttttcatgtgcttcttggccactagtatatcttctttgaagaaatgtctattcaagtctttggcagtttctaaatgagttattgtctttttgttgttaggttgtaagagttataatctggataacagatccttattagatatgtaatttgcacatattttctcccattttgtgggttgtcttttgtcttt

SEQ ID NO: 133046 - DNA, 496 bp, Homo sapiens
ccaccgtgcccccagccaacaccttcaatcttaagaagagctgtatgctccttttggctctgcagaccttacttatagccaggccttggaaagcagctgccaagacatttacttttagaagttcagttctgttcccagcaggcctctacagaaccttgtgagacagggactcactctgtcacccaggccggagtgcagtggggtgatcatggatcaccgtagccacaacctctggggctcaagcaatcctccatctcactcctccaccaggtagctgggacttcaggcacatgctaccatgcctggcttcaatactgtttttcattaggggaatgtaaattaaaaacagtgagataccactgcataactaccaaaatggttaaaatccaaatcactacaactccaaaagctgaaaggggagcaataataattctcactcattactggtgggaatgcaaaatggtacagccactttggaagatcatgtggcagtttc

SEQ ID NO: 133047 - DNA, 535 bp, Homo sapiens
atgtacacctcacaacacacactctcccaccctcgaactgtttcatatttcttttaaaaatgtactttttttctctcacacacattctcatgttctctcactcccaactttgtaatgaagcccactttttatttagtcaggatcttaaagatcttaccacagacgatcagatttaatcatacaagatgcccctagtgaaggatctctacaataaaaggtcttgacacaaacaaaaatgaagcaagcttcagattagtcagccccactctgcagatggtctttgtgggcttaatgaaagtaggttcaggctgaagaccctggatatacaaattgactaaacaaacatcaatttgtctaccaaagtgcctctgaatcacaaatgagtaaaatcgagttgtcttggaatctgagttatttggctttaaacttggctggcagtaccattaactattgatctgttaatttacaatggtttagaacaagactttgatggaaggtactagagctttgaccataaagtcaataagtctcttat

SEQ ID NO: 133048 - DNA, 146 bp, Homo sapiens
gtataggtggattggttggaaaaagtgggatgcatggatctttttcttcatgtgatctctctagcaggctagctttgggggatcttcagatcatggcctcaggatttcaagtgaagaaaaaagcaggtaatcctcccatgtgcaag

SEQ ID NO: 133049 - DNA, 325 bp, Homo sapiens
tatgtttaatgcccaccaccagtctttagattgatggctctctagttattttggttgtctgaagcatgtcctttggtaggttccttaggaagttcttattcttccatggtgagtataatttgtcagagtactttatatctcaaagtcacttttgctgcatccttagctccttggctcactctttaagcatcttaaatatgctactcccatttttttaaaaataacttaaagcattgctagtgaaaagtatgataattaaatttcttttaaaagtcttcgattttgggtagaggccccccagttttttctcttttttttttttgag

SEQ ID NO: 133050 - DNA, 417 bp, Homo sapiens
aagctggatcacctcacttagaacccaagaatgctcactgagaaaagcccaaggcctgaccatgtgtacacagcccctctggtctgccttccagactgccccgtgctgcctcattctctccctcattcactccaccatgggcttaccagccgcctccttgctgcagggcctcaagtgtaacccatgggctcccaccttaaggcctctgaacttggttccctctgcaaggaatcctcttccccaacatggtcactgggcttctccccatttcattcaggtctcagttccagtgtcattttctcgacctgttttggcgtgacacgggacttcatttccagaggatgtcagacctcaaagaaacaggcacaaattgcaatattctgaggtaactggcgtccaggactcagctgatactta

SEQ ID NO: 133051 - DNA, 224 bp, Homo sapiens
caggcctgcccgatcccgaagcgcattttggccctgggcctctctctggctcagtctgggcgcaaagcgggtctcagcaaccgtcccacttgccttcataccctcccaccacgctccactcagggactccagaaccagcttagacctccattgagagctgaaagcctcttccgataccgagaaccagcactgaaagcctcttccgataccgagaaccagcatgg

SEQ ID NO: 133052 - DNA, 400 bp, Homo sapiens
tgaaaatgttctaaaactgatttatgatgttgattgtacaacttggtaaacttacgttacaaaaatcgctaaatcatacacttggaaaggatgaattataagatatatacaatatgccttaataaacttaggacttgttttattatttatttagagacagggtcttactctgtcgcccaggctggagtgcagtggcatgatcacggctcactgcagccttgacctcctgggctcaagggagcctcccgcttcagcctcgttagtagttaggatcacaggtgcacaccactgtgcctgatgaattttttattttcttgtagagatgatcttgttatgttgcccaggttgtccgaattcctagggtcaagtgatcctcttaccttggcctctcaaagtgctg

SEQ ID NO: 133053 - DNA, 758 bp, Homo sapiens
ccacttaggctaggtacgaggccggggtaatcggccgagggagcaagaggccacctcccatgtggctctagacaccacgtgggctcattagccccagcgtctgtgccggctccaggtgcctgcctctgggtgtgtgagtgggagactttgctccctggcctcatcctagagaggcccctggtgcctagtgctgaggcctctggggctggaaagcctcagcagaaaggaggcactactgagcaactatgcattgtcattgtcgggtttggggctttcggtggttccttggtgactgggaattgcttgtgtgcatgtgttgggtgcatgcttccgggtctcagctgccccaggcccgcacaggcaaccccttcccatccaaagccattggtggagcttctctggaatcatttgccaaaagcccaaggcagaatccaagggtccaagaccatttccatggagctcatgtttttcttttctgtaggaacttttttttaaccagcacccaccataattccgaaggccacgtttcatctttcctggatcactacagtgaagtattacagttgtacagttcccagtctggccttggcttgctcggataaaactttgtatgtattttgtatggcatagattctatattgtaatgatgtcctatgcaaaaagaaaaattaacgaaattgtaaattttattgttttaacgtgtatgcatgtttagtgacgtttacattttgaaataaaatttatgattcattatttta

SEQ ID NO: 133054 - DNA, 436 bp, Homo sapiens
ggctggaaagcctcagcagaaaggaggcactactgaaggcaaccccttcccatccaaagccattggtggagcttctctggaatcatttgccaaaagcccaaggcagaatccaagggtccaagaccatttccatggagctcatgtttttcttttctgtaggaacttttttttaaccagcacccaccataattccgaaggccacgtttcatctttcctggatcactacagtgaagtattacagttgtacagttcccagtctggccttggcttgctcggataaaactttgtatgtattttgtatggcatagattctatattgtaatgatgtcctatgcaaaaagaaaaattaacgaaattgtaaattttattgttttaacgtgtatgcatgtttagtgacgtttacattttgaaataaaatttatgattcattatttta

SEQ ID NO: 133055 - DNA, 5927 bp, Homo sapiens
  misc_feature (716)..(716): n is a, c, g, or t
tcgcaccccaaggcgcacctgagaactcacacaggtgagaggcccttcgcctgcagctggcaggactgcaacaagaagttcgcgcgctccgacgagctggcgcggcactaccgcacacacacgggcgagaagaagttcagctgccccatctgcgagaagcgcttcatgcgcagcgaccacctgaccaagcacgcgcgccgccacgccaacttccacccgggaatgctgcagcggcgcggcgggggctcgcggaccggctccctcagcgactacagccgctccgacgccagcagccccaccatcagcccggccagctcgccctgagcccgccacagccatgagcagccgctcccaccccctcgtgagtccctggcctttccttttgtaataagaaagaagagagagaacttgatgcaaagtccacgaaaaaacaatttttttcacctcaggtgtcaaagtaaatttgttaaaaaaaaaaaaaaaacacaaaaatttcaaaaaacaccacccaccaaattgcacaatagatacacccacaaagttgagattcagcgttgttgaaccccctttctcagggatggacacgtttcacgaggtcagtgaggacaccccttcctgccgccttactctgtacatagatttgcactctggagttttctgttaggttcgggaacacgctggggacagagcaggccagccagtctggtggagctcancgtctggctggctggccagcctgtgggtctgttgggagcagatgtgctcactgacgtttgtgcctccagggcagattcctaagcagctggcctgacctcttcctgcccagcccccaacccagtctctggcctctgcccaacgagcctggctgggcttgcaacgcagctgattctgagacaggcccctgcagagggatgccttaaagctgtccctggctggaggagcactccaccttggggatagtggagggggccttcagccctctgcaccctgcctgcctcacaccccgccttcaggagccctctcctacggcgctagggagcactggaagcagagatgccagccctggctgagcgtagcactgcaccgtccgacctccgaggcaggggccggggtcacacctgccaggactccgcttctccgtgtcccagcagaaggcatgcaggaccctgtcactactatacctgggcctctgatggggaattctggtcttctaaaaagatgttagaaattcctggtggcacatccagttccgagtttgcccgcatgggcacttttgttggaaacagtgggcaggtcatggggcctcctcatcagagggtctgtgtgagcggctgtgcatgtggcagcgcaccatgcttcacagagaccattctgtagcaagagaccggaacattgtgacttggaccttttcaggagtggcgcggatgttacaggaaatgctgtcggagagcgcgcattctatttcctccgcagggaatgccagatagaaagttgcgggcaacacttttctcagacccaccatgtccccaactcagacttagcaaacctccagcctctccgtttcccctggactcctcctcccttttcctcctgcttctccttgtcctgcctggaggctccaggccacacccagctggtggggctgctccagtgccccatcaccggccttctcctggcaggagaggaggagcagagagctgggtcctgggctgggattcgagccctgggcgggggtcagtcaagccgtggtccagcaaactcctctgcagatggctggagtgttgacccaggcttgtggcccaggtatcaccttcccttcctcctgagagttgaggcctgtaaatacaagggcccaggacagagtgtgtgcgtgcgtgtgggtgtgtgcgcgcgtgagcacacacgcgtgtgttggggggggtggggggattggggtggactcagggtatcttgccagagatacctgttttgatgagtacctattttgatgcaaaggaacggccctgggacctcagagggccacagatgggcttcctgggcctagcgtgccttggttgtggccatcctgcttctactcagccctgccatgctatggggtgcagcacaaacccaggacccaggcctagccactgcccacagctgatggtcactgttttggctggctccagagtggacaggtacgctctgtccacagcagctgctcaggcacagtatgccgtcaggtgcccgcttcttaccactgtgtgtcagctgggattggccgacagcgtggtggtgacttctaggtagaccgatggaccctaaattgggcagtggcattgtttctgctgtggtgggaactggcagggagagggtcacctccactctggttggatgcggagctggtccctctggctgccatgctgtgttggggctctctgacctccctgcttgcattgggtctgggagagagagtggaatatttggtagggaccttgacagaagagagccctgggtgcttgtggtgcaaagatcttcatgcccagttccaaagtgaggtccctcccaaagttgttttcgtgtgaggcagagaaagccacactctgaatacattttatgtctcaggaattcacattccaggttcaggaattttattccaaagtcctttggtgcactcaccgtccaccgttccccaaggcagggagagggagtggcccgtccctgggaggctggcaaagtgctctccagggaggggtcagacgtccttgtgatctgcccagggtgtcacggaaggagattttctagctccacatctgtctgcacataggaaggaaaagataggactctaaacctagtcatcttggaataaaaagaagagctggtttgttttagagcagggcggggggtgggggagggaagcgggtgttggctgtttccaaagagagcacttaatttaatttttcctttaaatgacccagggctgttccgtctgatagatggaagggtaacattgccttaaaacagaaatatgcaggcgttggctatttttggcataagagcgtgtcttcattcccaaagtggttctcgtttaatggcagggtgcggtccttaggccccggcctggactgggaaatgggggtagggcaccaggagagaaatcctcctgggtactcctggccagaccctcctgaatcatctgcggcttaaactcatctcgcttgaagggcagggagaaacccatgaatctcaggcacggttcacaggggtcctcaagggcaggtttccatttcatcatgaagtgagggactcctgtggaagagggtggtgggccttggaacgctgcctccactgaggcgggcacacaaggcggaccctcctgaaacagcctccattttcttcaaacatgcagaatgttttcccagactgcgtctatttcagggtcttccatttttgtggtttatggccatgcttgccagttttggtggggttgaggaacccataggactcatagaaataatagtgaaaactcaaacccttattttgggacttcagttctcgtggtccataggggcagagatgtcaaagtgaaggttgcctgagtgaagggagagttcccctataaaaggcctaaaattgatttggggctcagccatcaaggggctggtgttgctcctgtcccagacaaggaagcccctctttacatcagccatattaggggaacggttgtcagctccccaaatgcctactggatcctacagccatacaggaaaacagacggacacagccctttccttaaagagccctggggtcctgtcctgcaggatgctgcataggaatgggcagagatgtcctggatgggaacatggtcctggaggtgccctacctgcatcctgctgcacccccacccacgacactcgagtgcaagatcgcctcactcctaaccctgactttattcccaggccccacaccgaggcaggtgcaggattcgccatggtgcagcctccgggtacaaacatctgaggcactggcgatcccagtccttgcagcaccctgaacacagctcagaccagtgaggggtgattcagaggtggggatgggcagagagggctggccactctgcctcaggacttgacctcaagtgttctgtctccccacccggtgtgtccagaagaccagcctctttcttgccagaagcaggtgctaagatggactgcacagggtcccggcactccctcgggacccattcaggatctcagctgggcaggggtgccacccaacaggaagatgtgatctgagcaatagtgtggccttgtttctccgcttctggttgtggctgtgtgtacagggctacctactattttgacttctgacaggtgtcactgattttctttcccccatttaaaaaaggtcatttagtcaaagacacagtgctagaggtttaaagggtgtaatgtgttggtcacatcacaaccagtaagaaacgcttggtaggttatccacatcttttgctgactgtttccatatacaattctggtcaccatattttccaaagctaaaatctgaggcgtgggctgatggtttttgaaatcaggattaccccaggaagaaccaggtcctattactaattttcctgattctgaggctctgaaggcttgtctgagacacattccggagacctttgtaccagaacttggatgcatagtccaccttactactgatacacgcctgagcaccctttagggcgaggcgccgcctcctgcctgctgtcctgtccctcagcatcagaagagttgaattcagcaggagacgggagcccggtgtccatgagggaagaggggtcgcgcttggtttctactgacccccatgaagatttcagacttgcagtgcggccacctggccctgccctgcctctctctttctcatacagctttaaaactttactacttttatttaaaaatgaactggatgggagagaagtagcgtcccctaccctacaagtcacacattccggggaggggggtggggggtggaggcaggaagtcatgggggtgggggtgggagcacgggaacagctttcttaaggcctcagggtcctgttttccctggcctcttctagagggcccgtggacaggtcgcagtgcgtgcttatttggaaaccaggtgtgtgagccgaatgcctgccaggccatgcactcagcagaggagcccttgtacctggctgccctgagaggagcaagaggccacctcccatgtggctctagacaccacgtgggctcattagccccagcgtctgtgccggctccaggtgcctgcctctgggtgtgtgagtgggagactttgctccctggcctcatcctagagaggcccctggtgcctagtgctgaggcctctggggctggaaagcctcagcagaaaggaggcactactgagcaactatgcattgtcattgtcgggtttggggctttcggtggttccttggtgactgggaattgcttgtgtgcatgtgttgggtgcatgcttccgggtctcagctgccccaggcccgcacaggcaaccccttcccatccaaagccattggtggagcttctctggaatcatttgccaaaagcccaaggcagaatccaagggtccaagaccatttccatggagctcatgtttttcttttctgtaggaacttttttttaaccagcacccaccataattccgaaggccacgtttcatctttcctggatcactacagtgaagtattacagttgtacagttcccagtctggccttggcttgctcggataaaactttgtatgtattttgtatggcatagattctatattgtaatgatgtcctatgcaaaaagaaaaattaacgaaattgtaaattttattgttttaacgtgtatgcatgtttagtgacgtttacattttgaaataaaatttatgattcattatttta

SEQ ID NO: 133056 - DNA, 5988 bp, Homo sapiens
  misc_feature (777)..(777): n is a, c, g, or t
tctgtatgacttagaggatcccgcgtggctccttcagagagggtgtgaaggcggggccaggtgcggatactgatgctctgcccctgtgcccacaggtgagaggcccttcgcctgcagctggcaggactgcaacaagaagttcgcgcgctccgacgagctggcgcggcactaccgcacacacacgggcgagaagaagttcagctgccccatctgcgagaagcgcttcatgcgcagcgaccacctgaccaagcacgcgcgccgccacgccaacttccacccgggaatgctgcagcggcgcggcgggggctcgcggaccggctccctcagcgactacagccgctccgacgccagcagccccaccatcagcccggccagctcgccctgagcccgccacagccatgagcagccgctcccaccccctcgtgagtccctggcctttccttttgtaataagaaagaagagagagaacttgatgcaaagtccacgaaaaaacaatttttttcacctcaggtgtcaaagtaaatttgttaaaaaaaaaaaaaaaacacaaaaatttcaaaaaacaccacccaccaaattgcacaatagatacacccacaaagttgagattcagcgttgttgaaccccctttctcagggatggacacgtttcacgaggtcagtgaggacaccccttcctgccgccttactctgtacatagatttgcactctggagttttctgttaggttcgggaacacgctggggacagagcaggccagccagtctggtggagctcancgtctggctggctggccagcctgtgggtctgttgggagcagatgtgctcactgacgtttgtgcctccagggcagattcctaagcagctggcctgacctcttcctgcccagcccccaacccagtctctggcctctgcccaacgagcctggctgggcttgcaacgcagctgattctgagacaggcccctgcagagggatgccttaaagctgtccctggctggaggagcactccaccttggggatagtggagggggccttcagccctctgcaccctgcctgcctcacaccccgccttcaggagccctctcctacggcgctagggagcactggaagcagagatgccagccctggctgagcgtagcactgcaccgtccgacctccgaggcaggggccggggtcacacctgccaggactccgcttctccgtgtcccagcagaaggcatgcaggaccctgtcactactatacctgggcctctgatggggaattctggtcttctaaaaagatgttagaaattcctggtggcacatccagttccgagtttgcccgcatgggcacttttgttggaaacagtgggcaggtcatggggcctcctcatcagagggtctgtgtgagcggctgtgcatgtggcagcgcaccatgcttcacagagaccattctgtagcaagagaccggaacattgtgacttggaccttttcaggagtggcgcggatgttacaggaaatgctgtcggagagcgcgcattctatttcctccgcagggaatgccagatagaaagttgcgggcaacacttttctcagacccaccatgtccccaactcagacttagcaaacctccagcctctccgtttcccctggactcctcctcccttttcctcctgcttctccttgtcctgcctggaggctccaggccacacccagctggtggggctgctccagtgccccatcaccggccttctcctggcaggagaggaggagcagagagctgggtcctgggctgggattcgagccctgggcgggggtcagtcaagccgtggtccagcaaactcctctgcagatggctggagtgttgacccaggcttgtggcccaggtatcaccttcccttcctcctgagagttgaggcctgtaaatacaagggcccaggacagagtgtgtgcgtgcgtgtgggtgtgtgcgcgcgtgagcacacacgcgtgtgttggggggggtggggggattggggtggactcagggtatcttgccagagatacctgttttgatgagtacctattttgatgcaaaggaacggccctgggacctcagagggccacagatgggcttcctgggcctagcgtgccttggttgtggccatcctgcttctactcagccctgccatgctatggggtgcagcacaaacccaggacccaggcctagccactgcccacagctgatggtcactgttttggctggctccagagtggacaggtacgctctgtccacagcagctgctcaggcacagtatgccgtcaggtgcccgcttcttaccactgtgtgtcagctgggattggccgacagcgtggtggtgacttctaggtagaccgatggaccctaaattgggcagtggcattgtttctgctgtggtgggaactggcagggagagggtcacctccactctggttggatgcggagctggtccctctggctgccatgctgtgttggggctctctgacctccctgcttgcattgggtctgggagagagagtggaatatttggtagggaccttgacagaagagagccctgggtgcttgtggtgcaaagatcttcatgcccagttccaaagtgaggtccctcccaaagttgttttcgtgtgaggcagagaaagccacactctgaatacattttatgtctcaggaattcacattccaggttcaggaattttattccaaagtcctttggtgcactcaccgtccaccgttccccaaggcagggagagggagtggcccgtccctgggaggctggcaaagtgctctccagggaggggtcagacgtccttgtgatctgcccagggtgtcacggaaggagattttctagctccacatctgtctgcacataggaaggaaaagataggactctaaacctagtcatcttggaataaaaagaagagctggtttgttttagagcagggcggggggtgggggagggaagcgggtgttggctgtttccaaagagagcacttaatttaatttttcctttaaatgacccagggctgttccgtctgatagatggaagggtaacattgccttaaaacagaaatatgcaggcgttggctatttttggcataagagcgtgtcttcattcccaaagtggttctcgtttaatggcagggtgcggtccttaggccccggcctggactgggaaatgggggtagggcaccaggagagaaatcctcctgggtactcctggccagaccctcctgaatcatctgcggcttaaactcatctcgcttgaagggcagggagaaacccatgaatctcaggcacggttcacaggggtcctcaagggcaggtttccatttcatcatgaagtgagggactcctgtggaagagggtggtgggccttggaacgctgcctccactgaggcgggcacacaaggcggaccctcctgaaacagcctccattttcttcaaacatgcagaatgttttcccagactgcgtctatttcagggtcttccatttttgtggtttatggccatgcttgccagttttggtggggttgaggaacccataggactcatagaaataatagtgaaaactcaaacccttattttgggacttcagttctcgtggtccataggggcagagatgtcaaagtgaaggttgcctgagtgaagggagagttcccctataaaaggcctaaaattgatttggggctcagccatcaaggggctggtgttgctcctgtcccagacaaggaagcccctctttacatcagccatattaggggaacggttgtcagctccccaaatgcctactggatcctacagccatacaggaaaacagacggacacagccctttccttaaagagccctggggtcctgtcctgcaggatgctgcataggaatgggcagagatgtcctggatgggaacatggtcctggaggtgccctacctgcatcctgctgcacccccacccacgacactcgagtgcaagatcgcctcactcctaaccctgactttattcccaggccccacaccgaggcaggtgcaggattcgccatggtgcagcctccgggtacaaacatctgaggcactggcgatcccagtccttgcagcaccctgaacacagctcagaccagtgaggggtgattcagaggtggggatgggcagagagggctggccactctgcctcaggacttgacctcaagtgttctgtctccccacccggtgtgtccagaagaccagcctctttcttgccagaagcaggtgctaagatggactgcacagggtcccggcactccctcgggacccattcaggatctcagctgggcaggggtgccacccaacaggaagatgtgatctgagcaatagtgtggccttgtttctccgcttctggttgtggctgtgtgtacagggctacctactattttgacttctgacaggtgtcactgattttctttcccccatttaaaaaaggtcatttagtcaaagacacagtgctagaggtttaaagggtgtaatgtgttggtcacatcacaaccagtaagaaacgcttggtaggttatccacatcttttgctgactgtttccatatacaattctggtcaccatattttccaaagctaaaatctgaggcgtgggctgatggtttttgaaatcaggattaccccaggaagaaccaggtcctattactaattttcctgattctgaggctctgaaggcttgtctgagacacattccggagacctttgtaccagaacttggatgcatagtccaccttactactgatacacgcctgagcaccctttagggcgaggcgccgcctcctgcctgctgtcctgtccctcagcatcagaagagttgaattcagcaggagacgggagcccggtgtccatgagggaagaggggtcgcgcttggtttctactgacccccatgaagatttcagacttgcagtgcggccacctggccctgccctgcctctctctttctcatacagctttaaaactttactacttttatttaaaaatgaactggatgggagagaagtagcgtcccctaccctacaagtcacacattccggggaggggggtggggggtggaggcaggaagtcatgggggtgggggtgggagcacgggaacagctttcttaaggcctcagggtcctgttttccctggcctcttctagagggcccgtggacaggtcgcagtgcgtgcttatttggaaaccaggtgtgtgagccgaatgcctgccaggccatgcactcagcagaggagcccttgtacctggctgccctgagaggagcaagaggccacctcccatgtggctctagacaccacgtgggctcattagccccagcgtctgtgccggctccaggtgcctgcctctgggtgtgtgagtgggagactttgctccctggcctcatcctagagaggcccctggtgcctagtgctgaggcctctggggctggaaagcctcagcagaaaggaggcactactgagcaactatgcattgtcattgtcgggtttggggctttcggtggttccttggtgactgggaattgcttgtgtgcatgtgttgggtgcatgcttccgggtctcagctgccccaggcccgcacaggcaaccccttcccatccaaagccattggtggagcttctctggaatcatttgccaaaagcccaaggcagaatccaagggtccaagaccatttccatggagctcatgtttttcttttctgtaggaacttttttttaaccagcacccaccataattccgaaggccacgtttcatctttcctggatcactacagtgaagtattacagttgtacagttcccagtctggccttggcttgctcggataaaactttgtatgtattttgtatggcatagattctatattgtaatgatgtcctatgcaaaaagaaaaattaacgaaattgtaaattttattgttttaacgtgtatgcatgtttagtgacgtttacattttgaaataaaatttatgattcattatttta

SEQ ID NO: 133057 - DNA, 2043 bp, Homo sapiens
gggcgatatggtcgcttgtatgtgcggttctcttttttttctttcccctctatggccccacaccgaggcaggtgcaggattcgccatggtgcagcctccgggtacaaacatctgaggcactggcgatcccagtccttgcagcaccctgaacacagctcagaccagtgaggggtgattcagaggtggggatgggcagagagggctggccactctgcctcaggacttgacctcaagtgttctgtctccccacccggtgtgtccagaagaccagcctctttcttgccagaagcaggtgctaagatggactgcacagggtcccggcactccctcgggacccattcaggatctcagctgggcaggggtgccacccaacaggaagatgtgatctgagcaatagtgtggccttgtttctccgcttctggttgtggctgtgtgtacagggctacctactattttgacttctgacaggtgtcactgattttctttcccccatttaaaaaaggtcatttagtcaaagacacagtgctagaggtttaaagggtgtaatgtgttggtcacatcacaaccagtaagaaacgcttggtaggttatccacatcttttgctgactgtttccatatacaattctggtcaccatattttccaaagctaaaatctgaggcgtgggctgatggtttttgaaatcaggattaccccaggaagaaccaggtcctattactaattttcctgattctgaggctctgaaggcttgtctgagacacattccggagacctttgtaccagaacttggatgcatagtccaccttactactgatacacgcctgagcaccctttagggcgaggcgccgcctcctgcctgctgtcctgtccctcagcatcagaagagttgaattcagcaggagacgggagcccggtgtccatgagggaagaggggtcgcgcttggtttctactgacccccatgaagatttcagacttgcagtgcggccacctggccctgccctgcctctctctttctcatacagctttaaaactttactacttttatttaaaaatgaactggatgggagagaagtagcgtcccctaccctacaagtcacacattccggggaggggggtggggggtggaggcaggaagtcatgggggtgggggtgggagcacgggaacagctttcttaaggcctcagggtcctgttttccctggcctcttctagagggcccgtggacaggtcgcagtgcgtgcttatttggaaaccaggtgtgtgagccgaatgcctgccaggccatgcactcagcagaggagcccttgtacctggctgccctgagaggagcaagaggccacctcccatgtggctctagacaccacgtgggctcattagccccagcgtctgtgccggctccaggtgcctgcctctgggtgtgtgagtgggagactttgctccctggcctcatcctagagaggcccctggtgcctagtgctgaggcctctggggctggaaagcctcagcagaaaggaggcactactgagcaactatgcattgtcattgtcgggtttggggctttcggtggttccttggtgactgggaattgcttgtgtgcatgtgttgggtgcatgcttccgggtctcagctgccccaggcccgcacaggcaaccccttcccatccaaagccattggtggagcttctctggaatcatttgccaaaagcccaaggcagaatccaagggtccaagaccatttccatggagctcatgtttttcttttctgtaggaacttttttttaaccagcacccaccataattccgaaggccacgtttcatctttcctggatcactacagtgaagtattacagttgtacagttcccagtctggccttggcttgctcggataaaactttgtatgtattttgtatggcatagattctatattgtaatgatgtcctatgcaaaaagaaaaattaacgaaattgtaaattttattgttttaacgtgtatgcatgtttagtgacgtttacattttgaaataaaatttatgattcattatttta

SEQ ID NO: 133058 - DNA, 5873 bp, Homo sapiens
  misc_feature (716)..(716): n is a, c, g, or t
tcgcaccccaaggcgcacctgagaactcacacaggtgagaggcccttcgcctgcagctggcaggactgcaacaagaagttcgcgcgctccgacgagctggcgcggcactaccgcacacacacgggcgagaagaagttcagctgccccatctgcgagaagcgcttcatgcgcagcgaccacctgaccaagcacgcgcgccgccacgccaacttccacccgggaatgctgcagcggcgcggcgggggctcgcggaccggctccctcagcgactacagccgctccgacgccagcagccccaccatcagcccggccagctcgccctgagcccgccacagccatgagcagccgctcccaccccctcgtgagtccctggcctttccttttgtaataagaaagaagagagagaacttgatgcaaagtccacgaaaaaacaatttttttcacctcaggtgtcaaagtaaatttgttaaaaaaaaaaaaaaaacacaaaaatttcaaaaaacaccacccaccaaattgcacaatagatacacccacaaagttgagattcagcgttgttgaaccccctttctcagggatggacacgtttcacgaggtcagtgaggacaccccttcctgccgccttactctgtacatagatttgcactctggagttttctgttaggttcgggaacacgctggggacagagcaggccagccagtctggtggagctcancgtctggctggctggccagcctgtgggtctgttgggagcagatgtgctcactgacgtttgtgcctccagggcagattcctaagcagctggcctgacctcttcctgcccagcccccaacccagtctctggcctctgcccaacgagcctggctgggcttgcaacgcagctgattctgagacaggcccctgcagagggatgccttaaagctgtccctggctggaggagcactccaccttggggatagtggagggggccttcagccctctgcaccctgcctgcctcacaccccgccttcaggagccctctcctacggcgctagggagcactggaagcagagatgccagccctggctgagcgtagcactgcaccgtccgacctccgaggcaggggccggggtcacacctgccaggactccgcttctccgtgtcccagcagaaggcatgcaggaccctgtcactactatacctgggcctctgatggggaattctggtcttctaaaaagatgttagaaattcctggtggcacatccagttccgagtttgcccgcatgggcacttttgttggaaacagtgggcaggtcatggggcctcctcatcagagggtctgtgtgagcggctgtgcatgtggcagcgcaccatgcttcacagagaccattctgtagcaagagaccggaacattgtgacttggaccttttcaggagtggcgcggatgttacaggaaatgctgtcggagagcgcgcattctatttcctccgcagggaatgccagatagaaagttgcgggcaacacttttctcagacccaccatgtccccaactcagacttagcaaacctccagcctctccgtttcccctggactcctcctcccttttcctcctgcttctccttgtcctgcctggaggctccaggccacacccagctggtggggctgctccagtgccccatcaccggccttctcctggcaggagaggaggagcagagagctgggtcctgggctgggattcgagccctgggcgggggtcagtcaagccgtggtccagcaaactcctctgcagatggctggagtgttgacccaggcttgtggcccaggtatcaccttcccttcctcctgagagttgaggcctgtaaatacaagggcccaggacagagtgtgtgcgtgcgtgtgggtgtgtgcgcgcgtgagcacacacgcgtgtgttggggggggtggggggattggggtggactcagggtatcttgccagagatacctgttttgatgagtacctattttgatgcaaaggaacggccctgggacctcagagggccacagatgggcttcctgggcctagcgtgccttggttgtggccatcctgcttctactcagccctgccatgctatggggtgcagcacaaacccaggacccaggcctagccactgcccacagctgatggtcactgttttggctggctccagagtggacaggtacgctctgtccacagcagctgctcaggcacagtatgccgtcaggtgcccgcttcttaccactgtgtgtcagctgggattggccgacagcgtggtggtgacttctaggtagaccgatggaccctaaattgggcagtggcattgtttctgctgtggtgggaactggcagggagagggtcacctccactctggttggatgcggagctggtccctctggctgccatgctgtgttggggctctctgacctccctgcttgcattgggtctgggagagagagtggaatatttggtagggaccttgacagaagagagccctgggtgcttgtggtgcaaagatcttcatgcccagttccaaagtgaggtccctcccaaagttgttttcgtgtgaggcagagaaagccacactctgaatacattttatgtctcaggaattcacattccaggttcaggaattttattccaaagtcctttggtgcactcaccgtccaccgttccccaaggcagggagagggagtggcccgtccctgggaggctggcaaagtgctctccagggaggggtcagacgtccttgtgatctgcccagggtgtcacggaaggagattttctagctccacatctgtctgcacataggaaggaaaagataggactctaaacctagtcatcttggaataaaaagaagagctggtttgttttagagcagggcggggggtgggggagggaagcgggtgttggctgtttccaaagagagcacttaatttaatttttcctttaaatgacccagggctgttccgtctgatagatggaagggtaacattgccttaaaacagaaatatgcaggcgttggctatttttggcataagagcgtgtcttcattcccaaagtggttctcgtttaatggcagggtgcggtccttaggccccggcctggactgggaaatgggggtagggcaccaggagagaaatcctcctgggtactcctggccagaccctcctgaatcatctgcggcttaaactcatctcgcttgaagggcagggagaaacccatgaatctcaggcacggttcacaggggtcctcaagggcaggtttccatttcatcatgaagtgagggactcctgtggaagagggtggtgggccttggaacgctgcctccactgaggcgggcacacaaggcggaccctcctgaaacagcctccattttcttcaaacatgcagaatgttttcccagactgcgtctatttcagggtcttccatttttgtggtttatggccatgcttgccagttttggtggggttgaggaacccataggactcatagaaataatagtgaaaactcaaacccttattttgggacttcagttctcgtggtccataggggcagagatgtcaaagtgaaggttgcctgagtgaagggagagttcccctataaaaggcctaaaattgatttggggctcagccatcaaggggctggtgttgctcctgtcccagacaaggaagcccctctttacatcagccatattaggggaacggttgtcagctccccaaatgcctactggatcctacagccatacaggaaaacagacggacacagccctttccttaaagagccctggggtcctgtcctgcaggatgctgcataggaatgggcagagatgtcctggatgggaacatggtcctggaggtgccctacctgcatcctgctgcacccccacccacgacactcgagtgcaagatcgcctcactcctaaccctgactttattcccaggccccacaccgaggcaggtgcaggattcgccatggtgcagcctccgggtacaaacatctgaggcactggcgatcccagtccttgcagcaccctgaacacagctcagaccagtgaggggtgattcagaggtggggatgggcagagagggctggccactctgcctcaggacttgacctcaagtgttctgtctccccacccggtgtgtccagaagaccagcctctttcttgccagaagcaggtgctaagatggactgcacagggtcccggcactccctcgggacccattcaggatctcagctgggcaggggtgccacccaacaggaagatgtgatctgagcaatagtgtggccttgtttctccgcttctggttgtggctgtgtgtacagggctacctactattttgacttctgacaggtgtcactgattttctttcccccatttaaaaaaggtcatttagtcaaagacacagtgctagaggtttaaagggtgtaatgtgttggtcacatcacaaccagtaagaaacgcttggtaggttatccacatcttttgctgactgtttccatatacaattctggtcaccatattttccaaagctaaaatctgaggcgtgggctgatggtttttgaaatcaggattaccccaggaagaaccaggtcctattactaattttcctgattctgaggctctgaaggcttgtctgagacacattccggagacctttgtaccagaacttggatgcatagtccaccttactactgatacacgcctgagcaccctttagggcgaggcgccgcctcctgcctgctgtcctgtccctcagcatcagaagagttgaattcagcaggagacgggagcccggtgtccatgagggaagaggggtcgcgcttggtttctactgacccccatgaagatttcagacttgcagtgcggccacctggccctgccctgcctctctctttctcatacagctttaaaactttactacttttatttaaaaatgaactggatgggagagaagtagcgtcccctaccctacaagtcacacattccggggaggggggtggggggtggaggcaggaagtcatgggggtgggggtgggagcacgggaacagctttcttaaggcctcagggtcctgttttccctggcctcttctagagggcccgtggacaggtcgcagtgcgtgcttatttggaaaccaggtgtgtgagccgaatgcctgccaggccatgcactcagcagaggagcccttgtacctggctgccctgagaggagcaagaggccacctcccatgtggctctagacaccacgtgggctcattagccccagcgtctgtgccggctccaggtgcctgcctctgggtgtgtgagtgggagactttgctccctggcctcatcctagagaggcccctggtgcctagtgctgaggcctctggggctggaaagcctcagcagaaaggaggcactactgagcaactatgcattgtcattgtcgggtttggggctttcggtggttccttggtgactgggaattgcttgtgtgcatgtgttgggtgcatgcttccgggtctcagctgccccaggcccgcacaggcaaccccttcccatccaaagccattggtggagcttctctggaatcatttgcctttcttttctgtaggaacttttttttaaccagcacccaccataattccgaaggccacgtttcatctttcctggatcactacagtgaagtattacagttgtacagttcccagtctggccttggcttgctcggataaaactttgtatgtattttgtatggcatagattctatattgtaatgatgtcctatgcaaaaagaaaaattaacgaaattgtaaattttattgttttaacgtgtatgcatgtttagtgacgtttacattttgaaataaaatttatgattcattatttta

SEQ ID NO: 133059 - DNA, 5467 bp, Homo sapiens
  misc_feature (716)..(716): n is a, c, g, or t
tcgcaccccaaggcgcacctgagaactcacacaggtgagaggcccttcgcctgcagctggcaggactgcaacaagaagttcgcgcgctccgacgagctggcgcggcactaccgcacacacacgggcgagaagaagttcagctgccccatctgcgagaagcgcttcatgcgcagcgaccacctgaccaagcacgcgcgccgccacgccaacttccacccgggaatgctgcagcggcgcggcgggggctcgcggaccggctccctcagcgactacagccgctccgacgccagcagccccaccatcagcccggccagctcgccctgagcccgccacagccatgagcagccgctcccaccccctcgtgagtccctggcctttccttttgtaataagaaagaagagagagaacttgatgcaaagtccacgaaaaaacaatttttttcacctcaggtgtcaaagtaaatttgttaaaaaaaaaaaaaaaacacaaaaatttcaaaaaacaccacccaccaaattgcacaatagatacacccacaaagttgagattcagcgttgttgaaccccctttctcagggatggacacgtttcacgaggtcagtgaggacaccccttcctgccgccttactctgtacatagatttgcactctggagttttctgttaggttcgggaacacgctggggacagagcaggccagccagtctggtggagctcancgtctggctggctggccagcctgtgggtctgttgggagcagatgtgctcactgacgtttgtgcctccagggcagattcctaagcagctggcctgacctcttcctgcccagcccccaacccagtctctggcctctgcccaacgagcctggctgggcttgcaacgcagctgattctgagacaggcccctgcagagggatgccttaaagctgtccctggctggaggagcactccaccttggggatagtggagggggccttcagccctctgcaccctgcctgcctcacaccccgccttcaggagccctctcctacggcgctagggagcactggaagcagagatgccagccctggctgagcgtagcactgcaccgtccgacctccgaggcaggggccggggtcacacctgccaggactccgcttctccgtgtcccagcagaaggcatgcaggaccctgtcactactatacctgggcctctgatggggaattctggtcttctaaaaagatgttagaaattcctggtggcacatccagttccgagtttgcccgcatgggcacttttgttggaaacagtgggcaggtcatggggcctcctcatcagagggtctgtgtgagcggctgtgcatgtggcagcgcaccatgcttcacagagaccattctgtagcaagagaccggaacattgtgacttggaccttttcaggagtggcgcggatgttacaggaaatgctgtcggagagcgcgcattctatttcctccgcagggaatgccagatagaaagttgcgggcaacacttttctcagacccaccatgtccccaactcagacttagcaaacctccagcctctccgtttcccctggactcctcctcccttttcctcctgcttctccttgtcctgcctggaggctccaggccacacccagctggtggggctgctccagtgccccatcaccggccttctcctggcaggagaggaggagcagagagctgggtcctgggctgggattcgagccctgggcgggggtcagtcaagccgtggtccagcaaactcctctgcagatggctggagtgttgacccaggcttgtggcccaggtatcaccttcccttcctcctgagagttgaggcctgtaaatacaagggcccaggacagagtgtgtgcgtgcgtgtgggtgtgtgcgcgcgtgagcacacacgcgtgtgttggggggggtggggggattggggtggactcagggtatcttgccagagatacctgttttgatgagtacctattttgatgcaaaggaacggccctgggacctcagagggccacagatgggcttcctgggcctagcgtgccttggttgtggccatcctgcttctactcagccctgccatgctatggggtgcagcacaaacccaggacccaggcctagccactgcccacagctgatggtcactgttttggctggctccagagtggacaggtacgctctgtccacagcagctgctcaggcacagtatgccgtcaggtgcccgcttcttaccactgtgtgtcagctgggattggccgacagcgtggtggtgacttctaggtagaccgatggaccctaaattgggcagtggcattgtttctgctgtggtgggaactggcagggagagggtcacctccactctggttggatgcggagctggtccctctggctgccatgctgtgttggggctctctgacctccctgcttgcattgggtctgggagagagagtggaatatttggtagggaccttgacagaagagagccctgggtgcttgtggtgcaaagatcttcatgcccagttccaaagtgaggtccctcccaaagttgttttcgtgtgaggcagagaaagccacactctgaatacattttatgtctcaggaattcacattccaggttcaggaattttattccaaagtcctttggtgcactcaccgtccaccgttccccaaggcagggagagggagtggcccgtccctgggaggctggcaaagtgctctccagggaggggtcagacgtccttgtgatctgcccagggtgtcacggaaggagattttctagctccacatctgtctgcacataggaaggaaaagataggactctaaacctagtcatcttggaataaaaagaagagctggtttgttttagagcagggcggggggtgggggagggaagcgggtgttggctgtttccaaagagagcacttaatttaatttttcctttaaatgacccagggctgttccgtctgatagatggaagggtaacattgccttaaaacagaaatatgcaggcgttggctatttttggcataagagcgtgtcttcattcccaaagtggttctcgtttaatggcagggtgcggtccttaggccccggcctggactgggaaatgggggtagggcaccaggagagaaatcctcctgggtactcctggccagaccctcctgaatcatctgcggcttaaactcatctcgcttgaagggcagggagaaacccatgaatctcaggcacggttcacaggggtcctcaagggcaggtttccatttcatcatgaagtgagggactcctgtggaagagggtggtgggccttggaacgctgcctccactgaggcgggcacacaaggcggaccctcctgaaacagcctccattttcttcaaacatgcagaatgttttcccagactgcgtctatttcagggtcttccatttttgtggtttatggccatgcttgccagttttggtggggttgaggaacccataggactcatagaaataatagtgaaaactcaaacccttattttgggacttcagttctcgtggtccataggggcagagatgtcaaagtgaaggttgcctgagtgaagggagagttcccctataaaaggcctaaaattgatttggggctcagccatcaaggggctggtgttgctcctgtcccagacaaggaagcccctctttacatcagccatattaggggaacggttgtcagctccccaaatgcctactggatcctacagccatacaggaaaacagacggacacagccctttccttaaagagccctggggtcctgtcctgcaggatgctgcataggaatgggcagagatgtcctggatgggaacatggtcctggaggtgccctacctgcatcctgctgcacccccacccacgacactcgagtgcaagatcgcctcactcctaaccctgactttattcccaggccccacaccgaggcaggtgcaggattcgccatggtgcagcctccgggtacaaacatctgaggcactggcgatcccagtccttgcagcaccctgaacacagctcagaccagtgaggggtgattcagaggtggggatgggcagagagggctggccactctgcctcaggacttgacctcaagtgttctgtctccccacccggtgtgtccagaagaccagcctctttcttgccagaagcaggtgctaagatggactgcacagggtcccggcactccctcgggacccattcaggatctcagctgggcaggggtgccacccaacaggaagatgtgatctgagcaatagtgtggccttgtttctccgcttctggttgtggctgtgtgtacagggctacctactattttgacttctgacaggtgtcactgattttctttcccccatttaaaaaaggtcatttagtcaaagacacagtgctagaggtttaaagggtgtaatgtgttggtcacatcacaaccagtaagaaacgcttggtaggttatccacatcttttgctgactgtttccatatacaattctggtcaccatattttccaaagctaaaatctgaggcgtgggctgatggtttttgaaatcaggattaccccaggaagaaccaggtcctattactaattttcctgattctgaggctctgaaggcttgtctgagacacattccggagacctttgtaccagaacttggatgcatagtccaccttactactgatacacgcctgagcaccctttagggcgaggcgccgcctcctgcctgctgtcctgtccctcagcatcagaagagttgaattcagcaggagacgggagcccggtgtccatgagggaagaggggtcgcgcttggtttctactgacccccatgaagatttcagacttgcagtgcggccacctggccctgccctgcctctctctttctcatacagctttaaaactttactacttttatttaaaaatgaactggatgggagagaagtagcgtcccctaccctacaagtcacacattccggggaggggggtggggggtggaggcaggaagtcatgggggtgggggtgggagcacgggaacagctttcttaaggcctcagggtcctgttttccctggcctcttctagagggcccgtggacaggtcgcagtgcgtgcttatttggaaaccaggtgtgtgagccgaatgcctgccaggccatgcactcagccatcaaggggctggtgttgctcctgtcccagacaaggaagcccctctttacatcagccatattaggggaacggttgtcagctccccaaatgcctactggatcctacagccatacaggaaaacagacggacacagccctttccttaaagagccctggggtcctgtcctgcaggatgctgcataggaatgggcagagatgtcctggatgggaacatggtcctggaggtgccctacctgcatcctgctgcacccccacccacgacactcgagtgcaagatcgcctcactccta

SEQ ID NO: 133060 - DNA, 5238 bp, Homo sapiens
  misc_feature (716)..(716): n is a, c, g, or t
tcgcaccccaaggcgcacctgagaactcacacaggtgagaggcccttcgcctgcagctggcaggactgcaacaagaagttcgcgcgctccgacgagctggcgcggcactaccgcacacacacgggcgagaagaagttcagctgccccatctgcgagaagcgcttcatgcgcagcgaccacctgaccaagcacgcgcgccgccacgccaacttccacccgggaatgctgcagcggcgcggcgggggctcgcggaccggctccctcagcgactacagccgctccgacgccagcagccccaccatcagcccggccagctcgccctgagcccgccacagccatgagcagccgctcccaccccctcgtgagtccctggcctttccttttgtaataagaaagaagagagagaacttgatgcaaagtccacgaaaaaacaatttttttcacctcaggtgtcaaagtaaatttgttaaaaaaaaaaaaaaaacacaaaaatttcaaaaaacaccacccaccaaattgcacaatagatacacccacaaagttgagattcagcgttgttgaaccccctttctcagggatggacacgtttcacgaggtcagtgaggacaccccttcctgccgccttactctgtacatagatttgcactctggagttttctgttaggttcgggaacacgctggggacagagcaggccagccagtctggtggagctcancgtctggctggctggccagcctgtgggtctgttgggagcagatgtgctcactgacgtttgtgcctccagggcagattcctaagcagctggcctgacctcttcctgcccagcccccaacccagtctctggcctctgcccaacgagcctggctgggcttgcaacgcagctgattctgagacaggcccctgcagagggatgccttaaagctgtccctggctggaggagcactccaccttggggatagtggagggggccttcagccctctgcaccctgcctgcctcacaccccgccttcaggagccctctcctacggcgctagggagcactggaagcagagatgccagccctggctgagcgtagcactgcaccgtccgacctccgaggcaggggccggggtcacacctgccaggactccgcttctccgtgtcccagcagaaggcatgcaggaccctgtcactactatacctgggcctctgatggggaattctggtcttctaaaaagatgttagaaattcctggtggcacatccagttccgagtttgcccgcatgggcacttttgttggaaacagtgggcaggtcatggggcctcctcatcagagggtctgtgtgagcggctgtgcatgtggcagcgcaccatgcttcacagagaccattctgtagcaagagaccggaacattgtgacttggaccttttcaggagtggcgcggatgttacaggaaatgctgtcggagagcgcgcattctatttcctccgcagggaatgccagatagaaagttgcgggcaacacttttctcagacccaccatgtccccaactcagacttagcaaacctccagcctctccgtttcccctggactcctcctcccttttcctcctgcttctccttgtcctgcctggaggctccaggccacacccagctggtggggctgctccagtgccccatcaccggccttctcctggcaggagaggaggagcagagagctgggtcctgggctgggattcgagccctgggcgggggtcagtcaagccgtggtccagcaaactcctctgcagatggctggagtgttgacccaggcttgtggcccaggtatcaccttcccttcctcctgagagttgaggcctgtaaatacaagggcccaggacagagtgtgtgcgtgcgtgtgggtgtgtgcgcgcgtgagcacacacgcgtgtgttggggggggtggggggattggggtggactcagggtatcttgccagagatacctgttttgatgagtacctattttgatgcaaaggaacggccctgggacctcagagggccacagatgggcttcctgggcctagcgtgccttggttgtggccatcctgcttctactcagccctgccatgctatggggtgcagcacaaacccaggacccaggcctagccactgcccacagctgatggtcactgttttggctggctccagagtggacaggtacgctctgtccacagcagctgctcaggcacagtatgccgtcaggtgcccgcttcttaccactgtgtgtcagctgggattggccgacagcgtggtggtgacttctaggtagaccgatggaccctaaattgggcagtggcattgtttctgctgtggtgggaactggcagggagagggtcacctccactctggttggatgcggagctggtccctctggctgccatgctgtgttggggctctctgacctccctgcttgcattgggtctgggagagagagtggaatatttggtagggaccttgacagaagagagccctgggtgcttgtggtgcaaagatcttcatgcccagttccaaagtgaggtccctcccaaagttgttttcgtgtgaggcagagaaagccacactctgaatacattttatgtctcaggaattcacattccaggttcaggaattttattccaaagtcctttggtgcactcaccgtccaccgttccccaaggcagggagagggagtggcccgtccctgggaggctggcaaagtgctctccagggaggggtcagacgtccttgtgatctgcccagggtgtcacggaaggagattttctagctccacatctgtctgcacataggaaggaaaagataggactctaaacctagtcatcttggaataaaaagaagagctggtttgttttagagcagggcggggggtgggggagggaagcgggtgttggctgtttccaaagagagcacttaatttaatttttcctttaaatgacccagggctgttccgtctgatagatggaagggtaacattgccttaaaacagaaatatgcaggcgttggctatttttggcataagagcgtgtcttcattcccaaagtggttctcgtttaatggcagggtgcggtccttaggccccggcctggactgggaaatgggggtagggcaccaggagagaaatcctcctgggtactcctggccagaccctcctgaatcatctgcggcttaaactcatctcgcttgaagggcagggagaaacccatgaatctcaggcacggttcacaggggtcctcaagggcaggtttccatttcatcatgaagtgagggactcctgtggaagagggtggtgggccttggaacgctgcctccactgaggcgggcacacaaggcggaccctcctgaaacagcctccattttcttcaaacatgcagaatgttttcccagactgcgtctatttcagggtcttccatttttgtggtttatggccatgcttgccagttttggtggggttgaggaacccataggactcatagaaataatagtgaaaactcaaacccttattttgggacttcagttctcgtggtccataggggcagagatgtcaaagtgaaggttgcctgagtgaagggagagttcccctataaaaggcctaaaattgatttggggctcagccatcaaggggctggtgttgctcctgtcccagacaaggaagcccctctttacatcagccatattaggggaacggttgtcagctccccaaatgcctactggatcctacagccatacaggaaaacagacggacacagccctttccttaaagagccctggggtcctgtcctgcaggatgctgcataggaatgggcagagatgtcctggatgggaacatggtcctggaggtgccctacctgcatcctgctgcacccccacccacgacactcgagtgcaagatcgcctcactcctaaccctgactttattcccaggccccacaccgaggcaggtgcaggattcgccatggtgcagcctccgggtacaaacatctgaggcactggcgatcccagtccttgcagcaccctgaacacagctcagaccagtgaggggtgattcagaggtggggatgggcagagagggctggccactctgcctcaggacttgacctcaagtgttctgtctccccacccggtgtgtccagaagaccagcctctttcttgccagaagcaggtgctaagatggactgcacagggtcccggcactccctcgggacccattcaggatctcagctgggcaggggtgccacccaacaggaagatgtgatctgagcaatagtgtggccttgtttctccgcttctggttgtggctgtgtgtacagggctacctactattttgacttctgacaggtgtcactgattttctttcccccatttaaaaaaggtcatttagtcaaagacacagtgctagaggtttaaagggtgtaatgtgttggtcacatcacaaccagtaagaaacgcttggtaggttatccacatcttttgctgactgtttccatatacaattctggtcaccatattttccaaagctaaaatctgaggcgtgggctgatggtttttgaaatcaggattaccccaggaagaaccaggtcctattactaattttcctgattctgaggctctgaaggcttgtctgagacacattccggagacctttgtaccagaacttggatgcatagtccaccttactactgatacacgcctgagcaccctttagggcgaggcgccgcctcctgcctgctgtcctgtccctcagcatcagaagagttgaattcagcaggagacgggagcccggtgtccatgagggaagaggggtcgcgcttggtttctactgacaggcaaccccttcccatccaaagccattggtggagcttctctggaatcatttgccaaaagcccaaggcagaatccaagggtccaagaccatttccatggagctcatgtttttcttttctgtaggaacttttttttaaccagcacccaccataattccgaaggccacgtttcatctttcctggatcactacagtgaagtattacagttgtacagttcccagtctggccttggcttgctcggataaaactttgtatgtattttgtatggcatagattctatattgtaatgatgtcctatgcaaaaagaaaaattaacgaaattgtaaattttattgttttaacgtgtatgcatgtttagtgacgtttacattttgaaataaaatttatgattcattatttta

SEQ ID NO: 133061 - DNA, 4991 bp, Homo sapiens
  misc_feature (716)..(716): n is a, c, g, or t
tcgcaccccaaggcgcacctgagaactcacacaggtgagaggcccttcgcctgcagctggcaggactgcaacaagaagttcgcgcgctccgacgagctggcgcggcactaccgcacacacacgggcgagaagaagttcagctgccccatctgcgagaagcgcttcatgcgcagcgaccacctgaccaagcacgcgcgccgccacgccaacttccacccgggaatgctgcagcggcgcggcgggggctcgcggaccggctccctcagcgactacagccgctccgacgccagcagccccaccatcagcccggccagctcgccctgagcccgccacagccatgagcagccgctcccaccccctcgtgagtccctggcctttccttttgtaataagaaagaagagagagaacttgatgcaaagtccacgaaaaaacaatttttttcacctcaggtgtcaaagtaaatttgttaaaaaaaaaaaaaaaacacaaaaatttcaaaaaacaccacccaccaaattgcacaatagatacacccacaaagttgagattcagcgttgttgaaccccctttctcagggatggacacgtttcacgaggtcagtgaggacaccccttcctgccgccttactctgtacatagatttgcactctggagttttctgttaggttcgggaacacgctggggacagagcaggccagccagtctggtggagctcancgtctggctggctggccagcctgtgggtctgttgggagcagatgtgctcactgacgtttgtgcctccagggcagattcctaagcagctggcctgacctcttcctgcccagcccccaacccagtctctggcctctgcccaacgagcctggctgggcttgcaacgcagctgattctgagacaggcccctgcagagggatgccttaaagctgtccctggctggaggagcactccaccttggggatagtggagggggccttcagccctctgcaccctgcctgcctcacaccccgccttcaggagccctctcctacggcgctagggagcactggaagcagagatgccagccctggctgagcgtagcactgcaccgtccgacctccgaggcaggggccggggtcacacctgccaggactccgcttctccgtgtcccagcagaaggcatgcaggaccctgtcactactatacctgggcctctgatggggaattctggtcttctaaaaagatgttagaaattcctggtggcacatccagttccgagtttgcccgcatgggcacttttgttggaaacagtgggcaggtcatggggcctcctcatcagagggtctgtgtgagcggctgtgcatgtggcagcgcaccatgcttcacagagaccattctgtagcaagagaccggaacattgtgacttggaccttttcaggagtggcgcggatgttacaggaaatgctgtcggagagcgcgcattctatttcctccgcagggaatgccagatagaaagttgcgggcaacacttttctcagacccaccatgtccccaactcagacttagcaaacctccagcctctccgtttcccctggactcctcctcccttttcctcctgcttctccttgtcctgcctggaggctccaggccacacccagctggtggggctgctccagtgccccatcaccggccttctcctggcaggagaggaggagcagagagctgggtcctgggctgggattcgagccctgggcgggggtcagtcaagccgtggtccagcaaactcctctgcagatggctggagtgttgacccaggcttgtggcccaggtatcaccttcccttcctcctgagagttgaggcctgtaaatacaagggcccaggacagagtgtgtgcgtgcgtgtgggtgtgtgcgcgcgtgagcacacacgcgtgtgttggggggggtggggggattggggtggactcagggtatcttgccagagatacctgttttgatgagtacctattttgatgcaaaggaacggccctgggacctcagagggccacagatgggcttcctgggcctagcgtgccttggttgtggccatcctgcttctactcagccctgccatgctatggggtgcagcacaaacccaggacccaggcctagccactgcccacagctgatggtcactgttttggctggctccagagtggacaggtacgctctgtccacagcagctgctcaggcacagtatgccgtcaggtgcccgcttcttaccactgtgtgtcagctgggattggccgacagcgtggtggtgacttctaggtagaccgatggaccctaaattgggcagtggcattgtttctgctgtggtgggaactggcagggagagggtcacctccactctggttggatgcggagctggtccctctggctgccatgctgtgttggggctctctgacctccctgcttgcattgggtctgggagagagagtggaatatttggtagggaccttgacagaagagagccctgggtgcttgtggtgcaaagatcttcatgcccagttccaaagtgaggtccctcccaaagttgttttcgtgtgaggcagagaaagccacactctgaatacattttatgtctcaggaattcacattccaggttcaggaattttattccaaagtcctttggtgcactcaccgtccaccgttccccaaggcagggagagggagtggcccgtccctgggaggctggcaaagtgctctccagggaggggtcagacgtccttgtgatctgcccagggtgtcacggaaggagattttctagctccacatctgtctgcacataggaaggaaaagataggactctaaacctagtcatcttggaataaaaagaagagctggtttgttttagagcagggcggggggtgggggagggaagcgggtgttggctgtttccaaagagagcacttaatttaatttttcctttaaatgacccagggctgttccgtctgatagatggaagggtaacattgccttaaaacagaaatatgcaggcgttggctatttttggcataagagcgtgtcttcattcccaaagtggttctcgtttaatggcagggtgcggtccttaggccccggcctggactgggaaatgggggtagggcaccaggagagaaatcctcctgggtactcctggccagaccctcctgaatcatctgcggcttaaactcatctcgcttgaagggcagggagaaacccatgaatctcaggcacggttcacaggggtcctcaagggcaggtttccatttcatcatgaagtgagggactcctgtggaagagggtggtgggccttggaacgctgcctccactgaggcgggcacacaaggcggaccctcctgaaacagcctccattttcttcaaacatgcagaatgttttcccagactgcgtctatttcagggtcttccatttttgtggtttatggccatgcttgccagttttggtggggttgaggaacccataggactcatagaaataatagtgaaaactcaaacccttattttgggacttcagttctcgtggtccataggggcagagatgtcaaagtgaaggttgcctgagtgaagggagagttcccctataaaaggcctaaaattgatttggggctcagccatcaaggggctggtgttgctcctgtcccagacaaggaagcccctctttacatcagccatattaggggaacggttgtcagctccccaaatgcctactggatcctacagccatacaggaaaacagacggacacagccctttccttaaagagccctggggtcctgtcctgcaggatgctgcataggaatgggcagagatgtcctggatgggaacatggtcctggaggtgccctacctgcatcctgctgcacccccacccacgacactcgagtgcaagatcgcctcactcctaaccctgactttattcccaggccccacaccgaggcaggtgcaggattcgccatggtgcagcctccgggtacaaacatctgaggcactggcgatcccagtccttgcagcaccctgaacacagctcagaccagtgaggggtgattcagaggtggggatgggcagagagggctggccactctgcctcaggacttgacctcaagtgttctgtctccccacccggtgtgtccagaagaccagcctctttcttgccagaagcaggtgctaagatggactgcacagggtcccggcactccctcgggacccattcaggatctcagctgggcaggggtgccacccaacaggaagatgtgatctgagcaatagtgtggccttgtttctccgcttctggttgtggctgtgtgtacagggctacctactattttgacttctgacaggtgtcactgattttctttcccccatttaaaaaaggtcatttagtcaaagacacagtgctagaggtttaaagggtgtaatgtgttggtcacatcacaaccagtaagaaacgcttggtaggttatccacatcttttgctgactgtttccatatacaattctggtcaccatattttccaaagctaaaatctgaggcgtgggctgatggtttttgaaatcaggattaccccaggaagaaccagaggcaaccccttcccatccaaagccattggtggagcttctctggaatcatttgccaaaagcccaaggcagaatccaagggtccaagaccatttccatggagctcatgtttttcttttctgtaggaacttttttttaaccagcacccaccataattccgaaggccacgtttcatctttcctggatcactacagtgaagtattacagttgtacagttcccagtctggccttggcttgctcggataaaactttgtatgtattttgtatggcatagattctatattgtaatgatgtcctatgcaaaaagaaaaattaacgaaattgtaaattttattgttttaacgtgtatgcatgtttagtgacgtttacattttgaaataaaatttatgattcattatttta

SEQ ID NO: 133062 - DNA, 508 bp, Homo sapiens
tcatgtgacagactagactgaggagggtcagaatgggaattgccttcctgccctgcaggggtgcagagtgtggctcccatggagcagcatgggcggctggactccgggaggcctgtgaagccagggcatgggcctgcaacccccaggcgttggagaccactggcccggcatgggtgtgtagtgcagcctgctttgtggtgtacttagggggtccactgccaggagcctggggccctgacctgtacctacccatgggccctgcagtttcagcacttgaaatgttgtttttatcctaggccgtgtcttctgcctccatcccaggcgtgggcgggagggcaggggcccaccttcatctctgccttgatggatttgtcacagaagctcttggaggtggggcatgtgggaggggtgttgagagaccagggtgttgggtgttgcgggcccttccccagagagggtgtgaaggcggggccaggtgcggatactgatgctctgcccctgtgcccac

SEQ ID NO: 133063 - DNA, 5933 bp, Homo sapiens
  misc_feature (722)..(722): n is a, c, g, or t
aggcacttggtggtggggccagggctcctgccggccataggtgagaggcccttcgcctgcagctggcaggactgcaacaagaagttcgcgcgctccgacgagctggcgcggcactaccgcacacacacgggcgagaagaagttcagctgccccatctgcgagaagcgcttcatgcgcagcgaccacctgaccaagcacgcgcgccgccacgccaacttccacccgggaatgctgcagcggcgcggcgggggctcgcggaccggctccctcagcgactacagccgctccgacgccagcagccccaccatcagcccggccagctcgccctgagcccgccacagccatgagcagccgctcccaccccctcgtgagtccctggcctttccttttgtaataagaaagaagagagagaacttgatgcaaagtccacgaaaaaacaatttttttcacctcaggtgtcaaagtaaatttgttaaaaaaaaaaaaaaaacacaaaaatttcaaaaaacaccacccaccaaattgcacaatagatacacccacaaagttgagattcagcgttgttgaaccccctttctcagggatggacacgtttcacgaggtcagtgaggacaccccttcctgccgccttactctgtacatagatttgcactctggagttttctgttaggttcgggaacacgctggggacagagcaggccagccagtctggtggagctcancgtctggctggctggccagcctgtgggtctgttgggagcagatgtgctcactgacgtttgtgcctccagggcagattcctaagcagctggcctgacctcttcctgcccagcccccaacccagtctctggcctctgcccaacgagcctggctgggcttgcaacgcagctgattctgagacaggcccctgcagagggatgccttaaagctgtccctggctggaggagcactccaccttggggatagtggagggggccttcagccctctgcaccctgcctgcctcacaccccgccttcaggagccctctcctacggcgctagggagcactggaagcagagatgccagccctggctgagcgtagcactgcaccgtccgacctccgaggcaggggccggggtcacacctgccaggactccgcttctccgtgtcccagcagaaggcatgcaggaccctgtcactactatacctgggcctctgatggggaattctggtcttctaaaaagatgttagaaattcctggtggcacatccagttccgagtttgcccgcatgggcacttttgttggaaacagtgggcaggtcatggggcctcctcatcagagggtctgtgtgagcggctgtgcatgtggcagcgcaccatgcttcacagagaccattctgtagcaagagaccggaacattgtgacttggaccttttcaggagtggcgcggatgttacaggaaatgctgtcggagagcgcgcattctatttcctccgcagggaatgccagatagaaagttgcgggcaacacttttctcagacccaccatgtccccaactcagacttagcaaacctccagcctctccgtttcccctggactcctcctcccttttcctcctgcttctccttgtcctgcctggaggctccaggccacacccagctggtggggctgctccagtgccccatcaccggccttctcctggcaggagaggaggagcagagagctgggtcctgggctgggattcgagccctgggcgggggtcagtcaagccgtggtccagcaaactcctctgcagatggctggagtgttgacccaggcttgtggcccaggtatcaccttcccttcctcctgagagttgaggcctgtaaatacaagggcccaggacagagtgtgtgcgtgcgtgtgggtgtgtgcgcgcgtgagcacacacgcgtgtgttggggggggtggggggattggggtggactcagggtatcttgccagagatacctgttttgatgagtacctattttgatgcaaaggaacggccctgggacctcagagggccacagatgggcttcctgggcctagcgtgccttggttgtggccatcctgcttctactcagccctgccatgctatggggtgcagcacaaacccaggacccaggcctagccactgcccacagctgatggtcactgttttggctggctccagagtggacaggtacgctctgtccacagcagctgctcaggcacagtatgccgtcaggtgcccgcttcttaccactgtgtgtcagctgggattggccgacagcgtggtggtgacttctaggtagaccgatggaccctaaattgggcagtggcattgtttctgctgtggtgggaactggcagggagagggtcacctccactctggttggatgcggagctggtccctctggctgccatgctgtgttggggctctctgacctccctgcttgcattgggtctgggagagagagtggaatatttggtagggaccttgacagaagagagccctgggtgcttgtggtgcaaagatcttcatgcccagttccaaagtgaggtccctcccaaagttgttttcgtgtgaggcagagaaagccacactctgaatacattttatgtctcaggaattcacattccaggttcaggaattttattccaaagtcctttggtgcactcaccgtccaccgttccccaaggcagggagagggagtggcccgtccctgggaggctggcaaagtgctctccagggaggggtcagacgtccttgtgatctgcccagggtgtcacggaaggagattttctagctccacatctgtctgcacataggaaggaaaagataggactctaaacctagtcatcttggaataaaaagaagagctggtttgttttagagcagggcggggggtgggggagggaagcgggtgttggctgtttccaaagagagcacttaatttaatttttcctttaaatgacccagggctgttccgtctgatagatggaagggtaacattgccttaaaacagaaatatgcaggcgttggctatttttggcataagagcgtgtcttcattcccaaagtggttctcgtttaatggcagggtgcggtccttaggccccggcctggactgggaaatgggggtagggcaccaggagagaaatcctcctgggtactcctggccagaccctcctgaatcatctgcggcttaaactcatctcgcttgaagggcagggagaaacccatgaatctcaggcacggttcacaggggtcctcaagggcaggtttccatttcatcatgaagtgagggactcctgtggaagagggtggtgggccttggaacgctgcctccactgaggcgggcacacaaggcggaccctcctgaaacagcctccattttcttcaaacatgcagaatgttttcccagactgcgtctatttcagggtcttccatttttgtggtttatggccatgcttgccagttttggtggggttgaggaacccataggactcatagaaataatagtgaaaactcaaacccttattttgggacttcagttctcgtggtccataggggcagagatgtcaaagtgaaggttgcctgagtgaagggagagttcccctataaaaggcctaaaattgatttggggctcagccatcaaggggctggtgttgctcctgtcccagacaaggaagcccctctttacatcagccatattaggggaacggttgtcagctccccaaatgcctactggatcctacagccatacaggaaaacagacggacacagccctttccttaaagagccctggggtcctgtcctgcaggatgctgcataggaatgggcagagatgtcctggatgggaacatggtcctggaggtgccctacctgcatcctgctgcacccccacccacgacactcgagtgcaagatcgcctcactcctaaccctgactttattcccaggccccacaccgaggcaggtgcaggattcgccatggtgcagcctccgggtacaaacatctgaggcactggcgatcccagtccttgcagcaccctgaacacagctcagaccagtgaggggtgattcagaggtggggatgggcagagagggctggccactctgcctcaggacttgacctcaagtgttctgtctccccacccggtgtgtccagaagaccagcctctttcttgccagaagcaggtgctaagatggactgcacagggtcccggcactccctcgggacccattcaggatctcagctgggcaggggtgccacccaacaggaagatgtgatctgagcaatagtgtggccttgtttctccgcttctggttgtggctgtgtgtacagggctacctactattttgacttctgacaggtgtcactgattttctttcccccatttaaaaaaggtcatttagtcaaagacacagtgctagaggtttaaagggtgtaatgtgttggtcacatcacaaccagtaagaaacgcttggtaggttatccacatcttttgctgactgtttccatatacaattctggtcaccatattttccaaagctaaaatctgaggcgtgggctgatggtttttgaaatcaggattaccccaggaagaaccaggtcctattactaattttcctgattctgaggctctgaaggcttgtctgagacacattccggagacctttgtaccagaacttggatgcatagtccaccttactactgatacacgcctgagcaccctttagggcgaggcgccgcctcctgcctgctgtcctgtccctcagcatcagaagagttgaattcagcaggagacgggagcccggtgtccatgagggaagaggggtcgcgcttggtttctactgacccccatgaagatttcagacttgcagtgcggccacctggccctgccctgcctctctctttctcatacagctttaaaactttactacttttatttaaaaatgaactggatgggagagaagtagcgtcccctaccctacaagtcacacattccggggaggggggtggggggtggaggcaggaagtcatgggggtgggggtgggagcacgggaacagctttcttaaggcctcagggtcctgttttccctggcctcttctagagggcccgtggacaggtcgcagtgcgtgcttatttggaaaccaggtgtgtgagccgaatgcctgccaggccatgcactcagcagaggagcccttgtacctggctgccctgagaggagcaagaggccacctcccatgtggctctagacaccacgtgggctcattagccccagcgtctgtgccggctccaggtgcctgcctctgggtgtgtgagtgggagactttgctccctggcctcatcctagagaggcccctggtgcctagtgctgaggcctctggggctggaaagcctcagcagaaaggaggcactactgagcaactatgcattgtcattgtcgggtttggggctttcggtggttccttggtgactgggaattgcttgtgtgcatgtgttgggtgcatgcttccgggtctcagctgccccaggcccgcacaggcaaccccttcccatccaaagccattggtggagcttctctggaatcatttgccaaaagcccaaggcagaatccaagggtccaagaccatttccatggagctcatgtttttcttttctgtaggaacttttttttaaccagcacccaccataattccgaaggccacgtttcatctttcctggatcactacagtgaagtattacagttgtacagttcccagtctggccttggcttgctcggataaaactttgtatgtattttgtatggcatagattctatattgtaatgatgtcctatgcaaaaagaaaaattaacgaaattgtaaattttattgttttaacgtgtatgcatgtttagtgacgtttacattttgaaataaaatttatgattcattatttta

SEQ ID NO: 133064 - DNA, 362 bp, Homo sapiens
actggtgtgttattgtcaagggatcttacaggccttgcttcccaggcccctctatcccctctgttcttgcttaggcattagtgatttggttcttctagctttttttctttttttgagacagggtctcgctttgtcatacaggctggagtgcagcagcgcgatcttggctcactgcaacctccgcctcctgggttcaagcaattctcctgtctcagtctcctgagtaggtgggtctacagtcacatgccaccacgtctggctagtttttgtattttttagtagagatagggtttcacttgttggccaggctggtctcgaactcctgacctcaggtgatccgccagtctcaacctcccagagag

SEQ ID NO: 133065 - DNA, 310 bp, Homo sapiens
acaggacccaggccagggagccccgtcagtggaaggcgtcaggaggaggacgctgaccctgcatcccatcccagccacagcagggctgcaaccaagaggaggtgccttccaggcccattaaccacctcctccctccacagacacacagctagctgcaggatcccagcagtgaagatgacatcattcttgtttaaatgctttattaaccaacctgctccctcaccagagaagcaatctcgcctgctctctattaactaacctgctccctcaccagagaagcaatctcgcctgctattaaccaacctgctcc

SEQ ID NO: 133066 - DNA, 215 bp, Homo sapiens
caccgcacctggcctaataacttttgactggaacaataagtggcaacatggacaggtagagggagcactgagctgggaatggaggcctgggcagatagctcatgccactggttcctgggacctgagtcaagccacctctgggctgtttcatgtccttattaacagatcggatgagataaccttttttttcttttttgagacagtctcactacatt

SEQ ID NO: 133067 - DNA, 227 bp, Homo sapiens
cagtcatgtcacatttggatatgaaattccctatttggcaactctaccattttggttagaatacccaatactacactagtgcaaaccttccctttggccaggcacagtggctcatgcctgtaatcccagcactttaggaagccgaggcgggtggatcacctgaggtcaggagttcaagaccagtctggccaacatggtgaaactttgtctctactaaaaatacaaaa

SEQ ID NO: 133068 - DNA, 389 bp, Homo sapiens
gtggcggcatattgtgtccaggagaatgaactgccatgaacagcaagtagaagagccgactcaacatggaatagtagttttagttgaagatatgaagctccccagtcactgcacagccagggtggattttctgccaccttcacaagcctcctgcagggagggtcaccgtgtctcagatctactcactgtggagtttaaatcctccctcctctgcttgtcacccctcagggtgagctgagaagtcagccagagggagcagagtgacagtggctgaagggaaatggtactgggcagttgatagtgaacagagcccgagaggaaaagcccctccccttaaggctgcaagatctgcattagggcaggaggttcttcagtgcagaaagaagcag

SEQ ID NO: 133069 - DNA, 309 bp, Homo sapiens
caaactctgggatcagagtggaattttggccaattttgcatgctatctaccatactctctgtcatgggtactttttttttaaactctgtacttccttgtagggaaatcatctcatatctgtcttctagtatactaaatctctcttcagctatggtcaatgtggtgtttaaccatgcactcaaatgtttaatttcgattactatattattcatttctagaagttccatttgatttttctcaaatctattcttttttcttttctttttttcttccttgggatggggtctcactctattgcccaggctggag

SEQ ID NO: 133070 - DNA, 216 bp, Homo sapiens
aattctagatccgtgtgtgtgtgtgtgtgtgtgtgtaagatgttagacctggaagaataaagggaccataaagtgaaatgcccttctgctgatctcaacggagccacagtattcattgaaagccacccattttacagattaagaaacaagctgggaggctgtgtggaaaccacagccagagacccatgctgcatgtgagtcaggcagcctggctgc

SEQ ID NO: 133071 - DNA, 594 bp, Homo sapiens
cctgctcaaatgtagtatttcttttctatattgctgtatttggttggctaatatttttaaggattttcgtctattattcatgaggaatatttgttgtagttttcttttctcgtaatgattttgtctggttttggtttcagggtaatgtcatctcctaaaattatttgcaagtgttctgtctcctgttttcagagagatttttgtgtagaattggtattatctcttccttaagtgtttggtagaatttggcagtgaagccctcacggcctggagctttctttgtgggtaggttttttattacaaattcaatttcattaggaagctctccagttcatctggagtgaactttggtagtttatgtccttagaggaattttgcccattttatatatgtcatcaaatggataatgccttttgaatttagtcagttaaaattcttactggaatttttgtgtatatgcgtatttgcgaagtgatcttttgttctttggttgacgtctccttatttggatttggaattaatattggtctcctattaagagctgttgtgtctgtttgtttttggtgttctttttttttttatttttcctacttc

SEQ ID NO: 133072 - DNA, 880 bp, Homo sapiens
tggacatttctatccctgtggaatttgctcctgttgtgtccttgagggagctctggcacaggtgtgattcaggtaaaggagacagagtctgtggaagtgactggcactccatgtagttaaatttgattcctagtaacttcaaaaccacttcagagagcaagagaatgaggtggggtttttggattgttttttgttttttcagctaaaataacattttaacaggtagaagacattccaaatcaggagattgctagcttcacagaatgagaggagcatccctgggtcctgggaatggttacagatcctgaggcctttacctgctcttgcctttctgggtcctccccactgccccacgggggagctctgcctatgaatgagctgatgctcagagaggttaaacgccttccaggccagggagctggaaaccaggagggcaaggatttaacccaagtcatactgatgcctaaccatgagcacccaaccactgtgtctgccgatggtcttcgcatgaggcatgatttctttcctggccattgctcttttgtcacagtaatgggacccttcagtgccttaaccttagccttagcccaacataggggcagacaggattcacgggaagagagggtcgccctgatggcaatgcagggaggtgagtgggcatgatctgggacaaacggagtagttaataaatacaggcagtgagtagtgagtactttccaaggaaagatattaacagggcccccaaactgcaggtgacagtgtctaacaggtccaggtagctcggaatgcaaaggttgactgtaccagtccacaatatggcaaaccctgatttttttcctatgtcattgttccttttttaaaaaataaaaattgtggtaaa

SEQ ID NO: 133073 - DNA, 653 bp, Homo sapiens
ggcctggaagagcagcaagtcagcctctccgggcccagctccatcctctcggcggcctctccaggtgcaaaacttcctcgagtcagcctctccaggcccagctcctcctgcctcccattggcctctttcagcccagcccagcccagctcatggctctcggcagccttcccaggccccgcttttgacttttggcggcctcttcaggcccagaacttgccctccagtggacctttgcaggcccggcctcggcctcggcctcacagcggactctccacgcccagctagctctcacctcactgcggcctccccagtccaaagctcctgcctttcggccgcttcggcaggtccagctcctgcctgccagtggcctctttaggcccagctcattcctcacaatggtcttcccaggccccgtttttcccttctggcagcctcttggcctctaatttgtttatcttttgtgtataaatcccaaaatatggaattttggaatatttccaccattatatgaatattttggtaggtaatttatttggagttagtttctgcaccatgcccgaattttttattttattttccttattatttggtgttaaacagatttaatgacggtcatggcaactttttggcacaatgaaaaatatcgcccatga

SEQ ID NO: 133074 - DNA, 482 bp, Homo sapiens
ttctctgaatccgctggggccctctggtttcctggccccgaggtctctagtgttcctgggactggcctagctcctcttccctttctccatggttcagaggcctggtctgggctccgtatatggaattctgggcccaggcttaagcgcgatgctgaagagctgccggtccccctccataacttgcccttctctctggaataaagactccaggcctcccgttctgaaactgatttccaggaggaaggtgtccagtctcaattccgtgttctttctgggatgaaggcaaatcacagaccgcaccaccctgactgaattatgctacaaatatctgcaagccctaattggttcccattcattcatatttcgctttggctcttaatgatacctcagaactagtcttgcccccaaagattccccaagacacagctaacagggttgtaatatactgttgtcattgaaagaaaggagtgtctcgatactgt

SEQ ID NO: 133075 - DNA, 738 bp, Homo sapiens
gtggaaaatatacgcttacattagaaaacagcagtggaacaaagtctgcctttgttactgtgagagttctggacacgccaagtccacctgttaacctgaaagtcacagaaatcaccaaagactcagtatcaattacatgggaacctcctttgttggatgggggatccaaaataaaaaattacattgttgagaaacgtgaagccacaagaaaatcatatgctgctgttgtaactaactgccataagaattcttggaaaatcgatcagctccaagaaggttgcagttattactttagagtcacagctgagaatgagtatggtattggccttcctgcccagactgctgatccaattaaggttgcagaagtgccacaacctcctggaaaaataactgtggatgatgtcaccagaaacagtgtctctctgagttggacaaaacctgaacatgatggtggcagtaaaatcattcagtatattgtggaaatgcaagctaaacacagtgagaaatggtcagagtgtgctcgagtaaagtctcttcaggcagtaattaccaacctaactcaaggggaagaatatctttttagagttgttgctgtaaatgaaaaggggagaagtgatcctcggtcccttgcagttccaatagttgccaaagatctggtaattgagccagatgtaaaacctgcattcagtagttacagtgtacaggttggccaagatttgaaaatagaagtgccaattt

SEQ ID NO: 133076 - DNA, 439 bp, Homo sapiens
tctttgcttattcaggtggctttatttacatgccaggcccaaacctagggtgcagggatctccttctttctcctaggagactgtttttccctctaagacttttttttgagacaaggtcttgctctgtcgcccacactggagtgccactgcatcctcacagtggtgtgatcatagctcactgcatccttgacctcctgggctcagcctcccgagtagcttggactacaggtacataacaccatgctcggctaattttttcatatattttttgtagcagcagggtctcactatattgcccaggctggtctggaactcctgggctcaagcaatcctcccacttcagctcccctaagggctcttaacctctttagtaaaagatcaacaaagcagatgcatcgcttttgagtttcagatcttcccagggctcctcactgccctc

SEQ ID NO: 133077 - DNA, 272 bp, Homo sapiens
tccttttagccctcgcaactccaggtgttctgctctattgaagtataaaatgggttatcatgtttctagagaatatcaaagaagtcaggtgggaagtggatttcagaaatgacatactacccaaccaggatctggttgttcctgacactgactggatgtattgtagtatcttcagattggagcacctccctggatttgtttttgggattcttcactattagaaggactgaggggccacattagaagtggatattctgcagtcagcctaaatc

SEQ ID NO: 133078 - DNA, 388 bp, Homo sapiens
tctctcccaacactcagccggtacccaacaggaatcatacaaaactcagaggctagtgaaaggttaaagcaggtggtccacaccagctgcagagtcaaaaacaaaatacgcgtctgctgccatttagaaagaggacacaaactcaggcaagactgtttttcacacgatgacccatgagtggctcctggctgggcctccccacacatagctgctgacctctgaatacaacatacacttcgggaccaggtgcggtggttcacgcctgcaatcccagcactttgggaggccaagaggaatggatcacttgaggtcaggagtttgagaccagcctggccaacatggcgaaaccctgtctctgctaaaaatataaaaattagttgggcatggt

SEQ ID NO: 133079 - DNA, 752 bp, Homo sapiens
tgcagtggcttatacctgtaatcccagcattttgggaggacgaggtgggcagatcacttgagtctgggagttcgagacctgcctggccaacatagtgaaatcccctctctactaaaaatacaaaaattagcagggagtggtggcacacgcctgtaatcctagctacttgggaggcggctgagacaggagaatcgtttgaacccaggggatggagcttgcagtgagccgagatcctgccactgcactccaacctgggtgacagagcgagactccatctcaaaaaaaaattaaaaatacaaaaaaattagccaagcatggtggcatacacctgtagtcccagctactcgggaggctgaggcacaactgcttgaacctgggaggcagaggttgcagtaagtggagatcgtgccaatgtactacaggcctgggcaacacagcaagactccatctcaaaaacagaaaaagaaaaaggaattcattcaaggaagcaaggaatatctaactctaatcaaggagaccatgttttattctttgatttaaaaaaaaaactataacctaatcaacagaattatctcatgaatgtgccaacacaaagggggttaaagttttagggggaaccccccaatattcatcaatgccacattttggtcaccaaagaggtatgctttattgtggaacatatttttccactgtttcgataaattatttaggatgatccgattgatcgtgtagagctttaaaatcctcacatc

SEQ ID NO: 133080 - DNA, 235 bp, Homo sapiens
gaagctcataaaaagcttacaaattcaccactgcacatacaatgaaggtggtggacccagtctagccaggactagagtgtccccacatacacccagcactagcccagcatcatcagtctcattatctgtgtcactgtcaatgatgacagtggcttcaggtcctagagtcaataccaagagaggacctagaagagaaccttggaactgtggccaatttcaacatgcctcccactaa

SEQ ID NO: 133081 - DNA, 179 bp, Homo sapiens
gacttcgagacagtctgcgagaagctcctgcacaggtgggcaataagaccaacattgtgagcctgagtcttgagacagactgggggttgaattttgcccttactatagccagctgtgtgagttgggatgagttatttaacctacataagctccagtcactgaatacactggacaccaac

SEQ ID NO: 133082 - DNA, 981 bp, Homo sapiens
cagaggttgcagtgagccaagactgtgacactacactccagcctgggcaacagagggagactgtctcaaaacaaaaacaaagaaacaaaaaaaaagacaagggctgagcacttgcttcccgtggcgaaggtggagtctgggcttacgcatgcatttcccctctaataacaaagcttgagtgatggggttatatgtcttgaagaagaaggaaaacatcaacatccagacacacccaggcccagccggcttcgggaggagccgagagcctctgtggctcctccctgtgcctgggaggcctgagtcccacctgctgggctgctctgtcctggcaggtacagcaacatctttcatgtcttcatccgcatctcgagagaagaggggctgaagactctctaccatggatttatgcccaccgtgctgggggtcattccctacgctggcctgagcttcttcacctatgagacgctcaagagcttgcacagaggtaaggagagctgggagcatgaggaggggacgttcaggaagcattccctggggacagcagctccacctgggtcacatagacctggagaccaggcggagtggggtacgacccctgggtggggcaggctgtagacccacatccaaatcgggagaaaacacactgtgtgcagccgccactgaggaacctggactcactgccttaaatgcctaagtgagaggaactctggctggtgccacggctcgtgcctgtaatcccagtgctttgggaggccgaggtgggcggatcacttgaggtcaggagttgcagaccagcctgggcaacatggcgaaaccccgtctctaccaaagatacaaaaaaattaggcatggtggcacacacctgtggtcccagctactagagaggctgcggtgggaggatcacccaagcctgggaggtcaaggccgcagtgagctgtgatctcactgctgcacaccagcctgggtgtcaaagtgagaccc

SEQ ID NO: 133083 - DNA, 545 bp, Homo sapiens
  misc_feature (50)..(50): n is a, c, g, or t
agcgtgggggccgtggcggcatggaggtagcggcggcggcgacgcgtccnggccggaccgagtctcctgccattccgagcaggcctggtatgggtaatggtgtgaaggaaggcccggtgcgattgcatgaggatgctgaggctgtcctgtcctcgtccgtctcatcaaagtgtcttcaaaaagattttctgccaaggaggccttccgggtcctctactacacctacctcaacgagggatttctcagcttgtggcgcgggaactcggccaccatggtgcgcgtggtgccctacgccgccatccagttcagcgcacacgaggagtacaagcgcatcctgggcagctactatggcttccgtggagaagccctgcccccttggcctcgcctcttcgccggcgcactggctggaacgacagccgcttcactgacctaccccctggacctggtcagagcgcggatggccgtaaccccgaaggaaatgtgagtccttacatcggtgatgcgcatcagccccgggggctctgtgtctcgggggctcccaggtc

SEQ ID NO: 133084 - DNA, 1112 bp, Homo sapiens
  misc_feature (50)..(50): n is a, c, g, or t
agcgtgggggccgtggcggcatggaggtagcggcggcggcgacgcgtccnggccggtgagggggcgcggggggcgccgggggggcccatcgcgtcagcggcccgcgcctgtcgggctgaactgaggaccgagtctcctgccattccgagcaggcctggtatgggtaatggtgtgaaggaaggcccggtgcgattgcatgaggatgctgaggctgtcctgtcctcgtccgtctcatcaaagcgtgaccacaggcaagtgctcagctccctgctgtctggggccctggctggtgcccttgccaaaacagcggtagctcccctggaccgaaccaaaatcatcttccaagagccctgcccccttggcctcgcctcttcgccggcgcactggctggaacgacagccgcttcactgacctaccccctggacctggtcagagcgcggatggccgtaaccccgaaggaaatgtacagcaacatctttcatgtcttcatccgcatctcgagagaagaggggctgaagactctctaccatggatttatgcccaccgtgctgggggtcattccctacgctggcctgagcttcttcacctatgagacgctcaagagcttgcacagaggtaaggagagctgggagcatgaggaggggacgttcaggaagcattccctggggacagcagctccacctgggtcacatagacctggagaccaggcggagtggggtacgacccctgggtggggcaggctgtagacccacatccaaatcgggagaaaacacactgtgtgcagccgccactgaggaacctggactcactgccttaaatgcctaagtgagaggaactctggctggtgccacggctcgtgcctgtaatcccagtgctttgggaggccgaggtgggcggatcacttgaggtcaggagttgcagaccagcctgggcaacatggcgaaaccccgtctctaccaaagatacaaaaaaattaggcatggtggcacacacctgtggtcccagctactagagaggctgcggtgggaggatcacccaagcctgggaggtcaaggccgcagtgagctgtgatctcactgctgcacaccagcctgggtgtcaaagtgagaccc

SEQ ID NO: 133085 - DNA, 668 bp, Homo sapiens
  misc_feature (50)..(50): n is a, c, g, or t
agcgtgggggccgtggcggcatggaggtagcggcggcggcgacgcgtccnggccggtgagggggcgcggggggcgccgggggggcccatcgcgtcagcggcccgcgcctgtcgggctgaactgaggaccgagtctcctgccattccgagcaggcctggtatgggtaatggtgtgaaggaaggcccggtgcgattgcatgaggatgctgaggctgtcctgtcctcgtccgtctcatcaaagcgtgaccacaggcaagtgctcagctccctgctgtctggggccctggctggtgcccttgccaaaacagcggtagctcccctggaccgaaccaaaatcatcttccaagtgtcttcaaaaagattttctgccaaggtgagccactatgtcaccgccccggcctggggacagtcaccactaccctgatgggctggcaggagttaggcaggtggtctgaggagagtctcaggggtggggacaggactacctgtcttcccattcccagctctgcctggacacagcccagcctgggaactgacgggacatcccgagtgtccttccggcagtggggtggggagactcaacagctctaaaacaaccttttcatgtttgatttattgttaaacagagagcaggtgctactttcttaataaaggaaaagataaactgta

SEQ ID NO: 133086 - DNA, 1305 bp, Homo sapiens
  misc_feature (50)..(50): n is a, c, g, or t
agcgtgggggccgtggcggcatggaggtagcggcggcggcgacgcgtccnggccggtgagggggcgcggggggcgccgggggggcccatcgcgtcagcggcccgcgcctgtcgggctgaactgaggaccgagtctcctgccattccgagcaggcctggtatgggtaatggtgtgaaggaaggcccggtgcgattgcatgaggatgctgaggctgtcctgtcctcgtccgtctcatcaaagcgtgaccacaggcaagtgctcagctccctgctgtctggggccctggctggtgcccttgccaaaacagcggtagctcccctggaccgaaccaaaatcatcttccaagtgtcttcaaaaagattttctgccaaggaggccttccgggtcctctactacacctacctcaacgagggatttctcagcttgtggcgcgggaactcggccaccatggtgcgcgtggtgccctacgccgccatccagttcagcgcacacgaggagtacaagcgcatcctgggcagctactatggcttccgtggagaagccctgcccccttggcctcgcctcttcgccggcgcactggctggaacgacagccgcttcactgacctaccccctggacctggtcagagcgcggatggccgtaaccccgaaggaaatgtacagcaacatctttcatgtcttcatccgcatctcgagagaagaggggctgaagactctctaccatggatttatgcccaccgtgctgggggtcattccctacgctggcctgagcttcttcacctatgagacgctcaagagcttgcacagaggtaaggagagctgggagcatgaggaggggacgttcaggaagcattccctggggacagcagctccacctgggtcacatagacctggagaccaggcggagtggggtacgacccctgggtggggcaggctgtagacccacatccaaatcgggagaaaacacactgtgtgcagccgccactgaggaacctggactcactgccttaaatgcctaagtgagaggaactctggctggtgccacggctcgtgcctgtaatcccagtgctttgggaggccgaggtgggcggatcacttgaggtcaggagttgcagaccagcctgggcaacatggcgaaaccccgtctctaccaaagatacaaaaaaattaggcatggtggcacacacctgtggtcccagctactagagaggctgcggtgggaggatcacccaagcctgggaggtcaaggccgcagtgagctgtgatctcactgctgcacaccagcctgggtgtcaaagtgagaccc

SEQ ID NO: 133087 - DNA, 2392 bp, Homo sapiens
  misc_feature (100)..(100): n is a, c, g, or t
gcaaaccttaagctgaatgaacaacttttcttctcttgaatatatcttaacgccaaattttgagtgcttttttgttacccatcctcatatgtcccagctngaaagaatcctgggttggagctactgcatgttgattgttttgtttttccttttggctgttcattttggtggctactataaggaaatctaacacaaacagcaactgttttttgttgtttacttttgcatctttacttgtggagctgtggcaagtcctcatatcaaatacagaacatgatcttcctcctgctaatgttgagcctggaattgcagcttcaccagatagcagctttattcacagtgacagtccctaaggaactgtacataatagagcatggcagcaatgtgaccctggaatgcaactttgacactggaagtcatgtgaaccttggagcaataacagccagtttgcaaaaggtggaaaatgatacatccccacaccgtgaaagagccactttgctggaggagcagctgcccctagggaaggcctcgttccacatacctcaagtccaagtgagggacgaaggacagtaccaatgcataatcatctatggggtcgcctgggactacaagtacctgactctgaaagtcaaagcttcctacaggaaaataaacactcacatcctaaaggttccagaaacagatgaggtagagctcacctgccaggctacaggttatcctctggcagaagtatcctggccaaacgtcagcgttcctgccaacaccagccactccaggacccctgaaggcctctaccaggtcaccagtgttctgcgcctaaagccaccccctggcagaaacttcagctgtgtgttctggaatactcacgtgagggaacttactttggccagcattgaccttcaaagtcagatggaacccaggacccatccaacttggctgcttcacattttcatcccctcctgcatcattgctttcattttcatagccacagtgatagccctaagaaaacaactctgtcaaaagctgtattcttcaaaagacacaacaaaaagacctgtcaccacaacaaagagggaagtgaacagtgctatctgaacctgtggtcttgggagccagggtgacctgatatgacatctaaagaagcttctggactctgaacaagaattcggtggcctgcagagcttgccatttgcacttttcaaatgcctttggatgacccagcactttaatctgaaacctgcaacaagactagccaacacctggccatgaaacttgccccttcactgatctggactcacctctggagcctatggctttaagcaagcactactgcactttacagaattaccccactggatcctggacccacagaattccttcaggatccttcttgctgccagactgaaagcaaaaggaattatttcccctcaagttttctaagtgatttccaaaagcagaggtgtgtggaaatttccagtaacagaaacagatgggttgccaatagagttattttttatctatagcttcctctgggtactagaagaggctattgagactatgagctcacagacagggcttcgcacaaactcaaatcataattgacatgttttatggattactggaatcttgatagcataatgaagttgttctaattaacagagagcatttaaatatacactaagtgcacaaattgtggagtaaagtcatcaagctctgtttttgaggtctaagtcacaaagcatttgttttaacctgtaatggcaccatgtttaatggtggttttttttttgaactacatctttcctttaaaaattattggtttctttttatttgtttttaccttagaaatcaattatatacagtcaaaaatatttgatatgctcatacgttgtatctgcagcaatttcagataagtagctaaaatggccaaagccccaaactaagcctccttttctggccctcaatatgactttaaatttgacttttcagtgcctcagtttgcacatctgtaatacagcaatgctaagtagtcaaggcctttgataattggcactatggaaatcctgcaagatcccactacatatgtgtggagcagaagggtaactcggctacagtaacagcttaattttgttaaatttgttctttatactggagccatgaagctcagagcattagctgacccttgaactattcaaatgggcacattagctagtataacagacttacataggtgggcctaaagcaagctccttaactgagcaaaatttggggcttatgagaatgaaagggtgtgaaattgactaacagacaaatcatacatctcagtttctcaattctcatgtaaatcagagaatgcctttaaagaataaaactcaattgttattcttcaaaa

SEQ ID NO: 133088 - DNA, 1385 bp, Homo sapiens
  misc_feature (100)..(100): n is a, c, g, or t
gcaaaccttaagctgaatgaacaacttttcttctcttgaatatatcttaacgccaaattttgagtgcttttttgttacccatcctcatatgtcccagctngaaagaatcctgggttggagctactgcatgttgattgttttgtttttccttttggctgttcattttggtggctactataaggaaatctaacacaaacagcaactgttttttgttgtttacttttgcatctttacttgtggagctgtggcaagtcctcatatcaaatacagaacatgatcttcctcctgctaatgttgagcctggaattgcagcttcaccagatagcagctttattcacagtgacagtccctaaggaactgtacataatagagcatggcagcaatgtgaccctggaatgcaactttgacactggaagtcatgtgaaccttggagcaataacagccagtttgcaaaaggtggaaatttccagtaacagaaacagatgggttgccaatagagttattttttatctatagcttcctctgggtactagaagaggctattgagactatgagctcacagacagggcttcgcacaaactcaaatcataattgacatgttttatggattactggaatcttgatagcataatgaagttgttctaattaacagagagcatttaaatatacactaagtgcacaaattgtggagtaaagtcatcaagctctgtttttgaggtctaagtcacaaagcatttgttttaacctgtaatggcaccatgtttaatggtggttttttttttgaactacatctttcctttaaaaattattggtttctttttatttgtttttaccttagaaatcaattatatacagtcaaaaatatttgatatgctcatacgttgtatctgcagcaatttcagataagtagctaaaatggccaaagccccaaactaagcctccttttctggccctcaatatgactttaaatttgacttttcagtgcctcagtttgcacatctgtaatacagcaatgctaagtagtcaaggcctttgataattggcactatggaaatcctgcaagatcccactacatatgtgtggagcagaagggtaactcggctacagtaacagcttaattttgttaaatttgttctttatactggagccatgaagctcagagcattagctgacccttgaactattcaaatgggcacattagctagtataacagacttacataggtgggcctaaagcaagctccttaactgagcaaaatttggggcttatgagaatgaaagggtgtgaaattgactaacagacaaatcatacatctcagtttctcaattctcatgtaaatcagagaatgcctttaaagaataaaactcaattgttattcttcaaaa

SEQ ID NO: 133089 - DNA, 294 bp, Homo sapiens
atatgcgataagattgcagggaacagtatagttctatagacttaagtgtgaacatagtcctcatttatagtccctagtctcccatggctcacgcagcttggtctttatgtgtttctgaatttagtgctgcagaggcacaatggggtctggtttctggatcttatacagacaagcacttaggtcagctgcagtggatgtcctgcacagacaccgtcgcaactcttgcctggttcctttttgtttttggagatggagtctcgctctgtctcccaggctggagtgcagtggcgcgat

SEQ ID NO: 133090 - DNA, 584 bp, Homo sapiens
gtctgtggggctttaggtcctccatcgctctggctgggggactcaccgtgcaaagcccatggagaaagggggcactggaagtccgtgcatgcatactgagatcttgaagaaacatcaccccttatctggccgcagaatgtgggtgtcagtgtggtggtgctgtatgtgcatctgtgtgtgtgtgtgagtgtgcatgactgtaggtgtgtgtgcggcatgtgatcaaatccaggtaactgagcatgacatttgtggctgattgtgtgcctgtgtgtgtatcggtgggtgtgcagtatttgtgtgtggtgtgtctgggtgtgtggggatgagaaatgaacagtagcgataatgcacatcagcaaatatgttttaggccgagctcggtgactcacacctgtaattccagcactttgagaggccaaagagagcagattacttgaggtcaggagttcgagcccagtctggccaacatggtgaaaccccatctctactataactacaaaaattagctgggcgtggtggcccacacctgtagttccagttactagggaggctgaggcaggaggatcacttgaacccgggag

SEQ ID NO: 133091 - DNA, 543 bp, Homo sapiens
tagaactgttgagagactggggctcagaagaaaggcgtcccccagggtctcagggcaagatggtagcagagaaggggaccctgaatggtcagagaccctgggaaggatctgtgtttgccctaagcttgaaccgtacctcctgagtttgtctctctaatgcaccctccgagtgtcatccaactactgcttaaataccaccaatggcagggagctcactaccaccaagtggtccatgcccgtcgttagttggttcagaatgttagaaagttccttcatttgacaaacttctttcttgaattcctgtaatgtgttgagcagttttctagacatgggatgccatgaactggtccttcagagtccctgccctcagtggagagacaaacaggaacctatacacagcagcatagggaagagagggagggaggagagtccagctcgtgcttagcagtgcagaggacacaaggccacaggagagggtgagggggctttttgcattagttgacattgagcagtgtcgactaagttgagagctgggtgacagga

SEQ ID NO: 133092 - DNA, 217 bp, Homo sapiens
ctttcccttacatttttaattaaaatcaatctggatgagcttttctgattttaggataataagtttgtttgttacgttttattatattgtaaatcaacaaagaatgcagtggaaatatattttcgcagagaaagcaaatatcaattccactataagaaaagcattaatttctgcagtatgtttattaattgttttccaggacagaggttataggcaa

SEQ ID NO: 133093 - DNA, 625 bp, Homo sapiens
ctagcattgcgatcttgagcaagacacactctgcacttatctccagaggccctttcagctcaatgaattgttactactttggggtatgtggtgtttaaagttctggtgggacatacatccttgtatgttaagttgcctttccttcttagctagcatttatttactttcctagtacttgagtttctcttccactttctctttgttttacctgtttttggttaaccttttacttaggctatggattatcactataagattaagactaaaagaaaaataggaggacagagctaacagggtggttagtaaattaataatgaagcttcccaggtcctcctctcccttcttccctccccgcgtcccaggtaagtactcaaagatactgcagcgagtctttttttttttttttaagaatacttttaagggaatgggaaaagacaattgttgcgttttcatccatttattctgccaacttttcctatctttcttttccctgtgttcctgatatgtaggtcatatcgtttaacttgcttttcatgtaccgtctgtagctgtgtgtgtgtgcctgtgtatgtgtatgtgtgcgcgcactttaaatcaggggcaattttgtgtcccagaggacatt

SEQ ID NO: 133094 - DNA, 291 bp, Homo sapiens
aatcactctggcagctgtacagacaatggatcagggtgaggtcacagcctgggtggggctaattaaaagggtactgaggtttcctggagaacagcgatgacagcctgaactaaattttaatagaacttagtacccacaaaatctctttagcctatcatgggctgcagcatcagtggagcgtctatcatggaggcagtgcctcaggaacaggcaatcctttcccagtaaatactgtgcagggcttttcacccccacctgctactgaggtcctggcataacacataacatttg

SEQ ID NO: 133095 - DNA, 261 bp, Homo sapiens
gaaaacagcatggtggaaactctccccatgattcaattacctccacctgatgtctcccttgacatgtggggattatggggattacagttcaagatgagatttgggtggggacacaaagcctaaccatatcacagggtttcaaaaactgaagattgaaacccctccctcaaaaggtttgcagtccacctggaaaacacccaccatattactttggagaatgatggtgatttgaagccgactttgtttttggtggactgtgtt

SEQ ID NO: 133096 - DNA, 512 bp, Homo sapiens
taccactgttcccctggctgggaaagaaggactggtttagcacaaaaaatctgtcccttatgacatttcacatatacatttggccccaataaaactcatttcttgggccaagtgcggtggctcatgactgtagtctcagcactgtgggaggccaaggcaggcagatcacctgaacccaggagttcaagaccagcctgggtaacatagtgaggctccatctctacaaaacataaaaaagaaagaaaggggcaaaaaaagatttcttgatttttttaacagcagctcaaatcctggcatttaatcaaagagactgccagtagcccaccttgtgtagctgtgaagggcaactgtggcccatgctcagagcagcatctgcattaagtatgagcccagtatctaaactacaattactttgcaagtttcccttcttccccaatgcaaagtactttagagtactttatacttttcaaaaacactttcacgtattatctcatttgagtctaccaataagc

SEQ ID NO: 133097 - DNA, 460 bp, Homo sapiens
aagagctgacagcttacaacctgcggtgagtgcattttcctgcacctccctgccttgtgggggccatggtggcattgctgaagctcctctggcccccattctgctgtgactgtgtcccagtcagggggttgcaaggctctgccagacccccattcttcctcagccaccacacctccccaaatgccttttcaatgcctggacctctcgctccccactcctctctgcccatgtggcctcttcctcctccaaatgcactcatacataagtcagggctttccagagaaacagaacaaacagggtgtatgtggagagaggagagaggagagcagggagagaggaggaaggagagcagggaaagagaggacaggaaggtgggggagatgagaggagaggaaagggagagagggggaagagacagatgttgaggaattggctcatgtgattgtggaggcttggtgag

SEQ ID NO: 133098 - DNA, 280 bp, Homo sapiens
ctaacatagtcacagtttctggggaagtcgatacaggagatgttattttgtgtacaatccttgataaataatttaaaattttaatacatactttatttatgcctacaaattaaatattgacatataccatataaatgtattttagctcttataatttacaaattagatgaattaatcatacaagagatctatatcgttgtaaacttgactgcttttcataatctatattatagatgaaattcatgatttagttatccaggtttttttttttttcaggtcc

SEQ ID NO: 133099 - DNA, 402 bp, Homo sapiens
cagtacccaacgcgctgaagtgttgcgcgcggagcgcgcgcttccctagtggtttccgcaggctatggccggacacttagacctagtctggcaccagcgggacgtgctcctcgtccccacccccgatggggagggccctgagcgggtagtgctcgctagtgtggcggagctgggtcttggcttcactgagctgacttaagtcttagtttctgttttgttttccaaagcgccctggcggcggagagtaagggcctcggaggcggaatcttgcgtcctgggggcgggcacctctcccacccaaaaggcacccgacaggcgaaaaacgatccgccaagtagcaactgggggcggggggcaaatggaagaatgaggttccacgcgggagctgtagggcgcagcaag

SEQ ID NO: 133100 - DNA, 329 bp, Homo sapiens
ctattaagcagaataaggactccagtccaggcagtctagtaccaaaggccttccttgtaatcgctgtgctttaccacctctcagagaacaaccacagggactaagcagtctagtgaagcttcaaatgctgtacgtttcagagaatggggaggtccctggctgtcacagaagcttcctggagaagtaggatcatgtaagttctaactcagggcaggtcagggtgatgtgagtgaccaactcactcggaacacagacattcatgggtgttcagtaaaaccggttctagaaccagtgatgacttcagcccaaggatcccacaagggaaagtg

SEQ ID NO: 133101 - DNA, 803 bp, Homo sapiens
gaggctgtaggtgggctccgctgggtaaaagttgccgcagcagctgtcccttggccccatcgcgatttatttttcccccttgctttccgggtcccgggatcccaagtttgtaactaacgggagcgaatccacacccgagcaaaatgtttgcgagtttcaggcgcccttagttgaaaggctgtaattaacaagtccgctgtttgccagccaggcgccgttgcaggcgctttctgtggattgtcatttatttctcacagcaaccctaggagatgaaattgaatcatggaagaatgcctttatctgaggagtcatcaccactagggagctatggaggctgttatccttgacatctgcagcagcccttccaagctgtggagaccaggtcatctggaatgcccatttatgtcaatggaagaaagaaaaaggggtctcctcccatcctcaccactgcattctcccaccaaccctgctcctgtcccacttcccacaactcagttgttgacaatttaacagtgggtttctggaaacagtgctgcctccttgatggtctaactaactaccagagttattctaacagcaggaatttcaagccaggtaaggggagctatgtcaggctgccagatggtggggaagacaggtgtgggtgagctggcttcagactaaaggaagaggagatcaagtgttggaatcacatttgagaaaaggagtcaagtgaacttcattacccattatagaggcctgttatatcctttagtgctatttggacttggattgaacctgtgacaaatccttttcttatgctt

SEQ ID NO: 133102 - DNA, 387 bp, Homo sapiens
cctcttctggggctggaatggtccgtgtgcactctaatgcgcattgagtgggcacacggaccgcgccacccaccagcggcggcgaataacttggtgagaaaactgaggcccaaccagcttgaagtgtcatccaaggtcactccgcagtctgtcttcatgggctgaagcctcctgtgacctgtgtttatcgtacctccagagcctacgggagccttcctgtcaggctgctcgtcctgaatgcccagcggcgtctccatggtgggaagatgctgcggaagagaacacgactcccaccttcacatcgacaaggaactttatcattgctccaaaaacgcccacacagtctgtatcctagcgactctggagagctcctcccagcctctcatg

SEQ ID NO: 133103 - DNA, 182 bp, Homo sapiens
agctctctgtaggacagctctttcaaccagctgttgaaaggtctgaggatatcattcacttccttcataacttcaatacagtcacttccacccaacccaatttaatccaatctatccatctatccacccacctactcatccatccatccactcaactatccatccatccacccacttgctca

SEQ ID NO: 133104 - DNA, 508 bp, Homo sapiens
aaagaaaagaaagaaaaatgatgtgggtagcactcacttagcatgatgtctggtacacacgggcaatggtatcttgtatcatcatcatcatcctcttcattttttgttattgtcatttaaagtctttcagccagtaagcggcaaagctagcatttaaatcatagacgcttgcctctgcaaagctgcaaaaacaaataaaaataataataaatcacagaccaagccaggtgtggtggcttacgcctgtaatcctagcactttgggaggccgaggagggaagatcacgaggtcaagagagggagaccatcctggccaacatggtgaaacaccgtctctactaaaaatacaaaaattagctgggtgtggtggcgcctgcctgtagtcccagctacttgggagactgaggcaggagaatcacttgaacccgggaagcagaggttgcagtgagctgagatcacaccactgcactccagcccgttgacagagtgagactctgtctcaaaaaaat

SEQ ID NO: 133105 - DNA, 794 bp, Homo sapiens
cagaacagcatcaccatagctacagaaatgacataaaataaaatacaaagagagcccggcgtggtatgccccgcctgtagtcctggctactccggaggctgaggcggaaggatcgcttgagcccgggagttcaaggatatagagaaacatgttcccgcctctgagtaccactgtattccagcgtggttgacatagggagaccccacctcctgtagtcccagccactcgggaggctgaggcaggaggattgcttgagcctgggacattgaggctgcagtgagttgtgatcccaccactgcactccagtccaggtgacaaagaccttagcatgatgtctggtacacacgggcaatggtatcttgtatcatcatcatcatcctcttcattttttgttattgtcatttaaagtctttcagccagtaagcggcaaagctagcatttaaatcatagacgcttgcctctgcaaagctgcaaaaacaaataaaaataataataaatcacagaccaagccaggtgtggtggcttacgcctgtaatcctagcactttgggaggccgaggagggaagatcacgaggtcaagagagggagaccatcctggccaacatggtgaaacaccgtctctactaaaaatacaaaaattagctgggtgtggtggcgcctgcctgtagtcccagctacttgggagactgaggcaggagaatcacttgaacccgggaagcagaggttgcagtgagctgagatcacaccactgcactccagcccgttgacagagtgagactctgtctcaaaaaaat

SEQ ID NO: 133106 - DNA, 305 bp, Homo sapiens
gtagctgggattacacgtgcccgccgccacacccaactagtttttgtatttgtagtagagaccgtgttggccaagctggtctcgaactcctgacctcaggtggtctgcctgccttggcctccctaagtgctgggattacaggcatgagccaccatgcccagcctaagtctccttttgtaaagaaaataatcatcccatctgtgttttgaatttaaaataagtatgcattttctcaaactggctgtacatgttgttaatctcctagtatgtaggcagcattaccttatgtaaatatctggctagaa

SEQ ID NO: 133107 - DNA, 301 bp, Homo sapiens
cccaaccactctccacccaacaccacaaagagttaagatcaaaggaatcaaaaattttggccatatagcatttatctcttgctgacattagaaagggagaagggggaagtcactcctaggggagtcagactgccaactcttacctaacagcgtaagtttctgcaggctttttttttttttaattttttttttttttagttaatacatatattaggggaatatatagatagacctctttccatatcagaagatgtagattaccttatatttaaaaaaattttttttcttttttttttttttt

SEQ ID NO: 133108 - DNA, 182 bp, Homo sapiens
ccggtgtctctggatgcaagtgtcctctggatgtggctgcaaaacactgtctactgttctcaataaagcatcttgagttttctacacctcgagtaaagccaatccattaattcatttaattttcacagtctaagaacacatttcggtaatataccactgagtacaacaacattgcgatgaaa

SEQ ID NO: 133109 - DNA, 436 bp, Homo sapiens
ccagtgttttaaagtttttaaattttatatctttttttttttttaaacagatttgtaagactccagggcctcccagccgtgaataatctgatggttcctgaaatgactggggaagcagacgcttcgtatggcagttgaagagtgtgtgtctatgtgcatttaaaaccttctttctgtacttacacattcacacgggaagacaggctcattcttgtgcacacttgagagttttacaactgatgaaaattaatttaagaatcagatggagcaacttgacgccagtgggctcaggagcccggggagaaaaatacatcactaatggccagttttccatatggtctgcacgggtaaagaaagtctgcaaaaagaagaaaaaaaaatttgcgcagattaaaccacaaaaatattctccagtttaaagaaggaactaagtgag

SEQ ID NO: 133110 - DNA, 507 bp, Homo sapiens
caggctggagtgcagtggtgcgatcttggctcaccgcaacctctgcctttcggtttcaagcaattcttctgcctcagcctcctgagtagttgggattacaggtgcccaccaccatgctcagatttgtaagactccagggcctcccagccgtgaataatctgatggttcctgaaatgactggggaagcagacgcttcgtatggcagttgaagagtgtgtgtctatgtgcatttaaaaccttctttctgtacttacacattcacacgggaagacaggctcattcttgtgcacacttgagagttttacaactgatgaaaattaatttaagaatcagatggagcaacttgacgccagtgggctcaggagcccggggagaaaaatacatcactaatggccagttttccatatggtctgcacgggtaaagaaagtctgcaaaaagaagaaaaaaaaatttgcgcagattaaaccacaaaaatattctccagtttaaagaaggaactaagtgag

SEQ ID NO: 133111 - DNA, 511 bp, Homo sapiens
ctcgtttagtcctgggtcaagctgagtatctccacgtttaggtgcacaaatactattttgtgaagatcttaaatttgtggtataagaacttgaaggaaatagaactgatttgttacttctaaaagatttgtaagactccagggcctcccagccgtgaataatctgatggttcctgaaatgactggggaagcagacgcttcgtatggcagttgaagagtgtgtgtctatgtgcatttaaaaccttctttctgtacttacacattcacacgggaagacaggctcattcttgtgcacacttgagagttttacaactgatgaaaattaatttaagaatcagatggagcaacttgacgccagtgggctcaggagcccggggagaaaaatacatcactaatggccagttttccatatggtctgcacgggtaaagaaagtctgcaaaaagaagaaaaaaaaatttgcgcagattaaaccacaaaaatattctccagtttaaagaaggaactaagtgag

SEQ ID NO: 133112 - DNA, 327 bp, Homo sapiens
taaatctgaaatcatccaggtcctccaggccacataataccctggagctgaatttagtcctggaaataactgggaactttcacttttctcctcaatctgaatgtattcacttttaaacactctagaaaaatggcattggaggttcaagtaattgtagattcatgtgggttttgagagtgtgttagagactagggtatgggaggttcatgaatgtcttatttaggagcccatgctttattctgtaggcaatgaagaaccattgaaagtatttgagatgatgagtgacataatcagatttgcattttagaaagatgactctggaagcag

SEQ ID NO: 133113 - DNA, 571 bp, Homo sapiens
gtatttttagtagagacagggtttcactatgttggccaggctggtctcgaactcctgacctcaagtgacccacctgccttggcctcccaaagtgctgggattacagatgtgagccaccgcgcctggccactaccttggtcagatcttaagttagtgttgactagtaaactctagcatgtacccattgtttaggttacataattttgccggatttgctttatctgtttctttcatgtggtggtgttgaactatctgcaagtaaatttcagacattatcttttgaaccctaagtactttgatatgcatctcctaagtactttgtcctatattatcccatctaagaaaattaattctaattccttaaaattatctaatatccagtccatattgaaacgtttttcataattgcttttttgaaccaggactcgagcaaggttcagatactgcttttggttttgtttttccagacctcaaaccctcaccctggccacattggtttctgtttcttgagataattcacatatcatacaattctcctatttaaagttttcaattcagtggttttagcatg

SEQ ID NO: 133114 - DNA, 196 bp, Homo sapiens
aatgaccaggtcacacaaaggaaaaaggatcaggattttcaggggaaagaggagaaatagagtgatcataaaatgtattgtccaacctaggacattttccaagacaaatgctacactggtcaggacagtgggaaaacaggcacaaactgggactttcctaggcaaattgaacatatgatcatactggtcaacaatg

SEQ ID NO: 133115 - DNA, 452 bp, Homo sapiens
ggcgttcagaggtccctgtcggtgcggcgtgccgtgctcatcaattctcatttggaaaaagatcattctggtaaaaatactgaaaatgaacactgcgggccggcgtgatggcctgtaatcccagcacttgggaggccgagagggtggatcacctgaggtcagaagtttgagaccaacattcttcttacaacttacaaaatcaacagcccagttccacaaaagcaatagctgctgccatcactttcactcctgctgaattcccaggagcatgggaacagagatcatctgggacacacatgtagcctaaaagttaaagaactctttctgtattgtgataatcattgtcatatgtgaatttcataatttcttaaaatatgttatctatttgcttccttgctagtactcatgtttaaatttatggctataatgttaagggagaaccagcattatat

SEQ ID NO: 133116 - DNA, 726 bp, Homo sapiens
tataacaattcttaacattcctatagggatttttaaatgtagcctaacaaatatatcttaaagtttatatgtaaaataaaagccaaagcaatttggaagaataacaaatcggaccaagagggtggtggtgttggctattttcatgcctgataacaagataaattataaagttatactaacaaaggcactgttactgatgtagggatggacaaatggatgaatgaaaaggaacatggagatcagccaaagacctaagcttatgtatggaaacttgaaatatgattgagatggcattttagttcatttgaacatcataaatcccgaaatagtactacacttggttttccatttgtgaaaaaacaaattctgttccacccacaaggaaataattttctgataggtttcaggacctacatgtgaaaagcaacacataacaactttttgaagtgagtatttggtttataattttaatgtaaggaaggatttctttagacatacaaagaacacataagaaagaaaaacactggcaaattgattatattaaaatttaaggccaggcatggtgtcttatgcctgtaatctcagcactttgggatgggaggccaaggtgggcagatcacttgagctcaagagtttgagaccagcctgggcaacatgacaaaaccccatctctacaaaaaatacaaaaattatccaggcatggtggcatgtgcctttagtcccagc

SEQ ID NO: 133117 - DNA, 446 bp, Homo sapiens
ccttctaagtgattcgatagaagtttttcaaggactgcacatttttgtttttcactatattttgtgcttttgacctacaacttacgcaaccaaattacataagttttcatgtaacacctacattgtcaaaattcaatcaatttatgtagaggagttgccaaaaatagttccatacaatatcaaattatctctctcaaaggactctgcctctttgccttctcccaaggaggtttgttttaagcagatttcctactaggttagtttagttctgcaagtaagaactgggtgtaaatgtagtcagagtaaactataagaggtattattaggaaacattattgttgttatagaacttaatattgacgtatgtcttttaaaaagcattttgtttcccaaaaatcctctgattgcaaatacagtccctttagtgtcttcatagctgccttgat

SEQ ID NO: 133118 - DNA, 680 bp, Homo sapiens
acctcaggtgatccaccagcctcagcctcccagagtgctgggattataggtgtgagccaccgcactcagcctccctttattcttttaagttacgggatgctttttaaaattttgacatatgtgtttttttaataatacttttcctacttttgtatgcttagatgctgtgataaagatctctggctttataatttcaaacaaggaatcattgaataggaaaacatgaaaattaggtcatacacatagtaccagaaaatatcaagtccattggccatgtgatcgtaactgagatagcactgagcaattaatgaccgtgtaccttacgtggcaaagaacccaagctgaaataaataggttcctaaaagacagattatataatttacatacagaattatgacagaatttctagttagtaaaagtatgttagtttaagctttattagttcagttataatggtcactctagtagcaaaaggatggaataataaaatttacttatttagcaagcttttaaatataatataaattaaaagattaaacattgtatagtaaaagttaaaagtcattgaaataaagtttcgggtttttttgggttttttttgtttttgagacagagtctcattctgttgcccaggctggagtgcagtggcacagtctcggctcactgcaacctctgtctcc

SEQ ID NO: 133119 - DNA, 397 bp, Homo sapiens
catgggagctgtagttaagaaaggtgaagatatttattcagtagtctagaaactggcccaaaactgtattacataaaacttccgctctctctggaaagaagcggagggaaacagaagtattggtaacttcctaagtgcaggcatatgctaggcattttaatttaattcagactcctctgtgagattattctcatcttacaaatgaggaaacagaggctcactgaaacttggaacccagctctatctgacccaaagcttctggtctctctatttcatccatgagtggttttgcatttttccacagggcagccaccataactgcccatggtttcctactgctaaatgcaaatatttgaattgccttaggaaaggcataatgcagagtgattgcttagag

SEQ ID NO: 133120 - DNA, 714 bp, Homo sapiens
gcttatttgttagttgtattatatttggcagttggatgacaggatatgttttagaatacctgaataaattagggaggatatatttctttaatatgattgttttaagttgtagatggcactcatggtaatgttttagtaatctaaatgtactcgtgtatgtaattaaagtttggataatcattagtgatattaaacccctcaaaaaattacattcttccctgggtctaggaagcatcttctgagttaatctacactagcagttttaaaactgtgtatgttccctagaacagttagaggtctggaaaggtataagaaattgggtgatcagaattctcagttccctcttgaaagcttcatccagggatgcttaatttttttggttttgtatgttgggatttcacacagacatattttctaattttgctatttcaaaaaatgttgcagtacagacttttatgaacatctgtgatactcctttaatatagaagatgaatcattgggtaaaaagatagtcttatctaaaatttgatagactaccaaattacttcccgaacagtgtttcctagtttatacttctttcaaaatctatggaaacatcatttcttttcatccttgacatcatttaatattaccatttttttaatttaaattttagatcttaaaaatttgaaaatttaccaacttgattagagtgtgtacctgattactagccag

SEQ ID NO: 133121 - DNA, 167 bp, Homo sapiens
aagggcagagaattggtcattgatgatacatctctcaggtatataaagatatgacattagtgggttttttcctgccagtttgtcagagataatgctgcacattttcacaaagcccatttcccttcctcctgggcacacaggtagattacattccccagcctcctctg

SEQ ID NO: 133122 - DNA, 290 bp, Homo sapiens
ccattgagcacctgccaacagagaagttgaggaagagcctaccatgactgtcaaaagtcctaatcagggaaaagggaaagccaccatcctgtccagattaggcagcctggtcagtggagagagctgataagaagaaccaggatgaaaattgctgaagagcatctcaaacacaattagaacacaggtgcaactaattctccacaaatgcctttgagatgtacattgcctatcaattgcaactttattttcaggacagttatgattaagtcaatttaaacctatagttatcc

SEQ ID NO: 133123 - DNA, 104 bp, Homo sapiens
gcagggaataggatgaaaatgaacaactttaccctctcatacttcaacaagctccagaaaactgaatctgctttgtaagtagcttcagttaatgaggattatta

SEQ ID NO: 133124 - DNA, 121 bp, Homo sapiens
agagagaactcagtctaattcagggatccaacattctccttgaattaaggagcgagaatcaaggttttaggaaagacaaggcggctgaagtttgccgggcagtgcactgaagaggacagag

SEQ ID NO: 133125 - DNA, 428 bp, Homo sapiens
tctcactttctagtacagtatctaacttatttgggtttattttctgcttccttctcctactagaatgcaagtttttgcaagaaggaagattgtctcttttatgtcactaaaatctatgagagtatccctagagcctgtaacagttcctgacatattgtatgtatcacatacaatagatgaagatggtcagtaaacacttgctgaggacaaagaagtgtcgaacacttggctgggcacagtggcgcacacttataatcccaggactttgggaggcttaggtgggtgaatcacctgaggtcaggagtttgagaccagcctggccaacacgttgaaaccccgtctctactaaaaatataaaaattagctgggtgtggtggtgcatgcctataatcccagctactcagaaggctgaggcaggagaattgctt

SEQ ID NO: 133126 - DNA, 819 bp, Homo sapiens
gaggaataagacccaaatgaatgaacccccatcagtcattcgtatcccccagctgatgaggatttcagcagttgtgctgacaccttgatcttgggctagccaccctccccttgctctgccatggagcttggtcaccttgtaccatggtcaaaataatggtgctctctttcaaaagccatccttagatttccagctaatagtgtgtagaaaagagaaaacataattttttagtaccccaaattctaggttatctactgcactgaatgatctaaaatatcaagtaggcgctttcagcaaagctgttagaaatataaatagaaaaaataggaaagattatttgtgggaccattcaaactaagactgttgttgttctcattattattgttgtttttaaaggacactgtccatatattgcaagacatgttgcccactgcccttcacctatgggattatataaacgcaatcctattttttaaatagttgtgcagaaaatcgagaagggagctaccttaactgtgtattcagttcttgagtgacaaagacaggcgtgagagagagagtcccttgcttccaaatcacccctcctttgcctcacccttttcaggacaaaccgactaccagaaatgaatctaacccatgtggtcactacaggatttatctgggcatttgctgaacctgctcgcaatttatttttatttcttccgatagacatggatttggcacaggggagtgaattctttttgaagcagcagatgtgcctggtacacccgtttgctgtaaccatttgtgctgtggttgaaaaaaatttttttaagagtg

SEQ ID NO: 133127 - DNA, 419 bp, Homo sapiens
tagaacaagcaaaaagcacaatgagtgtgaaagggctctggccctcaagtctggctgcacgttggaatcacctggtgagcttaaaaatactggcacctagatgccaccccagagattctgatttaattagtctggggtgcagtctaggcatcaacatttttaagagttttccaggtgtttctacatatgcaatgaagtttgaaaaccactgggctagggcagtacttctcaaactttaattagtatagaagttacctggggatttttgtaaaaaatatagaccctgattcagtaggtctggggtgaggcctgagattcagcatttctcataagttctaataagatgatgtttctgggccatgggccttgcttagcagcaagaatccagaaaatgtagtgattgctgtggctactgttag

SEQ ID NO: 133128 - DNA, 454 bp, Homo sapiens
ctgttagcagaagtaaatagccatcatcacaatagctggtctttatcaatgcgtagcatgtaccacgtgcacggtgtgcgttgacctttattcctggtgataactgcatgtggtaggtgctatcatcctcctgattttaaagacaggttaaggccggtcgcagtggctcacgcctgtaatcccagcactttgggaggctgagagatcatgccactgcactccatcctgggcaacagagcaagactctgtctcaaaataaataaataaagagagattaagtaacctgcccacagtcatgcaactggcagctgggatgcaaagctaggtcacttgcatttttgcccttccttgctgcctcttgcagccaaaaggggacttgaaacccaggtccctgtgcaggagggagccatgaggcttgggaggctgagcgtggctgctgcgacacagctctgtg

SEQ ID NO: 133129 - DNA, 269 bp, Homo sapiens
catcattatccattagacacttagagggaaaatgactgcatttgggtttggggataaaagggccaccatttcctcccacaaaggcaggtgtctttctctcagaacacgtggttattaaatattgctgttattaatattgtgaaacgacatcagactcaaacccttctcccagcagaacaggagaaggaggctggctcccctcccctgatctgtttctcctaggctgaccggaggggtgtcccgtcccccgctttccctcgacggttctg

SEQ ID NO: 133130 - DNA, 840 bp, Homo sapiens
agcaatagaacctggtttctatgaaaaataagaaccattaaacatttcagtctcatcgaactcaaccaaatcaagccaggcaattttttgagaatttaaggtcagaatcccaatatcttaactacatttcccaatctaaaaaaaagtgccaggactgaagcaacttttaaaagaaaggaaactggctgggtgagatggcttgtgcctgtaatcctagcactttgggaggctgaggcaggaggatcacttgagctcaagagtttgagaccagcctagccaacatggtgaaaccccatctccaataaaaatacaaaaattagccaggcatggtgacaaacacctgtatttccagctactcaggagaccgaggcagaagaattgcttgaacctggaaggcggaggttgcagtgagctgagatggtgccactgcactccagcctgggcgacagagtgagactctgtctaaaaaaaaattaattaataaataaaaataaaagaaaggaaacagtaaactttgctcatgttgattatgttttctagcactttcataaatttgaaaatttatgtgcaatgaatccaagattgccaattgagaagtaattgctatttgacactactgttgggtgatctagacgaagactatttcatgatacgctgaagcgctgcattcatatgtattccttcatgttctaaaacaactgtgcatgtcctccaaatagtcttaacatttagtagactttgaaactactcacctatcaaatttttgcttaaaaaacagattgccggccaggtgctgtgcctcctcatgcctgtaatcccagcactttgggaggccaaggc

SEQ ID NO: 133131 - DNA, 503 bp, Homo sapiens
gtaacattgctgaaaaacagagacaaagaaaagaaagatgcggtatattaaaaagagcaataataactgacaaatgacaccacagaagacaaaagaatatactatatggttcaaagaaacaattgtcacctaaagttctgtatgattaaaattgaaaatgaaatatcctttaaaaaatgaaatattcttaacattaaaggtgaaataaagatatttgcagacaagcaaaaattgagagaattcagcagccgcagattgcattaaagaaatactaaggacttttcttcaggagagaggaatattacttttgacagctgcttggagattgtaggaaggaatgaagcggtaaggttaacatgtgggaacctctaaatgaatattaaaggcatggtacagaaatgagaaagagaggaggtaaacagaacccagtgaataagtttacaacagtttaaacacagcacatatccactttcaatgccttcatttccaggaacatatttttt

SEQ ID NO: 133132 - DNA, 384 bp, Homo sapiens
ccccctttaaattcctctagcctagtggctccaaacctttttgagtatgagggttcatttttatcatcagaaaccttctggaagcttcacataacaacaggtgtgctttgagtaactgttttaaagaaaattcgaggacagaacctactcctaatccagtcatgcttcgaaatgaagttctgtcttgtcatcaaaacagcatcagtgtaactctgagagcaggccttacctgtatgtgtgtgacacctggaatttgacctttgtgctgcctccagttgggagcctcctgtcatccctactgcctcccttttctgaaaccttacctggcttaatccaagaccgtctccctcaggaaccattcatcattttaacaccttatattcc

SEQ ID NO: 133133 - DNA, 1138 bp, Homo sapiens
cacttttctaagtcttaagagtacaaaagagtatgagatagaagaatatgatacgtgagagagatactgtggggacgggctcatgaaatcctcgctgaggaagtgaaattaagctgaaatctgatttacaagaaagagccaaccatgtgaatatcaaaggaaagaatatcctaggcagagggaagagctcttagagacctatagtgagaataagcttgatatatttgagggactaagagaaggtaagtggcttaatgcctggtggggaaagaggaatgccatacaatgagggtaggaagtaagcagaggcttacttacattacacagcagagtgtgttttcatcagaatgttataagaagctgttctgagggttttaaacaaagaggtgacctaaatattttacattttgtaaatcctttggtacaggagataagtgggcacaagtgaggaatgatgtttgtacagcagtgatagtaatggagttggactggcaaggatggatttgagatacattttgaacttagatggtaagacttgcttggtactttgaatgcggacattggagttaaagagcagaatcagagatagcttagattctttgacctaagcaaaatgacagataagtagtgccagttactaagatggctgaggatttggagagaaaaatgaagcattttgttgtgctaatttcagatatgcctacgagacatcccaggtagagctgttaatgaggcacttatcgtcctgaggtcaaagagtaggactgaatataaagatttgggcatcattggttttaagtggaatgtaaagcatgtgactgggagagtatgtggtaaacaatggaaggaagccccagaaaagccagccagaggaagaagagccagcaaaggaaatgaagaggtctttgtgatagaagaaaaccagcagagaggtgtcatggaagctaagaagaaaatgatttttagaagagagtgctcagctgtccttttatgaaaaagcaacctatacccaaaacttagttttaaaagcccaaattacaagattttggactctgtaatattccctatgtacttcaaacatgtagtgagaaaagaatgttgaaaattagcttagtgccacagagtggtagaggccttt

SEQ ID NO: 133134 - DNA, 794 bp, Homo sapiens
atgtatgccttgttgcacatctcaacccttgaaatcagataggacaccaccaccttcatatcccacattttctccttgaagtacttttaatcacagtgacctgcaaaaacatagcttcatagagatacattatcaaagggaatgtcacgtgcgtgatcgtactttgaagctgaactgtctcgagcgagtagttcacgcggtgtcctgcagatactgcggtggccgtttccctcaaatgtcagatatccatttggcgcccttctgagttatctgcagtgccccggggtgcctcagctcagtttgggggtggttaggctgaagacatttgctaacaagtcctgttgttgaattagttccaactcaggttcagaggctttttagagctggaaacactggcagagtcaaagttcatgggaggtgattaaccaaaccagatattagggaaccagaagggcgacattttccactgataggcaaaagtccaaaaaccccacagtgtcagggctgtttgccaagtcagcaagtctgtgaagatcgcttccaagctggttctgttactgccagcgccccctggcgatgctactcaaggcttacttgagaaccatcagcagctaggaaggaggacaagtctactaagcggggaggggggaggaatagcattaggagatatacctaatgctaaatgacaagttaatgggtgcagcacaccaacatggcacatgtatacatatgtaacaaacctgcacattgtgcacatgtaccctaaaacttaaagtataataataaataaaatt

SEQ ID NO: 133135 - DNA, 387 bp, Homo sapiens
tgttcaaatccccattctgccacttactgtgtgaccctggacaagtcacttcccatctctgagccatgttcttcaggctaagtactggatatgggtgataggcattgagaaatcagggaggttatgtagttagaaggttatgcaccctttcagagaagggtgggaaggtcctgcccaggcatagaatctggaggagaaaagaatgtagggtgtgtgggagagtctggagatgggcgttacccccagaggtaggaggtgctgagggcgattccctcccactcatccttcggggctctgctagggtggcacctcctcccagaccctcccaggttccctggtgcctgtgttgagagtctctgccttgggtttggtcgcctctctgcccat

SEQ ID NO: 133136 - DNA, 442 bp, Homo sapiens
agcagctctgtggtaggagagtgagcctagaagatgaccccatgcagcctagtggccctcagagggcagaatccagacataggcctgctgcctccatgcccacaggcgctcctgcagcatgcacagcttagaagcaccaggtttgatatgaggagagggatccttatccacatctccttgaagcacacaacagtcagaaaactgtaggcaaggatcaaggcctcgtgcagggacagggcagggtcttccccaggccccgtgtcttgggaaggaggaaagccggggctgggtgagatgaggctcggcctgagggagttcatctggaccagagggctgcttgcagcccatctcaacaaagactcgctgctcctcactgctcggtgtcgtgcaggtgtgccactgcgagccgggcgggcagcccagccccataggtagtgggcag

SEQ ID NO: 133137 - DNA, 326 bp, Homo sapiens
tcctgacctcaagtgatccgcccacgttggcctcccaaagtgctgggattacaggtgtgagccactgcacccagcccggatgagtgttcttaaattggctcagtgggctgctccccaaaccctcaggcctgggtcagccctggatcccaggggaggtcatgccactccagatacttaggccctccttgtggaggatgtcgaaaggcacacatacatgatttgtggcatctgatgtcatctttccccagagtatctgcttagcctgaaaagtatgtcacctttttcacttattatcagttctatttcttaatttggtagacactgtg

SEQ ID NO: 133138 - DNA, 299 bp, Homo sapiens
acgtcaagggaccctcccaaagtgctgggattacaggtgtgagccacccgcacttggcctgtatttgtatttaggacattagactagggttggcaaacattttctgtaaagagccagagagtaaatattttcagctttatgggccattagtcatagccattcagctctgcctttagagcaggaaagtagccgtggacaatatataaatgggcatgaccaggtttgacctgcaggcgaccatgcattaaattgcaagaaaacatctcaggcacaattatgctaagaagttacagtgagat

SEQ ID NO: 133139 - DNA, 416 bp, Homo sapiens
gctgaacttgcaacatgtgagaacattttgtgcaaaggagacaacctggagctccagaggacctacactcagtgaatgggcttggtcctacatccaaatatacatgaggacatgcagagaaatgttcaagtatataggtatcatttttgtggttccctattttaacttatttaaaaatgtagtaacagtatttttaacataggcaaaaggagagaaaataatgtatttccatatactcaaactaggttaaacagttacaaagatttttgacacatttgcttcatctatcccatattttatttctctctcaagtattttaatgcaaattcttgaaaacaatcacccctacagacgtcagcagacatctgcagaaatattttaagccagcttttgattgctgaccaacctgtggtaca

SEQ ID NO: 133140 - DNA, 655 bp, Homo sapiens
cgccgagcctcggagagcaggggctttgcttttccggctgaggtgttcaataaacatctcttaaacaaaggagtgcgcaagtgagataatataagggggatgcccaactatacaacaaagagttgccaaacatttctctggagcaaataaatggtgtgatggatggaactaactggatcaccaacctgtgagagatggctggttcactggccttggcctcctcgggccatgacattaattcactggctccaccctccaccctgttctatggccctgggcgtgacttgctcttgccccttgccttctgtttggatcctgccaatgaggactcctagcaggagatgggggctctcatatttaactgaaaggctcagctccacgcagcgtttctgtctccagcccacacagcacgatgagataaagactagaggctgctcactgctgagagtggaccatccagctcatttggtcacataatttccagccagccaccttatgggcaagattttggctcacctgtaagctattagctggaaaatactggcttcatgaaatggcttggaagatttggaggcaacctaaatgtccatcaacagatgaatggataaagaacaacagggtgactaaagtcaataataatttaattatacattta

SEQ ID NO: 133141 - DNA, 6848 bp, Homo sapiens
agtccgcctgctactcggtcccggcgctgggctgaggggaggggttgtcttaaaagtctctccttccccctgtaggggcggccggcgagtcccagtgagagcggagggtgccagaggtagggggccgagaaacaaagttcccggggcttcctccggggccgcggtcggggctgcgcgtttgaccgcccccctcctcgcgaaggcaatggcttccaaactcctgcgcgcggtcatcctcgggccgcccggctcgggcaagggcaccgtgtgccagaggatcgcccagaactttggtctccagcatctctccagcggccacttcttgcgggagaacatcaaggccagcaccgaagttggtgagatggcaaagcagtatatagagaaaagtcttttggttccagaccatgtgatcacacgcctaatgatgtccgagttggagaacaggcgtggccagcactggctccttgatggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatggtattgatgacgtcactggtgaaccgttagtccagcaggaggatgataaacccgaagcagttgctgccaggctaagacagtacaaagacgtggcaaagccagtcattgaattatacaagagccgaggagtgctccaccaattttccggaacggagacgaacaaaatctggccctacgtttacacacttttctcaaacaagatcacacctattcagtccaaagaagcatattgaccctgcccaatggaagaaccaggaagatgtggtcattcattcaatagtgtgtgtagtattggtgctgtgtccaaattagaagctagctgaggtagcttgcagcatcttttctagttgaaatggtgaactgataggaaaacaaatgagtagaaagagttcatgaagaggccctcctctgcctttcaaaaggctggtcacctacacatgtttaaggtgtctctgcacatgtctcaagcccatcacaagaaagcaagtacagtgtggatttcaaatggtgtgtaacttcagctccagctggtttttgacagctgttgctgtggtaatatttttgacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtggttgtttctctggtcttgagtgactgtgtccacagttcatttttttccggtaggaataactccttttctacatccacgctccatagagtctctccttttcagacatcctgggatgaaagaatttggcttttttttttctttttttttttggacatctgttttcactcttaggcttttaaacaatagttattgcttttatccctctcagattctaataactgagagcgatggggctatattgaatctctgtatgcactgagaactgagctatgaagaggatcttattaaactgctggtctgactttatggattgacactgttcctttcttttattgtgaaaaaaaaaaaaaaccctgaaagtcttgggaaccccctaaagtcttttgggaatcctcaaaaagcatgggaagttaagtatttagctacataaatgttgtaagatcatatcttatgtatagaagtaataagaccatttggaattactggactaattgaatagttaaggtttctattcgggacaataaaatgtattttgaaagtgctgctaactattgatgctgacagtgtttcactcctatgagtgacccaaacatattataaatatgtggtaaagggaatggagcctgtggggttgagcagaatgttgtactagctgtgcctggactgagtataacagctttatgattatgagaaaacaaattctttattttttttttctgttccaaagattcatcctatggggtggccataaagtctagaattagatactaatattttgtcattcattataacatatcaataaaccatttgttaaaagatttgcctggtttccagacttggtggccaccttgaataattcttgctgtcttctgggaaggatgatgaaatttattcctgctgccttaaaaatatgtatcccttcttcacccatcatgactgtccccagtgagtgtcctttactattcttgggagtgactcctgtctaacttttcatactggcgagaagaaaagaagcctattttaacactttagtggtgttgaaacacattacttactttctgaagatgtcccagtgaatcctctgtcaattcactgccatatgtaatctatatgataaggaatgcatcttccttctaagtactgcccaaactcttgccagctcctctcccattgtcccttcatgtgaatatttcttggctaccttagtggaaatatagatcagttttctccccatccatcctctcaaacataatgagattgtttactttttagatttatgcagtgaaaatgcccagtcaggtctgaatcgtcagtgcattatattgactctgagcactttagaatttagagttgcaattgaatgccagctgtggagatggggtgcatatcagatatataaataaagctcaggtttgctagggaaccaggtatagagaaaaataagtctgatatgaggaaaattgcacaatttagagtagttatgccgtagagaaaatttccacaaactaggaaatgtagagagttattctatagaatactcaaaagaggaaagtatgtgatttttggaaacaggaaaatcttcaaacttctttcttcacttccctttgtgtttagctgaccctccaatgtgatcattgcctttggagtttgggagaggtacgggaagtggcctgatccctgcttccatacttcactcctccatccatccttccctccctcttcccctccagctaaatggacaattctagccaacattgagtcactcaataagtctcaacagtgggtgtgtttgctgagattgtccagcggttgagcagtttggtctcacctccctcgctagttgagaccaaaaagagacaaataactttttcatggtctttgaaacataatgcttatttcgtggtcaatggctttaaaaaaatctgtttcttgttttcttcaacaaactcactagttttcccttaaatgatattgtaaaaattaaagtaatcttgaaaatgttttgacaaaagtaaaattaaagggacatcttttaaaacttgttttgtttttttttttctattgccacacatgaccgttccttcacctttaagcaaagagagtggttcagatggtttctaagatgccaacctgacctcgcattctgtcattctacccagctcttaattcaatttgcttccattatcctaacaggcttctttcttacttagaacttggaaaggctgctgtatttaataccctccaacactaacgcagacttaagataggtactgtttattgaaaacctactgagtgaaatgtgcggttttaggaccttcataaacatctcatttaatctttctagcatcctgtgaaacagccatgatttcacgttgataaacaaagaagacaggggtcccagggatgtgaagcatcttgcccaggcttctgctgctggtgaccagtgtagccaggactccaacccaggttttcctgactcagaagactgagctttttcctggatgttattaatagctaattgtgtccaagcaaccaagggccttgagtctgcttggttctgcttatggcctcacatcaagaaatggagctagtccatgtctgtagtcccaatgctttgggaagccatgatgggaaggttgtcggaggccaaaagttcaagaccaggctgggcaatatcacaagactccatctctacggaaaagtaaaaaattagccagtcatggtggtgtacacttatggtcctagttactcaggagacttaggcaggaggattgcttgatcctaggaattcgaggctgcagtgagctatgattgcacctctgcacccaagcctgggcgacacagcgagaccctctctcttaaaaaaaaaaaatagcagagctcaccaaagtgatgttcacctttttatgacattcctttttcttagcttaagaaaagaaagctgctagatgagagtcttagttttcctgcataagacctcctttatgaatagaataaaagactgtcaaagtaggctgggcttgggcccaggctaatctatgaaggaagcaagctcgtgttccttacctatccttttggtgtccattggattgtgccccgaagtggcctttacccttgagccgtccccagccatggtgctcacacataggcttttgagctccttggagctatccagatcctgctcacttttccttcctgagatcagaacaaatcacccccttactcccactccaaacaaggccttgatgataaactaatccttcctaaaatgctggtaggtaaacaagcaatgatgaagcattgaacacaggttaactcctgacttttgtaccattgtctattccattacacattaacatgactctgaatgccagatccaaacctttgcccaccatctgcttgtcgtgcaacagttgaggcagtaaccaggggagattcacttcctgtcttgtccttccccagggatcacccccctgctgccctctagcagccaaactcagatgagttccattgttaccctaggtgtgcccatctctttggtagggaaggagaaaggtaagaatagccatcagtgaggaaggattcttggagcgaggagccactgtggtttttcctgctatttaagatgttgagaccggataactttagaaagatacctgcacaaacccataaatagtgcttttataaagtttagttcaccggaacctgagttcagtatttgacattagctttttgtccaaagagttgaagcctgctggaggtctttgctcaaataataaataccacatatttccaagtgtgttcaggtataggcactaggtactgtctgtttacttcatgttaggcacattacatgcattggctaatcaaatcctcatcaattacatatgtaataatctaaacttgcctccttgtattataaatggaaataatcctgtttatttaaacgggttttcatgtacctgtagggattaggaaactcaaatggcctttttaatacctttccctagtttgagctccctgttctctttaacagataaaacaacatatttgcttcagcctggaatctgtttttggtgctttggtgcagagacaggaaatgggcactcagagtcacactggtagttgcacactgtatctacagagggcgtgtctcatctgtactctgctgggttacaggatttcagtaggtatttgtgtccacctgagaattctgtttattacctttcatttgacagtgtctttcctttctgcagttgattttgctagagaggcaattcataaggtgaggtcctgttcatagtatgacttgctttctcaatatctccttcaatttttagtaactcttggtctatttggtgtctttaaaaaaaataacctagtaataaagacttcttttaatgtggaaatgtggtctggtagtaagttatttctttccacatgtaactgacccaatctggtttccaaatgagaagtgtgcaggccccagaggttgagaagccatatttcaactgtgaaaaaaatctgcttcctgcatctgttgaaatatagttgttcatacttgccatcccttatctttcttgtaacaatttgcacagttcttgccagaataaatgccattatctgtatgtttcagggagttccccaatttgatcatttttgtgtgtgtgtggtgtgtgtgtgagagagagagatactgcagtaaaacatttctaaaggatgaaagctcttgtatggcatagatatgaattccttcctctggtaataattaggttattcccagaagcacagtgtcattctttaaataaaagctttcctgtttaaagcttttcaaaggagcagaccaccttgaagattccccctagggttgatatgtgtctaattcattttataaaaattattcttgtcttcattttaaagctttggctatatagtcagaaatgtcctaaataacaaactattttgtatttaatttagggaagactaaagggaagaaaaatgaaaactcagtctttatgtaagctccaaggatattagggcttaaagggcttttctagttttatgagaatttgtactactgatttttatatattcctgtttttgagatgaacagatctctggggaaattgttgagttacaatggcatttcactgtgatccctctcaagctcagatcagttctataacccaatgacaacctgtctctttggtttactgtcctgtgaaatgtcagctcaagtttcccagaagtcgtgtgtttatgatgagtcagagtgcttttcctcggtgggacagttgctggccctcttaattttggtgtatgtgcttccaagtatctaaacctccagtctgatctgtatatgctatcctaactgttaattgtattattgattatgttgattatcttgcttgaaggttcatacttttcaatttgatagaaataaagtttttttctgcttatagctagcgaa

SEQ ID NO: 133142 - DNA, 6794 bp, Homo sapiens
agtccgcctgctactcggtcccggcgctgggctgaggggaggggttgtcttaaaagtctctccttccccctgtaggggcggccggcgagtcccagtgagagcggagggtgccagaggtagggggccgagaaacaaagttcccggggcttcctccggggccgcggtcggggctgcgcgtttgaccgcccccctcctcgcgaaggcaatggcttccaaactcctgcgcgcggtcatcctcgggccgcccggctcgggcaagggcaccgtgtgccagaggatcgcccagaactttggtctccagcatctctccagcggccacttcttgcgggagaacatcaaggccagcaccgaagttggtgagatggcaaagcagtatatagagaaaagtcttttggttccagaccatgtgatcacacgcctaatgatgtccgagttggagaacaggcgtggccagcactggctccttgatggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatggtattgatgacgtcactggtgaaccgttagtccagcaggaggatgataaacccgaagcagttgctgccaggctaagacagtacaaagacgtggcaaagccagtcattgaattatacaagagccgaggagtgctccaccaattttccggaacggagacgaacaaaatctggccctacgtttacacacttttctcaaacaagatcacacctattcagtccaaagaagcatattgaccctgcccaatggaagaaccaggaagatgtggtcattcattcaatagtgtgtgtagtattggtgctgtgtccaaattagaagctagctgaggtagcttgcagcatcttttctagttgaaatggtgaactgataggaaaacaaatgagtagaaagagttcatgaagaggccctcctctgcctttcaaaaggctggtcacctacacatgtttaaggtgtctctgcacatgtctcaagcccatcacaagaaagcaagtacagtgtggatttcaaatggtgtgtaacttcagctccagctggtttttgacagctgttgctgtggtaatatttttgacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtggttgtttctctggtcttgagtgactgtgtccacagttcatttttttccggtaggaataactccttttctacatccacgctccatagagtctctccttttcagacatcctgggatgaaagaatttggcttttttttttctttttttttttggacatctgttttcactcttaggcttttaaacaatagttattgcttttatccctctcagattctaataactgagagcgatggggctatattgaatctctgtatgcactgagaactgagctatgaagaggatcttattaaactgctggtctgactttatggattgacactgttcctttcttttattgtgaaaaaaaaaaaaaaccctgaaagtcttgggaaccccctaaagtcttttgggaatcctcaaaaagcatgggaagttaagtatttagctacataaatgttgtaagatcatatcttatgtatagaagtaataagaccatttggaattactggactaattgaatagttaaggtttctattcgggacaataaaatgtattttgaaagtgctgctaactattgatgctgacagtgtttcactcctatgagtgacccaaacatattataaatatgtggtaaagggaatggagcctgtggggttgagcagaatgttgtactagctgtgcctggactgagtataacagctttatgattatgagaaaacaaattctttattttttttttctgttccaaagattcatcctatggggtggccataaagtctagaattagatactaatattttgtcattcattataacatatcaataaaccatttgttaaaagatttgcctggtttccagacttggtggccaccttgaataattcttgctgtcttctgggaaggatgatgaaatttattcctgctgccttaaaaatatgtatcccttcttcacccatcatgactgtccccagtgagtgtcctttactattcttgggagtgactcctgtctaacttttcatactggcgagaagaaaagaagcctattttaacactttagtggtgttgaaacacattacttactttctgaagatgtcccagtgaatcctctgtcaattcactgccatatgtaatctatatgataaggaatgcatcttccttctaagtactgcccaaactcttgccagctcctctcccattgtcccttcatgtgaatatttcttggctaccttagtggaaatatagatcagttttctccccatccatcctctcaaacataatgagattgtttactttttagatttatgcagtgaaaatgcccagtcaggtctgaatcgtcagtgcattatattgactctgagcactttagaatttagagttgcaattgaatgccagctgtggagatggggtgcatatcagatatataaataaagctcaggtttgctagggaaccaggtatagagaaaaataagtctgatatgaggaaaattgcacaatttagagtagttatgccgtagagaaaatttccacaaactaggaaatgtagagagttattctatagaatactcaaaagaggaaagtatgtgatttttggaaacaggaaaatcttcaaacttctttcttcacttccctttgtgtttagctgaccctccaatgtgatcattgcctttggagtttgggagaggtacgggaagtggcctgatccctgcttccatacttcactcctccatccatccttccctccctcttcccctccagctaaatggacaattctagccaacattgagtcactcaataagtctcaacagtgggtgtgtttgctgagattgtccagcggttgagcagtttggtctcacctccctcgctagttgagaccaaaaagagacaaataactttttcatggtctttgaaacataatgcttatttcgtggtcaatggctttaaaaaaatctgtttcttgttttcttcaacaaactcactagttttcccttaaatgatattgtaaaaattaaagtaatcttgaaaatgttttgacaaaagtaaaattaaagggacatcttttaaaacttgttttgtttttttttttctattgccacacatgaccgttccttcacctttaagcaaagagagtggttcagatggtttctaagatgccaacctgacctcgcattctgtcattctacccagctcttaattcaatttgcttccattatcctaacaggcttctttcttacttagaacttggaaaggctgctgtatttaataccctccaacactaacgcagacttaagataggtactgtttattgaaaacctactgagtgaaatgtgcggttttaggaccttcataaacatctcatttaatctttctagcatcctgtgaaacagccatgatttcacgttgataaacaaagaagacaggggtcccagggatgtgaagcatcttgcccaggcttctgctgctggtgaccagtgtagccaggactccaacccaggttttcctgactcagaagactgagctttttcctggatgttattaatagctaattgtgtccaagcaaccaagggccttgagtctgcttggttctgcttatggcctcacatcaagaaatggagctagtccatgtctgtagtcccaatgctttgggaagccatgatgggaaggttgtcggaggccaaaagttcaagaccaggctgggcaatatcacaagactccatctctacggaaaagtaaaaaattagccagtcatggtggtgtacacttatggtcctagttactcaggagacttaggcaggaggattgcttgatcctaggaattcgaggctgcagtgagctatgattgcacctctgcacccaagcctgggcgacacagcgagaccctctctcttaaaaaaaaaaaatagcagagctcaccaaagtgatgttcacctttttatgacattcctttttcttagcttaagaaaagaaagctgctagatgagagtcttagttttcctgcataagacctcctttatgaatagaataaaagactgtcaaagtaggctgggcttgggcccaggctaatctatgaaggaagcaagctcgtgttccttacctatccttttggtgtccattggattgtgccccgaagtggcctttacccttgagccgtccccagccatggtgctcacacataggcttttgagctccttggagctatccagatcctgctcacttttccttcctgagatcagaacaaatcacccccttactcccactccaaacaaggccttgatgataaactaatccttcctaaaatgctggtaggtaaacaagcaatgatgaagcattgaacacaggttaactcctgacttttgtaccattgtctattccattacacattaacatgactctgaatgccagatccaaacctttgcccaccatctgcttgtcgtgcaacagttgaggcagtaaccaggggagattcacttcctgtcttgtccttccccagggatcacccccctgctgccctctagcagccaaactcagatgagttccattgttaccctaggtgtgcccatctctttggtagggaaggagaaaggtaagaatagccatcagtgaggaaggattcttggagcgaggagccactgtggtttttcctgctatttaagatgttgagaccggataactttagaaagatacctgcacaaacccataaatagtgcttttataaagtttagttcaccggaacctgagttcagtatttgacattagctttttgtccaaagagttgaagcctgctggaggtctttgctcaaataataaataccacatatttccaagtgtgttcaggtataggcactaggtactgtctgtttacttcatgttaggcacattacatgcattggctaatcaaatcctcatcaattacatatgtaataatctaaacttgcctccttgtattataaatggaaataatcctgtttatttaaacgggttttcatgtacctgtagggattaggaaactcaaatggcctttttaatacctttccctagtttgagctccctgttctctttaacagatacaggaaatgggcactcagagtcacactggtagttgcacactgtatctacagagggcgtgtctcatctgtactctgctgggttacaggatttcagtaggtatttgtgtccacctgagaattctgtttattacctttcatttgacagtgtctttcctttctgcagttgattttgctagagaggcaattcataaggtgaggtcctgttcatagtatgacttgctttctcaatatctccttcaatttttagtaactcttggtctatttggtgtctttaaaaaaaataacctagtaataaagacttcttttaatgtggaaatgtggtctggtagtaagttatttctttccacatgtaactgacccaatctggtttccaaatgagaagtgtgcaggccccagaggttgagaagccatatttcaactgtgaaaaaaatctgcttcctgcatctgttgaaatatagttgttcatacttgccatcccttatctttcttgtaacaatttgcacagttcttgccagaataaatgccattatctgtatgtttcagggagttccccaatttgatcatttttgtgtgtgtgtggtgtgtgtgtgagagagagagatactgcagtaaaacatttctaaaggatgaaagctcttgtatggcatagatatgaattccttcctctggtaataattaggttattcccagaagcacagtgtcattctttaaataaaagctttcctgtttaaagcttttcaaaggagcagaccaccttgaagattccccctagggttgatatgtgtctaattcattttataaaaattattcttgtcttcattttaaagctttggctatatagtcagaaatgtcctaaataacaaactattttgtatttaatttagggaagactaaagggaagaaaaatgaaaactcagtctttatgtaagctccaaggatattagggcttaaagggcttttctagttttatgagaatttgtactactgatttttatatattcctgtttttgagatgaacagatctctggggaaattgttgagttacaatggcatttcactgtgatccctctcaagctcagatcagttctataacccaatgacaacctgtctctttggtttactgtcctgtgaaatgtcagctcaagtttcccagaagtcgtgtgtttatgatgagtcagagtgcttttcctcggtgggacagttgctggccctcttaattttggtgtatgtgcttccaagtatctaaacctccagtctgatctgtatatgctatcctaactgttaattgtattattgattatgttgattatcttgcttgaaggttcatacttttcaatttgatagaaataaagtttttttctgcttatagctagcgaa

SEQ ID NO: 133143 - DNA, 7007 bp, Homo sapiens
  misc_feature (185)..(186): n is a, c, g, or t
  misc_feature (223)..(224): n is a, c, g, or t
agcggagccgccggggaggggacgagacgcagaccacacgttgcccacgtgcgaggaccgggcaggggctcagcccctaggccgcccggtgcgtggggctggcgggggctggctttgagtcacccccgcttgtgccagcttccccggctcggcggagactggcttggggatgcctggccgcccgnnccccttctcggacgcggcgtggggagcgagctggagnnaaggatgaaggggcggccggcgagtcccagtgagagcggagggtgccagaggtagggggccgagaaacaaagttcccggggcttcctccggggccgcggtcggggctgcgcgtttgaccgcccccctcctcgcgaaggcaatggcttccaaactcctgcgcgcggtcatcctcgggccgcccggctcgggcaagggcaccgtgtgccagaggatcgcccagaactttggtctccagcatctctccagcggccacttcttgcgggagaacatcaaggccagcaccgaagttggtgagatggcaaagcagtatatagagaaaagtcttttggttccagaccatgtgatcacacgcctaatgatgtccgagttggagaacaggcgtggccagcactggctccttgatggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatggtattgatgacgtcactggtgaaccgttagtccagcaggaggatgataaacccgaagcagttgctgccaggctaagacagtacaaagacgtggcaaagccagtcattgaattatacaagagccgaggagtgctccaccaattttccggaacggagacgaacaaaatctggccctacgtttacacacttttctcaaacaagatcacacctattcagtccaaagaagcatattgaccctgcccaatggaagaaccaggaagatgtggtcattcattcaatagtgtgtgtagtattggtgctgtgtccaaattagaagctagctgaggtagcttgcagcatcttttctagttgaaatggtgaactgataggaaaacaaatgagtagaaagagttcatgaagaggccctcctctgcctttcaaaaggctggtcacctacacatgtttaaggtgtctctgcacatgtctcaagcccatcacaagaaagcaagtacagtgtggatttcaaatggtgtgtaacttcagctccagctggtttttgacagctgttgctgtggtaatatttttgacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtggttgtttctctggtcttgagtgactgtgtccacagttcatttttttccggtaggaataactccttttctacatccacgctccatagagtctctccttttcagacatcctgggatgaaagaatttggcttttttttttctttttttttttggacatctgttttcactcttaggcttttaaacaatagttattgcttttatccctctcagattctaataactgagagcgatggggctatattgaatctctgtatgcactgagaactgagctatgaagaggatcttattaaactgctggtctgactttatggattgacactgttcctttcttttattgtgaaaaaaaaaaaaaaccctgaaagtcttgggaaccccctaaagtcttttgggaatcctcaaaaagcatgggaagttaagtatttagctacataaatgttgtaagatcatatcttatgtatagaagtaataagaccatttggaattactggactaattgaatagttaaggtttctattcgggacaataaaatgtattttgaaagtgctgctaactattgatgctgacagtgtttcactcctatgagtgacccaaacatattataaatatgtggtaaagggaatggagcctgtggggttgagcagaatgttgtactagctgtgcctggactgagtataacagctttatgattatgagaaaacaaattctttattttttttttctgttccaaagattcatcctatggggtggccataaagtctagaattagatactaatattttgtcattcattataacatatcaataaaccatttgttaaaagatttgcctggtttccagacttggtggccaccttgaataattcttgctgtcttctgggaaggatgatgaaatttattcctgctgccttaaaaatatgtatcccttcttcacccatcatgactgtccccagtgagtgtcctttactattcttgggagtgactcctgtctaacttttcatactggcgagaagaaaagaagcctattttaacactttagtggtgttgaaacacattacttactttctgaagatgtcccagtgaatcctctgtcaattcactgccatatgtaatctatatgataaggaatgcatcttccttctaagtactgcccaaactcttgccagctcctctcccattgtcccttcatgtgaatatttcttggctaccttagtggaaatatagatcagttttctccccatccatcctctcaaacataatgagattgtttactttttagatttatgcagtgaaaatgcccagtcaggtctgaatcgtcagtgcattatattgactctgagcactttagaatttagagttgcaattgaatgccagctgtggagatggggtgcatatcagatatataaataaagctcaggtttgctagggaaccaggtatagagaaaaataagtctgatatgaggaaaattgcacaatttagagtagttatgccgtagagaaaatttccacaaactaggaaatgtagagagttattctatagaatactcaaaagaggaaagtatgtgatttttggaaacaggaaaatcttcaaacttctttcttcacttccctttgtgtttagctgaccctccaatgtgatcattgcctttggagtttgggagaggtacgggaagtggcctgatccctgcttccatacttcactcctccatccatccttccctccctcttcccctccagctaaatggacaattctagccaacattgagtcactcaataagtctcaacagtgggtgtgtttgctgagattgtccagcggttgagcagtttggtctcacctccctcgctagttgagaccaaaaagagacaaataactttttcatggtctttgaaacataatgcttatttcgtggtcaatggctttaaaaaaatctgtttcttgttttcttcaacaaactcactagttttcccttaaatgatattgtaaaaattaaagtaatcttgaaaatgttttgacaaaagtaaaattaaagggacatcttttaaaacttgttttgtttttttttttctattgccacacatgaccgttccttcacctttaagcaaagagagtggttcagatggtttctaagatgccaacctgacctcgcattctgtcattctacccagctcttaattcaatttgcttccattatcctaacaggcttctttcttacttagaacttggaaaggctgctgtatttaataccctccaacactaacgcagacttaagataggtactgtttattgaaaacctactgagtgaaatgtgcggttttaggaccttcataaacatctcatttaatctttctagcatcctgtgaaacagccatgatttcacgttgataaacaaagaagacaggggtcccagggatgtgaagcatcttgcccaggcttctgctgctggtgaccagtgtagccaggactccaacccaggttttcctgactcagaagactgagctttttcctggatgttattaatagctaattgtgtccaagcaaccaagggccttgagtctgcttggttctgcttatggcctcacatcaagaaatggagctagtccatgtctgtagtcccaatgctttgggaagccatgatgggaaggttgtcggaggccaaaagttcaagaccaggctgggcaatatcacaagactccatctctacggaaaagtaaaaaattagccagtcatggtggtgtacacttatggtcctagttactcaggagacttaggcaggaggattgcttgatcctaggaattcgaggctgcagtgagctatgattgcacctctgcacccaagcctgggcgacacagcgagaccctctctcttaaaaaaaaaaaatagcagagctcaccaaagtgatgttcacctttttatgacattcctttttcttagcttaagaaaagaaagctgctagatgagagtcttagttttcctgcataagacctcctttatgaatagaataaaagactgtcaaagtaggctgggcttgggcccaggctaatctatgaaggaagcaagctcgtgttccttacctatccttttggtgtccattggattgtgccccgaagtggcctttacccttgagccgtccccagccatggtgctcacacataggcttttgagctccttggagctatccagatcctgctcacttttccttcctgagatcagaacaaatcacccccttactcccactccaaacaaggccttgatgataaactaatccttcctaaaatgctggtaggtaaacaagcaatgatgaagcattgaacacaggttaactcctgacttttgtaccattgtctattccattacacattaacatgactctgaatgccagatccaaacctttgcccaccatctgcttgtcgtgcaacagttgaggcagtaaccaggggagattcacttcctgtcttgtccttccccagggatcacccccctgctgccctctagcagccaaactcagatgagttccattgttaccctaggtgtgcccatctctttggtagggaaggagaaaggtaagaatagccatcagtgaggaaggattcttggagcgaggagccactgtggtttttcctgctatttaagatgttgagaccggataactttagaaagatacctgcacaaacccataaatagtgcttttataaagtttagttcaccggaacctgagttcagtatttgacattagctttttgtccaaagagttgaagcctgctggaggtctttgctcaaataataaataccacatatttccaagtgtgttcaggtataggcactaggtactgtctgtttacttcatgttaggcacattacatgcattggctaatcaaatcctcatcaattacatatgtaataatctaaacttgcctccttgtattataaatggaaataatcctgtttatttaaacgggttttcatgtacctgtagggattaggaaactcaaatggcctttttaatacctttccctagtttgagctccctgttctctttaacagataaaacaacatatttgcttcagcctggaatctgtttttggtgctttggtgcagagacaggaaatgggcactcagagtcacactggtagttgcacactgtatctacagagggcgtgtctcatctgtactctgctgggttacaggatttcagtaggtatttgtgtccacctgagaattctgtttattacctttcatttgacagtgtctttcctttctgcagttgattttgctagagaggcaattcataaggtgaggtcctgttcatagtatgacttgctttctcaatatctccttcaatttttagtaactcttggtctatttggtgtctttaaaaaaaataacctagtaataaagacttcttttaatgtggaaatgtggtctggtagtaagttatttctttccacatgtaactgacccaatctggtttccaaatgagaagtgtgcaggccccagaggttgagaagccatatttcaactgtgaaaaaaatctgcttcctgcatctgttgaaatatagttgttcatacttgccatcccttatctttcttgtaacaatttgcacagttcttgccagaataaatgccattatctgtatgtttcagggagttccccaatttgatcatttttgtgtgtgtgtggtgtgtgtgtgagagagagagatactgcagtaaaacatttctaaaggatgaaagctcttgtatggcatagatatgaattccttcctctggtaataattaggttattcccagaagcacagtgtcattctttaaataaaagctttcctgtttaaagcttttcaaaggagcagaccaccttgaagattccccctagggttgatatgtgtctaattcattttataaaaattattcttgtcttcattttaaagctttggctatatagtcagaaatgtcctaaataacaaactattttgtatttaatttagggaagactaaagggaagaaaaatgaaaactcagtctttatgtaagctccaaggatattagggcttaaagggcttttctagttttatgagaatttgtactactgatttttatatattcctgtttttgagatgaacagatctctggggaaattgttgagttacaatggcatttcactgtgatccctctcaagctcagatcagttctataacccaatgacaacctgtctctttggtttactgtcctgtgaaatgtcagctcaagtttcccagaagtcgtgtgtttatgatgagtcagagtgcttttcctcggtgggacagttgctggccctcttaattttggtgtatgtgcttccaagtatctaaacctccagtctgatctgtatatgctatcctaactgttaattgtattattgattatgttgattatcttgcttgaaggttcatacttttcaatttgatagaaataaagtttttttctgcttatagctagcgaa

SEQ ID NO: 133144 - DNA, 6639 bp, Homo sapiens
gcggggccgcgccccccggaacctgtggggcgggggggctcgcagcctcgcgcctctccagcccctccacgcagcctcgggcctcggggcagagccctgggtggctttgaaaggcctgtctgttcgttgtcgccttctaagaagttggtgagatggcaaagcagtatatagagaaaagtcttttggttccagaccatgtgatcacacgcctaatgatgtccgagttggagaacaggcgtggccagcactggctccttgatggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatggtattgatgacgtcactggtgaaccgttagtccagcaggaggatgataaacccgaagcagttgctgccaggctaagacagtacaaagacgtggcaaagccagtcattgaattatacaagagccgaggagtgctccaccaattttccggaacggagacgaacaaaatctggccctacgtttacacacttttctcaaacaagatcacacctattcagtccaaagaagcatattgaccctgcccaatggaagaaccaggaagatgtggtcattcattcaatagtgtgtgtagtattggtgctgtgtccaaattagaagctagctgaggtagcttgcagcatcttttctagttgaaatggtgaactgataggaaaacaaatgagtagaaagagttcatgaagaggccctcctctgcctttcaaaaggctggtcacctacacatgtttaaggtgtctctgcacatgtctcaagcccatcacaagaaagcaagtacagtgtggatttcaaatggtgtgtaacttcagctccagctggtttttgacagctgttgctgtggtaatatttttgacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtggttgtttctctggtcttgagtgactgtgtccacagttcatttttttccggtaggaataactccttttctacatccacgctccatagagtctctccttttcagacatcctgggatgaaagaatttggcttttttttttctttttttttttggacatctgttttcactcttaggcttttaaacaatagttattgcttttatccctctcagattctaataactgagagcgatggggctatattgaatctctgtatgcactgagaactgagctatgaagaggatcttattaaactgctggtctgactttatggattgacactgttcctttcttttattgtgaaaaaaaaaaaaaaccctgaaagtcttgggaaccccctaaagtcttttgggaatcctcaaaaagcatgggaagttaagtatttagctacataaatgttgtaagatcatatcttatgtatagaagtaataagaccatttggaattactggactaattgaatagttaaggtttctattcgggacaataaaatgtattttgaaagtgctgctaactattgatgctgacagtgtttcactcctatgagtgacccaaacatattataaatatgtggtaaagggaatggagcctgtggggttgagcagaatgttgtactagctgtgcctggactgagtataacagctttatgattatgagaaaacaaattctttattttttttttctgttccaaagattcatcctatggggtggccataaagtctagaattagatactaatattttgtcattcattataacatatcaataaaccatttgttaaaagatttgcctggtttccagacttggtggccaccttgaataattcttgctgtcttctgggaaggatgatgaaatttattcctgctgccttaaaaatatgtatcccttcttcacccatcatgactgtccccagtgagtgtcctttactattcttgggagtgactcctgtctaacttttcatactggcgagaagaaaagaagcctattttaacactttagtggtgttgaaacacattacttactttctgaagatgtcccagtgaatcctctgtcaattcactgccatatgtaatctatatgataaggaatgcatcttccttctaagtactgcccaaactcttgccagctcctctcccattgtcccttcatgtgaatatttcttggctaccttagtggaaatatagatcagttttctccccatccatcctctcaaacataatgagattgtttactttttagatttatgcagtgaaaatgcccagtcaggtctgaatcgtcagtgcattatattgactctgagcactttagaatttagagttgcaattgaatgccagctgtggagatggggtgcatatcagatatataaataaagctcaggtttgctagggaaccaggtatagagaaaaataagtctgatatgaggaaaattgcacaatttagagtagttatgccgtagagaaaatttccacaaactaggaaatgtagagagttattctatagaatactcaaaagaggaaagtatgtgatttttggaaacaggaaaatcttcaaacttctttcttcacttccctttgtgtttagctgaccctccaatgtgatcattgcctttggagtttgggagaggtacgggaagtggcctgatccctgcttccatacttcactcctccatccatccttccctccctcttcccctccagctaaatggacaattctagccaacattgagtcactcaataagtctcaacagtgggtgtgtttgctgagattgtccagcggttgagcagtttggtctcacctccctcgctagttgagaccaaaaagagacaaataactttttcatggtctttgaaacataatgcttatttcgtggtcaatggctttaaaaaaatctgtttcttgttttcttcaacaaactcactagttttcccttaaatgatattgtaaaaattaaagtaatcttgaaaatgttttgacaaaagtaaaattaaagggacatcttttaaaacttgttttgtttttttttttctattgccacacatgaccgttccttcacctttaagcaaagagagtggttcagatggtttctaagatgccaacctgacctcgcattctgtcattctacccagctcttaattcaatttgcttccattatcctaacaggcttctttcttacttagaacttggaaaggctgctgtatttaataccctccaacactaacgcagacttaagataggtactgtttattgaaaacctactgagtgaaatgtgcggttttaggaccttcataaacatctcatttaatctttctagcatcctgtgaaacagccatgatttcacgttgataaacaaagaagacaggggtcccagggatgtgaagcatcttgcccaggcttctgctgctggtgaccagtgtagccaggactccaacccaggttttcctgactcagaagactgagctttttcctggatgttattaatagctaattgtgtccaagcaaccaagggccttgagtctgcttggttctgcttatggcctcacatcaagaaatggagctagtccatgtctgtagtcccaatgctttgggaagccatgatgggaaggttgtcggaggccaaaagttcaagaccaggctgggcaatatcacaagactccatctctacggaaaagtaaaaaattagccagtcatggtggtgtacacttatggtcctagttactcaggagacttaggcaggaggattgcttgatcctaggaattcgaggctgcagtgagctatgattgcacctctgcacccaagcctgggcgacacagcgagaccctctctcttaaaaaaaaaaaatagcagagctcaccaaagtgatgttcacctttttatgacattcctttttcttagcttaagaaaagaaagctgctagatgagagtcttagttttcctgcataagacctcctttatgaatagaataaaagactgtcaaagtaggctgggcttgggcccaggctaatctatgaaggaagcaagctcgtgttccttacctatccttttggtgtccattggattgtgccccgaagtggcctttacccttgagccgtccccagccatggtgctcacacataggcttttgagctccttggagctatccagatcctgctcacttttccttcctgagatcagaacaaatcacccccttactcccactccaaacaaggccttgatgataaactaatccttcctaaaatgctggtaggtaaacaagcaatgatgaagcattgaacacaggttaactcctgacttttgtaccattgtctattccattacacattaacatgactctgaatgccagatccaaacctttgcccaccatctgcttgtcgtgcaacagttgaggcagtaaccaggggagattcacttcctgtcttgtccttccccagggatcacccccctgctgccctctagcagccaaactcagatgagttccattgttaccctaggtgtgcccatctctttggtagggaaggagaaaggtaagaatagccatcagtgaggaaggattcttggagcgaggagccactgtggtttttcctgctatttaagatgttgagaccggataactttagaaagatacctgcacaaacccataaatagtgcttttataaagtttagttcaccggaacctgagttcagtatttgacattagctttttgtccaaagagttgaagcctgctggaggtctttgctcaaataataaataccacatatttccaagtgtgttcaggtataggcactaggtactgtctgtttacttcatgttaggcacattacatgcattggctaatcaaatcctcatcaattacatatgtaataatctaaacttgcctccttgtattataaatggaaataatcctgtttatttaaacgggttttcatgtacctgtagggattaggaaactcaaatggcctttttaatacctttccctagtttgagctccctgttctctttaacagataaaacaacatatttgcttcagcctggaatctgtttttggtgctttggtgcagagacaggaaatgggcactcagagtcacactggtagttgcacactgtatctacagagggcgtgtctcatctgtactctgctgggttacaggatttcagtaggtatttgtgtccacctgagaattctgtttattacctttcatttgacagtgtctttcctttctgcagttgattttgctagagaggcaattcataaggtgaggtcctgttcatagtatgacttgctttctcaatatctccttcaatttttagtaactcttggtctatttggtgtctttaaaaaaaataacctagtaataaagacttcttttaatgtggaaatgtggtctggtagtaagttatttctttccacatgtaactgacccaatctggtttccaaatgagaagtgtgcaggccccagaggttgagaagccatatttcaactgtgaaaaaaatctgcttcctgcatctgttgaaatatagttgttcatacttgccatcccttatctttcttgtaacaatttgcacagttcttgccagaataaatgccattatctgtatgtttcagggagttccccaatttgatcatttttgtgtgtgtgtggtgtgtgtgtgagagagagagatactgcagtaaaacatttctaaaggatgaaagctcttgtatggcatagatatgaattccttcctctggtaataattaggttattcccagaagcacagtgtcattctttaaataaaagctttcctgtttaaagcttttcaaaggagcagaccaccttgaagattccccctagggttgatatgtgtctaattcattttataaaaattattcttgtcttcattttaaagctttggctatatagtcagaaatgtcctaaataacaaactattttgtatttaatttagggaagactaaagggaagaaaaatgaaaactcagtctttatgtaagctccaaggatattagggcttaaagggcttttctagttttatgagaatttgtactactgatttttatatattcctgtttttgagatgaacagatctctggggaaattgttgagttacaatggcatttcactgtgatccctctcaagctcagatcagttctataacccaatgacaacctgtctctttggtttactgtcctgtgaaatgtcagctcaagtttcccagaagtcgtgtgtttatgatgagtcagagtgcttttcctcggtgggacagttgctggccctcttaattttggtgtatgtgcttccaagtatctaaacctccagtctgatctgtatatgctatcctaactgttaattgtattattgattatgttgattatcttgcttgaaggttcatacttttcaatttgatagaaataaagtttttttctgcttatagctagcgaa

SEQ ID NO: 133145 - DNA, 6586 bp, Homo sapiens
cagtccaggcatgaagaggataatgagcttaacatacctgtgagaagtttcaggtggaggtatctggtggccttcggcacagcaagtgaagttggtgagatggcaaagcagtatatagagaaaagtcttttggttccagaccatgtgatcacacgcctaatgatgtccgagttggagaacaggcgtggccagcactggctccttgatggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatggtattgatgacgtcactggtgaaccgttagtccagcaggaggatgataaacccgaagcagttgctgccaggctaagacagtacaaagacgtggcaaagccagtcattgaattatacaagagccgaggagtgctccaccaattttccggaacggagacgaacaaaatctggccctacgtttacacacttttctcaaacaagatcacacctattcagtccaaagaagcatattgaccctgcccaatggaagaaccaggaagatgtggtcattcattcaatagtgtgtgtagtattggtgctgtgtccaaattagaagctagctgaggtagcttgcagcatcttttctagttgaaatggtgaactgataggaaaacaaatgagtagaaagagttcatgaagaggccctcctctgcctttcaaaaggctggtcacctacacatgtttaaggtgtctctgcacatgtctcaagcccatcacaagaaagcaagtacagtgtggatttcaaatggtgtgtaacttcagctccagctggtttttgacagctgttgctgtggtaatatttttgacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtggttgtttctctggtcttgagtgactgtgtccacagttcatttttttccggtaggaataactccttttctacatccacgctccatagagtctctccttttcagacatcctgggatgaaagaatttggcttttttttttctttttttttttggacatctgttttcactcttaggcttttaaacaatagttattgcttttatccctctcagattctaataactgagagcgatggggctatattgaatctctgtatgcactgagaactgagctatgaagaggatcttattaaactgctggtctgactttatggattgacactgttcctttcttttattgtgaaaaaaaaaaaaaaccctgaaagtcttgggaaccccctaaagtcttttgggaatcctcaaaaagcatgggaagttaagtatttagctacataaatgttgtaagatcatatcttatgtatagaagtaataagaccatttggaattactggactaattgaatagttaaggtttctattcgggacaataaaatgtattttgaaagtgctgctaactattgatgctgacagtgtttcactcctatgagtgacccaaacatattataaatatgtggtaaagggaatggagcctgtggggttgagcagaatgttgtactagctgtgcctggactgagtataacagctttatgattatgagaaaacaaattctttattttttttttctgttccaaagattcatcctatggggtggccataaagtctagaattagatactaatattttgtcattcattataacatatcaataaaccatttgttaaaagatttgcctggtttccagacttggtggccaccttgaataattcttgctgtcttctgggaaggatgatgaaatttattcctgctgccttaaaaatatgtatcccttcttcacccatcatgactgtccccagtgagtgtcctttactattcttgggagtgactcctgtctaacttttcatactggcgagaagaaaagaagcctattttaacactttagtggtgttgaaacacattacttactttctgaagatgtcccagtgaatcctctgtcaattcactgccatatgtaatctatatgataaggaatgcatcttccttctaagtactgcccaaactcttgccagctcctctcccattgtcccttcatgtgaatatttcttggctaccttagtggaaatatagatcagttttctccccatccatcctctcaaacataatgagattgtttactttttagatttatgcagtgaaaatgcccagtcaggtctgaatcgtcagtgcattatattgactctgagcactttagaatttagagttgcaattgaatgccagctgtggagatggggtgcatatcagatatataaataaagctcaggtttgctagggaaccaggtatagagaaaaataagtctgatatgaggaaaattgcacaatttagagtagttatgccgtagagaaaatttccacaaactaggaaatgtagagagttattctatagaatactcaaaagaggaaagtatgtgatttttggaaacaggaaaatcttcaaacttctttcttcacttccctttgtgtttagctgaccctccaatgtgatcattgcctttggagtttgggagaggtacgggaagtggcctgatccctgcttccatacttcactcctccatccatccttccctccctcttcccctccagctaaatggacaattctagccaacattgagtcactcaataagtctcaacagtgggtgtgtttgctgagattgtccagcggttgagcagtttggtctcacctccctcgctagttgagaccaaaaagagacaaataactttttcatggtctttgaaacataatgcttatttcgtggtcaatggctttaaaaaaatctgtttcttgttttcttcaacaaactcactagttttcccttaaatgatattgtaaaaattaaagtaatcttgaaaatgttttgacaaaagtaaaattaaagggacatcttttaaaacttgttttgtttttttttttctattgccacacatgaccgttccttcacctttaagcaaagagagtggttcagatggtttctaagatgccaacctgacctcgcattctgtcattctacccagctcttaattcaatttgcttccattatcctaacaggcttctttcttacttagaacttggaaaggctgctgtatttaataccctccaacactaacgcagacttaagataggtactgtttattgaaaacctactgagtgaaatgtgcggttttaggaccttcataaacatctcatttaatctttctagcatcctgtgaaacagccatgatttcacgttgataaacaaagaagacaggggtcccagggatgtgaagcatcttgcccaggcttctgctgctggtgaccagtgtagccaggactccaacccaggttttcctgactcagaagactgagctttttcctggatgttattaatagctaattgtgtccaagcaaccaagggccttgagtctgcttggttctgcttatggcctcacatcaagaaatggagctagtccatgtctgtagtcccaatgctttgggaagccatgatgggaaggttgtcggaggccaaaagttcaagaccaggctgggcaatatcacaagactccatctctacggaaaagtaaaaaattagccagtcatggtggtgtacacttatggtcctagttactcaggagacttaggcaggaggattgcttgatcctaggaattcgaggctgcagtgagctatgattgcacctctgcacccaagcctgggcgacacagcgagaccctctctcttaaaaaaaaaaaatagcagagctcaccaaagtgatgttcacctttttatgacattcctttttcttagcttaagaaaagaaagctgctagatgagagtcttagttttcctgcataagacctcctttatgaatagaataaaagactgtcaaagtaggctgggcttgggcccaggctaatctatgaaggaagcaagctcgtgttccttacctatccttttggtgtccattggattgtgccccgaagtggcctttacccttgagccgtccccagccatggtgctcacacataggcttttgagctccttggagctatccagatcctgctcacttttccttcctgagatcagaacaaatcacccccttactcccactccaaacaaggccttgatgataaactaatccttcctaaaatgctggtaggtaaacaagcaatgatgaagcattgaacacaggttaactcctgacttttgtaccattgtctattccattacacattaacatgactctgaatgccagatccaaacctttgcccaccatctgcttgtcgtgcaacagttgaggcagtaaccaggggagattcacttcctgtcttgtccttccccagggatcacccccctgctgccctctagcagccaaactcagatgagttccattgttaccctaggtgtgcccatctctttggtagggaaggagaaaggtaagaatagccatcagtgaggaaggattcttggagcgaggagccactgtggtttttcctgctatttaagatgttgagaccggataactttagaaagatacctgcacaaacccataaatagtgcttttataaagtttagttcaccggaacctgagttcagtatttgacattagctttttgtccaaagagttgaagcctgctggaggtctttgctcaaataataaataccacatatttccaagtgtgttcaggtataggcactaggtactgtctgtttacttcatgttaggcacattacatgcattggctaatcaaatcctcatcaattacatatgtaataatctaaacttgcctccttgtattataaatggaaataatcctgtttatttaaacgggttttcatgtacctgtagggattaggaaactcaaatggcctttttaatacctttccctagtttgagctccctgttctctttaacagataaaacaacatatttgcttcagcctggaatctgtttttggtgctttggtgcagagacaggaaatgggcactcagagtcacactggtagttgcacactgtatctacagagggcgtgtctcatctgtactctgctgggttacaggatttcagtaggtatttgtgtccacctgagaattctgtttattacctttcatttgacagtgtctttcctttctgcagttgattttgctagagaggcaattcataaggtgaggtcctgttcatagtatgacttgctttctcaatatctccttcaatttttagtaactcttggtctatttggtgtctttaaaaaaaataacctagtaataaagacttcttttaatgtggaaatgtggtctggtagtaagttatttctttccacatgtaactgacccaatctggtttccaaatgagaagtgtgcaggccccagaggttgagaagccatatttcaactgtgaaaaaaatctgcttcctgcatctgttgaaatatagttgttcatacttgccatcccttatctttcttgtaacaatttgcacagttcttgccagaataaatgccattatctgtatgtttcagggagttccccaatttgatcatttttgtgtgtgtgtggtgtgtgtgtgagagagagagatactgcagtaaaacatttctaaaggatgaaagctcttgtatggcatagatatgaattccttcctctggtaataattaggttattcccagaagcacagtgtcattctttaaataaaagctttcctgtttaaagcttttcaaaggagcagaccaccttgaagattccccctagggttgatatgtgtctaattcattttataaaaattattcttgtcttcattttaaagctttggctatatagtcagaaatgtcctaaataacaaactattttgtatttaatttagggaagactaaagggaagaaaaatgaaaactcagtctttatgtaagctccaaggatattagggcttaaagggcttttctagttttatgagaatttgtactactgatttttatatattcctgtttttgagatgaacagatctctggggaaattgttgagttacaatggcatttcactgtgatccctctcaagctcagatcagttctataacccaatgacaacctgtctctttggtttactgtcctgtgaaatgtcagctcaagtttcccagaagtcgtgtgtttatgatgagtcagagtgcttttcctcggtgggacagttgctggccctcttaattttggtgtatgtgcttccaagtatctaaacctccagtctgatctgtatatgctatcctaactgttaattgtattattgattatgttgattatcttgcttgaaggttcatacttttcaatttgatagaaataaagtttttttctgcttatagctagcgaa

SEQ ID NO: 133146 - DNA, 6954 bp, Homo sapiens
  misc_feature (185)..(186): n is a, c, g, or t
  misc_feature (223)..(224): n is a, c, g, or t
agcggagccgccggggaggggacgagacgcagaccacacgttgcccacgtgcgaggaccgggcaggggctcagcccctaggccgcccggtgcgtggggctggcgggggctggctttgagtcacccccgcttgtgccagcttccccggctcggcggagactggcttggggatgcctggccgcccgnnccccttctcggacgcggcgtggggagcgagctggagnnaaggatgaaggggcggccggcgagtcccagtgagagcggagggtgccagaggtagggggccgagaaacaaagttcccggggcttcctccggggccgcggtcggggctgcgcgtttgaccgcccccctcctcgcgaaggcaatggcttccaaactcctgcgcgcggtcatcctcgggccgcccggctcgggcaagggcaccgtgtgccagaggatcgcccagaactttggtctccagcatctctccagcggccacttcttgcgggagaacatcaaggccagcaccgaagttggtgagatggcaaagcagtatatagagaaaagtcttttggttccagaccatgtgatcacacgcctaatgatgtccgagttggagaacaggcgtggccagcactggctccttgatggttttcctaggacattaggacaagccgaagccctggacaaaatatcgtctcagccgccgttggattcaccctcctagcggaagggtatataacctggacttcaatccacctcatgtacatggtattgatgacgtcactggtgaaccgttagtccagcaggaggatgataaacccgaagcagttgctgccaggctaagacagtacaaagacgtggcaaagccagtcattgaattatacaagagccgaggagtgctccaccaattttccggaacggagacgaacaaaatctggccctacgtttacacacttttctcaaacaagatcacacctattcagtccaaagaagcatattgaccctgcccaatggaagaaccaggaagatgtggtcattcattcaatagtgtgtgtagtattggtgctgtgtccaaattagaagctagctgaggtagcttgcagcatcttttctagttgaaatggtgaactgataggaaaacaaatgagtagaaagagttcatgaagaggccctcctctgcctttcaaaaggctggtcacctacacatgtttaaggtgtctctgcacatgtctcaagcccatcacaagaaagcaagtacagtgtggatttcaaatggtgtgtaacttcagctccagctggtttttgacagctgttgctgtggtaatatttttgacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtggttgtttctctggtcttgagtgactgtgtccacagttcatttttttccggtaggaataactccttttctacatccacgctccatagagtctctccttttcagacatcctgggatgaaagaatttggcttttttttttctttttttttttggacatctgttttcactcttaggcttttaaacaatagttattgcttttatccctctcagattctaataactgagagcgatggggctatattgaatctctgtatgcactgagaactgagctatgaagaggatcttattaaactgctggtctgactttatggattgacactgttcctttcttttattgtgaaaaaaaaaaaaaaccctgaaagtcttgggaaccccctaaagtcttttgggaatcctcaaaaagcatgggaagttaagtatttagctacataaatgttgtaagatcatatcttatgtatagaagtaataagaccatttggaattactggactaattgaatagttaaggtttctattcgggacaataaaatgtattttgaaagtgctgctaactattgatgctgacagtgtttcactcctatgagtgacccaaacatattataaatatgtggtaaagggaatggagcctgtggggttgagcagaatgttgtactagctgtgcctggactgagtataacagctttatgattatgagaaaacaaattctttattttttttttctgttccaaagattcatcctatggggtggccataaagtctagaattagatactaatattttgtcattcattataacatatcaataaaccatttgttaaaagatttgcctggtttccagacttggtggccaccttgaataattcttgctgtcttctgggaaggatgatgaaatttattcctgctgccttaaaaatatgtatcccttcttcacccatcatgactgtccccagtgagtgtcctttactattcttgggagtgactcctgtctaacttttcatactggcgagaagaaaagaagcctattttaacactttagtggtgttgaaacacattacttactttctgaagatgtcccagtgaatcctctgtcaattcactgccatatgtaatctatatgataaggaatgcatcttccttctaagtactgcccaaactcttgccagctcctctcccattgtcccttcatgtgaatatttcttggctaccttagtggaaatatagatcagttttctccccatccatcctctcaaacataatgagattgtttactttttagatttatgcagtgaaaatgcccagtcaggtctgaatcgtcagtgcattatattgactctgagcactttagaatttagagttgcaattgaatgccagctgtggagatggggtgcatatcagatatataaataaagctcaggtttgctagggaaccaggtatagagaaaaataagtctgatatgaggaaaattgcacaatttagagtagttatgccgtagagaaaatttccacaaactaggaaatgtagagagttattctatagaatactcaaaagaggaaagtatgtgatttttggaaacaggaaaatcttcaaacttctttcttcacttccctttgtgtttagctgaccctccaatgtgatcattgcctttggagtttgggagaggtacgggaagtggcctgatccctgcttccatacttcactcctccatccatccttccctccctcttcccctccagctaaatggacaattctagccaacattgagtcactcaataagtctcaacagtgggtgtgtttgctgagattgtccagcggttgagcagtttggtctcacctccctcgctagttgagaccaaaaagagacaaataactttttcatggtctttgaaacataatgcttatttcgtggtcaatggctttaaaaaaatctgtttcttgttttcttcaacaaactcactagttttcccttaaatgatattgtaaaaattaaagtaatcttgaaaatgttttgacaaaagtaaaattaaagggacatcttttaaaacttgttttgtttttttttttctattgccacacatgaccgttccttcacctttaagcaaagagagtggttcagatggtttctaagatgccaacctgacctcgcattctgtcattctacccagctcttaattcaatttgcttccattatcctaacaggcttctttcttacttagaacttggaaaggctgctgtatttaataccctccaacactaacgcagacttaagataggtactgtttattgaaaacctactgagtgaaatgtgcggttttaggaccttcataaacatctcatttaatctttctagcatcctgtgaaacagccatgatttcacgttgataaacaaagaagacaggggtcccagggatgtgaagcatcttgcccaggcttctgctgctggtgaccagtgtagccaggactccaacccaggttttcctgactcagaagactgagctttttcctggatgttattaatagctaattgtgtccaagcaaccaagggccttgagtctgcttggttctgcttatggcctcacatcaagaaatggagctagtccatgtctgtagtcccaatgctttgggaagccatgatgggaaggttgtcggaggccaaaagttcaagaccaggctgggcaatatcacaagactccatctctacggaaaagtaaaaaattagccagtcatggtggtgtacacttatggtcctagttactcaggagacttaggcaggaggattgcttgatcctaggaattcgaggctgcagtgagctatgattgcacctctgcacccaagcctgggcgacacagcgagaccctctctcttaaaaaaaaaaaatagcagagctcaccaaagtgatgttcacctttttatgacattcctttttcttagcttaagaaaagaaagctgctagatgagagtcttagttttcctgcataagacctcctttatgaatagaataaaagactgtcaaagtaggctgggcttgggcccaggctaatctatgaaggaagcaagctcgtgttccttacctatccttttggtgtccattggattgtgccccgaagtggcctttacccttgagccgtccccagccatggtgctcacacataggcttttgagctccttggagctatccagatcctgctcacttttccttcctgagatcagaacaaatcacccccttactcccactccaaacaaggccttgatgataaactaatccttcctaaaatgctggtaggtaaacaagcaatgatgaagcattgaacacaggttaactcctgacttttgtaccattgtctattccattacacattaacatgactctgaatgccagatccaaacctttgcccaccatctgcttgtcgtgcaacagttgaggcagtaaccaggggagattcacttcctgtcttgtccttccccagggatcacccccctgctgccctctagcagccaaactcagatgagttccattgttaccctaggtgtgcccatctctttggtagggaaggagaaaggtaagaatagccatcagtgaggaaggattcttggagcgaggagccactgtggtttttcctgctatttaagatgttgagaccggataactttagaaagatacctgcacaaacccataaatagtgcttttataaagtttagttcaccggaacctgagttcagtatttgacattagctttttgtccaaagagttgaagcctgctggaggtctttgctcaaataataaataccacatatttccaagtgtgttcaggtataggcactaggtactgtctgtttacttcatgttaggcacattacatgcattggctaatcaaatcctcatcaattacatatgtaataatctaaacttgcctccttgtattataaatggaaataatcctgtttatttaaacgggttttcatgtacctgtagggattaggaaactcaaatggcctttttaatacctttccctagtttgagctccctgttctctttaacagataaaacaacatatttgcttcagcctggaatctgtttttggtgctttggtgcagagacaggaaatgggcactcagagtcacactggtagttgcacactgtatctacagagggcgtgtctcatctgtactctgctgggttacaggatttcagtaggtatttgtgtccacctgagaattctgtttattacctttcatttgacagtgtctttcctttctgcagttgattttgctagagaggcaattcataaggtgaggtcctgttcatagtatgacttgctttctcaatatctccttcaatttttagtaactcttggtctatttggtgtctttaaaaaaaataacctagtaataaagacttcttttaatgtggaaatgtggtctggtagtaagttatttctttccacatgtaactgacccaatctggtttccaaatgagaagtgtgcaggccccagaggttgagaagccatatttcaactgtgaaaaaaatctgcttcctgcatctgttgaaatatagttgttcatacttgccatcccttatctttcttgtaacaatttgcacagttcttgccagaataaatgccattatctgtatgtttcagggagttccccaatttgatcatttttgtgtgtgtgtggtgtgtgtgtgagagagagagatactgcagtaaaacatttctaaaggatgaaagctcttgtatggcatagatatgaattccttcctctggtaataattaggttattcccagaagcacagtgtcattctttaaataaaagctttcctgtttaaagcttttcaaaggagcagaccaccttgaagattccccctagggttgatatgtgtctaattcattttataaaaattattcttgtcttcattttaaagctttggctatatagtcagaaatgtcctaaataacaaactattttgtatttaatttagggaagactaaagggaagaaaaatgaaaactcagtctttatgtaagctccaaggatattagggcttaaagggcttttctagttttatgagaatttgtactactgatttttatatattcctgtttttgagatgaacagatctctggggaaattgttgagttacaatggcatttcactgtgatccctctcaagctcagatcagttctataacccaatgacaacctgtctctttggtttactgtcctgtgaaatgtcagctcaagtttcccagaagtcgtgtgtttatgatgagtcagagtgcttttcctcggtgggacagttgctggccctcttaattttggtgtatgtgcttccaagtatctaaacctccagtctgatctgtatatgctatcctaactgttaattgtattattgattatgttgattatcttgcttgaaggttcatacttttcaatttgatagaaataaagtttttttctgcttatagctagcgaa

SEQ ID NO: 133147 - DNA, 6586 bp, Homo sapiens
gcggggccgcgccccccggaacctgtggggcgggggggctcgcagcctcgcgcctctccagcccctccacgcagcctcgggcctcggggcagagccctgggtggctttgaaaggcctgtctgttcgttgtcgccttctaagaagttggtgagatggcaaagcagtatatagagaaaagtcttttggttccagaccatgtgatcacacgcctaatgatgtccgagttggagaacaggcgtggccagcactggctccttgatggttttcctaggacattaggacaagccgaagccctggacaaaatatcgtctcagccgccgttggattcaccctcctagcggaagggtatataacctggacttcaatccacctcatgtacatggtattgatgacgtcactggtgaaccgttagtccagcaggaggatgataaacccgaagcagttgctgccaggctaagacagtacaaagacgtggcaaagccagtcattgaattatacaagagccgaggagtgctccaccaattttccggaacggagacgaacaaaatctggccctacgtttacacacttttctcaaacaagatcacacctattcagtccaaagaagcatattgaccctgcccaatggaagaaccaggaagatgtggtcattcattcaatagtgtgtgtagtattggtgctgtgtccaaattagaagctagctgaggtagcttgcagcatcttttctagttgaaatggtgaactgataggaaaacaaatgagtagaaagagttcatgaagaggccctcctctgcctttcaaaaggctggtcacctacacatgtttaaggtgtctctgcacatgtctcaagcccatcacaagaaagcaagtacagtgtggatttcaaatggtgtgtaacttcagctccagctggtttttgacagctgttgctgtggtaatatttttgacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtggttgtttctctggtcttgagtgactgtgtccacagttcatttttttccggtaggaataactccttttctacatccacgctccatagagtctctccttttcagacatcctgggatgaaagaatttggcttttttttttctttttttttttggacatctgttttcactcttaggcttttaaacaatagttattgcttttatccctctcagattctaataactgagagcgatggggctatattgaatctctgtatgcactgagaactgagctatgaagaggatcttattaaactgctggtctgactttatggattgacactgttcctttcttttattgtgaaaaaaaaaaaaaaccctgaaagtcttgggaaccccctaaagtcttttgggaatcctcaaaaagcatgggaagttaagtatttagctacataaatgttgtaagatcatatcttatgtatagaagtaataagaccatttggaattactggactaattgaatagttaaggtttctattcgggacaataaaatgtattttgaaagtgctgctaactattgatgctgacagtgtttcactcctatgagtgacccaaacatattataaatatgtggtaaagggaatggagcctgtggggttgagcagaatgttgtactagctgtgcctggactgagtataacagctttatgattatgagaaaacaaattctttattttttttttctgttccaaagattcatcctatggggtggccataaagtctagaattagatactaatattttgtcattcattataacatatcaataaaccatttgttaaaagatttgcctggtttccagacttggtggccaccttgaataattcttgctgtcttctgggaaggatgatgaaatttattcctgctgccttaaaaatatgtatcccttcttcacccatcatgactgtccccagtgagtgtcctttactattcttgggagtgactcctgtctaacttttcatactggcgagaagaaaagaagcctattttaacactttagtggtgttgaaacacattacttactttctgaagatgtcccagtgaatcctctgtcaattcactgccatatgtaatctatatgataaggaatgcatcttccttctaagtactgcccaaactcttgccagctcctctcccattgtcccttcatgtgaatatttcttggctaccttagtggaaatatagatcagttttctccccatccatcctctcaaacataatgagattgtttactttttagatttatgcagtgaaaatgcccagtcaggtctgaatcgtcagtgcattatattgactctgagcactttagaatttagagttgcaattgaatgccagctgtggagatggggtgcatatcagatatataaataaagctcaggtttgctagggaaccaggtatagagaaaaataagtctgatatgaggaaaattgcacaatttagagtagttatgccgtagagaaaatttccacaaactaggaaatgtagagagttattctatagaatactcaaaagaggaaagtatgtgatttttggaaacaggaaaatcttcaaacttctttcttcacttccctttgtgtttagctgaccctccaatgtgatcattgcctttggagtttgggagaggtacgggaagtggcctgatccctgcttccatacttcactcctccatccatccttccctccctcttcccctccagctaaatggacaattctagccaacattgagtcactcaataagtctcaacagtgggtgtgtttgctgagattgtccagcggttgagcagtttggtctcacctccctcgctagttgagaccaaaaagagacaaataactttttcatggtctttgaaacataatgcttatttcgtggtcaatggctttaaaaaaatctgtttcttgttttcttcaacaaactcactagttttcccttaaatgatattgtaaaaattaaagtaatcttgaaaatgttttgacaaaagtaaaattaaagggacatcttttaaaacttgttttgtttttttttttctattgccacacatgaccgttccttcacctttaagcaaagagagtggttcagatggtttctaagatgccaacctgacctcgcattctgtcattctacccagctcttaattcaatttgcttccattatcctaacaggcttctttcttacttagaacttggaaaggctgctgtatttaataccctccaacactaacgcagacttaagataggtactgtttattgaaaacctactgagtgaaatgtgcggttttaggaccttcataaacatctcatttaatctttctagcatcctgtgaaacagccatgatttcacgttgataaacaaagaagacaggggtcccagggatgtgaagcatcttgcccaggcttctgctgctggtgaccagtgtagccaggactccaacccaggttttcctgactcagaagactgagctttttcctggatgttattaatagctaattgtgtccaagcaaccaagggccttgagtctgcttggttctgcttatggcctcacatcaagaaatggagctagtccatgtctgtagtcccaatgctttgggaagccatgatgggaaggttgtcggaggccaaaagttcaagaccaggctgggcaatatcacaagactccatctctacggaaaagtaaaaaattagccagtcatggtggtgtacacttatggtcctagttactcaggagacttaggcaggaggattgcttgatcctaggaattcgaggctgcagtgagctatgattgcacctctgcacccaagcctgggcgacacagcgagaccctctctcttaaaaaaaaaaaatagcagagctcaccaaagtgatgttcacctttttatgacattcctttttcttagcttaagaaaagaaagctgctagatgagagtcttagttttcctgcataagacctcctttatgaatagaataaaagactgtcaaagtaggctgggcttgggcccaggctaatctatgaaggaagcaagctcgtgttccttacctatccttttggtgtccattggattgtgccccgaagtggcctttacccttgagccgtccccagccatggtgctcacacataggcttttgagctccttggagctatccagatcctgctcacttttccttcctgagatcagaacaaatcacccccttactcccactccaaacaaggccttgatgataaactaatccttcctaaaatgctggtaggtaaacaagcaatgatgaagcattgaacacaggttaactcctgacttttgtaccattgtctattccattacacattaacatgactctgaatgccagatccaaacctttgcccaccatctgcttgtcgtgcaacagttgaggcagtaaccaggggagattcacttcctgtcttgtccttccccagggatcacccccctgctgccctctagcagccaaactcagatgagttccattgttaccctaggtgtgcccatctctttggtagggaaggagaaaggtaagaatagccatcagtgaggaaggattcttggagcgaggagccactgtggtttttcctgctatttaagatgttgagaccggataactttagaaagatacctgcacaaacccataaatagtgcttttataaagtttagttcaccggaacctgagttcagtatttgacattagctttttgtccaaagagttgaagcctgctggaggtctttgctcaaataataaataccacatatttccaagtgtgttcaggtataggcactaggtactgtctgtttacttcatgttaggcacattacatgcattggctaatcaaatcctcatcaattacatatgtaataatctaaacttgcctccttgtattataaatggaaataatcctgtttatttaaacgggttttcatgtacctgtagggattaggaaactcaaatggcctttttaatacctttccctagtttgagctccctgttctctttaacagataaaacaacatatttgcttcagcctggaatctgtttttggtgctttggtgcagagacaggaaatgggcactcagagtcacactggtagttgcacactgtatctacagagggcgtgtctcatctgtactctgctgggttacaggatttcagtaggtatttgtgtccacctgagaattctgtttattacctttcatttgacagtgtctttcctttctgcagttgattttgctagagaggcaattcataaggtgaggtcctgttcatagtatgacttgctttctcaatatctccttcaatttttagtaactcttggtctatttggtgtctttaaaaaaaataacctagtaataaagacttcttttaatgtggaaatgtggtctggtagtaagttatttctttccacatgtaactgacccaatctggtttccaaatgagaagtgtgcaggccccagaggttgagaagccatatttcaactgtgaaaaaaatctgcttcctgcatctgttgaaatatagttgttcatacttgccatcccttatctttcttgtaacaatttgcacagttcttgccagaataaatgccattatctgtatgtttcagggagttccccaatttgatcatttttgtgtgtgtgtggtgtgtgtgtgagagagagagatactgcagtaaaacatttctaaaggatgaaagctcttgtatggcatagatatgaattccttcctctggtaataattaggttattcccagaagcacagtgtcattctttaaataaaagctttcctgtttaaagcttttcaaaggagcagaccaccttgaagattccccctagggttgatatgtgtctaattcattttataaaaattattcttgtcttcattttaaagctttggctatatagtcagaaatgtcctaaataacaaactattttgtatttaatttagggaagactaaagggaagaaaaatgaaaactcagtctttatgtaagctccaaggatattagggcttaaagggcttttctagttttatgagaatttgtactactgatttttatatattcctgtttttgagatgaacagatctctggggaaattgttgagttacaatggcatttcactgtgatccctctcaagctcagatcagttctataacccaatgacaacctgtctctttggtttactgtcctgtgaaatgtcagctcaagtttcccagaagtcgtgtgtttatgatgagtcagagtgcttttcctcggtgggacagttgctggccctcttaattttggtgtatgtgcttccaagtatctaaacctccagtctgatctgtatatgctatcctaactgttaattgtattattgattatgttgattatcttgcttgaaggttcatacttttcaatttgatagaaataaagtttttttctgcttatagctagcgaa

SEQ ID NO: 133148 - DNA, 6233 bp, Homo sapiens
gggtgactctaaggatcccctgttacatggtattgatgacgtcactggtgaaccgttagtccagcaggaggatgataaacccgaagcagttgctgccaggctaagacagtacaaagacgtggcaaagccagtcattgaattatacaagagccgaggagtgctccaccaattttccggaacggagacgaacaaaatctggccctacgtttacacacttttctcaaacaagatcacacctattcagtccaaagaagcatattgaccctgcccaatggaagaaccaggaagatgtggtcattcattcaatagtgtgtgtagtattggtgctgtgtccaaattagaagctagctgaggtagcttgcagcatcttttctagttgaaatggtgaactgataggaaaacaaatgagtagaaagagttcatgaagaggccctcctctgcctttcaaaaggctggtcacctacacatgtttaaggtgtctctgcacatgtctcaagcccatcacaagaaagcaagtacagtgtggatttcaaatggtgtgtaacttcagctccagctggtttttgacagctgttgctgtggtaatatttttgacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtggttgtttctctggtcttgagtgactgtgtccacagttcatttttttccggtaggaataactccttttctacatccacgctccatagagtctctccttttcagacatcctgggatgaaagaatttggcttttttttttctttttttttttggacatctgttttcactcttaggcttttaaacaatagttattgcttttatccctctcagattctaataactgagagcgatggggctatattgaatctctgtatgcactgagaactgagctatgaagaggatcttattaaactgctggtctgactttatggattgacactgttcctttcttttattgtgaaaaaaaaaaaaaaccctgaaagtcttgggaaccccctaaagtcttttgggaatcctcaaaaagcatgggaagttaagtatttagctacataaatgttgtaagatcatatcttatgtatagaagtaataagaccatttggaattactggactaattgaatagttaaggtttctattcgggacaataaaatgtattttgaaagtgctgctaactattgatgctgacagtgtttcactcctatgagtgacccaaacatattataaatatgtggtaaagggaatggagcctgtggggttgagcagaatgttgtactagctgtgcctggactgagtataacagctttatgattatgagaaaacaaattctttattttttttttctgttccaaagattcatcctatggggtggccataaagtctagaattagatactaatattttgtcattcattataacatatcaataaaccatttgttaaaagatttgcctggtttccagacttggtggccaccttgaataattcttgctgtcttctgggaaggatgatgaaatttattcctgctgccttaaaaatatgtatcccttcttcacccatcatgactgtccccagtgagtgtcctttactattcttgggagtgactcctgtctaacttttcatactggcgagaagaaaagaagcctattttaacactttagtggtgttgaaacacattacttactttctgaagatgtcccagtgaatcctctgtcaattcactgccatatgtaatctatatgataaggaatgcatcttccttctaagtactgcccaaactcttgccagctcctctcccattgtcccttcatgtgaatatttcttggctaccttagtggaaatatagatcagttttctccccatccatcctctcaaacataatgagattgtttactttttagatttatgcagtgaaaatgcccagtcaggtctgaatcgtcagtgcattatattgactctgagcactttagaatttagagttgcaattgaatgccagctgtggagatggggtgcatatcagatatataaataaagctcaggtttgctagggaaccaggtatagagaaaaataagtctgatatgaggaaaattgcacaatttagagtagttatgccgtagagaaaatttccacaaactaggaaatgtagagagttattctatagaatactcaaaagaggaaagtatgtgatttttggaaacaggaaaatcttcaaacttctttcttcacttccctttgtgtttagctgaccctccaatgtgatcattgcctttggagtttgggagaggtacgggaagtggcctgatccctgcttccatacttcactcctccatccatccttccctccctcttcccctccagctaaatggacaattctagccaacattgagtcactcaataagtctcaacagtgggtgtgtttgctgagattgtccagcggttgagcagtttggtctcacctccctcgctagttgagaccaaaaagagacaaataactttttcatggtctttgaaacataatgcttatttcgtggtcaatggctttaaaaaaatctgtttcttgttttcttcaacaaactcactagttttcccttaaatgatattgtaaaaattaaagtaatcttgaaaatgttttgacaaaagtaaaattaaagggacatcttttaaaacttgttttgtttttttttttctattgccacacatgaccgttccttcacctttaagcaaagagagtggttcagatggtttctaagatgccaacctgacctcgcattctgtcattctacccagctcttaattcaatttgcttccattatcctaacaggcttctttcttacttagaacttggaaaggctgctgtatttaataccctccaacactaacgcagacttaagataggtactgtttattgaaaacctactgagtgaaatgtgcggttttaggaccttcataaacatctcatttaatctttctagcatcctgtgaaacagccatgatttcacgttgataaacaaagaagacaggggtcccagggatgtgaagcatcttgcccaggcttctgctgctggtgaccagtgtagccaggactccaacccaggttttcctgactcagaagactgagctttttcctggatgttattaatagctaattgtgtccaagcaaccaagggccttgagtctgcttggttctgcttatggcctcacatcaagaaatggagctagtccatgtctgtagtcccaatgctttgggaagccatgatgggaaggttgtcggaggccaaaagttcaagaccaggctgggcaatatcacaagactccatctctacggaaaagtaaaaaattagccagtcatggtggtgtacacttatggtcctagttactcaggagacttaggcaggaggattgcttgatcctaggaattcgaggctgcagtgagctatgattgcacctctgcacccaagcctgggcgacacagcgagaccctctctcttaaaaaaaaaaaatagcagagctcaccaaagtgatgttcacctttttatgacattcctttttcttagcttaagaaaagaaagctgctagatgagagtcttagttttcctgcataagacctcctttatgaatagaataaaagactgtcaaagtaggctgggcttgggcccaggctaatctatgaaggaagcaagctcgtgttccttacctatccttttggtgtccattggattgtgccccgaagtggcctttacccttgagccgtccccagccatggtgctcacacataggcttttgagctccttggagctatccagatcctgctcacttttccttcctgagatcagaacaaatcacccccttactcccactccaaacaaggccttgatgataaactaatccttcctaaaatgctggtaggtaaacaagcaatgatgaagcattgaacacaggttaactcctgacttttgtaccattgtctattccattacacattaacatgactctgaatgccagatccaaacctttgcccaccatctgcttgtcgtgcaacagttgaggcagtaaccaggggagattcacttcctgtcttgtccttccccagggatcacccccctgctgccctctagcagccaaactcagatgagttccattgttaccctaggtgtgcccatctctttggtagggaaggagaaaggtaagaatagccatcagtgaggaaggattcttggagcgaggagccactgtggtttttcctgctatttaagatgttgagaccggataactttagaaagatacctgcacaaacccataaatagtgcttttataaagtttagttcaccggaacctgagttcagtatttgacattagctttttgtccaaagagttgaagcctgctggaggtctttgctcaaataataaataccacatatttccaagtgtgttcaggtataggcactaggtactgtctgtttacttcatgttaggcacattacatgcattggctaatcaaatcctcatcaattacatatgtaataatctaaacttgcctccttgtattataaatggaaataatcctgtttatttaaacgggttttcatgtacctgtagggattaggaaactcaaatggcctttttaatacctttccctagtttgagctccctgttctctttaacagataaaacaacatatttgcttcagcctggaatctgtttttggtgctttggtgcagagacaggaaatgggcactcagagtcacactggtagttgcacactgtatctacagagggcgtgtctcatctgtactctgctgggttacaggatttcagtaggtatttgtgtccacctgagaattctgtttattacctttcatttgacagtgtctttcctttctgcagttgattttgctagagaggcaattcataaggtgaggtcctgttcatagtatgacttgctttctcaatatctccttcaatttttagtaactcttggtctatttggtgtctttaaaaaaaataacctagtaataaagacttcttttaatgtggaaatgtggtctggtagtaagttatttctttccacatgtaactgacccaatctggtttccaaatgagaagtgtgcaggccccagaggttgagaagccatatttcaactgtgaaaaaaatctgcttcctgcatctgttgaaatatagttgttcatacttgccatcccttatctttcttgtaacaatttgcacagttcttgccagaataaatgccattatctgtatgtttcagggagttccccaatttgatcatttttgtgtgtgtgtggtgtgtgtgtgagagagagagatactgcagtaaaacatttctaaaggatgaaagctcttgtatggcatagatatgaattccttcctctggtaataattaggttattcccagaagcacagtgtcattctttaaataaaagctttcctgtttaaagcttttcaaaggagcagaccaccttgaagattccccctagggttgatatgtgtctaattcattttataaaaattattcttgtcttcattttaaagctttggctatatagtcagaaatgtcctaaataacaaactattttgtatttaatttagggaagactaaagggaagaaaaatgaaaactcagtctttatgtaagctccaaggatattagggcttaaagggcttttctagttttatgagaatttgtactactgatttttatatattcctgtttttgagatgaacagatctctggggaaattgttgagttacaatggcatttcactgtgatccctctcaagctcagatcagttctataacccaatgacaacctgtctctttggtttactgtcctgtgaaatgtcagctcaagtttcccagaagtcgtgtgtttatgatgagtcagagtgcttttcctcggtgggacagttgctggccctcttaattttggtgtatgtgcttccaagtatctaaacctccagtctgatctgtatatgctatcctaactgttaattgtattattgattatgttgattatcttgcttgaaggttcatacttttcaatttgatagaaataaagtttttttctgcttatagctagcgaa

SEQ ID NO: 133149 - DNA, 5869 bp, Homo sapiens
ctaggtcgaggccggtgttaatcggccgaggggaaaacaaatgagtagaaagagttcatgaagaggccctcctctgcctttcaaaaggctggtcacctacacatgtttaaggtgtctctgcacatgtctcaagcccatcacaagaaagcaagtacagtgtggatttcaaatggtgtgtaacttcagctccagctggtttttgacagctgttgctgtggtaatatttttgacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtggttgtttctctggtcttgagtgactgtgtccacagttcatttttttccggtaggaataactccttttctacatccacgctccatagagtctctccttttcagacatcctgggatgaaagaatttggcttttttttttctttttttttttggacatctgttttcactcttaggcttttaaacaatagttattgcttttatccctctcagattctaataactgagagcgatggggctatattgaatctctgtatgcactgagaactgagctatgaagaggatcttattaaactgctggtctgactttatggattgacactgttcctttcttttattgtgaaaaaaaaaaaaaaccctgaaagtcttgggaaccccctaaagtcttttgggaatcctcaaaaagcatgggaagttaagtatttagctacataaatgttgtaagatcatatcttatgtatagaagtaataagaccatttggaattactggactaattgaatagttaaggtttctattcgggacaataaaatgtattttgaaagtgctgctaactattgatgctgacagtgtttcactcctatgagtgacccaaacatattataaatatgtggtaaagggaatggagcctgtggggttgagcagaatgttgtactagctgtgcctggactgagtataacagctttatgattatgagaaaacaaattctttattttttttttctgttccaaagattcatcctatggggtggccataaagtctagaattagatactaatattttgtcattcattataacatatcaataaaccatttgttaaaagatttgcctggtttccagacttggtggccaccttgaataattcttgctgtcttctgggaaggatgatgaaatttattcctgctgccttaaaaatatgtatcccttcttcacccatcatgactgtccccagtgagtgtcctttactattcttgggagtgactcctgtctaacttttcatactggcgagaagaaaagaagcctattttaacactttagtggtgttgaaacacattacttactttctgaagatgtcccagtgaatcctctgtcaattcactgccatatgtaatctatatgataaggaatgcatcttccttctaagtactgcccaaactcttgccagctcctctcccattgtcccttcatgtgaatatttcttggctaccttagtggaaatatagatcagttttctccccatccatcctctcaaacataatgagattgtttactttttagatttatgcagtgaaaatgcccagtcaggtctgaatcgtcagtgcattatattgactctgagcactttagaatttagagttgcaattgaatgccagctgtggagatggggtgcatatcagatatataaataaagctcaggtttgctagggaaccaggtatagagaaaaataagtctgatatgaggaaaattgcacaatttagagtagttatgccgtagagaaaatttccacaaactaggaaatgtagagagttattctatagaatactcaaaagaggaaagtatgtgatttttggaaacaggaaaatcttcaaacttctttcttcacttccctttgtgtttagctgaccctccaatgtgatcattgcctttggagtttgggagaggtacgggaagtggcctgatccctgcttccatacttcactcctccatccatccttccctccctcttcccctccagctaaatggacaattctagccaacattgagtcactcaataagtctcaacagtgggtgtgtttgctgagattgtccagcggttgagcagtttggtctcacctccctcgctagttgagaccaaaaagagacaaataactttttcatggtctttgaaacataatgcttatttcgtggtcaatggctttaaaaaaatctgtttcttgttttcttcaacaaactcactagttttcccttaaatgatattgtaaaaattaaagtaatcttgaaaatgttttgacaaaagtaaaattaaagggacatcttttaaaacttgttttgtttttttttttctattgccacacatgaccgttccttcacctttaagcaaagagagtggttcagatggtttctaagatgccaacctgacctcgcattctgtcattctacccagctcttaattcaatttgcttccattatcctaacaggcttctttcttacttagaacttggaaaggctgctgtatttaataccctccaacactaacgcagacttaagataggtactgtttattgaaaacctactgagtgaaatgtgcggttttaggaccttcataaacatctcatttaatctttctagcatcctgtgaaacagccatgatttcacgttgataaacaaagaagacaggggtcccagggatgtgaagcatcttgcccaggcttctgctgctggtgaccagtgtagccaggactccaacccaggttttcctgactcagaagactgagctttttcctggatgttattaatagctaattgtgtccaagcaaccaagggccttgagtctgcttggttctgcttatggcctcacatcaagaaatggagctagtccatgtctgtagtcccaatgctttgggaagccatgatgggaaggttgtcggaggccaaaagttcaagaccaggctgggcaatatcacaagactccatctctacggaaaagtaaaaaattagccagtcatggtggtgtacacttatggtcctagttactcaggagacttaggcaggaggattgcttgatcctaggaattcgaggctgcagtgagctatgattgcacctctgcacccaagcctgggcgacacagcgagaccctctctcttaaaaaaaaaaaatagcagagctcaccaaagtgatgttcacctttttatgacattcctttttcttagcttaagaaaagaaagctgctagatgagagtcttagttttcctgcataagacctcctttatgaatagaataaaagactgtcaaagtaggctgggcttgggcccaggctaatctatgaaggaagcaagctcgtgttccttacctatccttttggtgtccattggattgtgccccgaagtggcctttacccttgagccgtccccagccatggtgctcacacataggcttttgagctccttggagctatccagatcctgctcacttttccttcctgagatcagaacaaatcacccccttactcccactccaaacaaggccttgatgataaactaatccttcctaaaatgctggtaggtaaacaagcaatgatgaagcattgaacacaggttaactcctgacttttgtaccattgtctattccattacacattaacatgactctgaatgccagatccaaacctttgcccaccatctgcttgtcgtgcaacagttgaggcagtaaccaggggagattcacttcctgtcttgtccttccccagggatcacccccctgctgccctctagcagccaaactcagatgagttccattgttaccctaggtgtgcccatctctttggtagggaaggagaaaggtaagaatagccatcagtgaggaaggattcttggagcgaggagccactgtggtttttcctgctatttaagatgttgagaccggataactttagaaagatacctgcacaaacccataaatagtgcttttataaagtttagttcaccggaacctgagttcagtatttgacattagctttttgtccaaagagttgaagcctgctggaggtctttgctcaaataataaataccacatatttccaagtgtgttcaggtataggcactaggtactgtctgtttacttcatgttaggcacattacatgcattggctaatcaaatcctcatcaattacatatgtaataatctaaacttgcctccttgtattataaatggaaataatcctgtttatttaaacgggttttcatgtacctgtagggattaggaaactcaaatggcctttttaatacctttccctagtttgagctccctgttctctttaacagataaaacaacatatttgcttcagcctggaatctgtttttggtgctttggtgcagagacaggaaatgggcactcagagtcacactggtagttgcacactgtatctacagagggcgtgtctcatctgtactctgctgggttacaggatttcagtaggtatttgtgtccacctgagaattctgtttattacctttcatttgacagtgtctttcctttctgcagttgattttgctagagaggcaattcataaggtgaggtcctgttcatagtatgacttgctttctcaatatctccttcaatttttagtaactcttggtctatttggtgtctttaaaaaaaataacctagtaataaagacttcttttaatgtggaaatgtggtctggtagtaagttatttctttccacatgtaactgacccaatctggtttccaaatgagaagtgtgcaggccccagaggttgagaagccatatttcaactgtgaaaaaaatctgcttcctgcatctgttgaaatatagttgttcatacttgccatcccttatctttcttgtaacaatttgcacagttcttgccagaataaatgccattatctgtatgtttcagggagttccccaatttgatcatttttgtgtgtgtgtggtgtgtgtgtgagagagagagatactgcagtaaaacatttctaaaggatgaaagctcttgtatggcatagatatgaattccttcctctggtaataattaggttattcccagaagcacagtgtcattctttaaataaaagctttcctgtttaaagcttttcaaaggagcagaccaccttgaagattccccctagggttgatatgtgtctaattcattttataaaaattattcttgtcttcattttaaagctttggctatatagtcagaaatgtcctaaataacaaactattttgtatttaatttagggaagactaaagggaagaaaaatgaaaactcagtctttatgtaagctccaaggatattagggcttaaagggcttttctagttttatgagaatttgtactactgatttttatatattcctgtttttgagatgaacagatctctggggaaattgttgagttacaatggcatttcactgtgatccctctcaagctcagatcagttctataacccaatgacaacctgtctctttggtttactgtcctgtgaaatgtcagctcaagtttcccagaagtcgtgtgtttatgatgagtcagagtgcttttcctcggtgggacagttgctggccctcttaattttggtgtatgtgcttccaagtatctaaacctccagtctgatctgtatatgctatcctaactgttaattgtattattgattatgttgattatcttgcttgaaggttcatacttttcaatttgatagaaataaagtttttttctgcttatagctagcgaa

SEQ ID NO: 133150 - DNA, 3314 bp, Homo sapiens
agtccgcctgctactcggtcccggcgctgggctgaggggaggggttgtcttaaaagtctctccttccccctgtaggggcggccggcgagtcccagtgagagcggagggtgccagaggtagggggccgagaaacaaagttcccggggcttcctccggggccgcggtcggggctgcgcgtttgaccgcccccctcctcgcgaaggcaatggcttccaaactcctgcgcgcggtcatcctcgggccgcccggctcgggcaagggcaccgtgtgccagaggatcgcccagaactttggtctccagcatctctccagcggccacttcttgcgggagaacatcaaggccagcaccgaagttggtgagatggcaaagcagtatatagagaaaagtcttttggttccagaccatgtgatcacacgcctaatgatgtccgagttggagaacaggcgtggccagcactggctccttgatggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatggtattgatgacgtcactggtgaaccgttagtccagcaggaggatgataaacccgaagcagttgctgccaggctaagacagtacaaagacgtggcaaagccagtcattgaattatacaagagccgaggagtgctccaccaattttccggaacggagacgaacaaaatctggccctacgtttacacacttttctcaaacaagatcacacctattcagtccaaagaagcatattgaccctgcccaatggaagaaccaggaagatgtggtcattcattcaatagtgtgtgtagtattggtgctgtgtccaaattagaagctagctgaggtagcttgcagcatcttttctagttgaaatggtgaactgataggaaaacaaatgagtagaaagagttcatgaagaggccctcctctgcctttcaaaaggctggtcacctacacatgtttaaggtgtctctgcacatgtctcaagcccatcacaagaaagcaagtacagtgtggatttcaaatggtgtgtaacttcagctccagctggtttttgacagctgttgctgtggtaatatttttgacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtggttgtttctctggtcttgagtgactgtgtccacagttcatttttttccggtaggaataactccttttctacatccacgctccatagagtctctccttttcagacatcctgggatgaaagaatttggcttttttttttctttttttttttggacatctgttttcactcttaggcttttaaacaatagttattgcttttatccctctcagattctaataactgagagcgatggggctatattgaatctctgtatgcactgagaactgagctatgaagaggatcttattaaactgctggtctgactttatggattgacactgttcctttcttttattgtgaaaaaaaaaaaaaaccctgaaagtcttgggaaccccctaaagtcttttgggaatcctcaaaaagcatgggaagttaagtatttagctacataaatgttgtaagatcatatcttatgtatagaagtaataagaccatttggaattactggactaattgaatagttaaggtttctattcgggacaataaaatgtattttgaaagtgctgctaactattgatgctgacagtgtttcactcctatgagtgacccaaacatattataaatatgtggtaaagggaatggagcctgtggggttgagcagaatgttgtactagctgtgcctggactgagtataacagctttatgattatgagaaaacaaattctttattttttttttctgttccaaagattcatcctatggggtggccataaagtctagaattagatactaatattttgtcattcattataacatatcaataaaccatttgttaaaagatttgcctggtttccagacttggtggccaccttgaataattcttgctgtcttctgggaaggatgatgaaatttattcctgctgccttaaaaatatgtatcccttcttcacccatcatgactgtccccagtgagtgtcctttactattcttgggagtgactcctgtctaacttttcatactggcgagaagaaaagaagcctattttaacactttagtggtgttgaaacacattacttactttctgaagatgtcccagtgaatcctctgtcaattcactgccatatgtaatctatatgataaggaatgcatcttccttctaagtactgcccaaactcttgccagctcctctcccattgtcccttcatgtgaatatttcttggctaccttagtggaaatatagatcagttttctccccatccatcctctcaaacataatgagattgtttactttttagatttatgcagtgaaaatgcccagtcaggtctgaatcgtcagtgcattatattgactctgagcactttagaatttagagttgcaattgaatgccagctgtggagatggggtgcatatcagatatataaataaagctcaggtttgctagggaaccaggtatagagaaaaataagtctgatatgaggaaaattgcacaatttagagtagttatgccgtagagaaaatttccacaaactaggaaatgtagagagttattctatagaatactcaaaagaggaaagtatgtgatttttggaaacaggaaaatcttcaaacttctttcttcacttccctttgtgtttagctgaccctccaatgtgatcattgcctttggagtttgggagaggtacgggaagtggcctgatccctgcttccatacttcactcctccatccatccttccctccctcttcccctccagctaaatggacaattctagccaacattgagtcactcaataagtctcaacagtgggtgtgtttgctgagattgtccagcggttgagcagtttggtctcacctccctcgctagttgagaccaaaaagagacaaataactttttcatggtctttgaaacataatgcttatttcgtgacatggcgtgagggatcctctagaacaccaccac

SEQ ID NO: 133151 - DNA, 2135 bp, Homo sapiens
  misc_feature (5)..(5): n is a, c, g, or t
cagantccaaacagtgcccagagtccaaacagtgcccagatccaaacctttgcccaccatctgcttgtcgtgcaacagttgaggcagtaaccaggggagattcacttcctgtcttgtccttccccagggatcacccccctgctgccctctagcagccaaactcagatgagttccattgttaccctaggtgtgcccatctctttggtagggaaggagaaaggtaagaatagccatcagtgaggaaggattcttggagcgaggagccactgtggtttttcctgctatttaagatgttgagaccggataactttagaaagatacctgcacaaacccataaatagtgcttttataaagtttagttcaccggaacctgagttcagtatttgacattagctttttgtccaaagagttgaagcctgctggaggtctttgctcaaataataaataccacatatttccaagtgtgttcaggtataggcactaggtactgtctgtttacttcatgttaggcacattacatgcattggctaatcaaatcctcatcaattacatatgtaataatctaaacttgcctccttgtattataaatggaaataatcctgtttatttaaacgggttttcatgtacctgtagggattaggaaactcaaatggcctttttaatacctttccctagtttgagctccctgttctctttaacagataaaacaacatatttgcttcagcctggaatctgtttttggtgctttggtgcagagacaggaaatgggcactcagagtcacactggtagttgcacactgtatctacagagggcgtgtctcatctgtactctgctgggttacaggatttcagtaggtatttgtgtccacctgagaattctgtttattacctttcatttgacagtgtctttcctttctgcagttgattttgctagagaggcaattcataaggtgaggtcctgttcatagtatgacttgctttctcaatatctccttcaatttttagtaactcttggtctatttggtgtctttaaaaaaaataacctagtaataaagacttcttttaatgtggaaatgtggtctggtagtaagttatttctttccacatgtaactgacccaatctggtttccaaatgagaagtgtgcaggccccagaggttgagaagccatatttcaactgtgaaaaaaatctgcttcctgcatctgttgaaatatagttgttcatacttgccatcccttatctttcttgtaacaatttgcacagttcttgccagaataaatgccattatctgtatgtttcagggagttccccaatttgatcatttttgtgtgtgtgtggtgtgtgtgtgagagagagagatactgcagtaaaacatttctaaaggatgaaagctcttgtatggcatagatatgaattccttcctctggtaataattaggttattcccagaagcacagtgtcattctttaaataaaagctttcctgtttaaagcttttcaaaggagcagaccaccttgaagattccccctagggttgatatgtgtctaattcattttataaaaattattcttgtcttcattttaaagctttggctatatagtcagaaatgtcctaaataacaaactattttgtatttaatttagggaagactaaagggaagaaaaatgaaaactcagtctttatgtaagctccaaggatattagggcttaaagggcttttctagttttatgagaatttgtactactgatttttatatattcctgtttttgagatgaacagatctctggggaaattgttgagttacaatggcatttcactgtgatccctctcaagctcagatcagttctataacccaatgacaacctgtctctttggtttactgtcctgtgaaatgtcagctcaagtttcccagaagtcgtgtgtttatgatgagtcagagtgcttttcctcggtgggacagttgctggccctcttaattttggtgtatgtgcttccaagtatctaaacctccagtctgatctgtatatgctatcctaactgttaattgtattattgattatgttgattatcttgcttgaaggttcatacttttcaatttgatagaaataaagtttttttctgcttatagctagcgaa

SEQ ID NO: 133152 - DNA, 2037 bp, Homo sapiens
  misc_feature (5)..(5): n is a, c, g, or t
cagantccaaacagtgcccagagtccaaacagtgccccccctgctgccctctagcagccaaactcagatgagttccattgttaccctaggtgtgcccatctctttggtagggaaggagaaaggtaagaatagccatcagtgaggaaggattcttggagcgaggagccactgtggtttttcctgctatttaagatgttgagaccggataactttagaaagatacctgcacaaacccataaatagtgcttttataaagtttagttcaccggaacctgagttcagtatttgacattagctttttgtccaaagagttgaagcctgctggaggtctttgctcaaataataaataccacatatttccaagtgtgttcaggtataggcactaggtactgtctgtttacttcatgttaggcacattacatgcattggctaatcaaatcctcatcaattacatatgtaataatctaaacttgcctccttgtattataaatggaaataatcctgtttatttaaacgggttttcatgtacctgtagggattaggaaactcaaatggcctttttaatacctttccctagtttgagctccctgttctctttaacagataaaacaacatatttgcttcagcctggaatctgtttttggtgctttggtgcagagacaggaaatgggcactcagagtcacactggtagttgcacactgtatctacagagggcgtgtctcatctgtactctgctgggttacaggatttcagtaggtatttgtgtccacctgagaattctgtttattacctttcatttgacagtgtctttcctttctgcagttgattttgctagagaggcaattcataaggtgaggtcctgttcatagtatgacttgctttctcaatatctccttcaatttttagtaactcttggtctatttggtgtctttaaaaaaaataacctagtaataaagacttcttttaatgtggaaatgtggtctggtagtaagttatttctttccacatgtaactgacccaatctggtttccaaatgagaagtgtgcaggccccagaggttgagaagccatatttcaactgtgaaaaaaatctgcttcctgcatctgttgaaatatagttgttcatacttgccatcccttatctttcttgtaacaatttgcacagttcttgccagaataaatgccattatctgtatgtttcagggagttccccaatttgatcatttttgtgtgtgtgtggtgtgtgtgtgagagagagagatactgcagtaaaacatttctaaaggatgaaagctcttgtatggcatagatatgaattccttcctctggtaataattaggttattcccagaagcacagtgtcattctttaaataaaagctttcctgtttaaagcttttcaaaggagcagaccaccttgaagattccccctagggttgatatgtgtctaattcattttataaaaattattcttgtcttcattttaaagctttggctatatagtcagaaatgtcctaaataacaaactattttgtatttaatttagggaagactaaagggaagaaaaatgaaaactcagtctttatgtaagctccaaggatattagggcttaaagggcttttctagttttatgagaatttgtactactgatttttatatattcctgtttttgagatgaacagatctctggggaaattgttgagttacaatggcatttcactgtgatccctctcaagctcagatcagttctataacccaatgacaacctgtctctttggtttactgtcctgtgaaatgtcagctcaagtttcccagaagtcgtgtgtttatgatgagtcagagtgcttttcctcggtgggacagttgctggccctcttaattttggtgtatgtgcttccaagtatctaaacctccagtctgatctgtatatgctatcctaactgttaattgtattattgattatgttgattatcttgcttgaaggttcatacttttcaatttgatagaaataaagtttttttctgcttatagctagcgaa

SEQ ID NO: 133153 - DNA, 1684 bp, Homo sapiens
agtccgcctgctactcggtcccggcgctgggctgaggggaggggttgtcttaaaagtctctccttccccctgtaggggcggccggcgagtcccagtgagagcggagggtgccagaggtagggggccgagaaacaaagttcccggggcttcctccggggccgcggtcggggctgcgcgtttgaccgcccccctcctcgcgaaggcaatggcttccaaactcctgcgcgcggtcatcctcgggccgcccggctcgggcaagggcaccgtgtgccagaggatcgcccagaactttggtctccagcatctctccagcggccacttcttgcgggagaacatcaaggccagcaccgaagttggtgagatggcaaagcagtatatagagaaaagtcttttggttccagaccatgtgatcacacgcctaatgatgtccgagttggagaacaggcgtggccagcactggctccttgatggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatggtattgatgacgtcactggtgaaccgttagtccagcaggaggatgataaacccgaagcagttgctgccaggctaagacagtacaaagacgtggcaaagccagtcattgaattatacaagagccgaggagtgctccaccaattttccggaacggagacgaacaaaatctggccctacgtttacacacttttctcaaacaagatcacacctattcagtccaaagaagcatattgaccctgcccaatggaagaaccaggaagatgtggtcattcattcaatagtgtgtgtagtattggtgctgtgtccaaattagaagctagctgaggtagcttgcagcatcttttctagttgaaatggtgaactgataggaaaacaaatgagtagaaagagttcatgaagaggccctcctctgcctttcaaaaggctggtcacctacacatgtttaaggtgtctctgcacatgtctcaagcccatcacaagaaagcaagtacagtgtggatttcaaatggtgtgtaacttcagctccagctggtttttgacagctgttgctgtggtaatatttttgacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtggttgtttctctggtcttgagtgactgtgtccacagttcatttttttccggtaggaataactccttttctacatccacgctccatagagtctctccttttcagacatcctgggatgaaagaatttggcttttttttttctttttttttttggacatctgttttcactcttaggcttttaaacaatagttattgcttttatccctctcagattctaataactgagagcgatggggctatattgaatctctgtatgcactgagaactgagctatgaagaggatcttattaaactgctggtctgacttta

SEQ ID NO: 133154 - DNA, 2191 bp, Homo sapiens
agtccgcctgctactcggtcccggcgctgggctgaggggaggggttgtcttaaaagtctctccttccccctgtaggggcggccggcgagtcccagtgagagcggagggtgccagaggtagggggccgagaaacaaagttcccggggcttcctccggggccgcggtcggggctgcgcgtttgaccgcccccctcctcgcgaaggcaatggcttccaaactcctgcgcgcggtcatcctcgggccgcccggctcgggcaagggcaccgtgtgccagaggatcgcccagaactttggtctccagcatctctccagcggccacttcttgcgggagaacatcaaggccagcaccgaagttggtgagatggcaaagcagtatatagagaaaagtcttttggttccagaccatgtgatcacacgcctaatgatgtccgagttggagaacaggcgtggccagcactggctccttgatggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatggtattgatgacgtcactggtgaaccgttagtccagcaggaggatgataaacccgaagcagttgctgccaggctaagacagtacaaagacgtggcaaagccagtcattgaattatacaagagccgaggagtgctccaccaattttccggaacggagacgaacaaaatctggccctacgtttacacacttttctcaaacaagatcacacctattcagtccaaagaagcatattgaccctgcccaatggaagaaccaggaagatgtggtcattcattcaatagtgtgtgtagtattggtgctgtgtccaaattagaagctagctgaggtagcttgcagcatcttttctagttgaaatggtgaactgataggaaaacaaatgagtagaaagagttcatgaagaggccctcctctgcctttcaaaaggctggtcacctacacatgtttaaggtgtctctgcacatgtctcaagcccatcacaagaaagcaagtacagtgtggatttcaaatggtgtgtaacttcagctccagctggtttttgacagctgttgctgtggtaatatttttgacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtggttgtttctctggtcttgagtgactgtgtccacagttcatttttttccggtaggaataactccttttctacatccacgctccatagagtctctccttttcagacatcctgggatgaaagaatttggcttttttttttctttttttttttggacatctgttttcactcttaggcttttaaacaatagttattgcttttatccctctcagattctaataactgagagcgatggggctatattgaatctctgtatgcactgagaactgagctatgaagaggatcttattaaactgctggtctgactttatggattgacactgttcctttcttttattgtgaaaaaaaaaaaaaaccctgaaagtcttgggaaccccctaaagtcttttgggaatcctcaaaaagcatgggaagttaagtatttagctacataaatgttgtaagatcatatcttatgtatagaagtaataagaccatttggaattactggactaattgaatagttaaggtttctattcgggacaataaaatgtattttgaaagtgctgctaactattgatgctgacagtgtttcactcctatgagtgacccaaacatattataaatatgtggtaaagggaatggagcctgtggggttgagcagaatgttgtactagctgtgcctggactgagtataacagctttatgattatgagaaaacaaattctttattttttttttctgttccaaagattcatcctatggggtggccataaagtctagaattagatactaatattttgtcattcattataacatatcaataaaccatttgtta

SEQ ID NO: 133155 - DNA, 6615 bp, Homo sapiens
agtccgcctgctactcggtcccggcgctgggctgaggggaggggttgtcttaaaagtctctccttccccctgtaggggcggccggcgagtcccagtgagagcggagggtgccagaggtagggggccgagaaacaaagttcccggggcttcctccggggccgcggtcggggctgcgcgtttgaccgcccccctcctcgcgaaggcaatggcttccaaactcctgcgcgcggtcatcctcgggccgcccggctcgggcaagggcaccgtgtgccagaggatcgcccagaactttggtctccagcatctctccagcggccacttcttgcgggagaacatcaaggccagcaccgaagttggtgagatggcaaagcagtatatagagaaaagtcttttggttccagaccatgtgatcacacgcctaatgatgtccgagttggagaacaggcgtggccagcactggctccttgatggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatggtattgatgacgtcactggtgaaccgttagtccagcaggaggatgataaacccgaagcagttgctgccaggctaagacagtacaaagacgtggcaaagccagtcattgaattatacaagagccgaggagtgctccaccaattttccggaacggagacgaacaaaatctggccctacgtttacacacttttctcaaacaagatcacacctattcagtccaaagaagcatattgaccctgcccaatggaagaaccaggaagatgtggtcattcattcaatagtgtgtgtagtattggtgctgtgtccaaattagaagctagctgaggtagcttgcagcatcttttctagttgaaatggtgaactgataggaaaacaaatgagtagaaagagttcatgaagaggccctcctctgcctttcaaaaggctggtcacctacacatgtttaaggtgtctctgcacatgtctcaagcccatcacaagaaagcaagtacagtgtggatttcaaatggtgtgtaacttcagctccagctggtttttgacagctgttgctgtggtaatatttttgacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtggttgtttctctggtcttgagtgactgtgtccacagttcatttttttccggtaggaataactccttttctacatccacgctccatagagtctctccttttcagacatcctgggatgaaagaatttggcttttttttttctttttttttttggacatctgttttcactcttaggcttttaaacaatagttattgcttttatccctctcagattctaataactgagagcgatggggctatattgaatctctgtatgcactgagaactgagctatgaagaggatcttattaaactgctggtctgactttatggattgacactgttcctttcttttattgtgaaaaaaaaaaaaaaccctgaaagtcttgggaaccccctaaagtcttttgggaatcctcaaaaagcatgggaagttaagtatttagctacataaatgttgtaagatcatatcttatgtatagaagtaataagaccatttggaattactggactaattgaatagttaaggtttctattcgggacaataaaatgtattttgaaagtgctgctaactattgatgctgacagtgtttcactcctatgagtgacccaaacatattataaatatgtggtaaagggaatggagcctgtggggttgagcagaatgttgtactagctgtgcctggactgagtataacagctttatgattatgagaaaacaaattctttattttttttttctgttccaaagattcatcctatggggtggccataaagtctagaattagatactaatattttgtcattcattataacatatcaataaaccatttgttaaaagatttgcctggtttccagacttggtggccaccttgaataattcttgctgtcttctgggaaggatgatgaaatttattcctgctgccttaaaaatatgtatcccttcttcacccatcatgactgtccccagtgagtgtcctttactattcttgggagtgactcctgtctaacttttcatactggcgagaagaaaagaagcctattttaacactttagtggtgttgaaacacattacttactttctgaagatgtcccagtgaatcctctgtcaattcactgccatatgtaatctatatgataaggaatgcatcttccttctaagtactgcccaaactcttgccagctcctctcccattgtcccttcatgtgaatatttcttggctaccttagtggaaatatagatcagttttctccccatccatcctctcaaacataatgagattgtttactttttagatttatgcagtgaaaatgcccagtcaggtctgaatcgtcagtgcattatattgactctgagcactttagaatttagagttgcaattgaatgccagctgtggagatggggtgcatatcagatatataaataaagctcaggtttgctagggaaccaggtatagagaaaaataagtctgatatgaggaaaattgcacaatttagagtagttatgccgtagagaaaatttccacaaactaggaaatgtagagagttattctatagaatactcaaaagaggaaagtatgtgatttttggaaacaggaaaatcttcaaacttctttcttcacttccctttgtgtttagctgaccctccaatgtgatcattgcctttggagtttgggagaggtacgggaagtggcctgatccctgcttccatacttcactcctccatccatccttccctccctcttcccctccagctaaatggacaattctagccaacattgagtcactcaataagtctcaacagtgggtgtgtttgctgagattgtccagcggttgagcagtttggtctcacctccctcgctagttgagaccaaaaagagacaaataactttttcatggtctttgaaacataatgcttatttcgtggtcaatggctttaaaaaaatctgtttcttgttttcttcaacaaactcactagttttcccttaaatgatattgtaaaaattaaagtaatcttgaaaatgttttgacaaaagtaaaattaaagggacatcttttaaaacttgttttgtttttttttttctattgccacacatgaccgttccttcacctttaagcaaagagagtggttcagatggtttctaagatgccaacctgacctcgcattctgtcattctacccagctcttaattcaatttgcttccattatcctaacaggcttctttcttacttagaacttggaaaggctgctgtatttaataccctccaacactaacgcagacttaagataggtactgtttattgaaaacctactgagtgaaatgtgcggttttaggaccttcataaacatctcatttaatctttctagcatcctgtgaaacagccatgatttcacgttgataaacaaagaagacaggggtcccagggatgtgaagcatcttgcccaggcttctgctgctggtgaccagtgtagccaggactccaacccaggttttcctgactcagaagactgagctttttcctggatgttattaatagctaattgtgtccaagcaaccaagggccttgagtctgcttggttctgcttatggcctcacatcaagaaatggagctagtccatgtctgtagtcccaatgctttgggaagccatgatgggaaggttgtcggaggccaaaagttcaagaccaggctgggcaatatcacaagactccatctctacggaaaagtaaaaaattagccagtcatggtggtgtacacttatggtcctagttactcaggagacttaggcaggaggattgcttgatcctaggaattcgaggctgcagtgagctatgattgcacctctgcacccaagcctgggcgacacagcgagaccctctctcttaaaaaaaaaaaatagcagagctcaccaaagtgatgttcacctttttatgacattcctttttcttagcttaagaaaagaaagctgctagatgagagtcttagttttcctgcataagacctcctttatgaatagaataaaagactgtcaaagtaggctgggcttgggcccaggctaatctatgaaggaagcaagctcgtgttccttacctatccttttggtgtccattggattgtgccccgaagtggcctttacccttgagccgtccccagccatggtgctcacacataggcttttgagctccttggagctatccagatcctgctcacttttccttcctgagatcagaacaaatcacccccttactcccactccaaacaaggccttgatgataaactaatccttcctaaaatgctggtaggtaaacaagcaatgatgaagcattgaacacaggttaactcctgacttttgtaccattgtctattccattacacattaacatgactctgaatgccagatccaaacctttgcccaccatctgcttgtcgtgcaacagttgaggcagtaaccaggggagattcacttcctgtcttgtccttccccagggatcacccccctgctgccctctagcagccaaactcagatgagttccattgttaccctaggtgtgcccatctctttggtagggaaggagaaaggtaagaatagccatcagtgaggaaggattcttggagcgaggagccactgtggtttttcctgctatttaagatgttgagaccggataactttagaaagatacctgcacaaacccataaatagtgcttttataaagtttagttcaccggaacctgagttcagtatttgacattagctttttgtccaaagagttgaagcctgctggaggtctttgctcaaataataaataccacatatttccaagtgtgttcaggtataggcactaggtactgtctgtttacttcatgttaggcacattacatgcattggctaatcaaatcctcatcaattacatatgtaataatctaaacttgcctccttgtattataaatggaaataatcctgtttatttaaacgggttttcatgtacctgtagggattaggaaactcaaatggcctttttaatacctttccctagtttgagctccctgttctctttaacagataaaacaacatatttgcttcagcctggaatctgtttttggtgctttggtgcagagacaggaaatgggcactcagagtcacactggtagttgcacactgtatctacagagggcgtgtctcatctgtactctgctgggttacaggatttcagtaggtatttgtgtccacctgagaattctgtttattacctttcatttgacagtgtctttcctttctgcagttgattttgctagagaggcaattcataaggtgaggtcctgttcatagtatgacttgctttctcaatatctccttcaatttttagtaactcttggtctatttggtgtctttaaaaaaaataacctagtaataaagacttcttttaatgtggaaatgtggtctggtagtaagttatttctttccacatgtaactgacccaatctggtttccaaatgagaagtgtgcaggccccagaggttgagaagccatatttcaactgtgaaaaaaatctgcttcctgcatctgttgaaatatagttgttcatacttgccatcccttatctttcttgtaacaatttgcacagttcttgccagaataaatgccattatctgtatgtttcagggagttccccaatttgatcatttttgtgtgtgtgtggtgtgtgtgtgagagagagagatactgcagtaaaacatttctaaaggatgaaagctcttgtatggcatagatatgaattccttcctctggtaataattaggttattcccagaagcacagtgtcattctttaaataaaagctttcctgtttaaagcttttcaaaggagcagaccaccttgaagattccccctagggttgatatgtgtctaattcattttataaaaattattcttgtcttcattttaaagctttggctatatagtcagaaatgtcctaaataacaaactattttgtatttaatttagggaagactaaagggaagaaaaatgaaaatttcccagaagtcgtgtgtttatgatgagtcagagtgcttttcctcggtgggacagttgctggccctcttaattttggtgtatgtgcttccaagtatctaaacctccagtctgatctgtatatgctatcctaactgttaattgtattattgattatgttgattatcttgcttgaaggttcatacttttcaatttgatagaaataaagtttttttctgcttatagctagcgaa

SEQ ID NO: 133156 - DNA, 6785 bp, Homo sapiens
  misc_feature (6696)..(6698): n is a, c, g, or t
  misc_feature (6705)..(6705): n is a, c, g, or t
  misc_feature (6708)..(6708): n is a, c, g, or t
agtccgcctgctactcggtcccggcgctgggctgaggggaggggttgtcttaaaagtctctccttccccctgtaggggcggccggcgagtcccagtgagagcggagggtgccagaggtagggggccgagaaacaaagttcccggggcttcctccggggccgcggtcggggctgcgcgtttgaccgcccccctcctcgcgaaggcaatggcttccaaactcctgcgcgcggtcatcctcgggccgcccggctcgggcaagggcaccgtgtgccagaggatcgcccagaactttggtctccagcatctctccagcggccacttcttgcgggagaacatcaaggccagcaccgaagttggtgagatggcaaagcagtatatagagaaaagtcttttggttccagaccatgtgatcacacgcctaatgatgtccgagttggagaacaggcgtggccagcactggctccttgatggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatggtattgatgacgtcactggtgaaccgttagtccagcaggaggatgataaacccgaagcagttgctgccaggctaagacagtacaaagacgtggcaaagccagtcattgaattatacaagagccgaggagtgctccaccaattttccggaacggagacgaacaaaatctggccctacgtttacacacttttctcaaacaagatcacacctattcagtccaaagaagcatattgaccctgcccaatggaagaaccaggaagatgtggtcattcattcaatagtgtgtgtagtattggtgctgtgtccaaattagaagctagctgaggtagcttgcagcatcttttctagttgaaatggtgaactgataggaaaacaaatgagtagaaagagttcatgaagaggccctcctctgcctttcaaaaggctggtcacctacacatgtttaaggtgtctctgcacatgtctcaagcccatcacaagaaagcaagtacagtgtggatttcaaatggtgtgtaacttcagctccagctggtttttgacagctgttgctgtggtaatatttttgacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtggttgtttctctggtcttgagtgactgtgtccacagttcatttttttccggtaggaataactccttttctacatccacgctccatagagtctctccttttcagacatcctgggatgaaagaatttggcttttttttttctttttttttttggacatctgttttcactcttaggcttttaaacaatagttattgcttttatccctctcagattctaataactgagagcgatggggctatattgaatctctgtatgcactgagaactgagctatgaagaggatcttattaaactgctggtctgactttatggattgacactgttcctttcttttattgtgaaaaaaaaaaaaaaccctgaaagtcttgggaaccccctaaagtcttttgggaatcctcaaaaagcatgggaagttaagtatttagctacataaatgttgtaagatcatatcttatgtatagaagtaataagaccatttggaattactggactaattgaatagttaaggtttctattcgggacaataaaatgtattttgaaagtgctgctaactattgatgctgacagtgtttcactcctatgagtgacccaaacatattataaatatgtggtaaagggaatggagcctgtggggttgagcagaatgttgtactagctgtgcctggactgagtataacagctttatgattatgagaaaacaaattctttattttttttttctgttccaaagattcatcctatggggtggccataaagtctagaattagatactaatattttgtcattcattataacatatcaataaaccatttgttaaaagatttgcctggtttccagacttggtggccaccttgaataattcttgctgtcttctgggaaggatgatgaaatttattcctgctgccttaaaaatatgtatcccttcttcacccatcatgactgtccccagtgagtgtcctttactattcttgggagtgactcctgtctaacttttcatactggcgagaagaaaagaagcctattttaacactttagtggtgttgaaacacattacttactttctgaagatgtcccagtgaatcctctgtcaattcactgccatatgtaatctatatgataaggaatgcatcttccttctaagtactgcccaaactcttgccagctcctctcccattgtcccttcatgtgaatatttcttggctaccttagtggaaatatagatcagttttctccccatccatcctctcaaacataatgagattgtttactttttagatttatgcagtgaaaatgcccagtcaggtctgaatcgtcagtgcattatattgactctgagcactttagaatttagagttgcaattgaatgccagctgtggagatggggtgcatatcagatatataaataaagctcaggtttgctagggaaccaggtatagagaaaaataagtctgatatgaggaaaattgcacaatttagagtagttatgccgtagagaaaatttccacaaactaggaaatgtagagagttattctatagaatactcaaaagaggaaagtatgtgatttttggaaacaggaaaatcttcaaacttctttcttcacttccctttgtgtttagctgaccctccaatgtgatcattgcctttggagtttgggagaggtacgggaagtggcctgatccctgcttccatacttcactcctccatccatccttccctccctcttcccctccagctaaatggacaattctagccaacattgagtcactcaataagtctcaacagtgggtgtgtttgctgagattgtccagcggttgagcagtttggtctcacctccctcgctagttgagaccaaaaagagacaaataactttttcatggtctttgaaacataatgcttatttcgtggtcaatggctttaaaaaaatctgtttcttgttttcttcaacaaactcactagttttcccttaaatgatattgtaaaaattaaagtaatcttgaaaatgttttgacaaaagtaaaattaaagggacatcttttaaaacttgttttgtttttttttttctattgccacacatgaccgttccttcacctttaagcaaagagagtggttcagatggtttctaagatgccaacctgacctcgcattctgtcattctacccagctcttaattcaatttgcttccattatcctaacaggcttctttcttacttagaacttggaaaggctgctgtatttaataccctccaacactaacgcagacttaagataggtactgtttattgaaaacctactgagtgaaatgtgcggttttaggaccttcataaacatctcatttaatctttctagcatcctgtgaaacagccatgatttcacgttgataaacaaagaagacaggggtcccagggatgtgaagcatcttgcccaggcttctgctgctggtgaccagtgtagccaggactccaacccaggttttcctgactcagaagactgagctttttcctggatgttattaatagctaattgtgtccaagcaaccaagggccttgagtctgcttggttctgcttatggcctcacatcaagaaatggagctagtccatgtctgtagtcccaatgctttgggaagccatgatgggaaggttgtcggaggccaaaagttcaagaccaggctgggcaatatcacaagactccatctctacggaaaagtaaaaaattagccagtcatggtggtgtacacttatggtcctagttactcaggagacttaggcaggaggattgcttgatcctaggaattcgaggctgcagtgagctatgattgcacctctgcacccaagcctgggcgacacagcgagaccctctctcttaaaaaaaaaaaatagcagagctcaccaaagtgatgttcacctttttatgacattcctttttcttagcttaagaaaagaaagctgctagatgagagtcttagttttcctgcataagacctcctttatgaatagaataaaagactgtcaaagtaggctgggcttgggcccaggctaatctatgaaggaagcaagctcgtgttccttacctatccttttggtgtccattggattgtgccccgaagtggcctttacccttgagccgtccccagccatggtgctcacacataggcttttgagctccttggagctatccagatcctgctcacttttccttcctgagatcagaacaaatcacccccttactcccactccaaacaaggccttgatgataaactaatccttcctaaaatgctggtaggtaaacaagcaatgatgaagcattgaacacaggttaactcctgacttttgtaccattgtctattccattacacattaacatgactctgaatgccagatccaaacctttgcccaccatctgcttgtcgtgcaacagttgaggcagtaaccaggggagattcacttcctgtcttgtccttccccagggatcacccccctgctgccctctagcagccaaactcagatgagttccattgttaccctaggtgtgcccatctctttggtagggaaggagaaaggtaagaatagccatcagtgaggaaggattcttggagcgaggagccactgtggtttttcctgctatttaagatgttgagaccggataactttagaaagatacctgcacaaacccataaatagtgcttttataaagtttagttcaccggaacctgagttcagtatttgacattagctttttgtccaaagagttgaagcctgctggaggtctttgctcaaataataaataccacatatttccaagtgtgttcaggtataggcactaggtactgtctgtttacttcatgttaggcacattacatgcattggctaatcaaatcctcatcaattacatatgtaataatctaaacttgcctccttgtattataaatggaaataatcctgtttatttaaacgggttttcatgtacctgtagggattaggaaactcaaatggcctttttaatacctttccctagtttgagctccctgttctctttaacagataaaacaacatatttgcttcagcctggaatctgtttttggtgctttggtgcagagacaggaaatgggcactcagagtcacactggtagttgcacactgtatctacagagggcgtgtctcatctgtactctgctgggttacaggatttcagtaggtatttgtgtccacctgagaattctgtttattacctttcatttgacagtgtctttcctttctgcagttgattttgctagagaggcaattcataaggtgaggtcctgttcatagtatgacttgctttctcaatatctccttcaatttttagtaactcttggtctatttggtgtctttaaaaaaaataacctagtaataaagacttcttttaatgtggaaatgtggtctggtagtaagttatttctttccacatgtaactgacccaatctggtttccaaatgagaagtgtgcaggccccagaggttgagaagccatatttcaactgtgaaaaaaatctgcttcctgcatctgttgaaatatagttgttcatacttgccatcccttatctttcttgtaacaatttgcacagttcttgccagaataaatgccattatctgtatgtttcagggagttccccaatttgatcatttttgtgtgtgtgtggtgtgtgtgtgagagagagagatactgcagtaaaacatttctaaaggatgaaagctcttgtatggcatagatatgaattccttcctctggtaataattaggttattcccagaagcacagtgtcattctttaaataaaagctttcctgtttaaagcttttcaaaggagcagaccaccttgaagattccccctagggttgatatgtgtctaattcattttataaaaattattcttgtcttcattttaaagctttggctatatagtcagaaatgtcctaaataacaaactattttgtatttaatttagggaagactaaagggaagaaaaatgaaaactcagtctttatgtaagctccaaggatattagggcttaaagggcttttctagttttatgagaatttgtactactgatttttatatattcctgtttttgagatgaacagatctctggggaaattgttgagttacaatggcatttcactgtgatccctctcaagctcagatcagttctataacccaatgacaacctgtctctttggtttactgtcctgtgaaatgtcagctcaagtttcccagaagtcgtgtgtttatgatgagtcagagtgcttttcctcggtgggacagttgctggccctcttaattggggtnnngttcagnttnaactcagttgttgttttgtatctaacggaaggtatgggaagggaatggcgaggggcatcatggagaaaaagttgggc

SEQ ID NO: 133157 - DNA, 213 bp, Homo sapiens
ttctggtttcatttagcattggaacctcagtgtatggtgcttggtatatggcagacactcaacactttagaataaataaattaataagtatacacatgcatgaatgtgtattcctacctgtgaactaaaaaagatacttcaaagctcttttgacgtgttgaatattgatataggagttaaaaagaaattatttaggcagatagtgaggataag

SEQ ID NO: 133158 - DNA, 832 bp, Homo sapiens
gtctggatattttcaactaacctgtgttgtgttccagcttattaatcctttcttttattggatccaagtagctattaaacccatgtattcttaatttcaatttgtatatttttcagttcttggttattttttacaaattcatgttctttggtgaaattctttaccttgccatccaagcgttgtacattttagtcactaagattttcagatctatttctgatgactctcctatctgggtcactttgaactctatttgtgtttgctgttttacatctttgtcctatttgttaggacagttgctaattttgtgtttgattactggatattgtatattggaaactgtaaaggctctaaatgatgtcttccaccagactagattcactctgtactctggaaagcagcagagagacacagcacctgtgatggattttaaatatgttccacaaattttcgatacccctccttttaaatgtgaagcctatttccatctgggactatacttagtgactcacttgtagtgaatagaatatggcacaagtgacaatatttttggtaggcataaaaaaacatagccttccttgctttcccttagatgacttgctctggagcaagttaactgtcatgtcataagaacatcaagcaatctatgcagagctctacatggtgaggcatcctgctaatagctatgtgaacaagccgttttaggctctgacccccagccctggtcagacctttggtgactacagcacctgccaacatcctgactgcaacctcatgagaaaacgtgaggtagaactcctgaactacacgacttcctacttatttacccaca

SEQ ID NO: 133159 - DNA, 401 bp, Homo sapiens
ttttcctgtgcttattggtcatttttataacttctttagaggaatgtttattcaagccttttgcctttttccaaattgggccatctttttattgttgatttataagagttcttcatatacctgtacattaaaggcttatcagacatgatttgcaaatattttttcccgttctgtaacttttttcactttaagtgtcctttgatacacaagagttttacattttaatgaagttttacatttacaatttatctatttcttttcttttgttgcttgtgcttttggtgtcatttctaagaatccactgccaaatccaaggtcatgggaatatcttaatttctccttccttttggaaggctatagatttttgatgaatatagacttaactagttgacagttttctt

SEQ ID NO: 133160 - DNA, 670 bp, Homo sapiens
ttagcatcttataaagaaaaatctgttttctcaaggctctatagtaatgatattttgtttaagtttgtccaatatggtatttagttcttcctattaaggaggagtctctaaacttcagtctgtgggccaaatctacctcctgtttctgtttaattattttattgggggggggtgatatttatcccctcaagcatttattctttatgttacaaacaatccaattatattattttagttatttttaaatgtccaatctaattattattgactgtagtcaccctgttgtgctatcaaatactaggtcttattcattctttctaactaatgtttttgtacccattaaccattcctttcccattccccatctcaccactacacttcgcagcctctggtaaccatccttctactctctgtgtccatgagttaaattgttttgatttttagatcccaaaaataaatgaaaacaagcgatgtttgtctttctgtgcctggcttatttcacttgacataatgatctccagttccatccatgttgttgcaaatggctggacctcattcttttttatggctgaataatactccattgtctataagtaccacattttttctttatccattcgtctgttgatggacatttaggctgcttccaaatcttggctattgtgatcag

SEQ ID NO: 133161 - DNA, 427 bp, Homo sapiens
aaccttaaaagttacattgcttagtgcctttcatatcaactcgtggacaaagctggctttaaatctcaggccagaattcagcccaatttaaacaagtgttagtgtgagtgtattgtgtctaagatagaaaagtgtttagtaagttcaacgttccccatgcttactgtccaaggcaatcccttcatcaaaattcctcactgcaccacagtctaatattgttagtggatgtacagggtcacagagcatatcttattggtctgtactaagataagaaccagagttttgttctagagctgtgaaatgaaattaaaaatactacacacaatgcaaggatatggaataggagcatcaaagctccccaaaaaagtggtctcggatgcatttgcagctatatagtttatttgagcattttatatttaacaagaaa

SEQ ID NO: 133162 - DNA, 273 bp, Homo sapiens
caggatgttgtatttcattatttttatatatagtcaaattgttctttacaattttaaacatttcttttcatgctgtcattatcaattgaattttgttttactaaaatgactaaataattttattcgagtaagtagaacctatggaaaaattatatcttttgatccttttcagcttttcttttacaggggcagttttaattatttgatttttccattggtcagaagtattagataatagacatttgataatttccagtgggtctctgctaagac

SEQ ID NO: 133163 - DNA, 427 bp, Homo sapiens
ttcaagtaggccttagtggttcctggatcccactatacccatttctacatcattcatgctccccttcttttagacacttctaacattctccaagctctttgaagctgaaaaccttgttcctatattactgcgaaaacagaagcaattagaagagaactttcacaagttcccactgtatccactctttcctgtacctatgtccctagattctctcctttcccattaaaacttcctaaggccaacccttccacctatgtactattaaaggacattgttctaacaattttctcattatttttcctcataaatgcttccctaaatttacttggattactctcacaatcatgcagcaaatgtgatgtaatttcttccatcttaaaaaacaaaacaatttatttctctcctcttccagtcaccactccatctc

SEQ ID NO: 133164 - DNA, 186 bp, Homo sapiens
atatcccaccctcctaaccacagaggttcaggctgcagtgcccttaaccacagcaggagcgtgctgcctccctctaagggagcaactgaaccccacttaaatcctcaactagagcagaaatcacactggaggccaggtgcggtggctcacgcctgtaatcccagcactttgggaggccgaggcagg

SEQ ID NO: 133165 - DNA, 475 bp, Homo sapiens
ctattcagcttgattaggacaaagccccacgcagcttagcctggtcaggaacaacggcgagcctctaccccgattgggagcagcaatgggccccgcctcactggatctgaagtgcagcagataccctgctggatccggaggggtgtaagtcagtggtggtgtctgcaacaacagcaatcagcatgtggtagatggcgagcgaaagctcagttcgaaccagaacaatacacggaccacatagtatgcagttgtaagatttaatataatgacaaacagagctcccatacaacaggaggggacccaaagggggttgcctttgccggctcaaatgcctgggtttatatcccaatcattgtccctccccctgtgctctcaggcaatagatgattggctatttctttacctcctgttttagcctaattagcattttagtgagctctctttactacctgattggtcaggtgtgagctaagtt

SEQ ID NO: 133166 - DNA, 486 bp, Homo sapiens
cgctcagagtactctagctatatggataaagccattcgacagcagcttagcctggtcaggaacaacggcgagcctctaccccgattgggagcagcaatgggccccgcctcactggatctgaagtgcagcagataccctgctggatccggaggggtgtaagtcagtggtggtgtctgcaacaacagcaatcagcatgtggtagatggcgagcgaaagctcagttcgaaccagaacaatacacggaccacatagtatgcagttgtaagatttaatataatgacaaacagagctcccatacaacaggaggggacccaaagggggttgcctttgccggctcaaatgcctgggtttatatcccaatcattgtccctccccctgtgctctcaggcaatagatgattggctatttctttacctcctgttttagcctaattagcattttagtgagctctctttactacctgattggtcaggtgtgagctaagtt

SEQ ID NO: 133167 - DNA, 667 bp, Homo sapiens
agtcacagagttgataatttgataatgtttatagacagtatttgaatattttgactcattatggttttaagggtgaattatgagatttacaatttctttgattttgccttttgaggcttaagttggccttgtgaggcaactcagttgcttgatataataaattagaagtgtttttaaaaatttaggggaacttaattgatggcttattactatgactataaaggattttaatccgctaaaattgaattaaataagtggaaggatgatttcaaattatgtaaaaattacttagtttataagtaaaatcaaaatcacaaagtgaacttaaagtcctaagaaaattatagtttcgtttgcaacttaaattaattaaatgttattttaatattcaaatacctatacatggttcctttctatgcacaaaagcctccacttcccactttaaaaacacatcaacacacatggtaaggaaaatcactatgcatatagaagcccaggatgcaacagcacttcctgtatagtaagaaatgtgtggtctttgtggggcataaggtaatgcaaactacataaaaatatgcaccacacgcaatgctgatccaggcagaccagcttccaggaactaaaataaaagcaaagaatcaacaactgaggcgataattaccaaaca

SEQ ID NO: 133168 - DNA, 349 bp, Homo sapiens
tttttttttggtggcaaaatatatataatacaaaattttccatttaacctcaacaaatgctttttgatccacctgtgacagcagggattctcaacccggggtctgggaaacctaaggtaactacaggcacacctgtctttgtcattttcaggggatcagggcagggcgggaggccacagctttcatctgactctaaactgtgagaaggcaagggggagtcagcgtgaccgcccacgctgggaacccggggagggctgtgggcctctccctgtcgcatctgagacctgcagaagcagcaatgttggctgccgaccatctgcagagctaggctctaatccctagtccccag

SEQ ID NO: 133169 - DNA, 171 bp, Homo sapiens
tgttaaaccatccttgcattactggtatgaaacccgcttgaccatggtggattatctttctgatatgccattggattcagttagccagtattctgttaaggatttttctatctatgttcatcagggatactgaactacagatcaatatctttttttgttatgtcctttcct

SEQ ID NO: 133170 - DNA, 852 bp, Homo sapiens
acctgttttgaccgcagaatatacttgtaggagtcagagttcttactagtggtaagacgatagtactggtttgaatttccattccacccttactagccttgtgattgtgggcaagttatttaatatctatgaacctcagttttactaatctataaaatgggaatattttccttataggattattataatgagataacatataaatatgctttttataatgcctatacattctagacactcaaaaaatgaaaaccaccattacttgttattgttatttctactactattatttttactactaccattgttatttttactattaatacaataatattctttctcattccttaattttagttgatacaaaattttttaaaaagtcatgatagtgaaaaacagcagtagtaggcatttctttggatagctagggtaaaaatggggacaaggtcgtgtttctatttataggaacaaacagaaccaagaacctgaatctgtgaggcagtattcattggtcatccaatatgtaagaaaatgttcatgtatcatattttattatgttttccgttacacactacttaaatgaagttgttaaattgtgtattacatatacacatagataaaacctaaagcaaactggaattgcttataaagtttctgatgatttgccttttccttattctttgatgttttataacaatgtatctcaaagcaattttttctttagctgtcttattttaaagctatgttaatgggtcaagatgaagggtaatttgttgtacaggctctctcatacaaaagaacatcctgtcattcatagcagcaaagtacctttgtgcaaagatcaactatcag

SEQ ID NO: 133171 - DNA, 633 bp, Homo sapiens
attgagacatttgtattacatatatatatatatgatagcattgactctggcagcaactctgctagagattatatatgtaaatctcaagtcttgaaacagtgttgtattttggtattggtattcacagccctacttgccacatgatggtagagcagagatttgcactttaactcaaaggcgagtgtgagagtgcttaaaacacctggttagtgcacctagaaaaattagattgatttcagaatggcacaatcataactgtggctctatttaaagtcaaattgcattctctcatgtatcctattttacattcttgtcattatctgaaaacttataaaggttaagtacccttaatctaaaaacccaaaatccaaaatgccctaaaatccacgattttttgagtgctgatgtggtgctcaaagaaaatgcttattggagcattttggattttggatttttggattagagttgctaaactattaaggagattagagatcctaaactattaagaatgtgtgtgtatatatatatgtgtatatatatatatatacacatatatatactattaaacattcttaataatatatgtatatacatatctctctctttctctcaaatattccaaaatctaaaaaa

SEQ ID NO: 133172 - DNA, 249 bp, Homo sapiens
atgcacatgtgtacttattccgcaccaggagggcccttgtgtcaatcaggaaactatattatctagattttattttcaatctggttgtatgttgataatgaacatctttcaatacttgctgtaataaatgaaaatacctaaaataattaagaataaattatgttcaaagtatacttaatactgcacataagcaattctactgaatacagcattgatagtgaaaaattccatttgccatttatggtgaaa

SEQ ID NO: 133173 - DNA, 344 bp, Homo sapiens
  misc_feature (9)..(9): n is a, c, g, or t
ttaaatcanaagtaaccattaaagtgatcttgtaaaaagtcctggtttacctggttatgctaaatctgggtcaaatataagaacaaaaccgtaaatggcattcatagctgaatatagtctcttaaattgtgatgagaacaatgcagatcaaatgttttttgtttattttttaaagtaaatttaaaccagaaattttggatttatttcttagagagaaaatcaggaaaatctttggtttctattcatttcttatgtacctcaaaatttaatcaatcaaaactttgaattttaagaaagagatgtcattaattcgttcaatggaccagcatattgacaactcttct

SEQ ID NO: 133174 - DNA, 771 bp, Homo sapiens
aaatgctacagagaggtgaaagagaagaaagattgagaaaagggactggaacccaacaggtaataaggaatggacccagggtcagaggaggaatggacccacggtcagaggagggcctctccatccctgaccaaaaatgaaacaagacacacaaactggggaatgaatgaaattacaaaccctgctgggtacacatcagaatgttttcagtctccattcagatggaaatttcctgtgggtctggaagcgggaagcagtaggaactgctaaaatgagatggtgaaatgcacattcctaaaggtataaagtgggcacaggaacacctgccacttatctacctcacaaagataaaacacaaattagattcctataaagtgctttgagttctctgccattgtaatagacccaatacctatctttcagccttcagagaacagttcttaacatttgctgaactctccagcattcctgggaggtagatattatcgttggatgaggaaacaaaggccacacagcaagtcaaaagccaaggcaagattagaacagggcctgccttctgtgtggggaagtccagttggctagattccttttgtgtcagtaacaggttctttgatctgtaatacagaagaggcttgtttctggggaggctgtgaaaatagatacattaatgaccacaaggttctctgaaacttaccaagggggttgtgggaaaaaaaggtgcagccagccagattctggaaacaacagaagaaattacaggaggccgagcac

SEQ ID NO: 133175 - DNA, 663 bp, Homo sapiens
ctccctccgcctaattctgcttccctcactaagcagatgccccaggaatctctagcacgcaaggtctgcaggtcttagactctgctttccagagaaactgacctaagacatggggtatttgggtggtatattctctgagcatatacatctctgaaattgcttttatgttggaacaatgacttggctggatttaccattctcagatcaccattcttcctttcaaaatattgtggctatggcgattaatccacactcttctagggtttcagaggaacagcctctggaagaagcctgattgatatgcttttgtaagcctttttcccctactgctttggtgctagcagggttttgaaatttattcttgtaactcaaaaatttcactgggatgtgtctccatgtgcgtttcttttatttaatgtggcctaaaatgtaatgatcatatttggtctgcacagttacttacttttcatctctgaaaagtattcttccagcacaggaatggatctcagcatatctattctgactgtttcggttgctttgggaaaacactccagttttagcttggttctccagtttttaatcttcagtccaccatcttctttctcaacatgtgatgtccttgtcccattcccctatacttcagaagcacactcctcccagtgt

SEQ ID NO: 133176 - DNA, 356 bp, Homo sapiens
acacaaacacacgagcacaaacacacatgcacacaaacacacacatacacatatgcacacaaacacaaacaacacatgagcacaacacatacaagcataaacacagatgcacacacatgcacaaacatgagcacaacacaaacatacaagcataaacacacagatgcacacacatgcacaaacacacacacaaacaacacacacacatgcacacacacaaacacacatgcaaacacacgaacacaagcacaaaacacaaacacatgcagaaacacacatacaagcagaaacacacatgcacacacatgcacaaacatatacacacaatcacacacaagcacacacaaacatatgca

SEQ ID NO: 133177 - DNA, 343 bp, Homo sapiens
gtgagggcaggtgagagtgtctgaggggtgtgtgtgcttgcacgggtgagtgcatatatgtgtgagagcaggtgagagtgtctgaggggtgtgcgtgcttgcacaggtgagtgcatgtatgtgtgagagcaggtgagactatctgcagggtgtatgtgcttgcacgggtgagtgctgcatctgtgtgacagcatgtgagtgtgcgtgtgtgagagcaggtgacagtgtctgaggggtacatgcactcacacgggtgagtgctgcatgtgtgagagcatgagtgtgagtgtgagcgcaggtgagagagtaggtgtgtgtgcgtgctcacacgtgagtgcatatg

SEQ ID NO: 133178 - DNA, 616 bp, Homo sapiens
gaagaaaaacaaactaaaaacccctaaaaaccttggggcatttggtcaagacctcagagaagtcatgccttcatagtggggctaaactatccttatagtaaaggctactcaacagactttataaagcttaaaaacaatcttcaaaaagatcaagctgatcttccagtaatgtaattgtttaccagaacaaagtgtagcactctttaaagaaagactacgaaatccatcattcaaaacataaaattaaccaaatgtggcattccgtaaaattactaatcatgtgaaaacaggaaaatatgattccatatccagtaaaataaatcagtcggtagaaacatactcaaaatgacagaggtgaaagaattagcaaacaacaatttaaaaacagctattgtaaatatgcataattatttaaagaaaaatatgaacactgaggataaaaatgacatatagagaaaaacataaatcataaattctaattctgaaaaataaaatatcttgaatgaaaaatcactgcatggaattaatagccaattagacaatgtagaagaaaaaatggggaacttgaaaacataaatgaaaactatccaaaatgaagtatatataggaaaaaaag

SEQ ID NO: 133179 - DNA, 295 bp, Homo sapiens
taccattagatatgcagcttcagggacttattttgtctcaccaatcctactttcctcgtcaataaagtgagaacgagagtgtctgccttgcatgcatcagaaactgtgaagatacaatcaagtaatacaagctgtacagaatgagataatgaagcctacattttaaaatatagcaggcatctaccaatcataacgcagtttcactttcattacgacgtttaactttttctgacaacaaccttatgaggtaggattataatgatgtttattttacatgtgatgaaagttgggttcc

SEQ ID NO: 133180 - DNA, 463 bp, Homo sapiens
tgtgtttatgtccatattcacaccgactgctttgaccacagtcccctcttctaggggtctgtccaagaattcccttcagggaagtcaccctgtgtgcctctcataacttgcaatgggggatgcccagccccgtggccacagcagacaggaccatgcattcatcagaagccaaggagatttgatctattggtagcctctcagtgggcagaaataaaaactttgcctaaaagacatgagttgattatattagactatagtatcctctcatttggagcatcagattggatacttggtatcagggggaaaagctgaaatacataagagagaagacagtattcagatctcccaaggcagtcaggggaagccacgagtgagcagccaggatgagtaagtcagagccatgccatagagaagttactctggtagagtgagattaggaagcggaagtgggaaaagcagagag

SEQ ID NO: 133181 - DNA, 331 bp, Homo sapiens
gagctgctgctatttttaaactcggactggcgacggtaggagggggactgagtgtttcgctggccaccccagggagggaaagtgtgtgcgcatgtgtgcatgcgtgtgtaaatgtgcatgtacacgcctcccccctcgcctgcgcagccaccacgaagggaggacctgcagaggcaagggcagcagcaccacctcctggacaaaggaggcaggaggtgggcacactgggctttattggctaaggaagtgggggtggggactgagcttgttccaaatggtgtacaaaagtggcggctgctattttcagcctcctggtgccgatgaatagcga

SEQ ID NO: 133182 - DNA, 401 bp, Homo sapiens
caagtgattctcctgcctcagtcacccaagtagttgagattacaggtgtctgccaccacgcccagctaatttttgtatttttagcggagactgggtttcatcatgttggccattctggtcttgaacttctgacctcaggtgatccacctgcctcggcctcccaaagtgctgggattatagacctgagccaccatgcccagcctaaaatatatttttaaggttaaagtgagcagttccggaaagttaataatatgtagttataggttggatggacctacaagccagtcagaatgattgcactgtgcctttgataatcattatcctaaaatgagaacttctaaggaaggctcttggttttctatgtacacctccttttcacatggtagctctctgtccccctc

SEQ ID NO: 133183 - DNA, 602 bp, Homo sapiens
aaaaaatacatgcagccggcccttcacgtctgcagatgcagaactcgcagatttggagggtcaactgagggacctgagcatctgcggatcttggtgtctgaggggggtcctggaaccatactcccgcggatatggagggacagctctgttattaagacttttaaatggtatagttattgcctttgcacagccttatcatatttcttgaaatgtggtgtcaagttgcaggagagcatacctttaggtgactgattattttttaacatggtaagatacacaacacaacgtttaccatttttaccatttataagtgaacaattcattggcattaattacactcacaatgctgtatactcactatctgtacctgaaatgtttccatcttcccaaatataaacactgtatcaattaaacagtaacttgcctggcccctggcaatcaccattctactttctgtttctattagtttgtctattctgtgtatctcctaggggaatcacagattatttgtccttctgtgcctggcttacttctcttaatataatgtcttcaagattcatccatgttgcagtgtgcttcgggggatctctagagcagccaga

SEQ ID NO: 133184 - DNA, 345 bp, Homo sapiens
gaacaggaaaggagagtcagcagtctgaagcctgggacagttttagaaagaaagaagggactttgaagtgtcatctagaccgagaagtgatacactgcaccctgctgtcctccacccataacatgtgattgtattttcatcatttcttttcatgactgttataatactctaagtattctcaggaagtattcaagatagaaggattttcattaacacccagaaagtgaactgtccttgttgtctagaaacaagagtctgtgacctttaattcttgcagacgtaaaaacacttcagctagaggtttttccagaaagatccacaccttggatggggaagagaattcag

SEQ ID NO: 133185 - DNA, 732 bp, Homo sapiens
ggaaaatgttatgttcacagagtggggaaggacttcttaacatggaaccaaagaaaagacataaggaacaattggataaatttaaccacctaataatttaaaacttctgtatatcataaagttaaaggacaagcaacagacttggagaaaatatgtatgatgcaaataacagacaataactatccagaatacatggaaaactcctacaaatgaataaggggaggataaaaggacataatagaaatggacaaaggctaatttagtaaattttaggaaaaatgcaaatgaccatttaaaaacacagagaggtgttcagccttaccagaaattatagaaatgcaaatgaaaactacatcagttaaattttttgcccattatgttagaaaaagtgatgctattcaagtgtctatgtaagtgtaaggaaataggcattctcatattttctggtagagtgtataaattgatacagccgcttggggatagttgcagttctcatcagttctaagtgctttgtaaattaaaaagatacaaattctgttgcatgtcagttccatttcttgttatctactgcataaaaatgcttgtatatgcacacaagaatgaggcatgtgcgaggatgttcatggcagcattatttataatagtgcaaaataaaacaacccaaatttagctctagcaagagaatagctaaatacactatggtacggtatacccatactattaaactgacca

SEQ ID NO: 133186 - DNA, 274 bp, Homo sapiens
gtaatttcgcaggcagaccctggtcacacactgcatatgtggtcacagccaaccccacagagacgccagaatacagagctgagctgcaggtgtttactggggattgtttgttgatggatagagtcaggccaggagtgtggggagccctgaggaagggagggccaggtgggttgcaggggtcctcagatcagaaggaagtatctacacatctttgcagtcatcgctgacaacgatcctagactgttgggaaagaaataaagtggggacctgggag

SEQ ID NO: 133187 - DNA, 469 bp, Homo sapiens
gccagtcacgagccagggtcataagatgtttacaattgagaaaacgtcttacaaatgcctaggaggacacactactacaacaatggaaggtccagatgtcctgatattgcatagcaatgtatgcttttaagatcgttatagtcgccaggcgcggtggctcatgcctgtaatcccagcactttgggaggccaaggagggtggatcacctgaggtcaggagttcgagaccagcctggtcaccatggccaccatggtggaaccccatctctactaaaaatacaaaaattagccgggcgtggtggcgggaacctgtaatcccagctacttgggaggctgaggcaggagaattgcatgaacccaggaggctgaggttgcagtgaactgagatcgcgccatcgcactccagcctgggcgatggggtgactaagaccccgtctgaaaaaaataaggaaatgaagactcctcttttc

SEQ ID NO: 133188 - DNA, 739 bp, Homo sapiens
gacgccagtcctggccctgctctccacaaaagcccaggaaactcctaacattgcttccaatcattaaaaactttcacaagagtcagtcattaacaccttccgcaagaggccttaggctcacctctccaaggagactgaaaatcagaaggaatacatttccagtggaattataaaggtcctaaattattacctgggtggtctttcttaagtcattttccagaggagaagccagctgccctctcttgacatagccatgtgaagatgctcaagtactgaagatcctaagcctgccaacaaacatgctgaataatacatccattgtgtgggctagaagtatgagtactatattgaataaatggcgacagcagaaatcattgtcttcttcctactcttgagtgaaaacagccagtctgtcactactaaatatgatgctagctgaagggatttctatagatgccctctatcaagttaaggtaattctcttctatccctaacttgctgagagttttatcaggactgaaattcaaattctgcctaacttttttttctgtgtcaattgatatgattacacaactgatacgatgaattacactgatcgatttcaaatattgacacactttgcatgtttgaaataaattctactgggaatgatgtataatactttatattcattatcggattcagtttgctgaagttgaaggttttagtcgaagaatttaatctaagttctgagagataa

SEQ ID NO: 133189 - DNA, 206 bp, Homo sapiens
cagccaaccactggctacccttgcctgacgactgagcctctccaacctcgcgtgtccagaactgggtttctgatctcccaccctgcccctctcccaccttcatcttaatgtgtctcagttaatgggaactctgttcttccactgcaaaggccagaaacaccggagattagaatcaccctggatttctctctttttttttttttttt

SEQ ID NO: 133190 - DNA, 396 bp, Homo sapiens
atgttccctctgtttgtgagttcagggaataaagtatttgtcaaagtcctcctagaacttcacagtcatatcatcacaatcaaagtagcaagataaagataggtagatataggagacgcagcactctgtgatgatctggtggttgatggcatctttctgctttatgattttttaaacaaaatttttccatacatcctattccataacctactttatgatttactaacatgtcataaatttatttttatattagtaaaaagagacctacagaaacattttaagggctgcataatattccattataaagatataaagtaacttatttaaccaatcagcatcttcataaattttctttttttgctccaccattttgctatcataaacactactgtgggg

SEQ ID NO: 133191 - DNA, 787 bp, Homo sapiens
tattatggttgtctacagtatccagtatagttacatgctgtacaggcttatagtctagaaacaatgagccataccatacagcctaggtgtgtcataggctataacatccaggtttgtgtgagtatactctgtgatgttcacgcaacatcaaaatcacctaagatcatatttctatcgcatttctatcaccatgtttattagtccgttctcgcattgctataaagaactatctgagactgggtaatttatgaagaaaagaggtttaattgacttacagttccttaggctgtacaagaagcctggctggggagatttcaggaaatttaaaaccatggcggaaggcgaaggggaagcaggcatgtcttatatgacctgagaaggaggaggagagtgcagggggaggtgctacacacttttaaacaaccagatctcgtgagaactcactaccacaagaacagcaagggacaactctgtccccatgatccagtcacctctcaccagacccctccaacactggggattacaattttacatgagatttgggtgaagacacaaatccaaaccatgtcgccatggttaagccacacatgactgtatataacctacttgtatccttgcatatactttaaataatctctagattacacattataatacctaatacaggccgggtgtggtggcccatgcttgtaatcccagcactttcagaggccaaggcaggtggatcacgaggtcaggagttcaagaccagcctggccaacacagtgaaaccccatctctactaaaa

SEQ ID NO: 133192 - DNA, 358 bp, Homo sapiens
tggggggatacaatcacataggttatatgcaaatactatgccattttatatcagggactagggcatctgcagattttggtgtccacggggatcctggaaccagtccaagggatgactgtatgttaggtgtagcagattgcatataaaaggttttcttggtttacagaataattgagatcttacagaggaaacacccagttcctcctattactaatatcttatattagtatgagacccatgttagaattaatgaaccaatattgatacattattgataattattcactaaataatacatcattatctcactaattgtaaaaaaaaaaaagccataattgattcagagttccctagtttt

SEQ ID NO: 133193 - DNA, 1649 bp, Homo sapiens
acatgtttgaattttcttcataattaaaaaaagagaaaaactggttgggatgatggaaacgttctgaaattagtgggatggatgccaaacatagtgaatatactaaaacccactgacttgtacattttaaaactggtaaatttcatgttatgtgaattatatctcagttaaataaaataaaataaatgataaccaatttctgaggagctaatcgagtggaaagagaggctttgcatactcagcatcttttacattatatgtttctcaggtctgttagcaaatatttcattgcccattctttttaaacacctgctctgtgtagggagcttgcctgattcccttatggatgagagtcaacactatgcctgcctgtttcccattttggttaggcggcagggaggaagattatcactgcactacatattattattggtatcctatggggtacaggacagtgtactaggtgtcaagggtcaggtgagccccaaaaaatctaaacaaggacttcacaatttaagagagaaagtaaagccaatggtcggccataggccaccatgcacaggcgtgtagaaatcagatgagagacaaggagctgggctagagtgatcataaacgagaatgaggagaatctcaatagttgggtttctaattggatgccgggtgggaaatggtggtactaaaaaggacttaaaattgatgtgaataaaatctatatttcccataaaaactgctgtagggtcttagccaaggtcccaaccaagcttacctgctgaaagtttaaaatataaattacaaatgcaattaacagaaatttataaacctgctgctcagtataaaggtttctaaaggttatatgtgtcctgtaaacaggataatattctaatcaaacataaacaatttaaagtcatttagatttaaacaaaatttggggagttatttattattattaacaaagggaaagtctgcgaggaaaattcttaaggattctgaaaagtagctatatctgcttttaaaagaagcgagttagaattatcttaatagaaggactatacctgaggaaaagagtaacaaagaaagctgaggaggccacgaaacaatggggcaaagacatcctcagaaaaagtacagcacagggctttataaatagcagctggtcaatcactagaaaaaaaatgagacagtgtcttgtgcacggtttagcaaaaaaactaaatgtgttatatagttgtgaagagaataaattggttacttattttaaacgctttattattaagatttaaataaccaaatgactgttgtaaacacgagtacactgaatcactaagttgaggactgcaaagaattgactccctgatcatggcttcaggtcctaatctagaccatatttaatcaattagcatcactgaaaattggtctgacactctcactgtattctgtcattattacctgacatcttggtcaaaaaatgtcatttttagaaagctggaggaattatgctggaacaaaaaaaatgcagagaagaaaaaaacaaaatacaaagcagagtaaacaaaaaatactaaacaaggtattaaaagaagatacattcttcttgatgaatcgttctttttttgtgtgttggtttgtttgttgttttgagacggagtctc

SEQ ID NO: 133194 - DNA, 665 bp, Homo sapiens
acatgtttgaattttcttcataattaaaaaaagagaaaaactggttgggatgatggaaacgttctgaaattagtgggatggatgccaaacatagtgaatatactaaaacccactgacttgtacattttaaaactggtaaatttcatgttatgtgaattatatctcagttaaataaaataaaataaatgataaccaatttctgaggagctaatcgagtggaaagagaggctttgcatactcagcatcttttacattatatgtttctcaggtctgttagcaaatatttcattgcccattctttttaaacacctgctctgtgtagggagcttgcctgattcccttatggatgagagtcaacactatgcctgcctgtttcccattttggttaggcggcagggaggaagattatcactgcactacatattattattggtatcctatggggtacaggacagtgtactaggtgtcaagggtcaggtgagccccaaaaaatctaaacaaggacttcacaatttaagagagaaagtaaagccaatggtcggccataggccaccatgcacaggctgaggcaggataatcactttgaacctgggagacggaagttgcagtgagccgagatcatgccactgcactccagcctcagtgacagactgagactctgtctc

SEQ ID NO: 133195 - DNA, 720 bp, Homo sapiens
gaatctcactctgtcgcccagggtggaatgtagtggtgcgatctcagctcactgcaacctctgcctcccaggttcaagcaattctcctgtctctgcctccctagtagctaggactactggtgtgcaccaccacacctggctaatttttgtatttttagtagagatgggatttccccatattgatccagggtgatctcgaactcttgacctcaggtgatccacctgcctcagcctcccaaagtgctgggattacaggtgtgagccactgtgtccagcctgtgtgttgctattttaagtaagatgatctcagaagaccctcttaagtcctaccaccctcacctctgcctgccttttccttcaattactaccctagttcttttttttccttcacagtcagacacttactcctgaccctctttccaacctaccactcgtaatggctcttcaatgacctctctcatgaaaccagaggactttgtccagtcttcattctgcttgatttctcagcagcatttggctctgcttttcattctcttcctaaaacactcctccatcggcttattgagtcccacagtgtcttgattttcttcctacctctctggagactatcatttttcttaactgactcattctcttcttcctggcctttaatgatggaattttaagtttcagtccttgactttttttttttaatgttcttacgtcatagctgatctcatt

SEQ ID NO: 133196 - DNA, 373 bp, Homo sapiens
ttttgcttttaacttgtgtctttatacttaatgtatatttcttgcagatagcatatcacattaatttttatccaattttacaatctctatcttaactgggtgacttagactttttacaggttgctctagagtttctagcatacacttttgacttattacagtttcccttcaagtgatgacgtactgcttgacattcagcataagaaccttacagtggggtatttccctcgctaccctcccaatctttgtattttcttattatacattttgcttttatgtatgttgtaagtcccatattatgttgttatgatatttcattaaatggtcaattatttcttaaggagatttaaataatacgagaaagatcttacac

SEQ ID NO: 133197 - DNA, 106 bp, Homo sapiens
cgagggagggagggaaaaaaaaggaacagggggatgagagtaaaaaacagcgagagaagaacacaaattctcagcatcagcaatgaaacaggagacagtgaatgga

SEQ ID NO: 133198 - DNA, 169 bp, Homo sapiens
ctcactctcatctgaccaacaggttcccctagcggtacataattagatccaaaatggtgcttctctttatcattttctctgctttctgagaaatggaattgtcattttggcaagaatttggcagaaattgtatttcagattttaatacaattgagaaaaaaccattcat

SEQ ID NO: 133199 - DNA, 336 bp, Homo sapiens
aaaaaatttaaatgctaacactaatcaattcaaggctgtagtatctatattaatatcagacgaagcaggttttagagcaatgatgtcaatccatcaaaagaatataacaattccaaaggtttatgatcttaataacagagttctaaaatacatgaaacaaaaactgatagcacttcaaggagaaataggcaaatgcacagttatgcttggggattgcaatatccatgtttcaataaatgataaaacaagtggacagatgattggtaaggatatagatgccttgggacaacacaatataccaacttgacctaatcgacatttatatgacattccacc

SEQ ID NO: 133200 - DNA, 761 bp, Homo sapiens
ttcttaaaaataaaaagagagtgggagactgttctagatgaaaagtgactaaagcgacatggcaacaagatgaaatatgtgatcactgattggttcctggatcaaaatatagaaaatataaaaaggaaaaccaccactaaaaagtaatcaaggacttactgggacaactggttaaattttaaggatgtaataacagtactgtagcgatgcagaacaactctttgttttaggaaatacatactaaaatacttacgactgtcatgtctacaataactccaaacagtccagcaaaaaacacaaaccaagacatacgtacacacacacatcatatacctacaaacatacacagaaagactaagaacaagggcaagcatgcactaacgtggtgagtttctcttctttatggtaatttcaacaaaatggtcatgtactggagttcataggacctcaaccttaatttcaacagttctccagtgtcactgacacacattcattttaagtgaaaccagcttgaaaagtgtctgcaagggctgatggttttaagagacaagaaggaggccgggcacagtggctcatgcctgtaatcccagcactttgggaggccaacgcgggtggatcacctgaggtaggagttcgagaccagcccgaccaacatggagaaaccccgtctctactaaaaatacaaaattagccgggtgtggtggtgcatgcctgtaatcccagctactcaggaggctgaggcaggagaatcacttgaaccc

SEQ ID NO: 133201 - DNA, 741 bp, Homo sapiens
tttccttttccccttccatattccacagctgtcctttctgctgcctcccggagggcaccctgtcctggacacaaggctttgtcctgtgctgtgggtcatgcttggtgggatcgcttatcagcgtgaaggaggcactgaggtccatcttcttcagaagtctgtccttccttcctccaggcagatgccggcatcacagtcctggttaactaaaaccctgtgtctgatgtcctgccctgggccttccttgtctcttttctgtccccacccagaccataagcactggggaagcacatctgtcttcctcgctgcagcctctggtgcctgtgtgtctgcgtgctgacaccgggcatggccaacgaacatgttgtcttgtcacggtgcacggtggctcctttgcccgtgcggccttctcagcagctgctgcttctcctctaggactgaccgcaagtctcagagcgcgccggctggtgttttgtcgccctcaggagtgtggccgaggcccaggtgtgggtttcccgtgcccgccgtgacctggcagtgagggtctgtgcttctgtcagtgccgttggcctgagacatgtctgtcctggagaccagcacgtgtgggtgccgactctcagagagccccttgctcacagcaccaaaccccttgctgtgtttttattattaagaaatagaaaacaaagggcataaccgacttaggactttggtgattttctggctgaaggttttttttttttt

SEQ ID NO: 133202 - DNA, 353 bp, Homo sapiens
gagtcagtacaggaaggtactccgaatgatgcctggttcatagtaagtactacgtgttggcttttatcaggggctcaggtgttcatcaggaacaatgacaagtcctcagctcagcctgtgagttgacatataaccccaatccacctgactctatgattgtttattgaattgtctgcctcccccatgacgcagttccacgagagcaggaatatcatctgtcctgtttatacctctgcctccgccaagtcagtgctcaattaccataactactaactgaatgaatagttagaccaaaaaaccaattcaaacttatttctgtccaaacaaaccatttttaaagcccctccccacca

SEQ ID NO: 133203 - DNA, 313 bp, Homo sapiens
tttctgtaaggacatatccttctttcgtttcccaggtggcttctttgacaggctcttcctacctacctacttcttcctcctcctcatcatcttcatcatcatcatcttcatcatcttcgtcgtcgtcgtcatcctcgtcctcataatctctttcttcttctatgcaacctttgtaatttatgtcagtatcacctggcgatgatttccttttatctttacccaagtgctctgtaccattttggaggagactgcatgtagtagctggtgggacttgtcctggacaaggatatgaatgtggcagagttaccaataa

SEQ ID NO: 133204 - DNA, 606 bp, Homo sapiens
attcgacatcctagaataatctttgactgcttccttcctccagctgccactagacacactgtcagcctaccctgctttttcaagcatcactgttttctgctctgtgtattgtcttatttctgtcttgggttcttcctccagcagttgctcgatgaaatcaaacccccttttctgtccctgccagtttattctcacctagctgctgggccccatccccaactccattccctgggatttcctctgcagagatgacagtaggccataaatgtggggtcggacacccatttcttacctgctgtattttttataaaacttccccataaagcaatttgaaaacatcagttttttatcaaaaggaaattaaagtatcagagtattatttttttatattgttttttctacacatatgaggattccctagtaaaaacaattataatgaacaagaagacatatttaaatattcagaagtattattacttgtactattttgattgctctacagtctgtcttcgagtaaattctgacaccttttaggcaaggagctgaatctttggcttttctgtatcaactcttctgtatgttattccatggttgtgctcattaaaa

SEQ ID NO: 133205 - DNA, 455 bp, Homo sapiens
atttccccaaatcagcaggctcatgtgacagtggtcaccagttggtactcctggatagcatctcctccttaggagaaacttccctttttatggctacctgtgtggaagtggatatgggggttcggttgggagagcactactctgagtcctctaagtctcaaaacacaggtcagcttgggcacaagatcaccacttggaaccctagtactcagagccctggtactcttcctccccatgagctataggcctgccttctcttttgcccagttgtacagggggcaactgttgtcttaaacatggcatactcacctgtgcgcacatacacacatgcaaacacgtacacttgtacacatgtgtcattcatgaacaaactcatgaattctcagagaaaatggagtcccaagttataaggaggaaaataaagtttttcctaaccattaaataatgtgtacgat

SEQ ID NO: 133206 - DNA, 848 bp, Homo sapiens
gtggacaggcttgggaacagccatgtggatgtagctgctttgtgcttcttcccatgcagatttgatttttctttccactttctcccttttaatgaatgaactaaaaatgaatttgaactacttgccaaccttagaaggtttgattttaaaatatattttcttctcaaatacacgaaccagtagcatcactttcaattccctactcccattctctgtccaaaaatacatatgccaatcttcaattttttttttgtagattgcatgtaaacgatggttggtttgtataaagataaatattactttagtaacaagcacatagtaacagcttaatttctttttgaattgttaggctgcacaaatcaatcatgtggtgccagctgaagactgcttttacaacaagacatatgttacaaatatattaatcttagcggcatatggcacctgagaccttgtaggaaggcgttgcaaaaaggacgatcatgccctattagctggctcacttcctaacttacattaattcgtgcattatggaacgtcaccaacacatgaaacaaaaagtagaaatggcactgctgagtaatcacaagccattgactaaagaaacttcagggaaggcggggcaatgagcattctttgaaccacttaattcaagaaataacaggctttgtttatttaagaggccagtctgtctgttttctgattgcattcttattgtgaaaatgccagagcatattacaatggataaaatgagaggaaaaaaagggcgatttaagtaggccaggaaagagtggtggtagatgtttgaatgcccccccttggaattaatcagtggtttataaacctgaaat

SEQ ID NO: 133207 - DNA, 575 bp, Homo sapiens
atccttagaaacaaccacttccaacttctcgcttttactttagtatatatatgtaccattatgtctggagtgtcctcatacagctatttctttgttacttacagatatatactgattttctgctgtgtagatgaaaacttaactgttacatacccccatctctactaaaaacacaaaaaatagtcgggcatgttggtgagcgcctgtaatcccagctactccagaggctgaggcaggagtattacttgaacttgggaggcggaggttgcagtgagccgagattggccactgcacttcagcctgcgtgacaggagggagaacaattgtccttcaaaaacaaaacaaagagcaaacaaaaacaaaacaagaacaaacaaccacaaaaaaaaacacatctgtgtcgagcagccgcctaggcgcctcgtgaaaaagacgtctgttctacgaacccatttcgcgtgaggacgccgcgggcgccccccacatgggatcacgggtgccaagagtggcccacgactggcttcctgaagagcactcccggcttaataaacagtgcgctgggtatccccccacaa

SEQ ID NO: 133208 - DNA, 398 bp, Homo sapiens
aaataataaagatcagaagaaataaatgaaattgagattagaaaaacaatagaaaagagcaacaaaactatagctggttttttaaaaagataaaattttaaaacttttagctagaattaaagagagaagtctcaaaaaataagaaatgaaagaggagacattacaactgatactacagaaatacaaaagaataagaggctactatgaataattatgtcaacaaattaataatgtagaagaaaatactaggcacatacaatctaccaaggtggaatcatgaaacagaaaatctaaacagaccaatagcaaccaataacaaataagagattgaatcagtaatgaaaagtctaccatcaaagaaaagcccaggacctgatgaccattctttctaaaactac

SEQ ID NO: 133209 - DNA, 429 bp, Homo sapiens
tacatcacaaacaagggagcaatgcaattgttatccttggttgtcaatgacaaaaataccagtaatatctctcagttgcattttcttttttcaacagttttcccatctataaaatttatatacaagaccttgcttaaaatttccacatttcacaactgatgatgggtctttcagataaacaaatctggggatggaatgaggttccttctggcttacttcctgccttccatgaataggcaaaactcaagacttcccccagtagtctccatggatagagctgctaaataattagaagggtcaaaacaacaaccgaaatgatataaacactttggaaaatggtatgttttttaccaaatatattatccaggtaaaaagttatcccatctggaaaaaactacaaaaacttttaaaagaggccaggcatgatgg

SEQ ID NO: 133210 - DNA, 432 bp, Homo sapiens
cattttatcatcattggcaaacgggaaaggcagcttcctcaacttgtgtttgtcttctaaaggaaaaaccaaagcaatatatagcaactgatgcttatccagaagagataactcagatgcacagaggcaaagagatgtggacatctaaataaacccagacactttgttcttcagaacttttaaacataggcattttctctctcggcgagagagtgagctgtgatcagttgtgtgtgtagccaggatgttgctaaagcaaactgactttatctgccttgcacgccttctcctctgctttggtgtcatgcctgtctcctttctaagaccagctaaccatacttggtttcttctgtcctctttaacatcttcatcttgctttattgtgcatgtgtatgatttgaggttctagatccttgaactggggagtgacaa

SEQ ID NO: 133211 - DNA, 451 bp, Homo sapiens
ggtcccataggacatgcttaattcctccagcacctaattgtgacatgtaaaatagttgtctagaagaaaagctcatcagaggcttggtgcccaagggttttattgggctggtcacataggcaccctctgcgtagcacataccaaaatccccagactcccaaaaggaaagcaggtgttccgaataaacatgtttgtaccttgtacagagtttaggaattgtgagccactcttatttatcattagggaaggttttatgtcaccgttgggaactgtttctcattccagtttctagctgcttagctagccaagacccatcctctcaagcaaccctttctaagaaccgcagtctccagcctgttactttaacttttttttttctgttaacacatttttcaactccattcactgatctttttcttctgcattcgtttgttttttgttttgttttgtt

SEQ ID NO: 133212 - DNA, 170 bp, Homo sapiens
tagcagggaccagcttgcaagcttgaagtgtgcagatggaacacagagcactccagccacccaggcagatatcagaggatgggccctcaggcactgattcctgtctgtcacctgggagaggctccctgaggccaggtggaaatcatacccggatgccaccagaatgatga

SEQ ID NO: 133213 - DNA, 319 bp, Homo sapiens
cggacgcgtgggtcgacccacgcgtccggcaaaacgagacagcgttaggggcgagaaaggaaagagggaggaggattgaaagggaggaaattgaagggagagacaggcaaactgtcagaaggggaagaaatgaggccaggagcattgttgggaggggggcctgggggagccctctgctctgcgtgccaaggccaatccctgaattgccgcagcaagaccgtgtgacctcacagttggctctttttccaccaaacgcatcggtggtgagcacaggaaccagaaaggcttgaaacaggcaagtggcacctggccctggaag

SEQ ID NO: 133214 - DNA, 579 bp, Homo sapiens
gggacctaaaggaagaggaaacaggctatacatgtatctggggaaagagcctttttgtgttctccacagcatagtggcttatacatagtaggcattaaatattgttttaatttttcttataaatctaaggttgagggataggacagctactttatataatttatatgttaatgtctatcttaaactcataacttaaaaaaaattctcaatgaacagatttgttttagaatttaaacttcaacatgttcattacacatttgaagctatgacttgtaagctctcttaattttcagtaaccaaatctataaatgtgcctacatccttactagttcttccttctagtatacaacttcagtggaagagatactgctgtctcttttcaaaacgagtttcttcttctgtgctccatttcaaagactttgctcattttttatatttattcttaccttttcttctactttttcttctttttaggttgcctccaatcaacatttaaacatgcttaagatcaaattctgtaaaacatacacaacctgtaacaacaaaggaacagaacttagcattaactgtgttccactc

SEQ ID NO: 133215 - DNA, 389 bp, Homo sapiens
tcccttaagctttgtgaaagcaaaaggaaagtgctgaaaataggagagacaaataatgaagtggttcgatggagtgtttagtgagaaatcaggctgttatcgggacttcaggtggcatgccagttgggtcaaaataaggagaagaaccaatgccaccgcaaccaagattccccgtactgagattgactttagttttgggtgaacagagagaaggctttacttatcttttcacttgaagtggaattttaagttctccagtggctcacaagaatgctcaggtgctgaattctgttgttcttctgtggttcttcgggaccttcccacagtttcacttgagactgatgtatccaactggagatgccagaaatgttgatagctgttggggtgga

SEQ ID NO: 133216 - DNA, 756 bp, Homo sapiens
gttcctcttcctgtgtttccctattacagaaaattatattcttactcatctagtcaccccgattagaaatctaagcatcatacttgatgtttctccttttacgcctgtatataatcaattccacaagactattcttcccctttaatatctcacatgtatttacctctcttttctgattctattagtttagaccagaaattgaaaagaccttttctgtaaaagtccagatagtaaatactttaggctttgcaggccatatagtctctgccacaaccactgtagctcaaaagcagccacatacaatatgtaaacaaattagtgtggctattttcccataaaactttatttgtagacactgaagtttcattttcatgtaattcatatatcataaaatcttcttttgattttttccttcagctatttaaaaaaaaatgtaacagtcatccttagcttccttccctacaaaaacaggctcacaggccatagtttgcccacctctgacttagaccaacattctcacctatgatatggcagtagtacttggtctccctccttctcatcttgcccactctggtctactcttcatgttgcagccagattgactttttaaaattgcaaattgggactgggtgtgcgtggcttacgcccataatcccagcactttgggaggccgaggtgggtggatcgcctgaagtcaggagtttgagaccagcctgatcaatgtggtgaaaccctgtctctactaaaaatacaaaa

SEQ ID NO: 133217 - DNA, 603 bp, Homo sapiens
agaactaaggaggagtgtgggaagaagaggaatggatggatggatgagatgagcggtatgtgtgtgtggggtggagtcgggagtcagtgaaggaggagggacatcaagttggggaaggcaggctagagatgcaggcagttctgggagggatgcagtggacagagggtagtggtggaggtagctccgactgatgtctctccactaccttcccagcatgacctctgggacagaggaccatgccaataaactcctctccatccgcagtctctagatactccctttactctctctactcactttccccggaacctggagatgctgccactcagttgctgtcctctccactgcaggctgtttattctcccaactccatgctcctcaggccaggcagtggactcagtgtcttccagctcattgcttctccaccctctggactctttgaggtcaagtaccatgctacagcccaccttgtcagttacctaccattctctacactcacccaggactttcacacttgcctctctccccgaagcccatcactgtcctgacctcctcagctcctattattttttttcctgttcttgacttcctcctggagatcct

SEQ ID NO: 133218 - DNA, 274 bp, Homo sapiens
cagaagctcaataaatatgaatggatcaattgcacagaggtaaattccccaaagtgtttactatctgtcaaaaggcaacaaggaaacagacaaactgaaaaaaatagtggttttactacatagttcatgttaattacaactagctttacatagtaaattccagtttacatagcatgtctacatataaagacagctataatacaagttgggttttaacaatagccccattttacagatgagcctgagtgaggtagagacttgcccgaaatagtca

SEQ ID NO: 133219 - DNA, 365 bp, Homo sapiens
ttatatgctgtctcacagtaggtgagagggggagcagaatgggacaggatcttactgaagtattccagcagtttggtgatttagcagagaatcagatgagcacaaggatttacttttaaggcctgcatgtgaaaaaaaagtaaactgacagttacctgtgttacacagctccaaattgtactaagtatataaaatccagtttcgtggattaaaaaccatttcactacaaagattcagcacaggagcagcgcctgaatcaatgcacacccaaggcaaacggttattctcctaaaaaactcaagaatggctttctacagaaataacatttttgacaaaaatactttctatttgaggacagcatatca

SEQ ID NO: 133220 - DNA, 580 bp, Homo sapiens
aagcaatccacagggtactgactgtgagagcaattactaacagtatctaaccccacgtgggaaagctttgctggatcctgaaggacaagtaagagttagccagggtaaacagggtaggcagggcattccaggcagaagaaacagatgtagatttagaggttcaagagagcatgatacatttaagagctgcaaatagtttagtgtgatcagaatttagaatatggaaagggatggtgaaaggtgagactggaaaattaaacagagttgaatccatgagaagctttttgggtcctgccgggaatgtagattatagtctaaaagcaatgggaaatgattgattttaagcaagactagcttggtgttagaggacagtaagagtgtaaaatgagatgttgtctgtgttgtataaagttcaattttacattagcaggaagaatagaatttgagtcatttattcagcatgtattactgagcacttcctatgtgcccagcacttttctaggtgcctgagttatttagttcctgaacaagtatctcaagaacattatggtgcttacatccctgtggaggcgaaaagaca

SEQ ID NO: 133221 - DNA, 378 bp, Homo sapiens
atgtgagcaaagtgtctacctgtgcttccagttctctacaccaaactcccaaagttcctgacatagacagaattactcagtctacaaataattactgagcacctcaagagacctctattctgacttctgtggggaaaaaagaacaggaaaaaatgactgggtctttgctcttgaagggcttaccacttgagtggtgatcagggacatacgccacccccaaccttcaaaagcaagttgtaaaagcatcatacaaataacaaaatacagactgaagaccatctataaacacaggggtaaccaatgtgcagttaatcagggaaggcttcccagggaagatgatctctgaactgagagctagtgccctcttgcacaacttcc

SEQ ID NO: 133222 - DNA, 302 bp, Homo sapiens
  misc_feature (16)..(16): n is a, c, g, or t
  misc_feature (37)..(37): n is a, c, g, or t
gctctgtttttaagtngcattttgagctcctcagatnataatatccaggaattatccagttacttaaaccaagttatttgctctatttggctacaggaaaatagccccattcctttttttattaaacatactctaataccatttggtctttcagttgcctctatctaattgcttttaagtattttttaagcatctcttttagattgaaaattctcagaaatcagggtcaaatgtttaaattatgtcataaaaagttaccaaaatactgcctatcttttttatcttcaaaccagtggcatagc

SEQ ID NO: 133223 - DNA, 265 bp, Homo sapiens
  misc_feature (16)..(16): n is a, c, g, or t
  misc_feature (37)..(37): n is a, c, g, or t
gctctgtttttaagtngcattttgagctcctcagatnataatatccaggaattatccagttacttaaaccaagttatttgctctatttggctacaggaaaatagccccattcctttttttattaaacatactctaataccatttggtctttcagttgcctctatctaattgcttttaagtattttttaagcatctcttttagattgaaaattctcagaaatcagggtcaaatgttgtatagactggggaagcgcggggggagata

SEQ ID NO: 133224 - DNA, 497 bp, Homo sapiens
ctcatccctgtcttcccagcacttagtgcagtgcctaagacatggccagcatcgggaaacatctgctctactgaaaaagctcacaacaacaggcacggtggctcacgtctgtaatcgcagcccttcgggaggccgaggtgggtggatcatgaggtcaggagatcgagaccatcctggctaacaagggaaactccgtctctactaaaattacaaataattagccgagtgtgatggtacgcgcctgtaatcccagctactcaggaggctgaggcaggagaatcgcttgaacctgggaggcagaggttgcagtgagcccagattgtgccactgcactccaggctgggcaacagagcaaaactctgtctcaaaaaaaaaaaaaaaaaaagagagagagagcgagcgagtgagagagagagagagagcaagctcacaaagacttgaagcaaggaggccagcaggaaaccagagggggctgagtgagcttcagacggttaatg

SEQ ID NO: 133225 - DNA, 221 bp, Homo sapiens
ctgggcagggatgccacataggcttgtcatggaagcttgcggggaggggagggctgactttgaggagcaccactagaaaggtaggtggggtcagattctagaaagccagggatgtcaggccagatcgctttcattgtctttcatgaaggaagtcattgaaggtttttgagcaagagaggctacgacacaaagctgttgtatagccagaaggtccaggtatg

SEQ ID NO: 133226 - DNA, 674 bp, Homo sapiens
tgaccatagcttgttctgtagctccgaagttggatccaagtaaataaagcaacataaaatcaaaattagtaagaaagcagtctctatttaaaaaagcagatggtcctaactgtgccaaattggtggtcacacagagataaattattttacctgactttatagcagttatttgactgtagaagtgagtattcctgaaaacaaaaagaattgcatagtcatcttaactttaataatcatattgtttatgataatggtattattttgaaactattaaaattgaaataaagcaaataaatagtgccatttgcaaccaactcaacccgagtgatgacatgaacatacaatggaagtaaaaagcttgcagttttgaatttgaattacatgaattcttaatgtagtttctctaaaaatacacacatcctagctcattccattgaaacatcctaaataaggcaaccagtccagtagtaataggttcacctagtacttagattgcaacttagtttctaatttattataaatagaagggctttttgataaaatggctgggttatagcctcaggcaagaaatacgcaagatgagcctggtacatcctgtcatactagaaagataggcaggttatcaaagactacttcaggtcttgtcagaaggacttaagagctaataaagggtt

SEQ ID NO: 133227 - DNA, 243 bp, Homo sapiens
ctcttctggtttacagcgctctgttttgcacagatattcagtgttcaggatcctcctctctcctgtgtgctcccatcctcccggcgtggcatctgggtataagggggcagtgggtaagctttatggctcagatgccattccctgcctgttgctggtcttcactcccacgtggtcgctcggaatttgtccccgggcattacggattatggtggaacctaccaaaatggggtgaacctgatttag

SEQ ID NO: 133228 - DNA, 436 bp, Homo sapiens
aacagtggactggaaagcagcttagccaggctggggctcaagagaccttggcagattctggaaccccagattccttccctagcattgtatacagccacaaatccaacttgtctgcgtttccttaaaataaaaccagtgaaagaaaggaaagaaaggcaggccctgctttcaaatccacagccccgcagtgttccccaatcctgcatttgttgggatttgaaatctgccctttgctccagtgtgatggcccacgccagcatggggagagtgtcaggcttgctcagggcctccctggccgccagcctcttactttgaattcactgccctccagctgcaggagggtctctgggctctggagcatcacacttggtgggcagaccttgccgctctcggtacctgcacacctgcacggctgctaaacctgcatgcagcactc

SEQ ID NO: 133229 - DNA, 520 bp, Homo sapiens
tcctgtctcagcctcctgagtagctgggattacaggcacccaccaccatgcctggctaatttttttgtatttttagtagagacggggtttcaccgtattggtcaggctggtctcaaactcctgacctcgtgatccacccacctcggcctcccaaagtgctggattataggcgtgagccactgtgccctgctggtttgcccttttaatgtcagtaatactgttttagcgattctagtgtaagtatatggatgcccaacagcatgatttttagtagtgaaaaattttaaactcttcagttgggaaacattgttataatgcatcatgttaaaattacagtagtgaagactatgtagtaatatgaaaaagtgcttttgctgtaacttgataagagtccaaatatttgaatagaattagtataacttagaataagaattaaaataacatgtataaaagaaaagcttcataggaatactcctaaatacaacaaaataaatgagaacttttaatatagagaaaagaa

SEQ ID NO: 133230 - DNA, 332 bp, Homo sapiens
aacaaaataaaaaatagaaaaattggacatcatcaaaatgaaaaacttttgtgcatcaaaggacactattaacaaaataaaaaggtaagcaacagaatgagagaaaatattttcagatcacatatctgataagagattaacatctagaatatatagagagctcctagagcctatattcattttttttagagaaaatccaaaggatgctgaaaagcagtttagaccttcttgccccaggtactcaccaaacctgaaccagtcaccctcggccttgagtgtatgtcagtggaagacttactgcccagagtgtctgcctgataggacatgggtag

SEQ ID NO: 133231 - DNA, 360 bp, Homo sapiens
gcctcccaaagtgctgggattacaggtgtgagctttataagctgttgataaggattacaagagaagaggaatttaatgtgatgggccctggttcctgagaaggtagatggggtataaaatcaaacactgatagaaggttggaagaaggacaggaagaggaatcgttttcctttgtaacaggaggaatgtcacaggagggaggaatggatgggtgcagacgtgggtgggattgcagtttcacataggaagttgaaggactttcaacccaatgccttctgttctctttatgaagaagtaggagacatcttctgaaagtgatgagtgaaatgtagttttgcttaatgggaagtaagaaggttc

SEQ ID NO: 133232 - DNA, 180 bp, Homo sapiens
tgctgggattacaggtatgagccaccatgcccagccagggactgagagacttctgaagatgtagacaaatctgagatgaacttctgtgatccccggggcctcccatctaatcagaaataggcaagaggttataactgtcatggaatatgggcagaacctctgaccagggcatcacggggc

SEQ ID NO: 133233 - DNA, 240 bp, Homo sapiens
gaacatcctcccacactccccatttgttgtcccagggaagtattaacaccccctttaagactctgttccttactatcacatttgggattaagttaaagaaaagaaaagaaaattttttaattaaagaaaaacaaaactaaaagactctgtcctttacaactcctctgcaaagccttactgagcatctaccacatgcttagcattgtgttaggcaccgaggatgcatggtagaattaaatg

SEQ ID NO: 133234 - DNA, 381 bp, Homo sapiens
tcgacgattacagccatgagctactgcgcccagcccacatgtaacttttctagtgattcaaacagccctgctttctagcattttctagaatgtaccaacttttgaaaaaaaaatttttttctcaggaaagaaatggacaacttagaagtgtaagcaagacccagaaacccagctaaggctgtgcggggaaatggggttctaaactctgagaaacctcatttcttttttttcatcagtagataccattattattcagccattgtctcgccattgcttgatactacttactgagtgaaagggtgaagagatcagcttaccacagttactgagtatgtattatgccaactcctgaactaggcaccaaggctatagaaacagaaa

SEQ ID NO: 133235 - DNA, 307 bp, Homo sapiens
agttcagctcaaagaacttatctgatgtaattaatgccttgtttgtatgtgcatcttccccttcaaagcccttttgcaactctgagcttgctttatcctcctaacattcccttgaagcaggtgaggtaaatgttaaacaagctgagctcttaatctcagaattttgaacttcagaaaccccatagtctagccttgcctgaggttttgaaggtggagaaacagaggcacagcttaacggattggattcactaagccaaacagctcatgaacttctttgagggtgacagacacaacttttacctcctgg

SEQ ID NO: 133236 - DNA, 690 bp, Homo sapiens
tgtggtggctcatgcctgtaatccaagcactttgggaggccaagtcaggcagatcacttgagcccagcagtttgagatcagtctgggaaacatgatgaaaactctgtctctaccccaaatacaaaaattagccagtctcataacctggtctcaaaaaagaaaaaaagaatattcattatggacattcagaagggttaaacacatgcaggatttggtgcctgaatggcaaagtgatgagagggattagagtgcctcactttgtgttgatgggattggccactagattgaggatatataaggaaggggaggagagggcggtagctgatagcctggagagaaaaggaaagaaccgtcaaaggattgggaatgctatctaggtggaaaagtaatggagtaaaggaatgagataattggaagggttggagattttgtctgaaactgtcacattgaagtttaagattttagaagtgaagtagatctggtttaggaaaagctatctgaggctgggcgccgtggcttatgcctataatcctaccactttgggaggctgaggcgggtggatcacctgaggtcgggagttcgagaccagtctgaccaacacggtgaaaccctgtctctactaaaaatgcaaaattagctgggtgtggtggcccatgcctgtaatcccagctactcgggaggctgagacag

SEQ ID NO: 133237 - DNA, 187 bp, Homo sapiens
ttgataaaggcatatggctactttatatttctatattggtcttccacttaatatttacaagagactcattttaactcccaatccactttatacatttcttcttttcccataaataccaacttattttatattagctatatcggttttaataatctataatgcatcactcaactattttacctcttta

SEQ ID NO: 133238 - DNA, 497 bp, Homo sapiens
ggcgtggtggtccatgcctgtaatcccagctactggggaggctgaggcaaaagaattgcttgaacctgggaggcggaggttgcactgaacccagatcatgctactgcactccagtctgggcgacagagcaagactctgtctcaaaataaataaataaataaataaaattttaaaaaaagataaaagattggaagaacgttgggatcaggttgtgaatggcctcgaactttagcaaaggagttgctgtgtgctgagggcagtgagcgagggttgcttggaaagatctgggctgcagagctaacaggagctgacaaaagcaggcagagggaccttgtaagaggggtccaggaggagacttcgaagcttctcacagggcagggctggagggctggagggcagagggcagaaaggcagagcccttgaggctcaggactgaggaacacaggcatgaggtgggggcatggtggctactccaggtacctgtgtgaatggaggag

SEQ ID NO: 133239 - DNA, 440 bp, Homo sapiens
gaagagggagggtgcagagagatctggggagaggaacccacctcttccaggtgccaggcactggcacatgaatggtggagggagattggaccccaagccctgcgtgcattcagtcattctgctcagtgaagtgtggacagaatttgtttgatgggagggtagaattgttctcaaagggcttgtgacacaggaggaagacgtccacgttcaggacatgtctagttcctacccatccgtgatgtgtgcataatggtcatccctcttttataattattttgtaaaatctgatgatgcggttttgggcagggctgctggaactggggcatattgtcaaggaagtctatgccaaagacgaacagttttcatcgtgggggcatagaattttcacacatcttctggaatagatcatctaaactcttttactctcaggttttctgtat

SEQ ID NO: 133240 - DNA, 394 bp, Homo sapiens
ttttcttttcttttttttttctgttccctgaagagctgccccatgaggacctggcctcattcattattctcttttggtcttgcatcttcaaatttttcctccacagctgggccttgccccctgcctacaaacacagtctagtctctctaatcacctctccccaaatccttccctcaacttactctctcacaaacttctcaaacatgccgcctttttaacatctactgatttctcagctctttttctacaagaacttcaagcattttttaacattaaatatttcttaatacttgttccataatctccccaatcagttaacactgtactgttaacataaaaaagaacaaatagaagtaatacatatataagattagaaaatgttctaggaagtata

SEQ ID NO: 133241 - DNA, 795 bp, Homo sapiens
gctggcgtggacgtttgtggtggggcgtgttggtccgcgctctcagaactgtgctgggaaggatggtagggcgactggggctcacctccgcaccgttgtaggacccggggtagggttttgagcccgtgggagctgccccacgcggcctcgtcctgccaacggtcggatggcggagacgaaggacgcagcgcagatgttggtgaccttcaaggatgtggctgtgacctttacccgggaggagtggagacagctggacctggcccagaggaccctgtaccgagaggtgatgctggagacctgtgggcttctggtttcactagggcatcgggttcccaaaccagagttggtccacctgctagagcatgggcaggagctgtggatagtgaagagaggcctctcacatgctacctgtgcaggtgacagagcacaagttcataccagagagccaaccacttacccgccagtcttatctgagcgggcctttctccggggaagcctgactctggaatcttcaacctcaagtgattcgaggttggggagagctagggatgaggaagggcttttggaaatgcagaaaggtaaagtgacaccggagacagacctccacaaggagacccatcttgggaaagtgagccttgaaggtgaaggtttggggacagatgatggtctgcactccagggcattacaagagtggttatcagcagatgttctccatgaatgtgactcacagcaaccagggaaagacgccttgattcatgcagggacaaacccctacaaatgcaagcagtgtgggaa

SEQ ID NO: 133242 - DNA, 766 bp, Homo sapiens
gcagtatctgcctcccctttgagccctgcacggaagtcagcccaaaggagacctagttgattcagacctggatctctctgcacattgactagagactgagtgacaggttctgatcctatgcgacaacacaaggccaatagcattacttctgtttgactttccagatgttggtgaccttcaaggatgtggctgtgacctttacccgggaggagtggagacagctggacctggcccagaggaccctgtaccgagaggtgatgctggagacctgtgggcttctggtttcactagggcatcgggttcccaaaccagagttggtccacctgctagagcatgggcaggagctgtggatagtgaagagaggcctctcacatgctacctgtgcaggtgacagagcacaagttcataccagagagccaaccacttacccgccagtcttatctgagcgggcctttctccggggaagcctgactctggaatcttcaacctcaagtgattcgaggttggggagagctagggatgaggaagggcttttggaaatgcagaaaggtaaagtgacaccggagacagacctccacaaggagacccatcttgggaaagtgagccttgaaggtgaaggtttggggacagatgatggtctgcactccagggcattacaagagtggttatcagcagatgttctccatgaatgtgactcacagcaaccagggaaagacgccttgattcatgcagggacaaacccctacaaatgcaagcagtgtgggaa

SEQ ID NO: 133243 - DNA, 467 bp, Homo sapiens
aaataacatcctggatacgtcaattatggaggcttgggatgttaaaaggccaatatttttcagttgttccaaaaagttatgagcgtgagcttaaagtgaattctctgggttaatttttattgaagacaagttgaggaaataattttctttcactttactctgcctttttacccctaagcaatgaaacctgtttttgagcctcactctgaagaactccaatagcaagtttcaattttataattgaaatttctatacccaacctaaggataaattgatttgggtaaatgaacttgctccctcaaaccattttgatttttaataccttttcattttccttgtacactgttcagatataaataaaccaagtataagactgtttaaatgtcaatcatcaaaaaaagataaatctcacattccttgtctttagtttccaatgatttacatgccatactagattattacatctt

SEQ ID NO: 133244 - DNA, 445 bp, Homo sapiens
acagggtttcactatgttgtctaggctggtcttaaactccaggtcccaagcaatcctcccacctcaggctcccaaaatgttgggattacaggcatgagccactggccctggccaaaaagaggtttatttggctcacggttctgcaggctgtacaagaagcacagtgccagcatctgcttgtggtgagggcctgagactgcttccactcactgcagaagggacagaggcctagcgtgtgcagatcacatggcgagagagaagcaggaaagaggggaaggaagtgccaggctctttttcacaaccagctctcaggggaactcttgtgggaactcacagagaggactgcaccaagacattcctgaggggttggccctcatgacccaaacaccacccattaggccccacctccaacattgggatgcaaatttctctttattttttagag

SEQ ID NO: 133245 - DNA, 349 bp, Homo sapiens
gagcttcctgagaggctgaaggacactttagaaatgtcagcaggagagacccacttcccttttaacccatggagtcaggaggagaggaaagaaaagaggttcacctcaggctgctcagaaggaaggtgttccaggaaggccagaaaagggaggctgctctggaaaaacaaagaagagcttggcaggtcctagaacggaggagaagttagaccctgggaatccaagatgctgcaacgtcaggcagctggtccccagcaaggctggcacgtggaaacctcacggagaaaagtgattcataaccaaagcagggctcccacagcgacgctgagcagacacagaactatttttc

SEQ ID NO: 133246 - DNA, 246 bp, Homo sapiens
ttacaggagagagccaccgtgcctgtctacagaagccataaaaaatgtttttaagttttctcttccattaaaaaaaaaaacaaaattcaagcactaacataagctaagtatcaccactatttcacacttagcacttttctgctaggaagctaaactggaatttattctagattttacagatattcttttaaatataacctatctatgtgccagatatttaaaatcagatagtgcatgctaggattg

SEQ ID NO: 133247 - DNA, 339 bp, Homo sapiens
tcagcatccagagtagctgggattacaggtgtgcaccaccacacctggctaattttttgtgttttttagtagagacggggtttctccatgttggtcaggctggtctcaaactctcgacctcaggtgatctgcccgcctcggcctcccaaagtgctgggattacaggcttgagccaccgtgcccagccgtctgttctttgattatttcatgcttgcatgttttgtctcctctgttcattcttaagaccatttgggtaccacttcttaagggcccctttcttattttccatggggcttggcactcagtagttcagttggcttatttttccgcggctgccgt

SEQ ID NO: 133248 - DNA, 1153 bp, Homo sapiens
ttttggtggttcttacagacttgagatggggcttgtcttaaggaaacaaggtgccctgaatctaaagactgactaaaggtggtagaacttaagctatttaggtgatcctgaaaccaacagggacagttatggtattgactagtgggaacttttaagagccataagactggagaagtcaaatgctgaccaattatatcaaacccacctggggaacaaactaagtcaaaattactagggtggctaaaagctgagaaatgaactaggtggcagttaggactgctgaacaaacccatctcaccatagcagagaaatattagaatacacctagagccatgtaaagattcaggagtgctaaaagcatgaattcccctccttccctccaccacccccaaaataagcttctgcctgaatgaaggtaactgggaatctgcaatttttttctttcctgcacaaataaccacttccccttattcaaataaaataaaggatatatctagaaatctgatcatttttaaatatttccagaagtggtctagtttagaactaaggctggttagaccggggcaatgttccaggagtacagaaaggatcttccagggtcttctagataaggaatgtccttcaaatttctacaagaaagtctgcagcatactgcctttcaagattaatggacaggatgatttggttatggttttacttgatgggtggacgtaagttccactaagaggtagactttccactaagatcaaagcttctgttatctaatttataattctaagttagctggggctctgtactaataagattttgaaagacttagtacccacatatcacaattaagctactctcttcctagtatgcagataacaatcaagataatactcagaaattctgtcaaggcttggcactagtcaaaaggattaaggatgtatacagggagaagcatatgtaggcagtgcgataaagataaaaagccatgttgcaacagtaaactggtatcttctgggactaaggacagcatattaacagctaaatgtacttcactctgcttagagctttagtaatacttcagatattgttatagagcagaaaaacaaaaactgccttatttgtgaccttctataattgccctacccaaaattaaaatgaccaa

SEQ ID NO: 133249 - DNA, 698 bp, Homo sapiens
agttgaaagaatattataacgtagtttcttgattgtataaaagtgttctgatgtgacctctgtggaatatggctataacagttaaatatagttggcttcaaatgggaataggaaataggaatctaaagcagataaatcagtgaagaaatcagtggattccaataactatccaagccttcctctgtggctggaagattgaccacactataaagaaagtaatgatttgttattcttgctaaatcattctaagagccttcacaaatacactattcataatgctcaaaaccttacagtttaatgcagctttcccatttgtgatttagaatacttgacaactattttatcaaaattttatgttcttttatgtttttttttacctgagaattttactgtttccaccttgtaacttctgttacaagtaatttctatgttcctactgtactaaacagccctaagtttgcattttgatagattatgatttctatcatgcctattaccatgataccgagagggaagatatgtaccaaaaccctctatttcatatgctcagaacttaaatccattattttgcctataaaacctctatttataaaaggaaaataaaaactgagtttttctttaccttatttaagagtgagattaggttcagaggcaagaattccctataggaatccaacaacatgctttttcctttaaaa

SEQ ID NO: 133250 - DNA, 697 bp, Homo sapiens
tatttattttaaattcttatagtaatctgtttcagaaatatatctattattctattgatgggcatttaggttcttctcaattcttagttgtgtcagcactacatttagtatacctttctccttgtgctcgcattagggtatgtgtgcacattttaatcttattaaatatttgatattgacagattgctcttctgtggatttgtgccatataagcacttggtattttctgttttttagttactgccagtctgataagtatcaaatgctgtttgtgtgtgtgtatgtgtgttttaaaaatacatttctgtaataaccagtacagctgagaatttcttcatttggccacccttgttttctatttgatgaattacctattcatattttgtgtccattttcctgatggatcatttgtcttttctcttactgatttgtgtatgtgtgtgtgcttgtattttgtatattactactttgccaagtatatattttggtaattgaattctagttgaattccattatagttggagaacataatttacatgattttaggtgattccattttagatgctttgttggttcatcacttataattttttgtctttttagtggttgctttagagtttttaatacaattactaccacattctacattaaagtaatattatactacttcatctgtattacaagaaccttaggccag

SEQ ID NO: 133251 - DNA, 715 bp, Homo sapiens
gttgccaaattcttccctatagagattatagcattttatatcccaccagcaatggttaagttcctatttcctcacagcctcaccaacagagtaattgtcaaactttagagtttttactggtctaaaggtaagaaatggtatcttagtgtagttttaatttgcatttgcctcatgaaagtgaagctgaatgtattttcatatgtttaagagccagttcatattatttttctgaatcatctgtttaaatttttttgcctatttttctattgggattttagagtttttaattggttatctaagacttctttatatattaggaatattagcctattacctgtagtttatgttccaagtatttcctccctgcttatcatttgtctttggactttacttacgatgttttttgccatgcagaagtttttcatttttatgtaacagatttgtcaatattttctttcaatgaatctagagtttgagtcatatatataaagtctttctcaatacctaagttataaggaaattaatatatgttttctttcactctttgtatcatttcatactttacatttagaacttaggtctacttgaggtgtacgcatatgtttggtgtgcagaattgatccagatatatcattttccaaatagctatctagttatctcaacattatttatcaaaaagtgcatttttcctctagtcttctgagataaccccttt

SEQ ID NO: 133252 - DNA, 936 bp, Homo sapiens
atcttggctcactgcaacctctgcctcctggattcaagtgattctcctgcctcagcctcctgagtagccgggactacaggcatgggccaccgtgcctggctaatttttgtatttttagtagagctagggtttcgccatgtgggccaggctggtctcaaactgctgacctcaagtgatctgcctgccttagcctcccaaagtgctgggattacaggcatgtgccaccatgcccagcctgctttccacatttataacctgcttctttacctttacaatgatccagcaggataggtaggagagggattctttgctccgattaccagatgggaaaatcaaggtcctaagtgaccgaccaccacatgtgctgaggtcctttgggcaggggggtgcaggatccctgcatccacttctggtgctctttgtatcatcttcccccatccctgtatctgcagagcagaggcacatggctcattggttctgagtagaaatcttggagtcaggtttgaactgagcctcagttttactactactagctgtatgactttccacatgttactttctcttaatgagcctcagttttgcctcctgcaaaatgggcctagcaaaagcagggtgcctttagtctcagctactcaggaggctgaggtgggtggatcccttgagccccaagagtttgagaccagcctggataatgtagcaagagctcaaaattaaaaaaataaaataaaataaagatgcagtacatgtaatctgcttagaatattgcctggtatataagagctcagaaatcttagctactaatattatttggcagataagtttccctgtcataatcttttcttctctgtaagatcctttctctgtgtctggagaacccacgccacatttctctcctagtttctggtgactctttggtgtttttggctcatggctgca

SEQ ID NO: 133253 - DNA, 273 bp, Homo sapiens
ttgtttaagcattaattttcttttagtagtttccaatggtttaattaactcttaaagtgaagttgataagagaattggaaaattactgaactaagaaaaatgttgtctttcaactgctatttatggctgccagttacattttttgtgggagataattatcatttgaacctggaaggggttattagtgaacatatactatgggtattatcttagtcttgctgggctgctatgccaaaatagcatagactgggtggcttcaataacaaacattta

SEQ ID NO: 133254 - DNA, 745 bp, Homo sapiens
gtgtttgatatgaaagccctgaacaaggtgtaaatgtattcccatctctgtcattacaaacaccatagctttctgctacctgtgtgccctttgccacatcttttatgtttttgatcttgttgttgaattccaggctgtctggggagcctgatattgagaaattacccactttttgcgttttcctggagattgaagtcatgtgaagtgtttccactggtgcttttccaaattcatctcaagagactggagtcaggctgtttcttcatggcataaatctgctttgggactccttcctcttggtttcattacttttccccgccttgcatcagtgaagtgaatctgtcacatttgttgtggaagtctttagcttgagtcttagacagtatctttctcagtaggaacagccttatacagagagtgcactttcaaatctggactgactctttttatttttcatttttatttttcctgctggctcccttccacctcccccctggactgactgtaatatatcttagcttttaaaacactttatacttttatgaaactctataaagtttggcttaggtgggtttatcttataaatgtgcataaggctgctattaaatttagaggactattggtttgtaactactgttaagaaattattattaaataatacctacttgataggattgatttgtgtatttgcattctaaaagtgtatgaggaatatttttgtacatcttattttatttggtgatat

SEQ ID NO: 133255 - DNA, 170 bp, Homo sapiens
ggcacctggcccagccctggcgggcacagtgatcagcatttatacgtccaagaggctgaatgcctgagtggtgatggtccccctgcgatccaggatggggacacaaaaggctgctcggagattgtcatttcagagagggaaaacggaggccacagagggaagcgatacct

SEQ ID NO: 133256 - DNA, 179 bp, Homo sapiens
ggcctggtttaactttctcactgagttcttcctgcttggcctccttctctgccactttcttcttggctttcagggatctcttcagctcattcttgctcagttttggcttgctgccatccactttcacctcagccccctgtaccactgccacctttccagaaggctccacccaaaagtcc

SEQ ID NO: 133257 - DNA, 202 bp, Homo sapiens
cagatacttgacttaaaaataaactgtatcagataacagttatccaatgatgactgttatgcatatttagggtatttttgatagactgagtcaagctgtttataattcacacagtgtattattatctagaacaagataatatactgtcccaagacctgcctgtttttattctatgttaaggactttgtatggatttgttaga

SEQ ID NO: 133258 - DNA, 741 bp, Homo sapiens
cgccgcggcggcggaggcaaaaagctgcaaaagccgcggtgtgggggcagaaagccgcagcgggagaaagtctcactccaaattcccttgcttcagtaagcttctctaggccaatgttccttcggcattacccattttcttcctgtgaatgcaaatcacataaacatggaagtacatttgaccattttaattgtttaacattccatgtcacacgaccttccacaatagaatcaatgtattaaaatgtgttaacgaccacacattttacacaaatgccatgaatccttaaggtgttccaatttataaaatatgtctgcaaatcatactttatgatgctttgtattctgtcggtaattggatgtcatatatttaaattctattaaactgcttattaaaatgtccagtgcctcttttcttgcatggccacaaatattgtcactttaaatcagcacctttcaaagttagtttcatgacgactcaagatactttaaactattttagaaagtctcaaaataattcaaaaataattcatttagttaacatattttgtaaatatacatattctatgtattaatttaaatttggaataagtcaaggaagagatataaaatgtctttaaaaggtattacaactgtaagtaatcaaagaaggaaaaacaaacaaacagaataaactgttaaagggccagaatactaggaagaacttaaaaagtagtaagcaatacatacttcctcacctata

SEQ ID NO: 133259 - DNA, 425 bp, Homo sapiens
gaatttaagtagaacagcgttttttatgggcaggttagtcagctaatggataagagacttgaaattactcttttgggattagcaaatagaagggaaaaacatgataagggccagagccaatacaaggataagaactgcaaatacttgaaacaagaaaggacaagtatgaggacaacgcttaagagaacagaaggtctttgataaacctctgcctcctgtatggcaatgttaacaaatggaaagatacaattttgagggtggtaggactaagaagtccaagaatctaaacacggtatccatgggagaaaaataagaaagttagacatgattttcttctgtagaaggccatataaagcacaaaatttttttaaaaagaaaaactcaaatttctttttaacagtggataattttaatccttccctcca

SEQ ID NO: 133260 - DNA, 672 bp, Homo sapiens
gaaatagtgacttcagcatggtctttttttttttaagtgtaaatatatctaaaggtaggaaaaaactcaacaggatctatacatttgtatgtgtctgcctacagggtgattttcttttctcatttttgctcctgtgcattttcagttttctgtaatgaacgaatattatttgtgtcatttaaaaatggagattggctgggcatggtagcttacgcctgtgatcccagtactttgggaggctgaagctggaagattacttgagcccagaaatttgagaccagcctgggcaacatagggagaccctatctctaccaaaaaaaaaaaaaaaaaaaaacaaaaaaacatttttgtgtgggcgccgcccttggcccccttggaaaaaagctttttaaaaaccattcggtgttgggggcgcggggggcccccaagttgtggttatggtaggaaacacttgggcccaaacgtagggtttgctccaagaggaaaaaactcgcgggtcacacgacaaagtgggtcggggatttctcccccattataaaaaaaagccccgcggggaaaccccacagcttttcttgaaaaaaattccagaatgggggtctccggagagcacaatcacgggggtctctttcacacagaggtttcccacagggaactccgcttttcaaattagcc

SEQ ID NO: 133261 - DNA, 463 bp, Homo sapiens
tgacagagtgagaccctgtttccgcctaaaaattcaggcaatgtggtagttagaaatggatgtcagagtaacttgtaatcatcaagaatatcaaggtaagaaaaatgagtcttaactgtgaggagttctctcctgaagttttacataaaacccttctaatttgagggacaaatcacagcttctgtcagcttttcttgccttcctttaaatgccatgggaaatgcagtgaccacagtttctgcctctgttatacagtaaacccatgacattgtctgattcaaccaagcatgaatcgaaaatactgtacaatagtctcaggatttgaaacctgtggatacagagcaccaactgcattagctaaggtctttgatggatcctgtgcagatgctgatttgagcccaatccttatcagtgctctttgaagactggaaggttttttgtttgtatttttttttttagacgg

SEQ ID NO: 133262 - DNA, 289 bp, Homo sapiens
ccctcttcaggaggtgacagggccaccaagacggtgtcttacaggactacccccagtggtttgcaaataatgcccctgaaaaagtctcagaacgggatggaaaatggggacgccggctctgagaaggatgagaggcactttggaaatgggtcccatcagcctggcttggatttgaatgatcatgttggagagcaagatatgggtgaatgtgacgtgaatcacgctacactggcggagaacgggctcggctctgctctgaccaacgggggattgaacctgcacagtccag

SEQ ID NO: 133263 - DNA, 539 bp, Homo sapiens
tatgtccagagcttggcactgtgcatggcagattataggcacccaataagtatttgtaaaatgagtgcaagagacagtgagtgaataagtacatcaatggatcaggaaatgagtggattaatggataaatgaatggcatgatgactgactgatgaatatgcatttaggtgtcgtatgaaggaagaagtaagtacataaatggataagtgaatgagtgagttatggattaaatggataaaggaataaaaaaaatcaggtaatgagtcaaagaaggggtaaatgactaatagagatagggctactacatagaagcccttggtccaggaacttttgggtgaagacagttgacttccaggctgtgggttggcaagttgactgtaattcagctcattcattctctaccctgacctcacacatcctgaggtcatctgaaaaatcaagcctagtccatggaaagtactcagtaccccaaagaggcatttattcatgtgggcaaagaaacaacctgtcagaatctgactaggcctgaaagaggccat

SEQ ID NO: 133264 - DNA, 248 bp, Homo sapiens
ctgccctggcccatggcataagccatctttgcacattattttcaaactgtgaaaataatgccagagaaaggaagcacccatttgggcttctcatttttcagcctccccagctcctgagggcccctgcctgatttgcattcttagctaaatttgcataacagaacacaccagaacttccctggaccaactgtggtaagcgggcaagttttgtttttgttttgtttgggtttttcatctcctgccatgtc

SEQ ID NO: 133265 - DNA, 927 bp, Homo sapiens
taatcttgtatcctgtaaccttgataatgcatttattagttcatagtgttttttgcttcttttgttcttttctggtaaatgccttaggattttctttttctcccgactccccgccttcctcctcttctttttcttctgccttaggattttctttttcttctttctcctccttctcttcctcctcctcctcctcctcttctttcttctttcttcttcttcttctcttctttgtttttaaattgagacaggggctcactctgttgcccaggctggagtacagtgatgcaatcttaactcactgtagtctcaaactcctgggctcaagtgatcctcccacctcagcttcccaagtagccaggactacaggtgtgcaccatcatgcctggctaatttttatatgttttgtagagattgggtcttgctatgttgctcgggctggtcttgaactcctatcttcaagcgatcttctcacttcagcctccccacatgttgggattacaggcctgagctactgtgccaagctgaattttctacatgcatgattatgtcacatgtgaccataggtaattttacttcttccttttctatctgcttttttcccttgccttatttcctctggctgggacctccaataccgtttttaatagaaatgtgagagccacttcgtttgtttctgagtatagtgagaaagtttggtcttttaccattgcccagcttgaagtttcctatagtttatctataggtgatctttatcacgttgaggaagttctcttctctttctagtttgccgagagtttctatcattcatggatgttgcattttgtcaaatatttttctgcatccattgagataaatatatacattttaccatttattctattaattgatgttctaatgctaaaataaaccttttatttcttgcaaaaa

SEQ ID NO: 133266 - DNA, 334 bp, Homo sapiens
ggtaccagtgccacactaaccctcacctccaggggacctgaaccctcctgctgcttcaaagcccccctcttatataaaattatcccaattccatgaaacagtcaccctggccctggtgtcagacaggctagaccagtattgcctccacaaacctcaggttttttcatctatagcatagggatagtagcagtacttgtagggttgttgaaagaattaaataaatacatgcacataagcattttgcacagggcgtagtacttaagcaaagctcaataatattagtagcaattttttttttgagacaaagtctcactctgttgcccaagctggagtg

SEQ ID NO: 133267 - DNA, 633 bp, Homo sapiens
cacggtggctcacgcctgtaatcgcagcactttgggaggtgggcagatcacaaggtcaggagtttgagaccagcgtggtcaacatggtgaaaccccatctctactaaaaatacaacaaattagcggggcatggtggcacgcacctgtaatcctagctacttgggaggctaaggcaggagaattgcctgaacccaggaggcggaggttgcagtgagctgagatccgccactgcactccagcctgggcaactaagactgtgtgtcggaaaaaattaattaattaaatttaatttaaaaattagcagggtacggtggtgtgcgcctgtggtcccagacacttgggaggctgaaaggggaggatcgcttgagcccagaaggtcaaggctgcctgagccgtgattgcgccatacgatcgtgagccactgcactcctgcaccaccgcactccagcttgggtgacataacgggaccctgtctcaaaaaaaaaaaaatttaaaaaaaggccaggcacagtggctcaagcctataatcccagcactttgggaggctgaggtgggcagatagtctgaggtcaggagttcgagaccagcctggccaacatggtgaaaccccatctctactaaaaatacaaaaaa

SEQ ID NO: 133268 - DNA, 413 bp, Homo sapiens
cgaaggtagaggccctcttatcacagcaacaatcatcacttaagtcaaagacataaaattaagggataccttagtttcatcacagaaccagtccaaatgtgtttgtttgcattctcaacatttcagtaacctctagggagtatttcttctaacaattatgggtggaattgggcagttcccctttacaagatatgttttatgtactgccacctttgtgcagctcaaccgatttggaatttgcccagctaaccacattccggcaaaagctgcagctaattgaagatcttcaacgaattcagctaattaagaccaaacacaccctttcatttgaaggtacatttgacagtacctaatacaaggaaaagagctcctttgtcattcatgtatatccaacccagcagtggttctgcagg

SEQ ID NO: 133269 - DNA, 513 bp, Homo sapiens
cgctcactgcaacctccgcctcctgggttcaagcgattctcctgcctcagtctcctgagtagctgggattacagcgtgcgccaccacacccagctaatttgagtattattagtagagatggagtttcaccatgttggtcaggctggcctcgaactcctgacctcgtgatctgcccgccatggcctctgaaagtgctgggattacaggcgtgagccaccggtgcccgatccggctttccctctgttacataacatattcaagcttctaaacattacctttagactttccaaattctggcctccttacatccatttacctttccaatatatctcctgttactttttgtagtagattttcccatttaataatacaacactgcttttaatctccctgccatgcagtttcacacccacaggggtttacttatattggttattttcatgtaatgcctcacctttgttcacatgattcaagaattaagtatcagtttttccagacgtcaccctatggtag

SEQ ID NO: 133270 - DNA, 266 bp, Homo sapiens
ccaagcagtgggacagaggaacatttccgactcaacagctactaactgaacatggagcaattctagggagccctacaagaccctatcaaaagtgtccacatcaggctaggcatgatggctcaggcctgtaatcccagctgctctggaggctgaggcaggagaactgcttgaacccgggaggtagagattgcaagatcattccactgcactccagcctgggcaacagagtgagactccatctcaaaaaaaaaaaaaaaaaaaaaaaa

SEQ ID NO: 133271 - DNA, 565 bp, Homo sapiens
tgatgtctttgctcaaatagcaatgtatgcttctcctattttatagctgcagatagatatgatacaaacacctggcttcactgtgtactttattttacttacttacttatttatttatttattcgagatggagtcttgctctgtcacccaggctggagtgcagtggcaggatcttggctcactccgcctcctgggttcaggcaattctcctgcctcagcctcttgagtagctgcggttacaggcgcctgccaccacacctggctaatttttgtatttttagtagagatgaggtttcaccatgttggccaggctggtcttgaactcctgacatcaggtgatccgcctaccttggcctcccaaagtgctgggattacaggtatgagccactgtgcctggcttcactgtgtactttaaagctccccttttctccatccacttgctgaattgcctccatacagtctgagggtcttgctataatccattctctacctgggctgcagtaagcattgaaagtatatattaattagcggttattttccccgatatgtacttagggctttctat

SEQ ID NO: 133272 - DNA, 628 bp, Homo sapiens
agccccagaaattgtctaagctttaggtcccacaaaacctagatcagctccctgataattgatcaatataattaactaatatatatgaaaggaatacagactgtaagcaagagaagttttttgtaggctaagcagtctctaagtcccaggaatgagagtacatgggaacgtcatctcagagaacaggagccccatatgtgaactttgtgtggaactttaattgaatgagctcaatggagaatttaggcggatgaaaattcaagttgatcttcactcacctactaaatgatcagcttgctatgtgtgatgtatcaatttatttgtgacaagatcagacaatttggagaatgagacaggttcaaattttggcttcacctcttataattgagttcactcattccctctgagcctattttgtttacaaaaagggggttgataataataatagctaatttaatagggctaatggggtgctatagtgaaatgatagatatgaaaaatgctctgaagatagaaaatgctgcacagatgttagtagctatacaaagctaacaaatagtatactcatcgtttatattaatagaatgactaaaaggtcattctgctggagaaggagtcagtcgacttt

SEQ ID NO: 133273 - DNA, 400 bp, Homo sapiens
agtattaccattccaggtgagataattcttcattgttgtgtttattgcatgatacttagtatccttggaccccagcggtaaatgtcaataccaacctgaatgtattacagcaaccaagaatttcccacacatttccaaatgttaggttgaggtggtatggagtatctggttgagaagcactgggttagatcagtgtttagcttattactattatgtaaatggtagtcatagttaagccatgtagtataccaaggtttacaaccactgttttccctttcttgtacatttttctgttgtccctgaaattaattgtctttatcttttgtttagtgttctctgtacctactactaactgcaaactctcttctggttgtctgtttctcctttatttgctttcata

SEQ ID NO: 133274 - DNA, 319 bp, Homo sapiens
  misc_feature (15)..(16): n is a, c, g, or t
ctgaagggtgccctnnttggtgggtcagtatccaatgcatttctccagaactgggttccatcttcatttcaccaagcccacataagtggctgaacatcacaaccccagccatactgagcctgggcccacgatagggatgaaatatactaggttattaataatgctctttaaagtctgagagacccctaagaatactagcttgtctacactgtttactgaaaatatatggactaatatcgtagacttgattcactgggttacacagcctcattttggctacataaccagtgagacataaaacacccctcagtaaactttt

SEQ ID NO: 133275 - DNA, 741 bp, Homo sapiens
aattattattccaaaatgattttgctttccatttacccacaaggacctgacccaaaaggtatttagttttcaaatgagcatacaaataattcaaaacaaaacaagctcttaacaacaacaacaaaaccttatttaaaatccctggaaggcatctagtgagagcagtatgtgactgacgtggtaaattaggcctgctggagaaaaaaatcaagacaaaatatggattcattgttattttgaaaggcagccatctttccaagagaatgtgtacaccacattttattaagaaattacatctttccccatattttccttttctctttcacatgctggcaatggcaagcaggttgagcagatgtgataaaagaattaataccagtcttgggaacacgtagacgaaatatttcttttgaaatacctacctttaaattccattagttcaatctgatactgaaagagcctggattagggaaatgatttacacagcacaggttgtttgtccagacttagagcccttttgtaatatgaaaaacgtgaagatgaatttaatatttctccaatgaattggcacagggtttaaaatcttgctttgactgagataattgcgtttgttttagtgttaataaattcacctcggtgagaatttttctttttttttcttctagattcattcatagctgctacacattcatctctatataaaacctactctcccctctgaaaaagcagcataaccagtca

SEQ ID NO: 133276 - DNA, 674 bp, Homo sapiens
tatctttcattggaaaaaccagggtggttcagtgagttaaggacaatatagcatggactgggctgccagtctagcatttgtttccaaattcattcatgttcttttggagtatcttcatctcctctcattttcccatcttctgccctttactattctgggaaaatggcaaaaaagcttcacatgtgtccacaaaatgacaatttgtatgtttataaggaattcagtattctgtatcagttactttttccaaataaatccaaatatttaacatttaaaaaaatgcaatctaaagtataccaaactgtaacttacctagtaaatgagattagaaactattgtcagggtcatcgtagtgaattattattattattattttttgaggcagagtcttgtgctgttgcccaggctggagcacagtggtatgatctcagttcactgcaccctccacctcctgggctcaagctattctcccacctcagccgcctgagtagctgacactataggcaccaccatgccctggctaattttttaaaaacttttgtgtagagatagatagggtttcaccatgttgcttaggctggtctcaaactcctggactcaagggatccaccactttggtctcccaagtgctgggattaccacaatctagtacaactttatcacttctgatggct

SEQ ID NO: 133277 - DNA, 590 bp, Homo sapiens
gctatgtctcgtggatactgacgcagagttcggctatgctctatcactacccatctttgttgctcgggttgttcaacgacacacagctgccactaggagcctttacagctactcttgggtccctgtgacttgcaccatctttgtgggttcctttgagcacctccttaggctctggcaccacaagatgctcaattcctcctatatactccctgctcggccctacgattctgccatttctcaagggagccctggttccctttgttggagaatagtgttagaaaccaagaaaccaggggccgggcacggtggcttacacctgtaatcccagcacttcaggaggccgaggggggtagaccatgaggtcaggagatcaagactaatcctggctaacacgatgaaaccccatctctacgaaaaatacaaaaaaattagccaggcacagtggcaggcgcctgtagtcccagctactggggaggctgaggtgggcagatcacctgaggtcaggagtttgagagcagtctggccaatgtggttgaacccagtctcttgtaacgatacaaaaattagcggggtgtggtggcgggcgcctg

SEQ ID NO: 133278 - DNA, 449 bp, Homo sapiens
gtggaggttgcagtgagtcgagatagtgccactgccctccagcctgggcgacacagcgagactctgtctcaaaaaaaaaaaaaaaaaaaaaaaacttaagggaatcctgtgggaagtttctcttgtttgggtcatctattagtctgctggggactgtgctaatgcccataaagactgagagtactggtgttagtgatgttggaagattatctggattggattgacaattctttattataggatgaataaacttaaaaatcaatatgaggcttatgaatataaaactgtaataaagagaaacagggatcctatggacttagcagaaaactgtgcccctaatatagtttaattactcagagaaagttacagaaaccaatgtgatcagtgcgctaaagggtctattattgaaatattatggaagatttctattaaatgtcagaaaaaagtaa

SEQ ID NO: 133279 - DNA, 678 bp, Homo sapiens
ggtagcccagctggaatttgaacccagacagcatgtgggttcagagtgttttcatttttaactactctgctatattaccctctctagttttcagtattcatattagcacctcagccttccccagatgactacaaatcccatacatatgtgtatacacacatacccagggtcattcatgaaatctgaaacttcgggtgttcaatttgactttatagaaccttctacctctcctggctgatagtatctctttctcatttcacaaattaaacttcctataacactaccttaaacatgccacccctgctcaaaatactctggtggcttcctacgatctataagatgaaagctaacttccttagcttgccattcaaggcccttcacagtctttccagtcttactgtttattctatccctacttgagcacaaagcatttttttctttgatcatgcatagtccttctttcttcatttttttaagtgtacaattcagtggattttagtatattcagtgttatgcaaccatctccactatctaatgccagaacattttcatctctgctatctaatgccagaacattagaaaccctgtaccgcatagtggccattcccaattcacccttcctcttatcccctagcaaccaccaatctattttctgtctttacgaattagctattctgg

SEQ ID NO: 133280 - DNA, 189 bp, Homo sapiens
gtgtgtagttctcactaatggatgggatgagtcaacccaaccatccactctacctagggaagtgtaactgggaaacattcagagagaacctagaggccagagagtgacacagaaacagagaagtacaaatacacaggagaaagggctgtgaagcagtaaaagccatgagaaagaagacaagaaaggcaa

SEQ ID NO: 133281 - DNA, 851 bp, Homo sapiens
gttcccagatttggctctgatgaggagaaaggaaatgttcatctctgaatctgcgcttctacattgacccaccgaaaattggcttaattttaagggaaaatagagaacctggcttagtgcagccaactcctgttattcaggaaatgaggatgtgagaaatggagtctggggagaataaataagtattgtaagctttctgcaaaggctcatctcgcctgggtgttcttgccacacatagagagggtttagagggcctctgaattgagaaggaattcctagaaaacctgaggctcgctcctaaaagaagcagccatattctcctttgctgtctagagtcttagttgttgctgttattattgttgttgttaccattaatggtgggctgactgctggatactttgctacaagtgatttaatttaatcctcgaattgtcaaagctgagattcttacttcaaagcccatgctgctttcactctagcgtgcccccaattgtctattaacagagagataggagttgttataacagccctagagttctggtattctgaacttggatttttctcttttgccatttgagtagtgacaaactccttcaagtaatctaccttcttcctctcttcattcattgcattaacgcctccgaagtgctcttcttggacagacactgggaagatgatggtgtgttgtatcacaccttttaataagccacattttattcagggaaagtggggagcttttttgtggtttgcaaacctgatattaacattgtcctgaccagaaaatgtcaaaacttgcccacccacccagttgtgtttaggcttctaaaaataatgttattcctccatactca

SEQ ID NO: 133282 - DNA, 775 bp, Homo sapiens
cgtctcctctctatgcccctgggggatcctcgccagtacgtcggctcagctcgatggttcgaatcctggccccgccaccttctagtcccgcgaccttgggcaagtcgctctacctttccgaactttagtttcctgtaaaacaaaaacaataatgactgctgtttattgtggcaggcactgcgttacattctttatgggaattagctcgtttaaactacacagtaacattttttagtgagaactgctacagacacactatagaaaataaaggcagctgggcgcggtgtctcacgcctgtaatcccagcactttgggagaccgaggtgggtggatcgcctgaggtcaggagttcgaaaccagcctggccaatatggtgaaactctgtctctactaaaaatacaaaaattagccgggcgtgatggcatgcgcttgtaatcccagctactcgggagactgaggcagaagaatcgcttgcacccgggaggcggtggttgcagtgagccgagatcatgccactgcactccagcctgggcgagactccgtcgcacacacaccacaaacacacaccacaccaacctttcccccccctcgccccccaaacatccttcatcaaccaccctctgggccccggccccccacgccacgacacactggcccaaccgtcccagacacccggccccacaagggggggctcccaccataaacacccgggcccgccctctgacaacccaaggcccccggcacgggctaaacacgaccacggcccgtaatcccc

SEQ ID NO: 133283 - DNA, 147 bp, Homo sapiens
tttttccagtctgatctcactcacacctttaacactgtcaccaggatcttcataactcaaaagtacagtcctgtgatttctgtttttgaagtctttcagtgggttatcattacttatatgagaaatttataagtccttaatatgaca

SEQ ID NO: 133284 - DNA, 811 bp, Homo sapiens
atcatacaacttttaatagcctgtagaggatctgtttggtttgttactgtttaaagaaaaatgttttgttacaaaaattatcttcattaaaatagtcaacatattctccctctgggagatttcaagttttttttttttcgtttttgtttttaatgagatggttactgtgacacttttatttttaaatgtgttctattttatgcccagtggtacttatatttcttctttctttaatagagttagaatgtatatgtgttcctgtaaaatatgaatgcccatttcttatgaaaatcgtttatatcccaattatgaagagttttaaaaattaaacattcacaataagatttgttaaaaacatcttaacaaaagatgtttgggaagtagttagtcatacatgagagtagaaaagtgtatattgttccaaagttcaaaggcttttatgtgccatgttaagaagtttagatttagcttgtggtctttcaagactttaaacaatcttaatatttataaaatcgtggctattttagaaataccttaatattgataaaattgtggttataagacactaagacatataaaatgtaaatattgtatgatgattatttgactaaatatgagctatggcggggggaagcttcttaatgaaaatgttatctcagtgtctattcagattttaacatatagattaattctttttttctttatttttccacactatacagatgtatagactaattctttttaggaatgtatttttgccatttccctcattctgtcactttattaaatagtaatttaatttgactttttt

SEQ ID NO: 133285 - DNA, 491 bp, Homo sapiens
aaaacatttgaggtagaaaaagttcatattaatacttagatgcatgtttgggctcagaaatacttttgaactctgtagagaattaatatggtagctaacttaaacaggtcttaaatttcatctaataaatacttgagttacctttatgtgccatctcagtatgctaagtgctaggcttcaacccttttcatctggagaaaagtaacttacctttctgcttgtgatgggcctctgtgccccaacctcatcccaattcatgaataaactgatatttactctgtggtccctgactgatgtttcacattcctgactattgtttaacaatctgattctgggccgggcgcagtggctcacgcctgtaatcccagctctcagggaggcaagaggcgggaggatagcttgagcccaggagttcgagacctgcctgggcaatatagcgagaccccgttctccagaaaaaggaaaaaaaaaaaaagacaaaaaaaaaataa

SEQ ID NO: 133286 - DNA, 486 bp, Homo sapiens
gctggcagggagggatttccaccccgcattggtaagagagaagagcaagatgcgcttgcacattgcacctgtgcacacttgctcatctgtaattgtgggtacagggacaaaggtgtgtgcagacacactgcaggtcacaaagactgcatagaggcatagagtgaaagtgggtacagaaaaggggaggagtaggaagaaaagaaacaaggaatcacaggacacggcagctcgtgtctgtaatcccagcactctgagaggctgaggtgggaggatcacttgagcccaggagttcgagaccaacctgggcaacatcgtgagaccctggctctgctaaaaactaaagccagatgtgatggcttgtgactgtagtcctagctactggggaggctgaggcaggaggatccctcgagctcaggagggcaaggccaccatgattgtgccactacactccagcttagatgacagaatgagaccctgtctcaaaaa

SEQ ID NO: 133287 - DNA, 236 bp, Homo sapiens
cagagttacagctcagaccttctgttcccaagtttaatgtttcccgcaacttatgtataaacaagctatgaggcagaaactcatttaatacttggcctgacctaataaatattgatgagcttaaagaaactatgttttggagactcttacgtaggattagaaaattttggagagtgtgagatcttttctagtattaagggctatctaggtgttatgggttaggttaattttttttc

SEQ ID NO: 133288 - DNA, 244 bp, Homo sapiens
acagcttgttcatttcttatagataatctggcctttatcagaagctactgactgattaaaacagtctctttcagctatatgttccttttcttcgaattttgcctccctatattttttcccaagagagtctgattggacaacggagtccaccgtctcctccagcttcagagaagggacctgtctttgtcctgctctccttaatgctgctttctgccgacagaaccttcttcagttttttggtatc

SEQ ID NO: 133289 - DNA, 313 bp, Homo sapiens
actgcactccagcttgggcgacagagcaaaaacttcggttttaaaaataaatatttgatttatcaaaggtacaatttcacattcaaaaatctagttctggccgggcgcggtggctcacacctgtaatccgaagtaaatgtttccctccttgggtttgattcatttgctagagcagctcgcagaactgagggaaacatttacttcggtttaccggtttatcataaaggatgttacagccctggtgtggtggctcacgcctgtaatcccagcactttgggaggccgaggcgggcggatcacgaggtcaggcaatc

SEQ ID NO: 133290 - DNA, 684 bp, Homo sapiens
cacacttgtcagatttatctaactctcacaccattgtcatcacttccgcctgcccctcaggaacctaaattgatacctctgcctatcatggaaaatctaaactcttcagtcttgcattcaaagttctcctgcaactacctgccccagcctccatcatctttccaatctgacctctccttgcttcacactgtagaagcaggtactcttggagctgacagtcatcaaaaagatggtgcatatccaactctcacatgtcaaagatggggaaactgaagcccagagaagtgaggtgaatattcccaaggccacacacagtccttccactgtggctaagacgacatgctttccattccacacacaacttgctcctctggtcctaagccatggggcgaggtgagtagaactggtacccagaaaacagtatggcatgggataaatggtagataaagcaatgttgagaattaaaaactccaatgtgcttacaacacatagcgttctcagcaagtgaactttatatagaatttgccaccctcatagtagggaattcactaaagctgggaatgaatgtgcaaatgtttgtttgctttgttttgtttaccacagaagcgaaatttgtgacaatctttttcaacctaaattgaataaatgattcaggacaagaaatgattaccagatgtgtcaggg

SEQ ID NO: 133291 - DNA, 617 bp, Homo sapiens
gaaatcctccctgccatctccaccctttcccaaatacctgattttatagcaaagtcaatgagagaattaaaagctgtttctaggctgctgacataaagttattgccaagctctattctttggtttagttcatgtgtaagcatgaagaaaagaccctctcacatacctacttaggcaacaaaagcaacatttttaaaaattaatttgcccaggctgggcgtggtgggattacaggtatgagccaccgtgcccggccgtaatgctattgccttgttttattgttgtcataaatttatcactatctaaaataatcttgtttatttgtatgtaactttttctccccgtatctagaacataaaccccatgaggacaggaatctgtcctttcttcttctttaatgtggtatcctcagtccctagcacttagtatgtgctccatgaatatttgttaaacagatagatactgtcattaatgggattcctgaatttattcattctccagacatgcattgctcacttactttgttccttacaaaacattgggaacagatctcgtgggcaaatacacgtatagacatggcagtgggcatggtaccccatgacgtgctaaacgaggaag

SEQ ID NO: 133292 - DNA, 391 bp, Homo sapiens
aggcgtgagccactgtgcctgcctaggcgttatgttcttaaaaatagagaagcggaaggattacatattattgggtggcagaataaagtttttctgttataccataattgtctcaatttttggaattactctttaatttagctttaagaaaaaatactggtattatttccttgaaatattatgaattagctgttctgagaattcctcacggctcttttcagtcttgacctcctggacttaagtgatcctcttgcctcaggctctcaaatagctgggactgtaggcatgtgccaacacgcctcgctaattttttaagtattttgtagagacagggttgtgccacgttgcccaggctggtctcgaactcctgagctcaagcgatttgcctgcc

SEQ ID NO: 133293 - DNA, 354 bp, Homo sapiens
ctgaccctaatgtcccaccagatgagatttccaagtacggaggagaaaaaacttaacaagccattctgcacgtaagcttatccttaacacataagggagaacaggcaaagaaaatgccaaaagatttcaaaggtgtcactactacctttaaaaggaaaacagagaaatgtgagttaaataactggtgtcagctgggtgtggtggctcacgcctgtaatcccaacactttggggggctgcggtgggtggatcacctgaggtaaggagttcaagaccagcctggccaacatggtaaaaccctgtctctactaaaaatacaaaaaattagtcgggtgtggtggctcacgcatataat

SEQ ID NO: 133294 - DNA, 231 bp, Homo sapiens
ttggtgtctccctcatcatgatgacaaagtcagggcacctaaaaacgaactcagagccttcttcctaaactagctacatcccagaatcctgtatttctctcaaaaggaccatcaattggccaggtgcccggacgtgacatccatcacgtcttctgataagcacacaccaaggacccgctcatgccaggccctgtgctgccagaagaagcacacggggaattctacagaaca

SEQ ID NO: 133295 - DNA, 430 bp, Homo sapiens
tatatgacaggggcctgcatcaaaaactgtttggaattagatattagtcttttcatgcttttcactagtgagactaaagtactcctacagagctcagcttacatatgagaaaatataatacatattatcaaatataaaaggagattgctgaataactgttatccatatctaccacggacagaacaagaagatattggctcactctacagcacaaatttgggttagatgtaagaatgaatattctataaacaagatatcctaaaatattttgaaaaactggctagatatggtttgcttgagtttttctcctccatgctatccaattcctattctgccacttcggagcattggtctcaagctcagaacacaaccacctcttcccccttttcactcttttcctccctagtcttcattttctttaagccttccc

SEQ ID NO: 133296 - DNA, 299 bp, Homo sapiens
gcagatggtttctcgagggaatgcagtgcggccctcaacagaccccatcctcccctcctggcctccagacatggatccctgactccatcctccccttgaggctccacagagctctgaccccatcctcccctcctggtctccctccagacacagatccctgaccccatcccccactcccagcctccagacgtggagccctggctggggaactctgtgtgctcccagcctctgaaggtttctgggcttacctggctcctgtctcatcccagtccccctgagtagccacggaggtggggtcc

SEQ ID NO: 133297 - DNA, 732 bp, Homo sapiens
cagagaccctgcctaccaattctcgaaagcaccatctcccgggtggctgcaccctggtaacccgctgcctccaggcagaccaccagtctttacaaaagagccaccatcctggtgggtggcaacagcacctacctgcatgtacttctccaggttaaaactgtgagaaacaacttgctttctgaaggaagttaaaaagccatctgctatttgtctaacagtactttcttcagacagatactgtaaaggttaacctcagcccactcttaaatcgatgctcacaaaactccaaattgttagtcgtagttaatgaacttttataaaaatcaggcattcttaaataagatcacaaattcaattcaaatatagtacttatgtcttgttgcagtaattgtcaagatgaaacattctggattcctgtggcatttgtgaatgtgtatagcaagaaagaaatggttaaggaaaataatagtaattgtaatgttaaaacctcaggggcctaatgagtggaaagtctgtatctattcattgataataattgtctaattacaaccgattaaacatacaaatcacccacattttatatgagacagcactcacagaaatattgccgtggtttgcctactagcgttttcctctctttccccttcagctataaattgtgctattttggggtagcagacggcattctgggaaatgtcgaggaacatagtaactagttggtaggggatgaga

SEQ ID NO: 133298 - DNA, 270 bp, Homo sapiens
ctcaattgcactactagaaccataggtagacagtaatctaaaacaacttttaaaaatttccaaataagttatttatccagaacacttccaagttccagataaagcttaaaatgctttacaagaaagttcaaagcttaaaatgctttacgccctttattattcttcaaaatgaaggttttagaccggaaatattatttttcagttctggtagaagggaaaaaccaggctaaatcacttggtagaagttatttgttaatagaaggaggaata

SEQ ID NO: 133299 - DNA, 362 bp, Homo sapiens
ttggcgcagtggctcacgcctgtaatcccagcactttgggaggccgaggcagacggatcacctgaggtcaggagtttgagaccagcctggtcaacatggggaaatctcatctctactgaaaatacaaacattagccgggcatggtagcgcgcgcctgtaattcccgctactcgggagactgaggcaggagaattgcttgaacccgggaggcggaggttgcagtgagccaagatcacaccactgccctccagcctgggcaacagagtgagactccgtctcaaacaacaacaacaaaatgcctcttgaaacagtcaagccttttgacaccaaggaaatcatcttagctgtgattggtttggaaa

SEQ ID NO: 133300 - DNA, 453 bp, Homo sapiens
ctgatggggaaatgactcaatgtcctttacctgaaaatccctaggcagggatttcctgcgtgcagagtcctaaggatgcctgctaggtcagtggaactttcataaactattctgatttagtgtgaaaggcaagcgggctaggccccaagctggaacgccatttctctgtcttctagacccaaattttatccttctggttgttgaagaacaacacaaattgatatcacagcctttccaggcattttactgggaagttaggacactgactggaaaagagcaggccctaagaattggaacgggaatcactgggtggattgtgatgcagatgagaaactggaacctcaaattccacatcatcttccttttgctgttgaaagccagtgctcttttcccacctgagtggatcagcctccccttgtggaagactttgtaatgttctcattgaggcaatta

SEQ ID NO: 133301 - DNA, 380 bp, Homo sapiens
  misc_feature (59)..(59): n is a, c, g, or t
  misc_feature (107)..(107): n is a, c, g, or t
tgtggtaagtatctaaggttatataagttagtcaagcttttacatagttgagtgggctngaatgagaaagtaaagaccctctatttctaattcatttataccactanacaaaactcattcagttctttatttcagatggaactagaagcattacgctctatttatgaaggagatgaaagtttccgggaattaagtccagtttcttttcaatataggataggtgaaaatggtgatcccaaagccttcttaatagagatttcctggacagaaacatatccccaaacacctccaattctatctatgaacgctttttttttaacaacaccattgtgagtagtgtcttgcttttacttgtttttcattttaactcttttgttatt

SEQ ID NO: 133302 - DNA, 282 bp, Homo sapiens
ccagacacagttgcctggactggtgtgtctcctgggctgtatttcatcggcatttgggccttgaaggtttggagctgaagttcctgtcagaactttgggctgaatcccagactttatggacagtaattttctcgcagggcctctttcctaactcactttcttcaagcgatccttgaggccagaactctcacttgtgggcttgcttcctcatgtggaaagatgctgtagtatttagaggggtgggtcattggttctcagagtgtggtctgagaagcctggagt

SEQ ID NO: 133303 - DNA, 257 bp, Homo sapiens
ctggcccccagcacatcccatggcctggcagcaggtggtttctgcctggagggctcagccatcaaaagatttcaagatgtatattttgtaaggcaaagcctatactcatagactttgtgaaggacctggttggggagacaggagaaaaaatggatgggaaaaaagtagtaagcagttttactgtgtgagatattagtgggcgagataacattgaagcagtgcttgattaaataccaaatgaagttccaatggtagct

SEQ ID NO: 133304 - DNA, 683 bp, Homo sapiens
ggattttaattaaatttgttgcttaagttatctgtctataccagaaaaggagagaatgattaacctaaagccaaagaaaattctaattcccaatttatattaccccttagttcttcccaaagcattttctccacccccaacttaaaaaaagaaaccttttagaaacctatatattaataaaatatctctaatatggattaaagttgatatgattcgttttttgcttaatttgctttcagttcatttattcaatatatatctctgtgcatatgatatcctggactctcttctagactctgtattacagctagtcagacaatttcttgcctctgtggagcttacattctagcaacagacagattataagccaataaatgtataagaacaggtagcaataagtcatgaagaaaaatgaagcatggtgaggaaactgggagacaatgaagtatggtgtttttgtttttatgtactcagagggaaggttactcttcccttcatgatccatgcaaagatctaggggaaaggtgttctttcccacagggaatacatacagaggatacctattcatataatttaattttgaatagtacagaacagagagttgaagacagaaagtcttattcattgctacaaaacccatgtttcgattatggtcctttactggtatgtagcatatacacaga

SEQ ID NO: 133305 - DNA, 623 bp, Homo sapiens
gcagggccaggtttcttaaacccatagcagtcctgcaatgagctctttttaatcagcaccgaaagtctagattaatgccaatatagcttttattacttctgctgttgattcccaaaccccaccaacattttattgtgaaacatttcacaagtacagaaaagtttcaagaattgttcagtgaacatttgtatataccatacctagattctatacttaatgtatttgttgtatttgccttctcatataaggcagatccttttctctatccatccaattttttttttaatgcttttcaaaataacttgtagacaccagtgtggttcaaccctaaacacttcctggaattgattttatattaagaatgctttccattgcaagtgacagtaatccaactcaaaggatttaagtaaaaaaatggaatgtattggcttatttggctggaaaggatattggggagatagacttataggaagagttgctggaactagtgccttagggactggagccaagactctgctatcagaacagttaactctgtctatgctgtctctcgtctgcttctcactacctggttgcgcattctcctacgaatatatcttccccaaggcagggaagatggttac

SEQ ID NO: 133306 - DNA, 275 bp, Homo sapiens
ctgcaacaggaataggtttattcaaagacctgacccggcccacgctatacgcagcatctcaccccaggtacagcagtggaagccaatctcctgtggccaggttgtagttctattccagttgtctcagttgtcagagcctatgatttccccagatgtctcctatacctgccccctcttgcctcgctagttacacaactgatctctttgtcacagtgccacacagcacagtacagcttgtctctctagagcacagcaaacaactcttgcatacacac

SEQ ID NO: 133307 - DNA, 696 bp, Homo sapiens
tacactaagaaaagataaagtagttgttaaagataaaaaacagcaatcaatgaactagtaaactaaaataaaagtagaactctgtaactaagagctggttgtttgcaataaaagagataagttgctagctaacttaaagattgaatggagctaacgtgcatactcaaaaactaagaggggaaaacaccacagataaagagaaaatataagaatcgaaatggactattttgcttgaccccaaaaatatatttgaacacttgtatgatccagaaaattttcttaaaaattacagtttatcagaactgaatgtagaaaacataaattaatccagcagtacttaaagtgcggtctgtgaggttaaaactattttcatcgtaatactaagatgttatttgccttttttgcttttattctctctcaaggatacagtggagttttccaaggctgcatgatgtgtgatgtctcagtaaattcagtgtattagcagatatgagaaacagccggacgtttctcattaaatttttctttgttttggaaaatatagttatttttaataaaaatgttatttatgttacatgttatgggtttatagtaataaattttttaaataaatttaaacaatatttagccattagatattttcaaataaattttgttttatatatttttaaattaactaaatatttaaatattaaa

SEQ ID NO: 133308 - DNA, 273 bp, Homo sapiens
ggaatccggacagtccctgagggggtcctggctcgtggttccctttgctgtttttttgttcatttatttgttactagacattggcactgctgcttctgatggatcctctcaccctgcctgctgctgtttacaccggaaatccctgtgctactcaagctgtctttagtgtggggcgtgaacgaacccctcgcgttccggagggaacaggctcctcttcagtcctccctgatggggcctgggcaacaacctggcagtcgtccccactccggggca

SEQ ID NO: 133309 - DNA, 251 bp, Homo sapiens
tagaggatccccgctacccaggcgcactcctcatggggcccagctgtcctccctggagaagaggaggtcggggggcacgcaggggcctagcctgctctgcaggatgggatgggtaactggggacaggccttgcaagccagcggacccctggtcctcaagcagaatcaatggccggccagaggctttttgttctgctccacctccaccgcggtcacacgattaacccaagtcaatagaagtgcgcctgggtg

SEQ ID NO: 133310 - DNA, 348 bp, Homo sapiens
cccccattctaatttaatcattcctcctcttctgttccataataattaggagagacttccttatatggggaagtttcccatacattccttttgcttctctagttaaaaacttccagggcaccatatctcctacactttagagtttgattcccttagtgtggtgttcaagccctttatcccctgggcctcagcttgtttttcaagtctcatctcccatcactactgtccttctaccaaccttggtgccttgctttatagaagatctctcaattccatatacaggcttttgtcattcaagtactgtgccttggcatatactattccttcctcccatccctgcttcatcag

SEQ ID NO: 133311 - DNA, 192 bp, Homo sapiens
ttgaaataacttcccagaagtaggattaatgggttagtgttgctggtaacttattgatacacattgtcagtttaccctccaaaaacattataccaatttccatttgtattaacagttcatgagtgaatcttataatatttaatcctggccgggcgcggtggctcatgcctgtaattttagcactctgggagg

SEQ ID NO: 133312 - DNA, 152 bp, Homo sapiens
ctatgttgcccaggatggtctcaaactcctcgtatcaaatgactctcctgcctcagccccctggatagctgagattacagaagcatgccaccacactcaacgccttttttaatttaaagtctattttgttggatatcagtatagccatccct

SEQ ID NO: 133313 - DNA, 271 bp, Homo sapiens
atttcttcatccaaatgccgagaacctaataagtggtaaaaatgaacagacatagtccccttatggtgactttttgtcttctattttttatctgcttttaattttaacattaaaaattttaatttaaaaggaagccataatgtattatcttgctcatttaattaattacagaagttaacaatgagaaaggaatgaaagaaagtcaaggtagggtcagggtaagttaggttatactgcagaaacaaccttacagttttcatggccgattaca

SEQ ID NO: 133314 - DNA, 412 bp, Homo sapiens
agccttcagctaagagggcatgagaatcagtagataaatgcctctgtctcctgtcctttgggaagtcaattctcaggcatatttaacatactttcttaggggttcaaggctggattgagtctcagtttcccacaataactccttctacttttttcttctttacttctgcttcttggtatcacctcctaaataaactaaactgcttggaagtcctgctcttagcctctacttttaggggagtccaaaccagctaatagcagagaggcagcttagttttggtcatgtcagtaattagaaagaaagcaggtgggaaaaaacagctttaacagagatgattggagagttgactgtgtatgtattaatagatctatatatgtatgtgtatgcatgtgtttgcataatgcatgctcac

SEQ ID NO: 133315 - DNA, 390 bp, Homo sapiens
aagagagggaaacatctgtgaaggcaatacttttgttttgttgtcactgtgtccccagtgcctaaaacacattgtggatgcttggtaaacagtttctgaatgagtgactcattctagccagctgagtggggtcgggaaaagagggacagggcacctctttctcagagctgtacctgctggcggggcattttgtctcagtcacactccatagcagccttggggtgttggcactgtgcctgttttatagagggcatcgtgaggctcagagaggttaagtgacttgctgagggtcacacagcagggagcggtggatatgaggtttgagcccagatctaatcagctggtcctcttcatgctgcccaggtatctccactgggcatggggtgagga

SEQ ID NO: 133316 - DNA, 443 bp, Homo sapiens
attacgcagtctcaggtacctttttatcagctgcatgaaaacagactaatagagacagtttgacctttttgtttccaatttggatggctttttgtctttcttttggctaagtgctctggttaggacttccagaactatgttgaatagaagcagtacaagtggacattcttgtcttgttctagttcttagaggaaaggccttcagttgttctccattcagtatgatgttagctgtgggtttgtcatatatggtctttgttgaggccatatataaacattattatgtccatttaagacaaatagatattgaacatttttatccctccaggataaaaatgcttaaccaactaggcatggaaggacataataaatggggcctttttatgttgagcatttttatcctgaagagatgttaaattttatcaaagttttttctatgtctat

SEQ ID NO: 133317 - DNA, 718 bp, Homo sapiens
catgcattcaactggttattaggcagctctacctgaatatcccagagacacctaaaacctcagcttcttcccaactcaaggcatcctccttccaacctgtttgtccttctttgtgtcttaccttagtgaatgaccccagtcaaagcagaaacccgggttacacccttaattcttttctctcctccatcacccatgcagtcaccaagtcccatcattttgacctcctaaccttgtaattcgccggctctgtctcccaaagtgctgggattacaggcgtcagccaccggcccagcccccatagaatcttttcagaggttatcctacttggtttctgatagcatttggcactgttgaccactccctcctccttaaaccacttccatgacactgcactttccttgtttttcttctacttccttagtaattctttttttactttccagcctgggcgacagagcaagactccatctcacatacacaacaaataaataaattaattaataaaaagagtgtatcataggatcatgtaggaagggtaaatatgtttcatgaaatgcttcagtttgtatcgtatgtgaactggatcccgaggaaatagtatctcttttgcagatacctcacatccccaaaatgctgaaatacacattgaaaggttttaagcttgagattcacagggtatatttaacgttttacaaagatgactttggttgctctagat

SEQ ID NO: 133318 - DNA, 416 bp, Homo sapiens
aagtgcggggacaagatcaaaagagtatacattggcacccggctacagcaagtgactcctgctttattaattagtcatagcttctccaagctaatttactctgatagggcaaaaacattctgaaatataaaaacagcaaattataactcaactacaagcctttactgtttgctttcttcaactttcagtttaaacctttgcattatgttacaagctaaatgtcccttcagttttctaaaccttagggcacaaaagctattttacatttttttcaaagacattaatcatacagtcaaatgaccatttttattctctaaaatcgggtaaactttcattgatactgttcttttaaaaagtcagtgtattggcaatgtaatttaaaagtgcagttgctattaaaatgtgcaagctcgttc

SEQ ID NO: 133319 - DNA, 547 bp, Homo sapiens
catttcaacagggtcattcaactatgttctattaaaatactaacttcattgtgagtgtccagatatgatgagttgtgccaattggaagtgagtgatagaatttcatcaggtttgtgggtggaactcagatgtactcactcctcagacttaccttcttccaggctcctttttttctaccactataagtctaagaaaccatggatccttcaaagccagtatttccaaagtgtgtgcagggagataacacttttcaaaacggattttctggtcagtccatggtaacacccaacatattggatatgcttatcctggaaattcataatgcatacgttttgtgggggttgaattgtatatcccccacaaaaagatatgttggagtctgagtgatgtgaacagcagacatttactgtctcagagttctggagggaagaaatccaagatcaaggtgtcagcaggttgcttccttctgagggctgtgagggaagggtctgttccaggcctctctccttggctagtgcttgatcatcttctccctgtgtgtcctcac

SEQ ID NO: 133320 - DNA, 463 bp, Homo sapiens
gtttgacatgacatttctgatacctaaaagtgttcatatactaacttctctctaataagacttgtttttctactctcagattttaaaaatgattttcccagaaacaaatgaagtgttgttagctagttgactggttgtttggcattgtctttccatcaaaattttttttttcatttaaattttgatccatagagtaaaagatgagcctccattattttgtatttcactagtgctctaaaacttagcaaagcacttacgtggtggagcaagactccctggctttctggggaaagattaatgtttggtgtggcttcaatattagggtagttactatagcttttacccatatatctataatagtataatttaaaatggtatttttgataacagtaatttcatataactaagcaaaatgaattatgccccatggcagctaagaaaagctttattgctatttagaaac

SEQ ID NO: 133321 - DNA, 368 bp, Homo sapiens
ctggggtaagtttcccttgttcctcaagtaagacaggatatactttgcaataatctaaaaaatctagatgtgacctggacaaagagagagagacaaagtataaaatgctttcttagggataactcatactcttggtgacaagaaatgttaatggtgtcctgaaaccttttggtcagtgattgctccattatgtgggaaaaacataggaaaataaacataggaaaaacaaaggaaaataaaagactcatagtacttcaataaaagttgtcaccaaatcccaagaaaatgattgcattggaaggaatattctttttgttttaattgatagtattttaggaagtagctaacacttgttcttatttcctagc

SEQ ID NO: 133322 - DNA, 342 bp, Homo sapiens
atggtttcccagctctggaattaggactatgacccaagaccagctggggcctcagacagaggaaggccaggaggggaggaggatctgtgccaggaactgccagctcacatgccgtctcggggttgcaagttatcacttaagcccatttctgagctatgggggccttacctactaaagaaatggcaagttctggcaacggactcctgaaggaagaagcactgcctggaaaaaatgctctcaccacgaaagctccctgcggctgggagaaaggcagagggaacagggagcaccttccctggctggccacagcacgaggctgtgttccaggaagagcaacagcaa

SEQ ID NO: 133323 - DNA, 249 bp, Homo sapiens
tcagaagctcttttagcatggatcctacctgccacctttaaggtgacatcattcaggtgacccccaggctgctggtgactatattcttggatgaagtcattgaatgagatgtctgcatggaacttgtgtgggtatgggtgttccccattgacattcagttgataaactgcctgactatggatcttgtagtgttgatttgggtccaggctcttctcctcagtacccacaccactgtcagtggtatggttg

SEQ ID NO: 133324 - DNA, 304 bp, Homo sapiens
aattggatgctgtctgatatttccaaaaggataccatgcttgatgagatcaaaggaggagaggatgactcagaaaagacccagaagagctcacagtgctcttagcaggatgcttagtgacatggagtcctctgacagcaatagtgcttggagacatttttacacctatggccacaggcacatgcatacacacacaccccaccaccacaacaaaacctgctgcacagatggttcttccttaactgagcaaagtgtaagaatgaactttgagccaggcacggtggctcatttctgtaatcccagca

SEQ ID NO: 133325 - DNA, 487 bp, Homo sapiens
  misc_feature (193)..(193): n is a, c, g, or t
gcacacagaccacatgtacagcatgcacacacatacgtgcacgaaagtatacacacgtactcactgcacacgctcactgcacatgcactcacggcacacacactgcatgtacacacatctgcacggtactgcaggcatgtgcactcactgcatacatgtactcatactgcatgcacaggccctcactgcacancagcgaccatgcgtgtacacacatccacacagtacatacaggcatgtactccgaacacctgcacacactgtacacgtgctcatgtacacatgcactcaccacacatgacactgtgcacacacaacatacacccccacacagtgtacacacacaccatacacccccacacatacacaccatacacccccagtgtacacacacacacaccatacacccccacacagtatacacacacacacaccatacacccccacagtgtacacacacacacatacacccccacacagtatacac

SEQ ID NO: 133326 - DNA, 308 bp, Homo sapiens
aaaactggtgtttgcttctaggattctctagcctttgcattttgttttagcggcgaaaagcctagaagggggcctgggcagtcagtgctgtcctagttctttgcttgactcccccagactgtgtggcatgttgggggaccctatgcctgaagggggtggaatgaaagaaagatagcagatcaatagctgggactcccacctattgaattccatgtggcagttccaaaggtttgcatttaccaacacggatggatcaccaagatgacagattggggtggtgggggagggtagcaagacaaagggaaaca

SEQ ID NO: 133327 - DNA, 277 bp, Homo sapiens
ctgggcgactcccctcggcccccgccccgcgcgctctgtggccgcgccccggccccgcccctgccagcgctactccagccaaccagaggccgattgatctgcataactcggcgcgccccgcccccgccccgcccagctctcgcggtcagaatggtctctacgccgccacgacgtggcgggaaggaaaaggcgccaaaatggagggggaggggcgcggggcgtgaggggaggcgggagctgggtgtagggccgcgagggaggaaggatggggaggggc

SEQ ID NO: 133328 - DNA, 727 bp, Homo sapiens
caaaaaaaaaaaaaaaaaatatgttccagtataaatgttgggtagattcctaagtgtggaatttgagggtcaaaaaggtatgtatttaattttgttagattttgccaaattggcttcctataaggactatatccatttacactcccaccaaccgcatatggacttaggagccaggaggtctgggttaaatcctggctctgccacttgacagccatggggactgagcctgtgtcctcatctggaacctgagaataagactgtggttccaggaaggccatataaagtgtgccacaggctggtcaccacgaactcttctcaccaccacctctcctcaccaccacctctcctcaccaccacctctcctgccttttctcaccaccacctctcctgcctcttctcagtgtccttccctccagaactagggtccttgatagtcttccaggcccatagtaacgcacagagttgtcataaggcccaagggaaagaatgtgtgtgaagtgctctaccaaaaatgtgggaagggctgtcaggacacgaaatgtcatttccgtcttctgacttccctgccagtgaaagctgctttcggtactggaggttccgtctgtgaccaagggcaaagctcagctaactgcctcaccccagcgtcatagctaaattttggtctccttcatcacaggaactgacttgatgcatgatgcaatcaacccacaggttctcagtacaccac

SEQ ID NO: 133329 - DNA, 491 bp, Homo sapiens
ccttcccagtagctgagactactcgtgtgcaccactacgcccacctaggctctgatcctaacttgctataagctacttgtgtggcctataacctatagctgtttttttgagatgtagtcttgctctgtcacccaggctggagtgcagtggtgcaatcctggctcactgcaacctctgcctcccaggttcaagtgattctcctgcctcagcctcccaagtagctgggattacagtcacccaccaccacgctcagctaatttttgtatttttagtagagacagggtttcaccatgttggccaggctggtctcaaactcctgacctcaaatgatccacccacctcggcctcccaaagttctgggattacaggtgtgagccaccattctggcccctataacctatagctttctaaaccaaacgaacaaaaactctatctcatatataccttcttttggattttctttctttttgaagcaaaagtgaaatatccct

SEQ ID NO: 133330 - DNA, 746 bp, Homo sapiens
ggtcatgggggatggagcatgggtgtcaggcgtggcggagttgccagcgggtagacaggaagtcactgggactcccttggtgtccttatcagggtgggtgacatctctggggctgtggggaaaccccggagcctagaggtcaggctgtcatcctgcagatccccctctctctgacactccttctcccttctggtaccccaaccctgtctgtactcaagcaggagactcgtagggcagagcaggcctgcaggcccatgggtgcggcaggtggcatcgactgttgggaatttgccatggggaagaggggcaagagggagctgggactgggaatgccagtggggtctgggctggtcttcaggaatggatctgggctgtggccagcagataacccttctttactgccttggggagtcagagagggctccagtccagacctggatccacctctgctcccatctgaccacctgtccacatccctgtttcacctcttgcatctcatctctacctcagctcttttgttcagccacagaatcaagctggcctcctcctccttgctccttaaacaccaatccctggtctcaggggatgtcccaaaggccgctttccccactatattcagtccgtgcacaggtgtcccttcccagagagcatctaagctgcccatcccacctccatcactctttcccctttcctggcttatttttgttccataattcttaccactggatttatttatttatttgaga

SEQ ID NO: 133331 - DNA, 709 bp, Homo sapiens
gtgtgaaaggaaagtttgtgttttagtcaagccaaggtttgaatcttgctctacccagtggtgattatgtgccctaacttcagaacttcagtttcttttataaaatggaaacaaatctacatacgagtttgtgcctgatcttgagttaactgtatgtttaatgtatttagtgctgctaaatatatatatatgcgtgtgtgtgtgtgtatatatatatatattttttgacggaatctcactctgtcgttcagggtagagtgtagtggtgcgatctgggctcactgtaacctctgcctccccatttcaagcaagtctcctgtctcagcctgtggagtagctgggagtacaagcatgcaccaccctgcccagctaatttttgtattttttagtagagacagggtttcaccatgttggccaggttagtcttgaatgcctgacctaaggtgatccacctgcctcagcctcccagagtactgggataacaggcatgagccaccatacctggctgctaagtatattttttgaagactcaccatatgtgttaagtggtttggtaaaatataaaattcatttctaagcaagggaatccagattttttttccccctctagggctctgtttagaaaggacagggttgaaatctaacccagaagattaggctagtggcaaccatatgtaatctctaactccaccattttagtagatgagga

SEQ ID NO: 133332 - DNA, 461 bp, Homo sapiens
cctagaggatccccgcgacccaggcgcactcctcccggatcagtttgaagtcaatcccagacatcctatcatttcagccatcaatattttaataatgtatctctgaaaaataactcttttaaaaacattcaccataatgtcatcacacctaaaaatatcacaaagaaaattaataggcagaactattgttgaaacttctcaaccaccccttacaattgtctcatctaccactaactgccaacacttcaggaaagagtgttctagaagatgagggggaggtaggaaaataattcaacataatcccttctcctctcatctctttccctaagccagtcaagactttcacgttgtgtaccctttcttttgttctgaagcaatatgcattttggatatttacataattgcaacaagaattgggtatcctgttttcttcccttggcattatactattagcccccatt

SEQ ID NO: 133333 - DNA, 213 bp, Homo sapiens
tgtggtaatcattggaaaagtggcaagagagaaccttccagagtgatggaaaattctagtttttaatctaggtggtaatcatgcaggtgaatacattcatgtaaaaattcacctacctctggaactagagagtgatggtgtttacaaaatactgtgagtgtattaaatgccattgaattttatactttaaaatggttaaaatggtacacttaa

SEQ ID NO: 133334 - DNA, 283 bp, Homo sapiens
ggctcttagcaagcagtgcttacaaagttaggaaatatttgtaaaatgctgccatggtataatgtgaagcgctcaaacaagtcagggctaatgatgcactgagaattatttctaaattgagggcataaagagttacagttcttcgattttaaaaagcaaagtgacttttaatgcatcaaatcttactgtagccagagtactgtaacttagtttccatcagaatggaaataagtagttactgagcaagcagctggatgagccctatgcttgatgatacatattg

SEQ ID NO: 133335 - DNA, 664 bp, Homo sapiens
tgaaagaattaaaagtaaaaataaaacttgttagccttacagtcagaacatgtgggtaaataaatatgaaaagagcgaatagttaagctggcttaagaaagagatttaattgatagaaaaattaaacttttataggagagtctgggtaaatttaaccagtaagtaaaaacttaaagtccaatctcaacatatataaaggaatctgtataaactatatttgaaacctggatgtatgtgctcttcaaaaagttattagataagttttagatatcataaatattatcagaccagaaatggtgtatggaactcacagatatctaagaagacaagaggtgggatctcaaaaatcatgctctgatttccctaaaggatcagaagatctcagaatttatggagcagtatctcctcaaatcagaaagtaaaggatgcacacaaagaggaatctggaaaacctcccctttatcactggatggctatataaacgttcttaccaaaaatctgagaagacattcagggagatcagcttcgtctacttcaagcattattaggtggtcttcaaagtcttaggtgcattgaagaaatattttttaacgtattattgaaatggtatttgaatggaatattttgtaaaaataaagcacaaaaaaagcagatagataggaga

SEQ ID NO: 133336 - DNA, 268 bp, Homo sapiens
cattattccattctatctacttttgagtatgtttgaaaatttccattatagaactttgtttaaaaagagagaacaagaacatgttggcttagcaacagaaaagcatacatatgttcagctaaagacatgaacaagaatgttcttaacagcactatttataacagccccaaactggaaacaacccaaatgtccattaacagaagaatgaataaatagccgggcatggttcttagtgcctgtaatcccagctactggggaggctaaggat

SEQ ID NO: 133337 - DNA, 485 bp, Homo sapiens
gtccagagcaagccgaaactttcagtgaacatcctaaggcaatctgtattgaaccaggttcactccaaaaacccagttggggccatttctcaaggagctcagaacaacccgaggaatggattcatgggctgtcctaaagtagccttactcacaggtatcagagaattcacttgcttctaggcccttggattgctttaattctttcaattttcttttgttcaacaacataaaaaatatattctacttattgcaatttttacatgtcacattctgaatattatcctgtaccagtggcttcttggttgttatataacttgtttggtaaagttatgctgacagctttaatgaggcgatgtcatgtgatgcacgaatttcccctggtgctgaatgtggacattagcaactcagtatcgtgtgttagggcagtggagaatcagggtgtatctaataaattccttcatggagctctcatgccattaagcaga

SEQ ID NO: 133338 - DNA, 408 bp, Homo sapiens
tacaaatgagtggttccatcatttcatgagctcttatttaatataaaaaccctgcaaaatatatgttacctactttttcttaaatctattatttacaggccgggtgtggtggctgatcacgccactcccagcactttgggaggccaacgcgggcagatcatgaggtcaacagatcgagaccatcctggccaacatggtgaaaccctgtctctactaaaatacaaaaatcagtaatcccagctactcgggaggctgagacaggagaatcgcttgaacccaggaggcagaagttgcagtgagctgagattgtgccgagattgcgccactgcactccagcctggtgacagagcgagactccatctcaaaaaaaaaaaaatctattatttgtaaaggcacaaaacaagtctc

SEQ ID NO: 133339 - DNA, 461 bp, Homo sapiens
cccaaagtccatcaactgatgagtggttaaacaaaatgtcatatatatacaatggaatctgtaaaaaggaatgcagtactgatacatggtttctggatgaaccttgaaaacattatgctgagtgaaagaatccagttgcaaaaggtcatttattgtatggtcccatttatatgaaatggccagaataggcaaatctatagaaacagaaagtaagttcccaggtgctggggggagtggagaatggagaatgactgctaataggtactgggttgattttgtgggaagatgaaaatgttctgaaaatagatggtggtgatgattgcacaactctataatatatgaaccagccatttaattgtatatttttaaagggtgaatttccctacttgcttcagcaacatatatactaaaagggtgaattttatagtatgtgaattatatctcaataaagctgttaaaaa

SEQ ID NO: 133340 - DNA, 208 bp, Homo sapiens
ccgatcgtttcatgtgtgctgatggtcttgtcatgccacataaactaatgaaagcagaaactatgcccactggcttctgggtgagttggggaaaggaactgcccttctttgctgagtactcatcaggtgctatgttcagtgccaggcatttcatgttcaacatctcatttactctgtgaagactcataactgtaaattctcctcaaca

SEQ ID NO: 133341 - DNA, 330 bp, Homo sapiens
ggctatctctacatctaacagaaaacactggaaatcccatttgctgttgctaggttacctttttcccatgatggtaattcttttttaaaatcctaagtttttcattaatgtacgcccattagagaaaaattagcaaatagaagaagaaaggtatgtaattctctcatctcagtataatagttcacattttatcatgcacttcttttctgttatgtttacctgtgggtatggaaggatgtatacaatgtaaccacacatctgtatacatgtggttacatacacacacacacatgagatcataccttaactattggttagtaccttgctttt

SEQ ID NO: 133342 - DNA, 486 bp, Homo sapiens
gccttctaataaaccaatggtctatgtttaagcacacaaagggagtctattacatactagttgaactacttgttttttccccctgaatctccagaactatgtcctgtgtcctctctaggtctccattacttccacttacctgttttcagaagcccagccctgttgcttagtgctgtgataatagttcttaattgaatacctataatgctagacataccacaagccttgtcacaaatagaatggtgacaatgcctgcaaaaattcttttatgtaggagaaaaagcaggaatttaaataggaaacttgaacttttaatcaatttgctgctattactaaaattagtctttacatagtgctctattagggggaagcagaatgatttttatatgatgaatcttttatcctttgtaagttgagtgaacttcctggattgatataattagagggcctgtcattatgcctggcatgggaacctgcatttcaagc

SEQ ID NO: 133343 - DNA, 648 bp, Homo sapiens
cggacacaagcggctggacgtgaagaggaacacaccggcgggagaacacagaacaccaaccctctctttagtcaccctggaggcctcggagaaggcggtttcggtgatccgtgaagagaccccgagtctgttacatcccggagaatgacaagagagcgagtacctgggtgacgtttacgttctgggatttcgggagatgcggttttctgcacgccaggggccaagcctgagacgtagatggacggcagggataggagctctctccgcgccacaaacgcccctgctcatacctgggttccttgattttcctgcctatataaccgagcctcccatggccgggctctgagctctcattctgcggactgggacaaaggggttaactgtgatgcgctttgtataaccccaggattctgcacttgcccaagggcgaggcgcaaatcaaaaactacgcacaactgaacaccgagatcaggtgagtcctgagtgtctcacgacataaaatccttacgattttaacaagagttgtatttgtgctagcactgttaactgacaaacgcatgccagatcccatctgtctttaaagctcaatgtgtgacgttagacacgtcgttttgctcttcaactttcttatttggaaaaaaaaaaaaa

SEQ ID NO: 133344 - DNA, 970 bp, Homo sapiens
gacagagcaggttgtgtctgtgtcaagcccttgctggaggagagatgggacttgagctcagcctgggaaaagccaggttaaagtgagccgccctttgcccatgccctctccccgtgttgttcatttaggtcgtgcttccacacatcatcttccctttcaggaccactcaggctgtgaatgagtggagtgactgaaatagttgggagccattgaggaaaagccggagagagaggccacgagaactagcattttggggttacttagcacacgtcccattacttatcacacatagaggtctcaaaaacatcaccacaggcctgcctgaccctcctgtggcttggttgtcccttaaaggaaggacacagcagatcctttgagacatctccatcttcccattttcctccacctgggatttgtggtccttgagcactctggatgcagatccattggagaggggatgggtcctcagatgcagtctggtggcgtcatcttgtcttttccagactcctggccagcgacttgttgacttcctcctgggacccagtgactgagggaaatagagccagccaggatgggagaaatgggaagcacgtggcatttactccatgaaagaaaggccacaagcccttctcagccagcagtcccaaggcatcagttaccagttgtaatggatctcaaatggtgctaattactccatccctgggaaaatagaaaatagtcactcagggccgggcgtggtggctcacgcctgtaatcctagcaccttgggaggccaaggtgggcggatcacctgaggtcggaagttcaagaccagcctgaccaacatggagaaaccccatctctactaaaaatacaaaattagttgggcgtggtggcacatgcctgtaatcccagctacttgtgaggctgaggcaggacaatcgcttgaaccggggaagcaggctatggtgtgccgagatcacgccattgc

SEQ ID NO: 133345 - DNA, 1073 bp, Homo sapiens
caggatgttccttttcatatttaagacaagcactcttgcatacaaattacatagctgtgggctgaatgaagatgctaccattgctgtacttctacacaggttcttttcatgtaatgaaatcagaagggatggcttttccatttcaagcttctgttaataagtagtcttagaattgcctttgtgtactgtagccaacaccccaactcatatatttttataatctttgtgatgcagaataaattctgaaactttccacctcctaattaaatatagaaatactgaaaacaataaagcaccatgtattcactatggacatatgtcacattttgtcactttcttgcactcttgtaatccctctctaaagctcatgttaaactcatgttctttattttcttctcagatgattcctttggcactgcatgtaacagtacaggaatttcttcctttcgtacttccaacaaatacttttttgtctcttaacagatgtgaaccataatgctgttctttagaaagcaaaggatgaagtgcacagcagtgttttctatataaagctaatgggtcataaggggaaatatgggttatttccagcttgttaattgtcttaatacatttttcctaagaattctattgtgcctctgtggttatatgcaccaatattgataatcttacagcgtgccataaataaggatttttatattatctttgctaaatattttaagtttttgttttgggaattgaaaaaatcttttgtgcatctatggtatgtgatacgtatactaatggataaatcctgtttcacacaaagattaattgggtaacatttttctttcctagttttctgaagtcagtggtcatgttgtgtgttggtgattgaaaatatgctgtttaggctgggcgccttggctcactcctgtaatcccagcactttgggaggccgaggcacacggatcacctgaggtcaggagttcgagaccagcctggccaacatggtgaaaccctgtctctactaaaaatacaaaaattagctaggcgtggtggcacacgtctgtaatcccagttacttgggaggctga

SEQ ID NO: 133346 - DNA, 288 bp, Homo sapiens
  misc_feature (17)..(17): n is a, c, g, or t
gtcagactctagagagnatcccgcacccaggcgcacttctccagcaattggggaggggatagagagtgctaccccagacatgatattctgcattattcaggccacacctgatattgtgtgcacgtactcagagaggtatctagacagctccaggactctcaaggattaaatggccagcttgagtcagtaccacaacctggaggccttcagtctctgagaagagaagactaggcatagaggctggggaagcaggtgttcacttcggggccccagaagtgcgcctgggtg

SEQ ID NO: 133347 - DNA, 175 bp, Homo sapiens
tggggccaattaacatacaattttccacttcttatgttaccaagaaggacattatacatacacacacaatcactcatactcatatccctctcctaatcccatcattgtatgaaatgtgatagcccataaagggaaatcctaatcaaaaagctaacaaagagcaaaatatatttct

SEQ ID NO: 133348 - DNA, 450 bp, Homo sapiens
cattaagtggaaaagcaggcaggtttaaattggactgcagagttatcacaggtagagaaacaaaattagtttataagaaaataaaaaagaaagcactccttattactcacccacatccctcaccttcccctgtgccagcgttggccctgggcttactaggatgtttaaaggccgacaagaagaaatcctcatctacagccttagcacttaatgtgggtaaatgtcaactgttggtacccaggtgttgaatagcgtctgcctttacttttaagcaataagacaagataggctgaatacttgtgggtgactattgctttgctcaagtgaataccaaaatgactctgaacacatgagaaacataataattctttcgaaatgtcctgactgaagcacctcattttagattacaaaatggatttcatacatttcagctagaaagaaagaaagaaa

SEQ ID NO: 133349 - DNA, 522 bp, Homo sapiens
tataagtaggatgtactttattgcctaagatttgactccatgggagctctgactgattctttctgttgaccactgaggctactaagtggggagaagttgtagccagcttggtccctgaccaaggggagataccaactctgaacattgtttctgccaagctgggagtggcacagtttcttctacagactcttgctcttctccacctccagccctgggtctacatattcccctggtgtcctcaagtccagagtctctccttggatcttgcacagatgggaagatgtgggagaactgaggtccagcagttttgtgtgcagactttgacccagtcaccccattgtcagtgccatgctttgttctgccttctgcaacccctggtactttcaaattctgagtggcttcaggttcctgcagatatgttggctcacttttctagaatatcccctctataggagtgtaggctgtggctgccaggaaaccctacttcatgtattttttatgttttaaaaaaattttgaggcc

SEQ ID NO: 133350 - DNA, 534 bp, Homo sapiens
tacgtcgaggcggaatgtcatgctaacatggctagtggtcagtttgtatcatgcacgtctgtggactggtaaaaacccctgggcgacaatcataaaaaagcattccataacttggatggaaccagttaaatttctggaaggaggcagtatagcatggattatcggaagccctgtgtcttcattgtcggtttctttctccctgctacttcctagctgtgggacttcggacatgtcgcccaatcggtcgcaatagttcctccttcttagtattgctgtgctgatgagcaagatgaaacatatcaggcttatagccctgtgcctagccctgctacacatcaataaaatggcaacgtctgtcttcatcattagtagtaataataaaaacaacacactcaggatctctctacctaccctgcagatttatgggttggaggtgccttccaaagaagaccatctctgaggtccatctaatgtagggactttctagaacgttatacctaggctttctcttcctctgggatgcagagaaatgca

SEQ ID NO: 133351 - DNA, 164 bp, Homo sapiens
catcccagctgcagaccggggcctctcctgaattggcacctcacctttccttgtcctcatgggaagctcacacaagccacgagcaggtctcatgctccttggtttacaggtaaaaagcagagaccacaaaagtgacttcctcatggcctctcagtgataatggg

SEQ ID NO: 133352 - DNA, 763 bp, Homo sapiens
gctattagtattactagttatttttttgagatggagtctcgctctgtttcccatgctggagtgcagtgcatgatctcggatcactgcaacctcccaggttcaagcgattctcctgccgcagccttctgagtagctgggattacaggtgcccaccaccacgcctggctaattttgtgtttttagtggagacggggtttcaccatgttgtccaggctggtctcgaacccctgacctcaagtgatctgcccacctcggcctcccagagtgctgggattggcctcctaaagtgctgggattacaggcatgagccactattcccagcctattcctctttttaatagtaatttataattaacctactaaaaatgaatattgcttgaacattaaaaaccagcttgggataaagctaggaaaattgcacagtgacttatcatttgactcatttttaatgtaccgtttttatagtagggtatcggaatgactagggagaagtctttcttagacagttatttgggacagaacctgagaatgagtgatctcatacgtacaaaaatatgaattttgtgccttactcatggcaaaaatgttgtaggaattggggcataaaaagtgtgtttaatttttttttcttttaagcctatttcttttttgaggatatgattggctactttctatatccttcttcctgctaaacagcttttgaattattttgctaatttgtcgttaagttttacttcctgttgcctaaggacagtttagaaat

SEQ ID NO: 133353 - DNA, 552 bp, Homo sapiens
gatccatttgatgctttcctttttacttacccagagactataacttggagacagaacttatggtacaacacatggaagtgtctcatgagagtgcttaccagatacagacaataatttaaacatttctattctggagacacacctttgaattctgtgtttgaatatgtgttataagcaacatgttccacatttacccaaagattcccaaatcctgaaacttattacataatagaactgaactaattttaaacctacctccacagaaagctgaagatagtcataagatccatgcctaggatgtacacacatacctgtactccctcatccagaagcagaatgatcctcaaaatgtgaattttgagagtgaaataatgagaaacagggggaggggcagagtctgctgtatttaagtcggtatagcatattgacatcttagatgttctcaaagggggttatgtttccaaaatactatgaagacctcgatatagtgaagtctcacctctgacgtggtcatttggtattttaaaatttttgcccttcacattcaaaagt

SEQ ID NO: 133354 - DNA, 658 bp, Homo sapiens
tggcgccattgcactccagcctgggcaatagagtgagactccatcttaaaaaaaaaaaaaaaaagaaaaattgtcacttaattagttatgaaataaaatcctttcggattccttagttacttgtcttcagccagaatacacctctcctccaaggaagtagggaaagaaataatccaagattaatgtgtttttgtttggcctagacattgcttttttaaaatgtgagccaacatttttagtatcaggggatcttgtctaatagttcagactgttgaaaaaaggaagatctggcaatatactaagtctgtgtttttgtgtggcagaaagaggctattgctgagcaaatggctgcctacattagacaaggcatgcttttccttgctcaccatagttacatcaatccctgttttcttcttaaccttgaggccactgtttatagcaccatttgtcatttctcttgcactgtaatttttttcttttgagacaggatctctcgcccaagccagagtgcagtggcaccattacagtcactgtaacctcaaattcctaggctcaggagaatcgcttgaacctgggaggcagaggttatagtgaaccgagatggcgccattgcactccagcctgggcaatagagtgaacctccatcttaaaaaaaaaa

SEQ ID NO: 133355 - DNA, 470 bp, Homo sapiens
cgtctgctgcttcgatgacctgctgtcatcgtgttgcctcccctacgtctggcagtgcgcggtctaacctgttgaaccccatacttgactgcgtgatcgcgcggattgcgatcattccccattatctacgtgattccgctgtggtgcggttcttgcggcctctcggtagtgaggtctcatttgttctcctggtcttcactgtatgctgtctgctatgcttgggtccctgccttttatttctttatgggtgattttcatctgattgccttgctgcacaggtacaaagcaacagatctgcagaatgaaaacagctggggaaccctgagtggggtgagagtagaatggaggaggtggtggtatcttcttaagggggtactcatggtggaagggtcttcgtttttcttggggaggattccctttgtgctgtccaaggagacttccttacaccatgggctttggacatgcttggt

SEQ ID NO: 133356 - DNA, 320 bp, Homo sapiens
tctctcaagatctcctgggtcaggggtcaacttctcacctgtacttcagccaatgtatcctcctatgcttgggtccctgccttttatttctttatgggtgattttcatctgattgccttgctgcacaggtacaaagcaacagatctgcagaatgaaaacagctggggaaccctgagtggggtgagagtagaatggaggaggtggtggtatcttcttaagggggtactcatggtggaagggtcttcgtttttcttggggaggattccctttgtgctgtccaaggagacttccttacaccatgggctttggacatgcttggt

SEQ ID NO: 133357 - DNA, 269 bp, Homo sapiens
accaacaaacccaacaaacataatcctttatgttgtatattctaaaatttaaaaactcaagtaacagaaactaccctttgtgttttgcccactcactgccatcccccttacctctcctgtggaacttctgtgatcttttcagatatttatcaacatcccatttcagagagcccacttatcttgtttactgtgactctcctagttttcaagacatagattgaaatctattctcaaatatatatcttacatcacttattgcttgtattagg

SEQ ID NO: 133358 - DNA, 167 bp, Homo sapiens
gtctatagcttatgtcaaattgtcacacaaattgtgatccaaaaaataaccatacctcatgttttattgagcacatagtgtatgttaggcactgtgctaagtccttacatatattaattcatgtaacacaataacctttaatttttaatttttgtgggtacacagta

SEQ ID NO: 133359 - DNA, 395 bp, Homo sapiens
ctctttttgatagagtcagatcccccacccccgacttccaaagagcccctccgccccatgtatcttgtgcagtggagtctgtgcattgctaacctgccccaggggtctgctgtgcccacagtctttattcttcagcgttcccccacatccgctccccaagttaacttactgcccctaaccccctcctcaagccctcattgcttctgtaagggagggtctcacagccctgccccagcccaggcccctaaccccctcctcaagccctcattgcttctgtaagggagggtctcacagccctgccccagcccaggcagggtgaggaccgccttgccctcctgtgcacttcactcttcgacctttctctccctgccccgctcttccggccatgccttgca

SEQ ID NO: 133360 - DNA, 108 bp, Homo sapiens
agcaagttttccaagtaatattttaagtatctgtggggttttttttcttttgtttggtttttttaaataatgaggaaaaagtaattccccagagggaaaactttttta

SEQ ID NO: 133361 - DNA, 748 bp, Homo sapiens
gtgatgtgagatgcaagaactttgtgcctgataattgttgtccctctgagtcctgtaggatgcctatatttttgaaagcaaaaggagtaatgcctgctaaactttgcctttttcttctttacagactcactagctgagtttttcacattgcctgccagtagacactttggctgacctcaaagggcagccagctggacacagattttcaggaaggcacagagcagttctgatccttgcctagcacttcccttgagcttttataaatggaacttgatatgcctatcctggaggactttgcaaccgggtaaaactaaagaccacacatacaaatctgccatacgtgtttagagactcctgacagagtttctatttcatgactcacttgggaaatatggagcacctttgtaatatgctgggtctggagccagaaaggatgtgaagggaatctgagacactgtcctctgacaggtgtttctgctactatgtgtttgctaacgtattggtggtagtcacgcggaaaagtgtgccatgctccagtaagtttgtgaaagtctgtgtaatattaagttaaacaagtttcttcagagcctttatttgctgttgttcatagtgaattgctaagtattaagggagctcaaatgactctaaaatcatttttttattggagcatcttgtgggactactttcctttagaatacattttcacaaaccctggtaaaaatgctttagcacgtaggctcagggataa

SEQ ID NO: 133362 - DNA, 149 bp, Homo sapiens
gatgactgtgtattctccgacttctgctaagaaagatcccctatgaaacacatttttgaatctctgtctgcctgaatatcaaatagtccctcagagtctcctctcactcaggatgatttgtcccatggggccctttcagattatctaac

SEQ ID NO: 133363 - DNA, 741 bp, Homo sapiens
ctaaaaagagaaataagagagcaaactatatatgtatgctttatatgtgtcagtgtgcaaggaattgtgcaagactatatgagagatgtatgtacatcaaagatgatatttgatagaagatatgcaaaactttgtatgtgagacagaaggaaacagtcctaaaggaaagacactctcaaaacttcattccctaacaaagcgaattgtagctttgaaccatgtctctttaattagagttgctgttgatatgaataatcaaaggtcttgatcatgctattattggctttgatgcaataaatagaatggtaatatttttgtgagatgggaggttgtatagtaaaacacttgtgttccgaggctgaacagtttgctgaggcgctgtaagattattgtgaagggcataaatacttagtaactttgccccctaccccaatttagaatttctgtaagagaaagaaaagtagtgttaaaggaagaaaaaaagctatgctcgactgggttgtagtgattggattatgcaatattgatttactgtcataaattgtgcacaaccagattttgctgactgttgtaagttgagcttataacgtgtcagaaatccaaatctgttttatttctaatatgtgagtagaatttaaattaattcaacagcaatggcctctgtgttcttttcagtaatgagaagtatcatttacatcaccactctgttctttggataaataaattttttaaaaaataagg

SEQ ID NO: 133364 - DNA, 229 bp, Homo sapiens
aggaggttttcttcaaaataaaaggccctggagacattaaaaggaaactcataaaaaattcatctctgagtagtaattgcatcataaaaagtattgagttggtgtgcagatgcaaattgggccgtatgaattaatgatgtaaacagttggaatgagggtgcacattcagaaaatgtcctacaccgtcttcttcagtgtgtgaggcgaagttgggccaggtggcactgtg

SEQ ID NO: 133365 - DNA, 1780 bp, Homo sapiens
  misc_feature (71)..(71): n is a, c, g, or t
  misc_feature (443)..(443): n is a, c, g, or t
  misc_feature (576)..(576): n is a, c, g, or t
  misc_feature (825)..(825): n is a, c, g, or t
cgtaatacgtgctcattccatcttcaatggaacaaatgaatgttgctgcatcgagcatctgtttactcacntcttcattctctaaccactctattgattctttatcttgacccgcaagcatacttacgtctcatcttggtgacaaagagccctcccgtggcccaggcacctcgctgaactgctctcttatttttaaccgcactgactttgcccactcaacacttcaactctgggcttttggtcctccaggcatcttgctgaaactactctcttgaaggccgccagtgagttcctacaaagtgttactgtctgtctgaaatccctaaaatttccaacaatttaaaattgttctcccctttaacattttcttcttgattgcccgcatttctgagcgaggcataatgatgtatgcaggggctggatgccatggggcctggggtttntggtaaaatgtcggtaaagtaaccacacagcaaaagggatagtatggccctcatcttaatctctgctgattatttatgaatgggcacgggtgggggttcattatatctgcacttttgagtgtgtatggtttantttaggtcgtctcactctgtcgcccaggctggagtgcagtggtgccatctcggctcactgcaaccttcgcctctgggttcaagtgattctcctgcctcagccttccaagtagctgggagtacaagcatatgccaccacgcccggctaatttttgtgtttttagtagggatggggtttcccatgttggccaggctggtctcgaacttatgacctcaggtgatcctcctgccttggcctcccaaagtgctnggattataggcatgagccactgcacctggcctgtgtattgtttgaaaatttttatgaaaccaaaaacaaacaagtttgctttcatccttgggcattgatggcgtccgacttgcccagtggcctcctgcctccttgctgctgctttgccggagttcaccttcctcctgcttctcccgggctctgcctttgccctcctttctctctctgcagtctctcttggctacttccgccctgccaggatttcagtgatcattcctgtgtctctaattcccacagccctcaattgtctccccgggtccctggtcctgagtttctaatgatctgccgacatcccctggatatgccctgtgtactctctgtctcacacctgacccttttgtatatatacagttcttacttgtccttcaagatcttgcttgagtgccacttcctccaggaagcccttgctgatttctcagtcagatgtcatttctcccacttcattattcttaaatgacttcagcatggtctgaccttattacttagattttgtattctagttttgtgggaactgttcctggaatactagggttgtgttttccagagatccaacatgttgtgggaccttgtacactggaggcaattcatactttgtagaccagttatgatggtaaatggaaaaatctgaaaaaaaaaaagctgagaaaaatggttccaccaaagtattcaaaattgcttttcatatttcagaattgacatataagagtaaaaagaaagtaacccaaactgcagtggtgctgtggggctagcataaaatgttaatcaggtaaataggaactcaaaggaaatttaccaaattgagctcatttacatgtgtaattacccatctgtgatcattctactgttctatttattctgtctttctcctcccacactgggttaaaaatactttgtattaaagattttcttcataacc

SEQ ID NO: 133366 - DNA, 549 bp, Homo sapiens
cgtggctcccctctcagaagctgggctcagctgggaagtgacccgaggtccccggccagggactggggagcttgagtgggacaccagggtcccagagctctgtccctgggatgggacgaatgtattaggacctcgaaggaatcttcagccctgttggaattcatgcctcttggaggtgagaccttttccacagacagttaacaccgacacaggtgctcgaggaaacagagctgcattttaggcgtgattctcaccatacctccatgtttgggtttttcaccaggcaaggggcttgcgaaagacacagcgaagctccggttcactcgcagccaccgcctctgggggacttggtgggctctctcctgctgggctctgtcagggctctgtccagtgctggccgaggcctccccatgtgcagggcactgccctgtagcctccccggtcccccagaaaaaccgcaccggcttggccaccaccccagaagccaggaagccaagagcagctcaggcctaccagctcccgccaggctcccctcttcctactcctgcc

SEQ ID NO: 133367 - DNA, 878 bp, Homo sapiens
aaagataaaaacatttgccatcttcctatacaaattataagctgtctgaaattattagaaggggatgtaatataggaagtgtattgtgacaaagctaatttttcaaacttttggggatattgtactgaaaacaaaaataagcactaatcaatgtcctcagacttacctctaggataaaataaaattttagttggactacttcatggaatttccctcattactcttaacttttttttttctttgagacggagtctcgccctgtcgcccaggctggagtgcagtggcatgatctcggctcactgcaagctccgcctcctgggttcacgccattctcctgcctcagcctcccgagtagctgggactacaggcgcctgtcaccacgcccggctaatttttttgtatttttagtagagacggggtttcaccgtgttggccaggatggtctcgatctcctgacctcgtgatccgcccgcctcagcctcccaaagtgctgggattacaggcgtgattactcttaacttttaagccgggagaaatgggaaattgagaactcctgaatagagagagagagaaagaaagagaaagaaggagagagggagagagagagagaaagagagagagagtgtgtgtgtgtccttgttttgatgcgcttttacctgggttacctttccgtgacagttctgagctttgtcacatgggtgtttcctgctcataagtgcatggcgctcgctgtagatagggacagtctacactggaggtttcagaagttaaaccaattcatgagtcaaaggggctcacagaggacgaagagcatctcatttattctaaacaagtgattgctcttttttttccttattagtgagatgtatgttttttca

SEQ ID NO: 133368 - DNA, 280 bp, Homo sapiens
cgatagtgcacacgggagagtgccccgacttcaacttttcgctcaaatttacaaatgaaattagggttcaagtatgaacaatttttttaacgactaagaatgaggacttttccataatctctcagcactttggaataaagaatagattcactctcagtaatgatttgcgactgacattttgagtagcataaattatatttcacacataatgaaaataaataatgcctttaaaatataaatgataagtgtcattttatggtctcagaaatcctgtatgttc

SEQ ID NO: 133369 - DNA, 381 bp, Homo sapiens
ctgagaaaacagtcaagctactcgcgacaatattcctgagcagtgaaacgggtgaacagagagcgagcaagcaggggctgagaatcagtgagaggaaaaatcaaggaacaaaaccggagagtctggtccagcattaagaaaacggagcaaaggaagagggtgaaacgcgaggggagggaagaccgagagtcggcagagaccgtggtgccgcgaggttcagagcagggctgggtccaggaagagtcagacctcggcagcccagcgagcttcccatttctggctaaagccagcgaagaaaacggccctggggagcagacaatgagccaccgccccagggccgactgtcatctcagcgctgagatgacagtcggccttggggaa

SEQ ID NO: 133370 - DNA, 944 bp, Homo sapiens
gagctaatcatgtggccagagatgtggcaagtctgtttatgaccaggaaggtgagactgcgatggactggatagtgggataggaagatttctccaaagagagaagagagttgttattaatagaagaagtgagaatagtgatgctgggcagacaaaacacatacacaacaccaacagctatctgctactgcatccgaaaagattctttatctgcagccacagagccctgaacaaccagcctttccggcttccttttgttgccaattccctcacacgtattattccaacccaaggcttcagggaggctgtttttaccacagttcagtgacaaatcctaccagagccttccatataccagtgaatgtccttggttatacttgtctcgttctgaatttagaaatccatctctgtgtcactgccttcattaggacctttcgtctcctccctggattcttctggtaccctcatttcttgtctcctacttcctgttgtctcctaattattcaccttctactttttttgttagaggttccagacagtttcaagaaaaatacttaatgctgggcaaggtgcttctcccttcctctctaagttccatagaacaggggacattttgcttctctgttgctatggactgagtgttttgtgtcttccccaaatttttatgtcaaaatcctaatcctaatgtgatggtatttgggcatgaggcctttgggaggtgattaggtcagtagggtggagctcttatgatggaattagtgtccttataagaagagacaggagagagattacttcctctctttctctgccatgtgaggatacagcaaggtatctgtctgcaaaccaggaaaaggaccttcgccaggaactgaatgtattggtgcactgagcttggacttcccagattctagaactgtgagaaataaatttctgatatttaagcca

SEQ ID NO: 133371 - DNA, 427 bp, Homo sapiens
aacccagacgtactatatgattctatttatatgaaattctagaacatgcaaactatagtgacagaaggcagatcagtggatgccttggcatgggtgagaaccggagggaattacaaaggggcataagaaaacttgaaggtgataatttcagtatcttaattgtagtcatggtttctcaagtatatgcatatacaaaaaatttatcaaattgtacaccttacatgtgcagtttatatcaattatacctcaggaaagctgttttttaaaaaaaaaaaaaaagaaaaaaaccttagtaaatttgtaaggattagaggatgcattacataatagagttaacatctgaaattaatggaactgtttttctaaaaccttttaattattgaaacaaaaacaaatgtggttttttttgggcaccagttataggctt

SEQ ID NO: 133372 - DNA, 422 bp, Homo sapiens
gatccatgaagagagggagagtcataggaaaatgttttgtgcttcgattgggtcggggcatcaagaacggcttttgagtaaggatgtgatttgggctgtgcttcaagatggtgacatggctgcaccttgtacgcagattggacaggcagccaaggacaaggcgtcagacgtgggctggtgggcaccaacgtgggggtagaatccaccttgcctgtgggtttcttagcctggactgggagaagtgagactagagacctgaagggtgagactagaggcctgaaaggggccaagagagctgcatcctcccagctgatcccctggctggagcctgagcagacgggaggagcaggaaggcagatgcacccaagactgcaagacatggaaaagggctcaggctccctctcccattgaagaaaaggtag

SEQ ID NO: 133373 - DNA, 650 bp, Homo sapiens
gatgtggctcacatctgtaatcccagcaggattatagtctcgggaggctgaggtgggcggatgcttgagcccggaaggtcaagaccagcctgggtgccatggtgaaaccccatctctacagaaagatacaaaaactagctgggtgtggtggcaccacctgtagtccccgctacttaggaggctggggtgggaggatgcttgagcccaggagccagactggtctcaaactcctggcctcaagggatcttcccaccttggaccccaaagtgctgggatacaggtgtgagccaccatgcctggcttcatatttatttcaggaaagctttattgattatatccttaaatactttaaatatatatttttaaattgtgataaaagatacataaaagttgccatcttatccatttttaagtgtacagttcagtgccactaagtacttttcatattacaacttttgccaccacccatttctagaactttttcatcttccctttgactgaaactgcatatccattaaacaataattctacatttctccctcccccaagtccctggcaaccacccctctactttttgtctctatgaatttgatgactctacataccttatgtaagtggaatcatataatacctatcttcttatgactggt

SEQ ID NO: 133374 - DNA, 692 bp, Homo sapiens
agatgcaaaagacaacatgcagaaagagtgaacacaactcagtgactaatggggcatgcaggatcaggaagagctaaaagtcaaatgacattcatatcctggagaatgaggtgcccccatcaagttaatccattaattaatcaaacattcaggacctggagccattcactctctaacatattctttggctgtattaatatggccattaattcctgaacaacaagcagaaggaaacagtacttaaaaccatggttgagagcacttagtttttcttctctgacgatgtgcaaatcggcagttgcacttttaaaaaaagcctttcatataaatctgggcaccatcctgaatgcatcagtcctattaacagcatgctagttttggagaattgctacaaacccagcctgaggtgaatggcagctgctcttctctggtcagggctacttaaagaagtggcaagtccaaagccatttagaaactgaaaagtggccttctgataaataaaacgacacttctgaagctgaacatcaaggaaagaactttgtgctgacggagaactacagaagctttcctatgggaggctggcatgcagatgtcaccgtggggctttgttgattatgaaactggaagccatagcagtaagtgggtgcatgggggcaaccaaaagcaggaggatggccttgcctgtgtctgta

SEQ ID NO: 133375 - DNA, 689 bp, Homo sapiens
gaaagttctgattttttgcaagaagaatattttttatgtagtagttgtataaacttaataatttaaaaaccctcaaagaatgaggacaggaagccaaattccagattgagtttaattttctttgaccagcctctttgtctcctttctagagacttcttcattacaatacccaaccaagaatgtttaaaacttttcaaagataatgcatatgtgagttaattggtatagctaaaattatgaaatcattgataatgaagtataagacagtatatgacggcggctaagtgcgtagaccctgaagccaggatgttgggtttgaatcttgacttccttgttgtatgacctctctatgccttagtttcctcatttataaatttggggtactgatagtacctgtctctaggttgttgtgagacctaaatgaattttcatctgtgtagtccttagaacagtagctggcacgtagtaagtaatataaaggttactattattgttattgtatcctgacacttagaaaaactggtggtagattgttatatatacatccagacttttttctatatatgtgtgtaaacatttacatacacttacacagatacaggcacgttcacaggagtaagtatatttttattaaaattggattatactatttctatttttttgtaatcttttacactcaacaccatata

SEQ ID NO: 133376 - DNA, 271 bp, Homo sapiens
gccccctcctcttataaataagaccacataccaatctataggttttgcccctaataaaggaaatcagccattgatttacaccaacagatggcaatgttgctcagtctgtagaattacgaactgagactccttagattaagtttcctttatcgtaccagctaaatgctaactgaagcactggcagcaactctgttccccagatgaaatcccaagtttcttcccagcacctcctgagatgtgcttctttattccattgttcagcactccccgg

SEQ ID NO: 133377 - DNA, 546 bp, Homo sapiens
agctgggactacaggcgcccgccactacgcccggctaattttttgtatttttagtagagacggggtttcaccatgttggccaggctgatcttgaactcctgacctcaagtgatctgcctgtgttggcctcccaaagtgctgggattacaggcatgagccactgtgcccagcttttttttttttatgttgcccaggctagagtgcagtagctattcacaggcacaatcctactactaatcagcatgggagttttgacctgctctgttaacaacctgtgttggttcacccttccttaggcaatctggtggtcgcccgttcccaggagtcaccatactgatgctgaacttagtgcggacacctgattggcgtagcgcactacagcctagaactcctgggctcaagcgatcctcctgcctcagcctcctggtatctggaactacaggcacacgctgcacccagcaagttttcagtattcttaaactgaaatatcccctgccactaaaatatagaaaaccaaaaaaagagttcacattaaaacaagaatga

SEQ ID NO: 133378 - DNA, 434 bp, Homo sapiens
gtagggtacaagaagcttttgtaactgtaaagagggagggaggtagctacgttggtctattttccagttcctggttccaactatacctaaagctttaactgcactttctatccttgcagtaatatgacaaaggcccccagatcttaatcataaacttttcattttctataatgcagtctctacaaagtagtgcctaaaacattccagcactctaccctaccttttacccagctagctctaagtcttccttcaggtcccagcttaaacaccacttcctcccggaaacccttcatgactactcagaatatcttatatcatccagtggcactccacacctcaccatactcagtaaatgttattactgccctgttggactgtaaacaccaaagagtaagaacaacttttgttcactactttgttcctactgcctagca

SEQ ID NO: 133379 - DNA, 489 bp, Homo sapiens
taactccttttcacaggggcatcaaataaggcagtaatgagccaatctgaataataagtttgaaagtcatgttaccattttctgaggataagagagcaaattgccccacatggaatagcagaaggaaccttttctcctttcctttccccttgaaaaagacacgtgtctcctaaaaggggaaggagggactaggaagccaaactggcaactacaggatgaaaactcgtcctcctggcatgctcagtgttgttgttcttcaggcttttctgtctgtccagagggaaacctacgccaagaatttcatcttgccttttctttcagtagatctggcatgaatttcctggcttacaggtaccttttgaaatgtgaggatcaagtataaattgcattttttttttttaagagacacgctctcactctgtcacccagcctggagtacagtggtgtgatcctagctcagtgcagctgcaaacccctgggctcaaacaa

SEQ ID NO: 133380 - DNA, 309 bp, Homo sapiens
tagatcatgccacgctggcctcacacctcttcctggccatggttttctggggctcttcagttactttcattacttgcctggctttttgtaggcgtttgactttggcctaaataattctctgactttagatcaagttctatgtggcagtctttgagagccttaacacatattgatacatattttgtgatttggtagcaaatcttgacctcaattagtttgcatgttctttctgcaacacacaccttatactctcctgattaaaacacttagaggaatttcctcctcagaccattggtgttacttttcatg

SEQ ID NO: 133381 - DNA, 338 bp, Homo sapiens
gctgcgttcgactgtaccccaacatcaggaagggatggctcaacctgggaggggtctggaagtcactaagaactatttagtaaaaaacatttctgtttcctggtatacatgatcaccttaaaactgacgctgcgaaatgccagcttccatctgcacgccttggctcctgcctggccctcattgcgaggcccgcgggagtggctgcctccctccccctgctccgcacagagtcctgcatgggaccagcagctcctgtctcacttccgcacttggggtttcagccctcggagaagagcagccgcgtggttcccctcacgcagacatgcttgagctttccg

SEQ ID NO: 133382 - DNA, 272 bp, Homo sapiens
ctcctgtgtgccagactctgttttagatactagacatacagtagggaacaaaacagcaaagctgcccttgtggggtttacattctggtttgggagacagatagtagatctgtagtgggatgtcagtggcagtaattgctaagaagaaaaattgctggacgtggtggctcaagcctaattgtaacactttggttttattttattttattttttttgagacagagtctcactctgtcgtccaggccgtctctgctcattgcaacctccgcctcc

SEQ ID NO: 133383 - DNA, 362 bp, Homo sapiens
agatgcatagggtctgggtcaagggctggcttccctgatgaagggacacctgaactgagactgggagggagtatgctcccaacagatggaagagaaagcagagggcctgaggcaggaaggggcttgtgttggacaagcccagtggggcctgtgattcacagtgagtctggaggaggagcagggagagccaggccacgcaggaccttgtgggacaaagtaaggttggggtctttatctcaagggcaggggagacccctgaaggtttctggcagaggaatgacatgctcatttttatattccaaaaagaccactctgccattataagaagccatattggatgtagagacgggtcgggggtctag

SEQ ID NO: 133384 - DNA, 634 bp, Homo sapiens
ggatcatagatgatactggttaaaatgctcaaaaagcctctggatcatccgagacagactcacagttcttggtcctcttcctccaggcctcattgtcttactgcttccatgttaaagcacccagacccttgtccagaacttttatagcaagataaaagatcccttccctgagcaacttcctcctgctttgggacacatcttccctcagggcacaatctgtcagacactcgctcgcctggcctgctgtctcccctcccggcctgatgttggatttcagtaggttgcagctaatgttgaatatatttcagatgctgtaccctctctgtgaactatgaagacatgattagcagatacaattagctactttagcattaaaaaaaaatcaaaagatctagattttagttattgccctgttggttattactacattggcttctgcaatagtttatttctaaagcaggaagagagtggaaaatgggtagacctgagaatacagcatttcttttttcttctgaaggaaagaaacccagcactctttcaaaagctgtgaaagcattctcatgatctggtagatcccatctgtgcgtttttcagtgacatacttcaagtacacgagctgccgtcaaaggaccta

SEQ ID NO: 133385 - DNA, 206 bp, Homo sapiens
aggtccttccagggagaaccagagttcaattgaccaggctgacccaatccctttattattattaccattagcctctgctgatttaaccaaaattagcttccaagcagccctggctgaagggggaattaattaacaggcattagttgtggttgttattaatagagaagagaatgaaataaaaacgttggagggggttggctggctag

SEQ ID NO: 133386 - DNA, 517 bp, Homo sapiens
cttagtcaacagagaccaaccccatatataaacataactaatttatatattcataaacagagcacagtttctgcttggtttcctttgattcttgtttgtcctttgatcttcagccatcagacctgggtagggagccagtgccccaccggatttctttgtctggttccactggggcgtaatgagtaccctttatccccttccatctcattaggcagaattcttcccctagatcctggaatggttatggaggcaagttttaagacctctagcactgccctagcttactttagccaagatggagtaatttacagcccattaggcccttaaaatttggcttgcttctgtgttctcctggagtttcccagctccttctaaagaggtttcaggaggctgggtgcagtagctaacatctgtaatcccaacactttgggaggccaagacgggtggatcacttcaggtcaggagttcaagaccagcctgggcaacatagtgaaaccctgtatctactaaaaaaaaa

SEQ ID NO: 133387 - DNA, 1129 bp, Homo sapiens
agtttgtcacttttagacatgccctaacaagaaatgctaacaggagatcttcaagttaactgaaaagatactaaaccaacagtatgaaagcatatgaaagtatacatctcactgctaaaagcaaacatgaaaacaaacatggaatattgcaatactgaaatctgtggcacgtaaatctcattgaacactagtatataaattaaaagacaaaaatagtatgagtaactacaacaaccacagaaatttgttaatagaaacaatatagaaagaagtaaaatctgaaatcaattacatacattggtgaggaagaggggggagaagtgtagagattctgaatatgaatgaagttgttactagctttaaaaagcctgctatgactacataatatttgatgcaaacccgatagtaaccaaaataaaaagtatagtaaataaacaaaaaaaagaaaaaaatcaaagcattctactacaatcatcaaatcacaaagacaacaaacaagagaaaaacaggagaaacagaaagcaaatagaaaacaatgaataaaatggaaacaattaagtacttaattattaaaaattattactttaaatttttaataattaagggctctcagtagacatggaatggctgaaatggataataaaaacaacactcaactatacgctatctacaagagactctaacatttaaggacacacgtaggctaaaagtgaagggattgagaaagatattccatgcaaactataaccaaaagagagcagggtggctatctatatcagacaaaatagactttaagtcgacaactgtcaaaagagacaaagaaggcattatataatagtaaaagggtcaattcaatagaaagatacaacaactaaaaatacatatgcacccaacatcaaagcaccttaaaatatacagtgaacattgacagatttgaaggaagaaatagatatcgatacaatatagaaggagactttgatacatcactctctataatgtacaggtcatccagacagaatgccaacagcaaatattgatagaattggaggaagaaatagatatcaatacaatacagaaggagactttgatacgtcactgtctataatgtactggtcatccggacagaata

SEQ ID NO: 133388 - DNA, 421 bp, Homo sapiens
ttcaggaggatccctcataggtcgcagggtagtgtattacgtgcctcagtgtcttggtgtgatatacacttagtaaagtcaggcctgctaggtggggtcaccggggtgctccaggcaaatatcatccccctctcccaaggtaagggccctgccaggcaatggagagtatttctccaacacaccatgtttccaatatctgtcagagaaaagacctgattcaacttgtatccagtgatttgaaagctaaacccaaatctcaatgtcattctgacaatatttctattaaataaaatcctctgtttccttgggggcttttaaaatcaatctgccacaaaaagcttccgaacaagttaataacgcagacgtgctgactcacactccccagcaagcactcctccatgaagaatcaacggactttgtt

SEQ ID NO: 133389 - DNA, 243 bp, Homo sapiens
cagagcagggacaggaggagcaaggtgaaaagaatggctaaaaccacagggcagacaggcatgggctccatccagccctctagtctctgagctggtctcttcctctggaaagggacctgatcatagcacctcttccatagggctgtgacaatagacgacacaatgcagaaagcgctcagagaacagcagaccctcaacaaatggtgatggatgtcgattgttagtttttgagtgttgagtgat

SEQ ID NO: 133390 - DNA, 198 bp, Homo sapiens
atcatctgactcttctaagtagagcgtatctttaactttttattttcagttcaatttcaaagtgtctactaaaacagagttctacccatcacatttactgtgagaactagtcttatttctggcattacatattatattttgtattagttttcaagttcaagaccagcctggacaacatggagaaaccctgtctatact

SEQ ID NO: 133391 - DNA, 651 bp, Homo sapiens
  misc_feature (368)..(368): n is a, c, g, or t
  misc_feature (371)..(371): n is a, c, g, or t
  misc_feature (376)..(376): n is a, c, g, or t
tccctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagatcaagatgagtgggaaaccatctcaataaacacatttgggattaaaaaaaaaaaaacaaaaanaancacanaaaaacttttgggggccgccgggcccccctggagagtcgtttttttagagcccattgcggtggggcagcggggggcccccacatgtagggttacactgtacacaatttgggcacaacgcggtgtcccccaaaaggagaacacccggggcacaagacacacaacggcgcggtggaattcttccacactataaaaaaaaaagcgcccgggggggaaacacgggcggttcttggacacaatctcccaagggggcgatcggggagccaaagcgcggcca

SEQ ID NO: 133392 - DNA, 381 bp, Homo sapiens
cagattactgtgcccatttttcagatgagaatactgaggccatgagaactgcttcatggaccctctgagtttagccagggtggccccctgttggtacacccatatcccagaaacagagctacccgttcttctcgggcctttccagtttctacctcagatttatgtacctggagagggaagaaaccccaactggtactccctgaggaagattcagctcaaatgcacatgtagtgagcatctctttggtgccaggtccagtgatagacggcttgttatgattaaaagagcactagctttctagctttctaaactcaatctctggctaccttataaatgctgtgttatcttgcccaagaagcgtgatctctctgctgagcctaa

SEQ ID NO: 133393 - DNA, 206 bp, Homo sapiens
cagggtaatgcttgcctcatagaacaagttaaaaaatatttcctcttctaacgtttgaaagagttggagaaagattgaggtaaattccactttaaatatttgctagaattcaccagtgaggtcatctagtcctagacattttctttgttgggaggtttttgagttctgactcgatctgttattacagatctgttcagattttccat

SEQ ID NO: 133394 - DNA, 168 bp, Homo sapiens
atatacaattattatttgtcaattttaaaaaaatagaggctgggaacggtggctcacgcctataataagtaatagtgcactggacatttcaaaattgccaaaaatgtagatatttttaaccataaaacaatgataagtatgtgaggtgatagcttttaaattggcatg

SEQ ID NO: 133395 - DNA, 559 bp, Homo sapiens
aatggcaaatagtgctatgtcttagcccaggtccagggctgtgtggaagtgatatgggaggggtacagggatgggtagagaaaggcagggtccctgacaagggctccacccttgtgcctgagcccacggacctaggtgaggacaggcactcctgtttccttgcccaaatgttgcattttccaagtccaccctggcccgtcacgcccccaatcctgtgcctataaaaaccccaagaccttagcgggcacatacactaatagctggacatcaagaggaacacactggcagaagcacacacaagtggctggacatcgacaggaacacactggcagaagaacacatagacgctgacagaccatcaacagcagaatgacgcagagggtggtcggaggagagcctggctgctgagcggcccgactccaggggaagaccaccttcccactccatcccccttctgactccccatctatctgctgagagccacctccagcattcaataaaaccttgcactcattctctaagcccacacatgatacaatttttctggtgcactagggca

SEQ ID NO: 133396 - DNA, 808 bp, Homo sapiens
ccatttgaggggatgccagtgaaatcaatgcatctaatgtccttgttcatttagaaaattgcacaaatagctgagacccagagatatactgagcatctttgaaggttataatcaaatagaccttgaacagtgtgatctgacattactgacttctcttgggtaaacagtaatggttgcaaaagataaattcagatgaatattatatagccaaatgacatttatgtaattctcttaagttctctatatcaaaaacagtttcagacctgacagtttcccccagtgcatatcaaatgtaagattcaccccaccataaaaactagagaggcaaaagtactgtatcaattcccatttgttcatttgttccttcaaataaatgagttctaactctgtcccagcccccacgtgtgcaatgatgagtaaaagtatacttctctgcactggcagagcccagactggagagtctataaaatcaaataatgctaatcttttaaactgaagctgaggtgctttgagagcatatgatagcaggatttgtcctggggaacagaccactgagttgatatttgaaggattaggagctaatcctaggaaagagagcaaagagtttgttgtgtgcaaggccccaggggtagcaggagaacggcaagtactgtttaggaagaaggtcaacatataataggtgggaaataagaggacgcatgtagatgcagatggaattggggaggtaagggccagatcacagagttgtgtaggttatgtaaagaaatttagttctgattccaaggtcagtgggaggagttgtaaggag

SEQ ID NO: 133397 - DNA, 220 bp, Homo sapiens
ccaccttgtgcggtgatgagctgatctcttggcggtgccccccaccgacaccccacatcccaagcagcccagggagtgatatcaggcagggctggaatggaacttcagatgtctcttcccagcctgagacccgagcccactgccttcccaggggccaggtagctgggacagcattcacccttgcacctcgtttctccgtctttgaaacggtcatgataac

SEQ ID NO: 133398 - DNA, 379 bp, Homo sapiens
taaacgtaacttcattatattagaacactgtctgtatatgtttaaccttcattttaaatatttattgtgtgtatatgtgtgtgtgcgtgcgcgcgtgcccacatgctagaatcatgtgcttcactgtggaacatcatactcaaagctaaaccaagcccaaatcataactaaggaatagaacttcctcaaaatatgacacttcactaggagacttgtgtgcattttgagcaacatgttaaatgttgaaaggaggggggaatcatggtgaagcactttccaagtcaagcctgaggcgctactagattttcccagacagaagctgggggttaggtagcctggaaatactttctcaaatatttgtcagtaaaataggaaaata

SEQ ID NO: 133399 - DNA, 886 bp, Homo sapiens
cagaacatttctgagcctgctggagtgtgtgtcctgtgtatgtcgccgctccttttagtgatgatctttaatgatcctttatctttctgtactttttttcctactaattctttatacttgtatgctttgccttctcttaagcgaaattaaatttacaagcttaatattgacttagcacaaatttgtcagtcttactggaaaatgagttaaatacactgggacccagaaatgaaaacaacttatttttgtatgtacatgtggcgaaactacaacccagggaaacaagtgtgcagtctcgcaaaactatcatgactagcaaggttgatctgagagtaactttttactctagtcaaatggcaaatatctatgttctacttcttacatcttaattttgcacaaatagagattcattgttttgttaggcttatctcatttaaaggtaacttagaatttgaaatgctgaagctgtttcacagtatagtagacaataagcacttccgctgttttcccgtggttttagttttttcctctgaatttaagtaacttttattttcttgagtttgtttctatacaggtctaattaagataattatttttaaattatatctacttataaacaagaatttgaggtgaatagaagaggtgcttcaaaataaaaaatgggtgaatatatgcctttgttagtaaagttctgaaactgtagaccactattcttattttcagctttgatcatgatttgaatatattataaagtttataattctatagaaaaataaatcagaagtcccagcagccaccaacatgggttggttctttttataggataaccgtgccttgtatatcattaatgaactaactaaagctgctgttgataatgggatgataa

SEQ ID NO: 133400 - DNA, 258 bp, Homo sapiens
taacttagattcttagctcctcctttcctccctccttccaacattattgaatatttgctctatgttagggactcttttggtctccagaaatagagcagagagcagcttcctgagtggtgtgcttgttcgcatgtttttttaagggtctagttttattcattccacaaatatttagctgaattttttttttttgagacagagtcttgctctgtcacccaggctggagtgcagtggtgcggtctcagctcactgcaattt

SEQ ID NO: 133401 - DNA, 135 bp, Homo sapiens
gtacccaacatgatagtggacagttaaaaatgactaaaggtaaccatcattccttattattagatgagaaaaagccattagggaaaaggatagaaaagaagttaatttattttgtcctaccaattacagaaaatg

SEQ ID NO: 133402 - DNA, 323 bp, Homo sapiens
ggcccctgagtagctgggattacaggcatgcgccaccacgctccgctaattttgtatttttagttgagatggtgtttctccatgttggtcaggctggtcttgaactcctgacctcaggtgatccacccacctcggcctcccaaagtgctgggatcacaggcatgagccaccgcgcttggcctctttttctttttttttaatgattattctccctattccggtgggaaataatttttatttttcagtctttcctttactctctgttttctgccttaattacaaattttttcctattaaattctcttccttttttccatttttct

SEQ ID NO: 133403 - DNA, 450 bp, Homo sapiens
cagggcacactctggtatctcagctctggtccccaacccattttcttacactctgactccagtgtcttctttcaaacacaacagtgagtttagaagaccttcaatgcacccctttctcttaactcctgggttctaaactagatgccaggtttggactcctttccctgtctcagagaggatctgagagtgcaaggcctctgtcaccacaggggccggagctccaactctggctctgacacttatctgccttgggacgttgggcccattccttcaactctctgaacttctgcatattcacatttaaaatggaggaagtatagtaggtccctataatcccagctactcaggaggctgaggtgggaggatcccttgagcccaggagttcaagactgcagtgagctacaagtgtgcctgtgaacagccaccagtactccagccagagtgatgcca

SEQ ID NO: 133404 - DNA, 621 bp, Homo sapiens
cattttatactagacttcattcttgtctctcatgcttcttgggttacttaatggtttatgctagccctgaaagctatcagtaaaaatttcatgcttatatcaaagaattaaatctgatcctttaatatctgatattttgccagtacttctagtgataagggatttttggaagtcagtcacagaatttaaaaataaattctagtctttcctcagctatttgatactcatccctgttcctgcaaaagacatgatcacattattttttatggctatggggacaaataggccaagtactcattgccaagcatttttgtaagtatgcatgcttatatttggtccagaaacaatgcattctagattggtttagaattactggtagcttattttacagcaaggaaaagcagctgagcaagaatttgctgtctttagaacagtttgtgaaatatgatataagggtgttttcatttcctattccctattctctctctactctgctcctctgaccccattcattgaaaggcagctgccttattttacatgaaggtgtgcaatgcctcagatttctttcagcttgcacccctgatctcggtctgagcacatggtgaagctctacggaaagtt

SEQ ID NO: 133405 - DNA, 560 bp, Homo sapiens
tgctcctcgggagcagaactgtgcctttgtcacatctgtgtccccagcacctagcacagtatcttacacatagtacacaaccagtaaatgtgttaaaggaataagtgagagagtgaataaaatgcaagcttatgtgtgtgcaggacacacaacataatgaattttgaaggagcaggtattgagtatccatcctcaccactgctcttagtgcggactctggaagatgccatagaacatgctggaagaggccacacagaccattatataggagaggaaactgagatcttgggtgcttcagaaactccccatttcacacatggaattagtagcaaagtctagaatttaagggtcttaggactcagtcctgtgtccactctactttcctagttagaatcctaagcaattgtatttcgctaacaattcagggaaaagggcaaaaagaaagctggagggttttacaaccaagtagagcagttgagcaccatttcctacatcaaattgcttcttccccaaaaagcaggcctcttaaatgccaggagttacatttgctgatattctaa

SEQ ID NO: 133406 - DNA, 513 bp, Homo sapiens
  misc_feature (23)..(24): n is a, c, g, or t
  misc_feature (35)..(35): n is a, c, g, or t
  misc_feature (37)..(37): n is a, c, g, or t
  misc_feature (170)..(170): n is a, c, g, or t
ttggcttggagaagggtgcactnngttcccaggcngnaatgcagggcacaaactcagctcactgaagcctcaaactgccgggctcaagcaaacctcccaccccagcctcccaagtagccgggaccacaggcgcacaccaccacacccagccaatcttttaaaattctttngtagaggcagagtcttatcatgttgcacaggccggtctcaaactcctgggctcaatcctcccgcctcggcctcccaaagtgcaaggattacaggtgtgagctagtgatcctggcttgcagctttaaacagtatagccagggaagacctcactgaggaggtgacctcggatcagggtttgagggagccgagggagtgtttacccaggaaagtccccgtttagcattgacactgtggactgaaaataccatgtccccaaaaacccttcagtcctgggtaaactgggatggctggccaccctaagagtgggtcatgtggctctcttaggaaaaggcactccaggca

SEQ ID NO: 133407 - DNA, 129 bp, Homo sapiens
taacatattataaatattttcctactgtgtgtcatgtgagctccagtgtttttaccaattcacacatgtagagaggaaccttccccccaccataaaccagtaaactagcaaaaatcagtagtctgtaat

SEQ ID NO: 133408 - DNA, 744 bp, Homo sapiens
taaaatttatactacttctcctataaatctcccctataaagattatttttattggtgggattacaggcatgagccaccatgcctggccaatgctgacaagttttaaaacatcagatgaaacagtgttcaaaatataattatttatgaaaataattgtcttttactattccagaacttaaaacagaatttgatagtaatttgaaaaaccagccaggtgtggtggctcacacctgtcatcccagcattttgggaggccgaggtgggtggatcacttgaggcctggagttcgagaccagcctggccaatgtggcgaaacccaaaaactaaaaatacaaaaaatgagctgggcacagctgtgtgaacctgtaattccagctactcaggaggctgaggcatgacaatcacttgaatatgggaagcagaggttgcagtgagccgagaatgcgccactgcactctagcctgggtgacactaagactctaaaaaaaaaaagaaaaaaagtaaagaaaaaactgtgctattcactggaactttgatttgggagaggaaataaggcttgcaggaaacagctatctttcggccaattctcaactgcctgtgtaagagcataatcacaacccactctcacacctgaatgctttctgcatgttttccttaaatttcccagcatacttgctggttctgagatgttcttgacattgcaaaagtccaggtcatggacatagtttacattctagttccaaa

SEQ ID NO: 133409 - DNA, 577 bp, Homo sapiens
caaagggatgccttccggtactactaactcaattcagttcattcatcatcagcatacatgtaattcatatatagcacaactgtcaagttacggaatataatgctgacaagttgtgttttttttttttttttttgagatggagtctcactctgtcacccgggctggagtgcagtggcgtgatctcggcttactgtaacctccacctcgaggattcaggaggctgaggcatgacaatcacttgaatatgggaagcagaggttgcagtgagccgagaatgcgccactgcactctagcctgggtgacactaagactctaaaaaaaaaaagaaaaaaagtaaagaaaaaactgtgctattcactggaactttgatttgggagaggaaataaggcttgcaggaaacagctatctttcggccaattctcaactgcctgtgtaagagcataatcacaacccactctcacacctgaatgctttctgcatgttttccttaaatttcccagcatacttgctggttctgagatgttcttgacattgcaaaagtccaggtcatggacatagtttacattctagttccaaa

SEQ ID NO: 133410 - DNA, 496 bp, Homo sapiens
ttctgcacaggggaggttgtttagatatccagacccgctggagacagtaaggagtaattttatattttatgctatcaggttaaactttgaattcataggtgagaaccttgtaaaaatttagagtactgagttagagaaagacccctatataaacacagtggattcataaacccagaaaatatcctctaatccctattgttgaattagaatttaaatatgggggagagccaagatggctgactagaaggagctagcgtgcactgctctcacggacagaagaaatagtggtgagtaaaccctagacctttaactggaacattcaggtggacacattgcgattcatcaaggaaacaacccacgaatgaaagagaggaatgagacaagacaaccacccacctgggatggcatagagccagaggaggcccccatacctcggaaaaatgatgagtgagtgacagtccccaggaacccacacttctaccatggacttttgcaa

SEQ ID NO: 133411 - DNA, 415 bp, Homo sapiens
ctgagtctctctgtggggggctgcagaccccgctctccactagggcctggctgacccatctcacctcttcaggtggccctctcaaccatttgctggccgcctagcacctggaaacatgcccttagacccttttccagttccctaactatggctcttgcatggtttctcatcgtttatatttcccaggcaaaaacaggacactaagcttctgtgtccccaaactgcggaaaacacacactgagttctaagtggtctccttgaggccctttttgacattcttcagatgaaggggagggggtagagagcacaccccaaggaaccctcccattttcactctgaccagtggagctttaacccttttgtaaccctcaattgcaacctggcatttggcaactgcctgttcttttttcccagc

SEQ ID NO: 133412 - DNA, 453 bp, Homo sapiens
tcctctgtgttcccatagagcctaccgctatctctatcaaagcactagttatattgctgtagttatttgtttacctcctgtattcccaactagactctcaacatctcaagggcaagaacgatgttgtacttacctttgaatttcctttaccaagaatagtacttggctcacagtaagtgcttaataaacatctgatgaataaatgaatgattgctctatctatcctgttggtggtagagaattaatccaaaaaatatattgctaatggtgcaatttcaggcatattacaggctggtaaaagagaaattttgaaaccaagagacctgccctacttctatcaatcatctcataaaagtatctacatgaaaggctgctcttgagctggtagctaatgttcctggaaaaactccctggcaggttacccagggagattagtttaaagggaggttgtta

SEQ ID NO: 133413 - DNA, 695 bp, Homo sapiens
gaggaggattgtctgagccaggcagttgaggctgcaatgagctgtgattgtgccaccgcactccagcctgggtgacagagtgagactctgtctcagaaacaaacaaacaaaaaaaagtggaggcagcaagggaaagttaaatagttttcatttcatttctattatgtagcacataaaaggtggatccagggctaaaatgcaccagtacctaaaggatctactcaattcaccaacctgggtagtgccacttctagttcaaaggttctcccaatcaagatatggaagaaacatgtccctctgtactatgtgtcaagcacagtttcatcatttcagactgcaaatgtttgagccaacaactgagcatcactgctgaaaagttctttctaggcagcaccttttttggtaagaaaaatctcagcagttcgtaagtgactttaacttgccatactgtattttaaagacgtatctgaacaattaaaaacactgtattgcaaattgaaatttctcttgcctagttgcaaattttattgccacaaatggggtccctaagaagcactgtcaactttattggcgacttgttgctccctgattgtgagtcatcctcaataaagtaattcagggatcatctcctcagtggaggaaaaaggaacacgggcagaaacaacacaatggggtgagaggaaaatcccagaagg

SEQ ID NO: 133414 - DNA, 245 bp, Homo sapiens
tttcctttgggctgtgttaagtttcagatgtttgttagactttgaggtataaacatgtagaccattgaagatgtgagtctggagttccggtatagattaggtctcaatattctatttgggggtcacacattttatctttaaagaattccatgtattttcagaataagaagttagtttgatagaataaagaacctgtggtaatttgattcgaatgatgaaaaaaatttaaatcaaactttcttttc

SEQ ID NO: 133415 - DNA, 231 bp, Homo sapiens
gactcgtattatctgtttaaaccacacagctaccctgtgatggcaatatctatcttaagtccttttttcacagatgaggaaattgaggctcagagagatgacatctcttgtccaaagtcgtagctaataaatagtaaactggaaaatggaggcgcagccccagggctgcctcccactaaagcccattctcgcaactctttcactgtcgactctgttgctttctctttccca

SEQ ID NO: 133416 - DNA, 459 bp, Homo sapiens
ctgacacaagtcaaaaaattcagatttagaaagggaaacaatggcttgtagttttaccgatttgtttccgatacataacaacgctgacgttctttaaccatcttctaagtttagttctcaagctctaggttagggtaccactaacgaagcttccaccttacccgtgaacagagctggtagcaactaaacggaaaacgctgtgaagactacatctacgtttagctacctaatgtccatgccgcaccgacctcctaaagggaattcttaataatgggagactgaaatatccagggagggtgaggtagtagaaaactgtttagactgtcaaaaatctggcattggctaatcctgcctgttactccgggcctcggtttccccatctacaaaactgatgtaaggtagggggattgacttaaacaatttctaaagtccttatggctatagtaatccagaaactca

SEQ ID NO: 133417 - DNA, 328 bp, Homo sapiens
tttctcttacgaaattagcccccccatttatagtaacagtagtcgttagcaactaaacggaaaacgctgtgaagactacatctacgtttagctacctaatgtccatgccgcaccgacctcctaaagggaattcttaataatgggagactgaaatatccagggagggtgaggtagtagaaaactgtttagactgtcaaaaatctggcattggctaatcctgcctgttactccgggcctcggtttccccatctacaaaactgatgtaaggtagggggattgacttaaacaatttctaaagtccttatggctatagtaatccagaaactca

SEQ ID NO: 133418 - DNA, 188 bp, Homo sapiens
gctaatgggagctgggagaaggagtaatgaattcaacattataaggagcttggtgttaaaatcagttcagatacatagtgtgagtatggcactgggacacagggataggacatgcttaaatgggcagatgcatggtgatgactctgtgagtcttagggatgaataattcccaggaggaggcccatgat

SEQ ID NO: 133419 - DNA, 706 bp, Homo sapiens
atttcattttggttgttgaaacatgtacatatattacctattcaaaaagttaaattaaggtcaggtgcagtggctcatgcccgtaatcccagtactttgggaggttgaggtaggaggatcactttaccccaggagttggagaccagcctgggcaatatagtgagacctcctttctacaaaaagtttacaggtgtgagccactgcacccaacccaacgctatcctttctatgtaactcactagaggacagccccagggagtggaccagcaaagaccgcatgagccataccccagtgacacaggctcccaaacccggccatgtatcacaatcagaatctggggggagtacggtcagggatctgtgtcttttaaagtcctccaggtaattcagtcagttactgacctgtccttgtcaatgcttcccagtgaagagagtacaggctacatgtcccaggtacatatcccttccctttagacagcagtcatcactgacgtcttctgagtaccagtgctgtgccagacactgaggcattctacgtgttactgtaaggcaaacagcatcccggcagggcaggcctcgccaatgtgctcactgagctcggtgtcctctggagtgactgacttattcaatgtcatattgctggtaaatgtcagaactaggatctgaatgcagtcataaactccctgagcctctgttttcttctctg

SEQ ID NO: 133420 - DNA, 1911 bp, Homo sapiens
gataaatatctccaggttgaggaagaaggttgcacatatcgggtgctcaataaatatttgtcgaatgaatgaatgagtgaatggccccagtgtgtggggcttgggaagtgattggatataggcagagaaaaggaacaagtcaaaaataattcagaaatcaagaacaagcaagttgccttgatatacttcattcctacacttggcaaactttagtgattaaggaaacaatgttttaaaaaaagttttggtgatgagacattcaggaagatctatcaataaatagcaaacctggtcctttttaagacactgtgtataaaaaaattccaaaaagattaaaatcagtgcagaaaccaaagaaccatttttttctatatcatattgatcatttcaagtggaactgttagctatcttagaaaaattgtggttctcaattggttttgcctctatctctgaaccaccattcctaaaggaaaacattcaaccagaaaatttcagcacatcacaatctctctgaagattaagaagtctctgtgaaggactgaatgtataaattgaaaaatttttgctgtcacatttaggtaaaagagaaatcgttcttcatatccccttcctttccatctgtagctcacctatgtcaactttcctctcagaagtgaaataaaattaaagctatgacactgagtgtcagtcatggagggacacgttccccacttagcctttgctgaagtgtttccagagacaactgtctaatgccaggtccccacttagtgggctgcacttttctactcatttgcacataatccagaagtcacattttgggttcacagtttccactggggtaacctcattaggcctggccacctctgtgcttcttgtgaagtctctgatttgaaggattagtatcctttccagactgtgtgggttgactttcacccatctggagttgcttggaacaaagataactacctcaactccttgtcatgaaagcaaaaaaaaaatagcattagagttctgagaacaggatgtcattacgggttgtgccttgtcagctacaggtaagatatttgagtggctcctcaagcctccccaactccctctccaacctcgctacacagtcttcccaggtctggtatttgacctccagactgccgcccagaaagcaactcagagctcagcaacaccatgatgatgaaacacaaatatgtgggcccccaactttggagactccactggttgcttttgtgcagctctttctatatatgactttcaaaatggcagccaaccctctcaactgttggttgatctgaatatgtaaagttcagccttcaaacccagcaaacagtcagctataggatagagttcaggtgctggggaatgaccacggttggctgctacgttgggaaccctggtgacatcatatatggacctgggaatgtaaagaaacgtaggaaatctgaatttatgacttttctaatctctctatcgggatccttttttggaatcaagatgattttccttctaaaaggtcattttattacagtaatgggcagggtagacatacctcactagcgtactctcaaaatttcttgcatgcatatgctttctccggcatgcatatgctttctactacaatgtgaacaagcctacgaaagctagcctaatggaggatgagagaccacgtggaggagagctgaagtgccccagccagcagctagcctacacccacagctattttgcttgtgttccactcgtcctatttgcataatattgttctttaagttaacccattcttaatttattgttttaatcttaagcaataatattcaagaactaatgagttttgtgtattcattatatttttccataatatatattatactaataaatgcccattcaaattttagtttgagt

SEQ ID NO: 133421 - DNA, 1005 bp, Homo sapiens
aggaggttgaggctgcagtgagctgtgatcatgccactgcactccagcctgggcaatagcatgagaccttgtctcaaaaaacaaacaaaaagaaaacacattccacttttggatgcacatgggcagcagtcgaaggcgggcagcagtcgaaggcaagcagcagtggttgtgtgtgcctcagaaaaaaatgtagcccttagaactgcccagcaccttgccaggcacagtggctcatgcctgaactttgtgaggccaaggcgggtggattgcctgagcccaggagtttgagacaagcctgggcaacatggtgaaaccccatctctactaaaatacaaaaaagtatctgggccttgctgcgtgcacctataatcccagctactcctgatgctgaggccagagaatcgcttgaaaccaggaggcagaggttgcatgaaaccaggaggcagaggttgcagcgagccaagatcgtaccacagcactccagcctgggtgccagagtgagagtctgtctccaaaacaaacaaacaaaatttgcccaggcagggcttaagagtattggtagaaatgcagtttgaggctgggcgtggtggcttacgcctgtaatcccagcactttgggaggccaaagtgggccagactacctgggtcgggagttcaagaccatcctggccaacatggtgaaaccctgtctctacttaaataccaaaattagccatcaatggtgggcgcctgtaatcccagctactcaggggctgaggcaggagactcgcttgaaacccggaggcagaggctgcagtgagccgagatcatgccactgcactccagcctgggcgacagagcaagactccgtctccaaaaaaaaaaaaaaagagaaaagaaaaaagaaatgcagtttgaaactttacatctgtcctgccaagtagaaaattccttgagttgaacaggctatagagatggtggcactgggccgggtgcgatctcagctcacaatcactagtgaattcgc

SEQ ID NO: 133422 - DNA, 419 bp, Homo sapiens
tgaagtgactaaatctagctaattaacatatgcagtacctcaatccttatcctttcctgtggtgagaatacttgaaatgtactctgttagcaatattccagaatacaatccactgttactaactttagtcactgtgttgtacaatagatcttttgaacttcttcctcctatttgagtgaaattttgtatcctttaaccaacatctccccagcaccccatctccatcccaacctctggtaattgctgctctagtcttttgatttgaaataatttccctgaggtctttaacttgagaagatggagttttaaaaacaataatgcttatattacttttgttttgtttgttattttacatattgcaatatagtgtttgttgcaaatataaatgagtatactgtaataaaaattcttcacctctc

SEQ ID NO: 133423 - DNA, 522 bp, Homo sapiens
tactaaattgataaagattttttaaaattttaatagaactaaagagaaaatatttctatatactgatgttaggagtatgcagtttaggccaggcatggaggctcacacctataatcccacccagcactttgggaggccaaggtgtgtggacacttgaggtcaggagttcgagaccagcctgaccaacatggtgaaaccctgtctctactaaaaatgcaaaattacctgagtatggtggtgcacacttgtaatcccaactacttaaggaggctgaggcaggagaatcacttgaacccgggaggtggaggctgcagtgagccaagatcgcgccattgcattccagcttgggcgacaagagcgaaactctgtctcaaaaaaaaaaaaaaaataggattaaatttaaccatgagcaaggcttaactatcagaataaatgttttgataaagaaaagtgactgaaaaacattacagaatctaagcaaaatgtcattaagggagccaccatccagtaacacaaatggga

SEQ ID NO: 133424 - DNA, 373 bp, Homo sapiens
cgaaatattggccatggctgttccttggggaaaaaccaccgccaagcaaacccaaaaaatggccaatcgctggttcctcggaggaaatatcttaaaatctcagcagcttaaccagtaaatgtttatttcctatcacctctctatctgattctggcagagagggctcctccatctgaaacgcatggcctccatgagactgaagcaagatctccctggccagagcccagtcacatggccccaacttggggggctgaggaactcagaggagtgcacgatgtttggagagcacttgctttctctgccacagtgattcaccatatgctcatcaatattgattgagcaactattacataaattggatgctttttggtag

SEQ ID NO: 133425 - DNA, 312 bp, Homo sapiens
atatttccaccgaggccacctgtggcttctgggtaccctattggacagcatagatagagaatatttccatcattccagaaggttctatgggacggcactggtctagacagagcatggtgactgggtgggggatgctgcccagagatcctacctggctgtaaatccaggcctgaggtcatgcccacagcagggccctccacacagcctcagtcaagtccctcctcccctctttgggattccgccagatctccctcctggcacagccagccccttcctccccactgtttcacgaggccactcctggggttctct

SEQ ID NO: 133426 - DNA, 661 bp, Homo sapiens
tggcaacccgctagggtccccttccacagtgtggaagctttgttcttttgcactttgcaataaatcttgctactgctcactctttgggtccacgctgcttttatgagctgtaacactcaccgcgaagatctgcagcttcactcttgagaccacgagcccagcgggaggaatgaataactccagacgcgctgccttaagagctgtaacactcactgcaaaggtctgcagcttcactcctgagccagcgagaccacgaacccaccagaaggaaaaaactccgaacacatctgaacatcagaagggacagactccagacgtgccaacttaagagctgtaacactcaccgcgagagtccgcggcttcattcttgaagtcagtgagaccaagaacccaccaattctggacacaaagtcactagagtcaatccagttattgggcaagaaagatttcaaaagctctggtaggggacagggagtctattaataaatggcagtctccatagccggcacttttatatttttgcaacaaatctgtaaaatatttatttttctcctgactttgaggaaagtaaggctcacaaaagttatgggacttgtgtctgatcatacagctagtggcaggagaatgaaattcaagttcaaaggcatttactatggtagat

SEQ ID NO: 133427 - DNA, 1132 bp, Homo sapiens
ctttaagtctaaaaacgtctgtttccatggagagcattttaaaatgtggtgtctgcatttctgcctcctccttttggtttctaattgctcatcgatgcaggaattgattctggttatcggaaatgcgaagcacagaaggacgcagggtaggaactggagctcctcccttttccttccctctgcccctgaattctcctgctgtctcgggaggttcgtagctgagtgtggggtccagtctctccctgtgcgtctgacatcacccccacagcgcttttgaatctgagagctgtagggttccgtggtgctctcagtctcgtggtttgctttcttctcccaacggtgtatcccgggggtctctgggccagcgtgtgatgaggagtagcacttgagtgcctgtatatggggtgggttctgcctttcccacttcacaggtgaggacgctgagcacagatgggcaacgtcacctgcgccgggtgccagctccgcttggagcccgccctctgcgtcacctgctgtgtctgtcgagctccttccagtggcggcagcgtgctccacagtggagtttgaagttcaggggtacaagaagaaaactcccccgcctcccctgaccagggccagcctcttccaggcaggcctgtaggtggctggctttcgctgtttcacatggggctgcaggccctgagcacatgtgtgggagggggcggggcctctggggtctccctggcctcccaggctgagcggtcaggcaggcgtgaaggggcctgggctaatgctgcccacactgtcctcccagccagaggcaccggtggcctttctgcctctttcctgtttgattcctgcctctctctgaggctcagagaggtgcagcagcccgtccagggtcacacagtgagccagtgctgagccgcttcagcatccaggagtcctctgactcctggtcagaggttttcagcccacatggtgctgttttacctaagccttaaaaaaaaagtttttcttttgatgacaaagccaaggtgatatatgcagattacaaggaattgaaatcctctccatgataagcaatgtttgtcctgccaaaacagttctctgtgtgcgtgagtctgagtgtgcatgtgagtgtgtatgtgta

SEQ ID NO: 133428 - DNA, 484 bp, Homo sapiens
aggatgcaaagtccctggaagaccctcttgtaggtggagatattcaatagattggttcaatgacagtcttgctgtgactgcaggtattggggacagcaccctgcttctaggaagaccagggcaggaaatatctagaacagctgtattaatagatgtgcaaggcagagcatcacctctctctctagcagaagtccctcagctgctcttccctggacccagggagagaagactttggtatgtgaaggtggaaggtgagaaggtggtatgaggaatggagaacaggttgcatggctcccctcgacctctcacactttccagaagaagaggacatatctataacaggctcacagtagatacaggcattttctcgtcagtcctgccccatgtctttccagccataaggatgtctcagaatggcttggggcttctagtccagagcctacgatctagagcacctgctctgggtcatccctgtccttccacc

SEQ ID NO: 133429 - DNA, 460 bp, Homo sapiens
ttctccacagggcttaacaaaagctacaatggacaagttgttaaacctcataatctttgggaaaactttgatagactactttattttctataaatagaacaaaagagaaatatttagcaaatatcaaatgttctttattttgaccccttccctacctcccagccattggattttatctaaaaatgtttaataaaatgctttgttcagtcctatttcttctttttccacctataatcaataagactgttgcccatgtatttctggagctagaaggaaaaggacctcttgtgtaaggggtgttttgtactaaatgaatattattgttttttcttggcagagtcaatttgggtattgccccaactactctgatgaataatttgtagagtgatacaactggattttgttgcaacacctactgagagttacccctattttaatttgcgtgggaatgatgccacag

SEQ ID NO: 133430 - DNA, 381 bp, Homo sapiens
ccgggctctgccatccccagcatgtcactctcccctccgagtgctggggctgaaggtaaagagaggacttccagttcaaattcgatcacgtggtacgcaggcgcaacaggcagactgatgctcgtgaccttgtcggaggactgaatccggagcgcggcctcacgtgacagaagggcaagggagcttttgtaggcccttcttctaagggcactaatcccattcatgggggctccaccctcatgacctcatgacctcccaaaggccccacctcctaacaccattatcttggggttagggtttcaacatatgaatttgaggggacacagccattccatctgtgaccgtcctcaatcagccttctccctgcagggctgcaaatga

SEQ ID NO: 133431 - DNA, 391 bp, Homo sapiens
ctcttcccttttatacaggaaggtccctcaggtatctgaagacagttttatccctccttctgcctcaaggactctccaggccaacaagttgtgtctcactagcaggtcctcctcagtgaacccttcaccatcccatggttctttctcgtatttttgaatgtggagaatcagagctttgaaccctcctgtgtactcttccaccagcaacccatgccttgcactttctccttcagggtctgtcttactgcacagggctcctgattccctagactcaggtcttggtaggccagagtctaggttttggctgagactccttctaagacctcattagggacattcagttcactgacggacaccaatccttccaacctagatgttctgggctggcttc

SEQ ID NO: 133432 - DNA, 459 bp, Homo sapiens
ggctggagtgtgcccaagggggacttgatcttattctgggtgttttagcccaagcagaaatcaatgcagggttttctgccacctgcttattttgtttccagtcaagcaaaacaaggggcttatctccctcacagatcagcatatgagatatgcttcagatatgtttgcctgtcagactcataaacacaacaagatatgccagctgcaatgaagagaagccctgtttcagttcgtggattacagactgcaacatccatcagcatcaagacaaacaccttcaaactactgtccttggcgtccagcctaacagatctgaggaatgtgataaaggaacactggattcccaaggtctgctcaggtttccttccataacaagaagtagccaaatacagctgaacaggcctggtaagtaaaggagaagcctccttccttgaaacactttgctgtattctcaagaac

SEQ ID NO: 133433 - DNA, 357 bp, Homo sapiens
ttgcttccttaagacagataatatgccttatattttaaacttatatgtgtgtgtttattcaataattctaaatctcaggtcatatttaccctctccatgaaaatgtctgctaattttaaaaattagctgattttttacagttgtaaaaaatataatggtactatctatgagactgcgtttagtcaaaatgtgaagagttcatgcccatgcttgaataagtctagggaattggtaattttatcaacattttattttttaattgtggtgatgaataatgaattgtcaaccctggaaactttatagtagctaaagggccatcaatattgctggatgcaaagttaaaccaacttttacaga

SEQ ID NO: 133434 - DNA, 484 bp, Homo sapiens
ggcaatgccacagccatctgctcagacaagacaggcacgctgaccaccaatcgcatgacagtggtacaggcctatgtcggcgacgtccactataaagagatccccgaccccagctccatcaacaccaagaccatggagctgctgatcaatgccatcgccatcaacagcgcctacaccaccaagattctgcccccagagaaggagggcgccctgcctcggcaggtgggcaacaagacggagtgcggcctgctgggcttcgtgctggacctgaagcaggactacgagcccgtgcgcagccagatgccagaggagaagttgtacaaagtgtacaccttcaactccgtgcgcaagtccatgagcactgtcatcaagctgcccgacgagagcttccgcatgtacagcaagggggcttctgagatcgtgctcaagaagtgctgcaaaatcctcaatggggcgggagagcctcgtgtcttccggccccgcg

SEQ ID NO: 133435 - DNA, 345 bp, Homo sapiens
agagcagtcctgtgatgtgactcagtttccagggcttaacttttcccattggcataatgaattggggagctcctgaaattttattttattttcacaattttgatttgcattcaaaccaaatcaaatgtgcattcagggaggttttgaagtgacttgcccaagatcatctggtcagtgtggcagggatgggagaggagcccaggtcagactgactcccaagtcagcactcagggaggtaaagcacccacccaaatttgcagagctagggactggggaagcctgcgacaaaactcctatcttctgtctccagaccttctggtactgtgtttccccaagagaaaggat

SEQ ID NO: 133436 - DNA, 594 bp, Homo sapiens
ttcttgaagataacgtgaaccccaatatggcatcatcctcttctacctatccatagaacctccttgattctacttctttgttttgtctttgcagctttagtcaacagaggctgttcccacagttcctcatccttccctcagttatctatttctgtagctctgggtcctgaattacagcattttctaaccctttgatttggctctcttctgctctgaaaagcattggctctttcacagttactgtacagtatccccactgtggcattttctgactcccatgctgggccatctcatcccccatcaacaaatcaccttgctaccacatggccttttggtaactgacttttatgtagaataacatacatgtagaatgtgtgagagaacaatgcaggcaggagcctggctttgctctgcactgaatatttagcactagcatagttctctgctgtacaaataggaagtcaataatacttgttgaattaataaatatttatacagtgcaatttaattaattccaagtttggcatcttctaaaattcacataggaattttcaatgtggccaaaagccccacatttcatagcaaaatcatgac

SEQ ID NO: 133437 - DNA, 201 bp, Homo sapiens
tgatgggtgtgtggtgctgtctcatcgtggctctactgtgcagtgttgagcatcttttctcatcgtggctccagggtgtgatgtcgagcacctcttcacgtgctcattgccatcagcgtatcctcctgatgaaatgagtattcttgcctttcagccgtttcctaataggactgtttgttttttaatgttgagttttgagag

SEQ ID NO: 133438 - DNA, 223 bp, Homo sapiens
ttgtctacaggaggcatcttcctccttgtgaccttggtgacagtctgtgcctgctggaaaccctccaaaaggaaacagaagaagctagaaaagcaaaactccctggaatacatggatcagaatgatgaccgcctgaaaccagaagcagacaccctccctcgaagtggtgagcaggaacggaagaaccccatggcactctatatcctgaaggacaaggtgagcg

SEQ ID NO: 133439 - DNA, 353 bp, Homo sapiens
gctcttcacagagtccaactgcagcttagagctgcagaggctgcaaggggtggtggaaagaccactggactagaatgaggatatctgagttctaatttccagtctgtaaaccaagaggttggataactttacctctcaaggtctttccagctgcaaaattccttaagatacaaaacaaaactgttaactgctgctgagcatgacagaggtgagacatgaacctcccaggggaggcgaggcatcacaagcgccatcctgaggtcagtccaacacatttaacttatttcaccccataatgctgcaaattctgcttagttcctgtatttcttcagggacaaggagaaaaacattct

SEQ ID NO: 133440 - DNA, 666 bp, Homo sapiens
aggaagcatggcagagtctgcttctggggaggcctcaggaagcatccaatgatggcggaaggagaagggggagcagcatttcacttggctagagaaaggggaggtgccacacacttttaaatgacctgatctcatgagaactcacttactatcatgagaactgctccaaggggaaaatccgcccccatgatccaatcacctcccaccaggcccaacctccaacattggggattaaaatttgacatgagatttgggtgggaacacagatccaaaccatatcactgatgtttaaagaacattttcagatattcttctaaatgccttacttttaatcctcacaataaccctatgaggtacttttacttatatctgggatttttttttttttttttttttttttggagatagagtctcgctcatcacccaggctggagtgcagtggtgcaatcttggctcactgcaagctctgcctcctgggttcacgccattctgcctcagcctcctgagtagctgggactacaggcgcccgccaccacgcccggctaattttttgtatttttagtagagacggggtttcactgtgttagccacgatggtctcgatctcctgacctcgtgtccgcccgccttggcctcccaaagtgctgggattacaggcttgagccac

SEQ ID NO: 133441 - DNA, 407 bp, Homo sapiens
cagggatgagcagcagccgaggggttttaaacactgagcggctcagtcagatagacttttccataggtgcctggcaacagtatgggaggcagagaggccggtagaggctgttgtggtcttccaggaggaattgtgctggtggtggggaagcacctttggtgactggcagtgccggccattgcaaggtctcagcctcaggcagcttttggtctagtaagtgctcctttcccaatcactgaccacgtgccgacccctacattggttaacactgaatctgcacagcagccctgggagtacctgtagccacctgacagactctagaacagtgctacccaacagaaatatagtgtgagccacttatggagtttaaaattttccaggcaccagagttcgaaagctataaaaag

SEQ ID NO: 133442 - DNA, 925 bp, Homo sapiens
caataagaaaacaatacaaagagatacactaaagaacactataaataaatcaatatggaaggcaggagaaagaaaatagaaaatgaaaaggagaaataacaaacagaaaacaagaaataaagtagcaaatataattatatttaatgtagattgtctaaatatacaactttggcagagtggatcaaaaagcatgacccagctatatactgtctataagaagcttatttacaatataatgataaaggcagattgaaagtaaaaggatggaaaaagatgtataatacaagcattaatcacgacgaaataggaaaagctctattatatcagataaagtagactgcaaagaaaagaaagttaccacagacagaaaaggacattatataatgataaatgggtcagtacaccaaaaggacatagcactcctaaaatgtgtttgcactaagtaacagagcagcaaagtatgtgaatcaagatctgatagaactgaaaggagaaatatgcaaattcacaattacagacgtcaacatccctctctcaacaactgatagtacaactagccagaaaatcagcaaggatatagaaaagctcaacaatatcatcaaccaacagggtctaatcaacgtgtatagaatactctactcaacaagagcagaatatacctcaagaatttagaaaaatgggtcctggtagtggctatgagaaaaaaaatatagaaaaagaaaagcaaaataaacccaaaccaagcaaaaggagatgcgtaataaagataagagcagaaatcaatgaaattgaaaacagcaaaacaatagagaaaatcaatgaaacacagagcttgctctttgaaatcatcaataaaattgacaaatctctatcaagattggcaaagaaagaaaaagataaaattaccaatatcagaaatgaaata

SEQ ID NO: 133443 - DNA, 388 bp, Homo sapiens
agggaaagaaattttgatgactttcctcatgtaaaaagggctatgatgccacctggagtggcagcttctcttactgcatcttctggtgcagggacagtggggtctgaaggagatggccatcccctctcccggaaccccatgcctccctcacccaagcacgcagccagcatagccctgagctggtgaccctacccctgctgcccagggagagagcgacttccatcagagatgaagacagcagtgaagagagtgaccaagagccaagggtgctggggaaagctgggcaaggagggggctgccccgtccctcccagccacacgctcacgtgcagagagatgcatattgtactccagagccccttgagcaggcaccccaacgacaccgcagc

SEQ ID NO: 133444 - DNA, 295 bp, Homo sapiens
agggactgttccctgaaggatagtagagctgatgtgaggattaaacaagctattgcatgtaaagtgctcaatacgatgcctaccctactcgaagtcccaatgcatatgagctattaagaatgagatactggccgggcatggtggctcacgcctataatcccaacactttgggaagccgaggcagttggatcacttggggtcaggagttcgagaccagcttggccaacatggggaaaccccgtctctactaaaaatacaaaaaaattagccgggcatggtggtgcatgcctggact

SEQ ID NO: 133445 - DNA, 646 bp, Homo sapiens
atcactatcaactcttgcccaattattgtgaccacctgtctcatcttacctggcttttcctggacaatctgcttctctcatgactagctatatcattctcctactccttcagcttgataaaaaaggacttgctgcttcttgctccccaggaccactccctgttatcctatcactaaaaaatcgcttgggagtcacattactcactgaaaccattccttctgcaacatctaccaacctccagaacaccctcctatttcccctacccaataacttcaattctgcttgctcccaaattcagccattattctcaatgacttcaacaaagatgctcaagaactttctacaccctgaccttcaaaaactcctaagaccttcatctgcacttcagctagccacaaagaaacaaaacagagccatcaactgaaaagtgctaggccgggtgtggtggctcacgtctgtaatcccaacactttaggaggccaaagcaggtggatcacttgaggtcaggagttcgacaccagccctggccaacatggtgaaaccctgtctcctttaaaaatacagaaaattagccggacatggcggctcatgccttaatcccagctacttgggtggttgaggcaggagaatcacttgaacctgggag

SEQ ID NO: 133446 - DNA, 761 bp, Homo sapiens
gaacgccataatagtctggcttttaattttgcctctaagaaatcagttattttatttctttttgttttttgggccataagtgataatcatttcactctcagagttgttctttaggaagacttctctaatagcagagtgatgggtgaatttaaagtaggcagttggtggtagagaaagattctgtcagttaggaggagactgtgatgttacttttcctgtgatatgatgagtacttttttacctgaagagtagcaaaggaggagcttaagtttcactttaaactcagtataaaaattagatttcctctctgcaacatttagagattattgaatagtaggttaacaaatgtctttgagtggctgctgtgtgaagagcagtaactacagtagatgctagggctacatagaaacacagcaatggtggccatgtgtggttgttcatgcctgtaatccaagcacattgggaggccgaggcaggcggatcgcttgagctcaggagtttgagaccagccttggcaacatggcaaaaccctgcctctacaaaaaaatacaaaaattactcaggcgtcttggcatgcgcctgtagtcccagctatttgggaggcggaggcaggagaatcacttgagctggggaggcagaggttgcagtgagccaagatgacgtcactacactccagctgggttacagggcaagactttgtctcaattaccaacaacccacaacaccaaacacttttttggcgccctctgcccctaaaaaat

SEQ ID NO: 133447 - DNA, 120 bp, Homo sapiens
ctgtcctgttaccgcacattataaatacaaggcagaactagtgacatgatctgaatttgtatttccatccaaatctcgtgctgaaatataatccccaatgttgcaggaagggctggatgg

SEQ ID NO: 133448 - DNA, 263 bp, Homo sapiens
caaaactcaaaactaaaactaaagaatcctccgggatccataatggaaaggcagaataagaaacctggtatgtttcaggctatcggatgattttttagtgcaagaacgaacgttttaaaaggtgcccgagcagagattacagacagcctcgattaatgacacaggatcactcagcatttgagctggatgaattgtccttagtgatccttgaattgtgtcccttattttacagataatggattagaggcccaggaactcaaaat

SEQ ID NO: 133449 - DNA, 682 bp, Homo sapiens
caacagataaatgaaacaaaaagctgattctttgaaaagataaataaaatcaacagaccattctattgattgggaagatccaaataagctcaattataaaacgggagatattacaactgacaccacagaaatacaaaagatcattcaagggtactatgaacacctttacgttcataaactagaaaacctagaggagatggataaatttctgaaaagatacaaccctcctagcttaaatcaggaagaattaggaagcctgaacagaccaataacaagcagtgagatttaatgataatttaaaaattatcaacaacaacaaaaaaaaatccaggaccagacagtttcacagctgaattctatcagacattcaaagaagaattggtaccaattctactgacactattccacgagatagagaaagagggaatcctccctaaatcattctatgaagccagtatcaccctaataccaaaaccaggaaagaacataaaaaaaaaagaaaacagaaaaaaaaacgatgtgtggggcgcgctgggggccccgcgagaaaaaagtttttaaaaaccattgcggttgggggccgcggggcccacataggttaggtggacccgggggccaaaaagcgggtgccaaaggagaacaccgggccaggaacaggggcctggattcccccccaatagag

SEQ ID NO: 133450 - DNA, 211 bp, Homo sapiens
gggaggtgggagatgctttcctagtatcccaatgagcttctatgaccttgtgatagtagtaaggtcgtcccttcatatcttcaggggattggttccaggagttttggggatactgaaatctggatgcccaagtcccttgtataacatggagtagtattggtgtgtaacctacacacatcgtcttgtatacagtctgtacagtcacacgcag

SEQ ID NO: 133451 - DNA, 277 bp, Homo sapiens
cctgtgtcctgaatggtattgcctaggttttcttctcgggtttttatggttttgggtctaacatttaagtctttaaagatatatatgttcttaaaaaggcataatgccttacatttttggtccattgatttttgacatgggtgtcaggcaattcaatggagaaagaagagtcattccaatcaatggttttggaatgactaggtatccacatataaaagaattaaggtggacacctgcctcataccatacacaaaaattactgcaaaatgaatcacag

SEQ ID NO: 133452 - DNA, 211 bp, Homo sapiens
gctgaatggtcgctgagacagagatggaagccaggacaagggagcccaccgggcccagataggtacagagagcagaggctcctgttctgtcctcgccacccacgagggtgacactgcttgtaaatggtggctgtgctctcccagcaagtaaaaagcacaactaaatccacactgcacacagacgcagacagaaagccttcaagtagctctg

SEQ ID NO: 133453 - DNA, 669 bp, Homo sapiens
tggccttccttagctcttgtacccatatatcatactagtcaacatctatcttgcttactgtctgccccctcccacatcagaatttgagctcctaagggttttgaaagagtctctgctggttttattcccagctctatccccagcacccggcatggtgtctggcacaaagtaggagtatactacttttgtcaaagacataaataaaggtcaagttgaagtcaactccatctgtggtcagggctgccctgccctcaccttctgtttcactgaatgtgtttcctcccctctcacccatctggtatgcattgccacacaggggccagtgagttcttaccagcagcctgcaccagatgtacacgggtggcatctctctccagcaataggccccatgccctgaagaagcttacaacctacagtgtactaatatttgcaatctgctggtatttttaacatgggtttacagagtataaaccccagggaaggccacagaccctggcttccagtaatctgagagcagtttccagcacctcataccctgaatggaaccagcccaagggccctcaacttcacacagaagatgtgggagcaggcctcagccattccaaagaggcttttcctcagtacctactaggcctaaacacaaccaccccaatcagctctggcagggca

SEQ ID NO: 133454 - DNA, 541 bp, Homo sapiens
ggcacctgatggcagttttcccaatattgcgaaattaagtttgattattttgttaaggtagtgtccaccagatctctccattttaaagacatccttttctctaattactcagtggactgtagagtgatgctttgaaactgaataactaacactccctaactcagtgatttagcacccgttgattttttttttttgcctgaatcaaatattattatagtagttttaaatggtgattttccatttctattcttttgttagctgccattcttctataattttgtctttatattttactgggtgttaagattgctattccagctttcctttgtcttttacaccttttcccattcttttatttttttccatccctttttgtcctgttttccaatagatggatagaattttctttctctggtttaaaggttatacatttgtgtgtgtgtgtgtattcttagccatttgcccttaaaacatagagatggttattcctgttgattaaaaaaaactcagtaatgttactatcttctctttaataagatag

SEQ ID NO: 133455 - DNA, 596 bp, Homo sapiens
gaattatattaaggctataatttaaagctagtgctgtatcttcaggagactaaagaaattagcttgataaaacactatacagtaagtcatttaggctttttctttgctgggacaaggaagtgtttcacatgaccataagtttttataagggtgctttaggataaaatggcactatggggaaaccaataggcatgatgaaatggcgctgaatattttattctttctatgtggtgaatttctagtgctagattacataacggaaggcattaatgtacctgacaaattttctggaaaattatcatttatcctaattggagtgagtacacagaaaaatagaccacgatggaaaggaccagacagacctatccgttgaaacaaggtttgtgtccaggagttactcagctgtgagcagtgaacattgaaaaaaaatcacttcaggggaaaggatccaactgaactgggtacagtgaagtgagttggtccaggtttctgaatcttccattttgatccagctaggaatggaacagacaatgaagggaagtccaacaaacatgaacctatctaaagtccaatgatcaaaggaatttgtaggaagc

SEQ ID NO: 133456 - DNA, 484 bp, Homo sapiens
ctaggccagagaatgtatattattattttattcctgaaaaacatatcctaaaataaagggtgcacatgtagacattttaaataatacagaatgaatacctacataggcactgcccaccctaagaaagacagcataagcaattgaaacactcttaacctctaattcaatggctgtcacctgggggcaatttttctccccccaggggagcttgccaagtctgcagacagcctgggttgtcatcacagggaggggccaccactggcatctggtgggtggaggccagggccgctgctcaacaaccttcgagtccagaatgccccattggcctcaggtgtcaccagggccttccctctgcatgctgttcccccaggagatcatcacaatctcacgagactctcgtgttaaccatcccttgcccttcctcatggttctactgcacgtctgtgtctctaggtcacgtttggctttgcctgtgtttgaactt

SEQ ID NO: 133457 - DNA, 511 bp, Homo sapiens
ccaaatcaagatccaaactgactttatgtatgtatatatctctcaatgcaagcaatatcaaacttcattttctctacaaaaatgccaagttagtctctttataaaaagcagttacaatctgaagacattcatgttacttcctttgccagctccaactctgccttatttaaatctttgcatttcatgggaaacattaattctatctatggcagagccacttggtttgttagcagactgatttgctgtcatcagactgtgagatgattttttgtgtgcatcatttttttcttgaccagctttttgaaaattaagaaatggatagtcatgttttcttcaggttctcaagtattgtcagcatccgtaaatcccttccactctgggaaatactactgctccctgcttcccatggcttccacatcagtccaggactttttctacacaaattattctggctctgcctccttgaccttggtattcttagcattatttttcccatttttttgcaatggag

SEQ ID NO: 133458 - DNA, 465 bp, Homo sapiens
ctaaaataaccttctcttcaccattaaagcagaatcccaaattctagcttctatcaaaatcatgaaaatgatcagctccaaagtcacacatacagattctggaacaaagctaagggatggccgtctgtcatcatggaaaagcagctcctcagaaataagtgacattaactattgtctccaaaactaaatctatgcattggtttgaccagggatctcacccacaaatgctgcctagagcagaaactgactacttctgacatttcatatcctcctaatgaagaaggtacatataggtatgatgagcacaagaaaagctcagtggcagcaaagggttggaacttgaaaccatgtatctacctccacgaaatgaagtcagctacatagtcaaggcaatattcaccacttagcttcctaaataaaaatcctatataaatgctatgtgctcaataaaagctataactctcc

SEQ ID NO: 133459 - DNA, 459 bp, Homo sapiens
ctacagcaaccatcccttgaagactggggaaacttgtcttggctttgaccaaatggtagtacatgtctcattcctaaggatagacaacataaggttggattttaccataaatatatcactcatttcacaagaacagagttggggttgaggtgaatcttgatattgctctatgctacagaattgacatcaaagagataaattagtaataggttttagcacctaagaagaataagcacaatctccaggctgctcattgaatttggaagacataatgacaatgatatcactgaaaacactaggatatcattgacagaacttccagtaccgataaattcatagatttaatgatgagtcaggtgaaggttttcaaatgcagaggaggcaaaaaacaaagtataaatattagaaagtagattctgcaatgaaagaactaaggaaaattagtatggggatatagat

SEQ ID NO: 133460 - DNA, 153 bp, Homo sapiens
aggctgcatggtcattttgtctccattttcggtagaagctggcatcacagtagggattgtctgaatgactacctttggagaggtcgctgttgttggactagtgctggttattaatggtgcacctgcattaactgactgaactgccacagttga

SEQ ID NO: 133461 - DNA, 750 bp, Homo sapiens
gcctatgaattatgaggattttcctgctaactgatgagaacaagaactatttctgccctatgcaaacttcagggattattccttgtaatgcagtttctcaaccttagaattattgacatttatgggctggataattatttctggagtttaggggactgccctgtatatgaccaaatgtttaggagcatccctggcctcaatacagtagatggcagtaacatcctttaaattaagacaatcaaaaattgtctccagatattgccaatggctccaagggagtacaattgccctcagttaagagccactgctctaattctttctggtagttttcttatatgcatgccatggctaaggactttgctcaggactcaagggagacctcctacagatctcccaaattctgtatctgccaccctttcctcttctataggcttacctgagaatctagtcagttgacgtctctggattcccagctctgttttcccaactcaaggagacgactgagttttgcctgtgtttctttttccccatcacagcctggaaactctaggctgcaatgctggggcagtcataggctcacattgtttcctgtctctcagtgatctctgtcctttgttgcttgatacccagcatctttgaaaactatggtttcattatcctttatttttatttatttttagtttctagttttttcaggtggattcctgttaacctcatcttggtcctcatctttattcttgaaagatactt

SEQ ID NO: 133462 - DNA, 843 bp, Homo sapiens
gccacagcagaacgggatctctccgcgcatgtttaaggcctttgtaagcaagagccacccggaattctcctctaacaggcagcaagatgcccaggaattcttcttgcacctggtgaatctagtagagaggaaccgcatcggctcagaaaacccaagcgatgtttttcgttttttggtggaagaacgcattcagtgctgtcagacccggaaagtccgctacacggagagggtggattacctgatgcagttacctgtggccatggaggcggcaaccaacaaggatgaactgatcgcttatgaactaacgagaagggaagcagaagcaaacagaagaccccttcctgatgtgggtacgtgccaagataccatttagtgcctgccttcaggccttctcgtgaaccagaaaagtgtgatgatttctggagcagtgccctacaagcaaagtctgcgggtgtgaaaacatctcgctttgcttgattccctgaatacttggtagtgcagataaagaagttcactgttgggtctgtggactgggtttcccaaaagaattgatgttgctatgtgatatggccagaccttacttggattatcgacccatctccgagccaggggttttccagccagggagagggaagaactttccaggacattcaggcccccccataagtctttcctgaatgactcaaaagatcgtctgattgaaacaattgattggacccatcagaacatcgatgggcatcagaggatggaattggccaaagggttcccgcgtggaaaattgtgcaaggggggtgtcaccgaaaaaggggggagggcgcacaggacttgcccggaaaccattgg

SEQ ID NO: 133463 - DNA, 246 bp, Homo sapiens
tttattgtcattatatatttacaaaagtctcctctattttatcctgatttcctagtgggcaaaaccaaattcttactggtctttggtctactacatagtcagcacatagcactcaacaaaagtacctttagttaaatgagtctaactctcctatcagcttttagatggcctaagaattccctcttcaaacaccagatatcagttttccttcttaatccaatattcttatgtgaaaattttactgca

SEQ ID NO: 133464 - DNA, 119 bp, Homo sapiens
ggttgccctagagcttgcaatatatatttacaagtccattttgaagtaacactgcattacttcattgatagtgcaagtactttttaataacaaaatagttctaattcctcttttttctc

SEQ ID NO: 133465 - DNA, 513 bp, Homo sapiens
aagcagagacacagtgaacacggccatggcctggccgccaccagttctggtgggaactgcagtgttttggtgacatctcaaaccctatgtgggctcactcgatggagtaatggctaatttgatactttatacgttatttgcgagagtagatcttttttactttttaataggatggtgctattttttttaatgatacctgctcatgtaaaaaacaaaatagagcaacagaaaagtaccaagaaagcaaaaacatttcatcatcagaaatagccagtgttaaactaagctttgtaaagaaaactctgaagattctcatgaatagtttgcttcctagaaacccaccaacagattttttgttgttgttttttttgagacggagtcttgctctgttgcccaggctggagtgcagtggtgcgatctcggctcactgcaagctctgcctcctgggttcatgccattctcctgcctcagcctcccaagtagctgggactacaggcacccaccaccacgccc

SEQ ID NO: 133466 - DNA, 784 bp, Homo sapiens
cacggtggctcatgcctgcaatcccaacactttgggaggccgaggagggcagatagcctgaggtcaggagttcgagagcagcctggccaacatggtaaaaccccgtctctgctaaaaatacaaaaattagccaggcacggtagtgcggacctataatcccagctacttgggaggctgaggcaggagaatcatttgaacccggtggaggttgcagtgagccaagacggtgccactgcactccagcctgggggacaagagcaaaactccatctcaaaaaacaaacaaacaaacaaacaaagtgttatactaaagctggtctttttaagtttgtgcagtgaattcagtgcctaagctttaacaggttaccaagcagctttgttacattaaattgaatcatcagccaccaaatttatatcaggtttcagatgctggccatatgaaaggggaaaattcttaagtatgtttggcttttttgttgttgttgttcattcaacaaatatttactgagaatatcctaatgccagaaaacgtgctagaagtgatttaaaacttgagtaaatcaatatctgcttaggaagattgatataggttagattttagatcccattaacttgtttcagaaaataaaaatgcaaactgattgtggtaaacttgtggagttatacaggtaaacatattattaaacatgattttgacaataatttggccattatttggggcatttaaattttcataagatgagttggtatgtatatataccacagttaacatatctacctatatg

SEQ ID NO: 133467 - DNA, 399 bp, Homo sapiens
taaaataatagctatttcacacggaaattggggagaataaataagcacgactgtccagattttacagacagaagaacatgaaccacaaaggactacataatttgtccagcatcagaatgtaaagtcaggttcattgttgtttgtgttagatcatataatgcagagcagatggcctaatctgtgttggtgtttgtccactttcctaaatttttgtttgtctttccgttatctctatttggttctagctaggtcatgattgcttatgtcaaagaaacaaagaaaatacgacaagaatctgtaactgtaacaatgttgtttaacacaactttgaatacatttttacaggaagcaaagaagtgtgttgccctctaggaaatgtgtgttgctctgatgtaatta

SEQ ID NO: 133468 - DNA, 327 bp, Homo sapiens
tccactgaatagcaccccttgacctggtcaccagtgacccagcccatgctgaccaggccaccactaagcccagctgaccaggtcgccaccggtcaagccccacagcctaggtctgcactgaccagacaccaagcaactggctgccagtaggtccccacttgccaaaacccccactactggatccccctaatgagaccctccctaagcagacccctgctggccaggttcccactaaacaggcctcactgaccaagtcccaactgactaggtccactgagcaggcccacactgatcaggcaggcccctcctaaccacatcagaaggcca

SEQ ID NO: 133469 - DNA, 393 bp, Homo sapiens
cgatctagaggatcccttatatgctgtctcaggggacacactcttggttcataagcaaggaagattcccagcagcagatggacagtgatgtcattctccagtatcttgcagctagttgactggtttgttcactgacatcttaattcgtggacattttcttagttcactctgtattttctggcaggaattgattatatgcgaagctggaaaaggtgaagcgagttgaaggtagttgctatttgacatacagccctccaaagagctctgctttttttctcttcctttcatctcaacacacttttcttgtagagactggctttttcatgaatgaactcatttggaggaaacacctgtactctctgcttatttactgtggagagagcatttttgtag

SEQ ID NO: 133470 - DNA, 361 bp, Homo sapiens
gggtcataaaacgagacttgctcatattgggtgcttattctgtagtccttgactttacccctcaccagcagggtgaccttggggcaaatgacttgacctctgtgccttggtttccccagctatgaaacgggtaataataacacctcctctgggtttgatgcagcacttaggacagcgtccagcacgtggtaggagctcagtcatgtcagccaccgttattattacacacaaatgcacagacgtgcagacacagcaatgccaggctctgccatctggcagcagcagcgcgaaggtaacgatttatttctgtgtgctttgtctgtctgtgtttaccgaagggagtgatattagtgtgtgtgtg

SEQ ID NO: 133471 - DNA, 435 bp, Homo sapiens
atcacttgaacccaggaggcagaggttgccatgagccaagattgcaccactgcactccagcctgggtgacagagcgagaccctatctcaaaaaaataataaatataaataaaaggaatatttctaccttttagacagaatactcaaaaacatgcatgaatgaaatagatgcagttatgctattttattcttatgtgttttcaatctgaaatgtttatagctaacagttgggaattatgtgctgtagtatgtatatagtatttttagtgaaaatattcatataaaatattacttaaatcatttctacattgcacaaaatgatttcagataagtggaaagagtgaagatgcaacagctgctacataagtgttgcttcaaggaagtgatatcccagtcttccattctaccagatatctgccatctgtcgtatgcaaaa

SEQ ID NO: 133472 - DNA, 601 bp, Homo sapiens
aatcaatcaatatttaaatttgttttaatttctaatatggtaaatattgataaaacccacataaaagctctttgtggttcttaaattttaagagcgtagaggggtcctgagaccataaagtttgagagctgctgttttatagtatttaatacaaaagtaagtttatttgaataaaaaatacttgatcacttggttttattatctttatgcaagttacttctgattacaaatacaatcgtccctcagtatctgtgggggattgttgccaggacacccccttagataccagagtccatgtgtgctcgtgtctcttatataaaaataatgtatttgcatatagcttacatatgtcctcccaaatacttaactcatctagattataataacgtcatataatacagatgccatgtaaatagttgttatactgtgttgtttaggaaataatgataaataaaaaggctgtacgtgtttagtgctgtcttttttttttctctctgagtattttcaatccacccttggttgagtataaggatgcggagcccacagataaggaaggacgattgtacacatcggttctaggaaacacacttctcttttataa

SEQ ID NO: 133473 - DNA, 162 bp, Homo sapiens
gttagactagcagatggagaggatggtggggggaatgagagggcattccaaatggaaggtgcgctaagtgcaaaaggcctggagacaagaggcaatggcctatcccaggaactgacagatactcacagggactgaggggataatcatgggaagaggagtgta

SEQ ID NO: 133474 - DNA, 338 bp, Homo sapiens
caataattagaagaggagaagcacactggttgcatttcccgcttgtatagctctttttatctgtggccaggtcccagttagcagtacaagtaagcacttagaaaccttgaatcttactgattatttaagggccatgtttcaggacagctacagcagcaggaaagtgagggataaaatgctaataggggaaactgcaaattttgcatataaactcaagccacttatctaggtaactgaccccctaaactatgtatatgcagccagaatccagtatagttagttgagactaaagatactaagtagggatttcagctgctgcctaccccacggaagagagt

SEQ ID NO: 133475 - DNA, 268 bp, Homo sapiens
aatagttttataaggacctcatgaaagggtatagggaggatgaaattggatcttataatagttatgcctaggcaaattgtctttaacagtgagcatttaactgtttatttagacactttaacaatgtcttataagttatcctgaaacatttaaggttgtgtggttacaaggccaacttaattttttaaatactataagtgtaatattcagatggaggcattcatgaaataatgttgtttcaattaaccattccacagtctttttgttc

SEQ ID NO: 133476 - DNA, 423 bp, Homo sapiens
gtaaacagcttctggggtaggcttgaaagtaggctccacaggtcccatcttcctactgggaacctggagggagctagtcctatgaggagctgaccttggcaaagagccacaggggccagagctgtggcagatgtgggaagaattctcagtgcctactagtgggcccagcacacaggaggctgatgttgcttatgtccaactagcactgttactgataaaattgatccataaaaatccaaatacgtttcatgccagacaaccatttggtagaacagaaattccagccacaactcagaatattatccagctaagttctattttggaactagtggaatttgatattaaaaaactgtagtgtttaagatattatccacgtcatttccttctttgttctctccctccttctctccttcccttcttcct

SEQ ID NO: 133477 - DNA, 160 bp, Homo sapiens
gcaatttggaagcaatttcgccagtgacacaggactctcatcagcgcggctgttcttggtaggtaggtctgaggagatgggaatgtatgcactgccacccaccaggctgcatctggccagtctccagggagaaattcttccttctggagaaggacaaccc

SEQ ID NO: 133478 - DNA, 519 bp, Homo sapiens
ctaaaaatacagaaattagccgggtgtggtggcacattcctgtaatctcagccatttgggaggctgaggcaggggaatcacttgaatctgggaggcagtgagctgagattgtgcgactgcactccagcctgggtgacagagtgagactcactctttaaataaataaataaataagtacatgagcttaaagggatagtggtgtaatgtagagtttaagcacatacaagttttgaagttagacatatctgtatcagatgctggcttaaccgcttattagctaagtctgtttcctcatttaaaaatcaagttatacacttaaaatatatacaacaaaaataaaatagagtaaaaaaacaaaagtaacaaattgggatgtcataaaaaaatgacagagcagggaactccaaaggtccattctgccactaaagtgaggaaaaaactggtaaaaatgtcagaatcaacctttttggaactctggaaactaaccaaagtttgcaacaaacagaggaatgcttaatt

SEQ ID NO: 133479 - DNA, 206 bp, Homo sapiens
tgttaccatctgggttaccaaggggatcttacaccttctaccttcctagattgttggtgtctgcagagaggctcagtcttcaacagtgctgtccagtagaatgtgctgcagtgatgggaaatggtcttagagattttcatggagttttaagctgtaaaaactatgagccctattaatagcacattttatagaggcttcatgaagtg

SEQ ID NO: 133480 - DNA, 383 bp, Homo sapiens
acagggtctcactttgtcatccaggctggagtgcagccgtgcgacttgtagctcatggcagcctccaacacctgggcgatcctgtaatcctcctgccttggctcccgagtagctgggaccacaggctcatgccacctcccccagctaatttttaattttttttttttttttttaaatagagatggagtcttgctttgctacccagtgtggtggtgcatgcctgtggtcccagctacccaggagactgtgactggaggatcgcttgagcccgggagttcaaggctgcagtgagccattatcatgccactgcattccagcctgggagacagagcaagaccctgcctcaaaacaaaaacaaacaaaaaaaccctctgctctggata

SEQ ID NO: 133481 - DNA, 461 bp, Homo sapiens
catgtgactgactgtaggagagaagtgcggaatgatttctaagtagtggcaataattttatcagaacagaaggcaatacatttgaatgataagttcaaggtatctttgaggcattttgatggagatctctaatagataaattatagttagaaaaaggataggatctttgtcttgaatgaggttatgataggtgtgtacatttgagagttactgtgtggtgatgatggaagcaatggaaatggattacctagagatttattttgttcctcacaaaagaatcgtcatagaagacttacgctgtattgggaggcagctatgtaaaaagctgaggacttcatccagagacttcattcagatcttaattctggatctctgttttctctttcataaattaagggtaatatcagctatatcagaataatcatagataatattttattagggcctgaggtataagagtt

SEQ ID NO: 133482 - DNA, 607 bp, Homo sapiens
gcacagcaccgacagtagtggaagcacatggggaggcatggtggggagaccacagactatcctcatggggctggtacctagcaactttaaccatccaatatgtgagcgtggctaaagaaggcaggacaattcttctattaacataagggagcactgctaaacacactttggggatggggggacacaaagtactcacagaatgtggacagaacacagaaatcaaaccaacatgcccccgaatatggattcctataagcctaggctgaataagtttgctacagaaagtgtcactgtgcttgacagttttgtttgggggaaggaggaagtggggtaaatggtgcacattctttcaaaatgtaccttcaattaagcttaaaaaaaaaaagagaggaagtaagttttaaactaagcaaaaaaacaggtatttacattttcagtgaggcatagtatttcaaatctcctgcctttttccttctttcaacaataaattatcagccaacgctctgataaggcctccagattagaaatgattctactaaccttgttttatttacactacgcatgctttgagttttacagttcagtagtagagctgcacagctcctca

SEQ ID NO: 133483 - DNA, 396 bp, Homo sapiens
agaacagttggcttggaacagcagatagagaagcagtgagagtaaacgcaggtctgcggggccaccgaggacaatgattaatgggtttcccaggcctgctatcagctggggcaggcagtataggaataggtctcagaacatgttaccccaaggccctcttgcaagcactccagtgagcagaggatcggcctacacattcccaacccatgagctcaggctggaggtgagccagggagagccaaggtggacagtgggaggagggtcagaaagggtctgaacgtctcactgctgctccaggaagggaagactagccatccattgaggcattacgacaccacctctgactcgaacaatggactgtgtggtgtgaccttaattaaaggaaaaacgtagaat

SEQ ID NO: 133484 - DNA, 383 bp, Homo sapiens
agggaggacagattccttaaggaaagactgtgctctgggagggggcaggtagcgtcattttggggtgtaaaggcatggaatgctgatttgtaggcaaagttgtttaaggaggtcctgtcacattcagtggcatccgttatgataaagccaataggcttttacactcatctgtccatttctgtcaagaccctatggctgaggtcaaaacaatgttctgggagaaccagttacctctaaccttccaattcagacactgccagcttaactatgtagaaactggcacacagaccctgttaagtgctgcaacaatgacagcgtttctatgaatttgttggtacatgtgggactttagctcatctgaggagtcgaacagcagctgtgaa

SEQ ID NO: 133485 - DNA, 701 bp, Homo sapiens
ttcaactgagtagtaactataaaaagaaaatctgttaacctcacaatacttccaaacctagacagcagagggagtcttagaaacaaatacccaacacattaagttgtataaatcaagccactttaggaacaatgaaaactgggtttttactcattgtaatcactttgtaggatattataaactgtgtaaataaatgtattaaaaaaattatatgtgtaaaaatattcaagtgatattatcttgaaattaatttaaaatgttaagtgggcggggtgcggtggctcaagcctgtaatcccagcactttgggaggccaagacgggtggatcacttgaggtgaggagtttcagaccagcctggccaacatggtgaaaccctgtctctactaaaaatacaaaaattagctgggtgtggtagcaggtgcctgtaatcccagctactcaggaggctgaggcaggagaattgctgaacccggagaggcgaagtgcattgcagtgagccgagatagcaccactgcactccagactgggtgacagagcatgactctgtctcaaagaaaaaaaaacaaaaaatgttaagtggtatttctcctttactgtactactaagattaacgatatttcaaaataaatctggagcatgaacaatgaaaattagctacagttcatgaattttcctaatagatctataattcaagagagcg

SEQ ID NO: 133486 - DNA, 327 bp, Homo sapiens
taagttggagtctcatgccattcagtaaggatttacatggcaagaatgaggtcattgccagccactggcctgggcctgaactagacatcagtcaagcgttctaagtataaggagtatcctcagaaacagagatatggaggaaggccctaaagagccactgtctttttaaaactcaaaacatgaaataagggaaacagcacatttgcaaggtaggtggtgaagaggtgcttttcttgttagaaaggaaaggaaaggaagaagaaaatgaggaagcagtttattttcaaaggagtctcagtggttagtgctttgtgattttgcatattg

SEQ ID NO: 133487 - DNA, 446 bp, Homo sapiens
ttgctataaacaaatcaccccagtgtttagtgcttctttctttggaatcccaacaggccctatatcaggacagtttggggcactgcctggtaggaactccactgccaccacttttggggtgataccagctgcaagtccagagggacaaaacagatgccctgaagtccctcccatgttctatgattctctgggatgtaatggtagacataatttcaaaaaccattttagagcaacaagtttacaaatcttgatgattcctttccatgtgtgccatgtgtgccatgttgctgtgccagcaacagcagtaattctcagggtcaagtttccccaagtgctgagcagaactttttactgaacacattactggaccctagtgattgttgtcaataattgcatcataagcagtggctaagcaagcattaccacctacactgaagaaacacaaa

SEQ ID NO: 133488 - DNA, 380 bp, Homo sapiens
tctaaaccagggataattttaacccacagcggacatctgataatatctggagatatttttagttatcacaactaggaggagggtgccactggcatctagtgggtggccacaatgctgctaaacatcctacaatgcacaggacagaccacctcaccaaagaattatctggcgcaaaatgtcgatagtgctgaggttgcaaaaccctgttctagtccctttacagttttccaggaacccttggtgactgcaatgtccttgtgagataagcaggttggagactgctaaccccatttaagagttgaggaaggcccgggtgggcagatcacgaggtcaggagttcgaaaccagcctggccaacatggtgaaacctcttctctact

SEQ ID NO: 133489 - DNA, 684 bp, Homo sapiens
gagtgactaaaaaacagccatgatgtagtagaactctggcattttcaaagcagtcatctccaagtgtggtgtattgcctgaattgtttcagagtgttggtaaaagtgatatacttggtggtacttgccaactttaaccctgggttgtgctaggaaatgaagtttagtaggacaaggacccatagtagtatgtgttaagaaagggccatagaacagttaaattaatagcgttttcttctctcccctatagtattttgggcacgtttatacccattgaaaggcaggtttttttttctatgcttattgatttagcctatctatttataacagtataattcagaatataaatatggaacaagtttcataaggaagtttatctgtaactcagacattatatcattaatacttcaaatctcattataccattatgacctgaatgctacatttttcttcctgtatggagagcttagggaaaaattgtggcctgatgtcttcatccattcacttatcatagagtacataatgatctcaaatatccaaaaatggttatattcagctgcatatttctaagaaaataggtaggtccacagcaggttcttaaattccacatacttgggtgtaggacacagggattcattccctgagagtttttgaagctgaggagacacctgggttttgtttttcc

SEQ ID NO: 133490 - DNA, 243 bp, Homo sapiens
gtatggttaaataaatcaggatgcttccatatactttgctgccttcttaaagatttatagtgcacattagcttagtaaaagctttgggaagttctgcagttaaaaaacaggtttccttttatttaactcagctagtccctaaaagtaatcagtcatgaattctttaaacatttttttttttttgggcaaaagactttaacatcatggaaccaggggtccagtggaactcctttgggaaaggtt

SEQ ID NO: 133491 - DNA, 409 bp, Homo sapiens
gcacttatagctcttaaaatgaaaagtagaaatgatgttaagtattatctcattctaagcaataaattatatttatccatgagtgcagtggcgcgatttcagctcgctgcaacttccttctcctggtttgaagcgattctcctgttttagcccagctaatttttgtatttttagaagagatgggatttcaccatgttggccaggatggtgtcaaacttctgacctcagatgatcagcccaccttggactcccaaagtgctgggattaaaggtgtgagtcactgcgcatggctaaaggaaaggtgcaagtttttttttttttttttggaaacagagtttggctctgccgcccaggtagcttgaaatttcacgggcacgtaaccaccagtgcctgactattcacttggtat

SEQ ID NO: 133492 - DNA, 1006 bp, Homo sapiens
aaagagttcacagggatctatcatgaaaactgtacagagggtttggagcatcctacaaaaacatgttctgagaaaccatgttccatgcccttgtcccagacttgaaaggcatttgcccatcatgttggaaggatgggatttgaggctgatcctcttgtctggatgggttttctgcacccagcctcaggagacactgacatgaggctccattttgagaccttaaggttggagtattccataatacagcccacagccaggggtgcagtagtcttcctctcttcctagagggtagggattctgccctgctcatatttgcacctttctcctccctctgacctccctcactgccatcagcaaactagagtactttgcctgtcgggggtgtttgccaagtgtttctgagtagaccctggtactacctggtggacactaaagagggctctaggcagtaataagagggaattctggttgtaccttgtgcaggggaggcttcctgctgttgctggattccctgttggaaagaagctgggcagttgtgtttagaactgaccctgcagatggggaggcttcccccttctctctcttcctgagggctacttccagatgagtgggggagcctgccagtgctcatcaggtccacctgacatgtcaaaaggaaaaaggagaaacctgggtcttccccgggaactttgaagttacgaataggaaatcgaaggacttgatgccgagataatgttcttttggaaggaagggactggttccccagaccagcacctctggtaaccagagagaagatgttttgtgaagactagagtgatgcgttttctgggagactgcaagttaagaaggctttaagctttatattaattagaaatttgtattaatgtatagtaattagagaaaagcctacaggaaaatcacagaatcggataatgaggagacctgtgtgacttagtagcattctaggtaccaaagtggtgcctcggaactctcgagtggaaaccag

SEQ ID NO: 133493 - DNA, 210 bp, Homo sapiens
ctcggcactgcttggatggtgtaatttactaagagctaatagaaaggctaggaccaaacccatgggtctgctgagattcctggtgcagggctctttggggaaggagcatggtggctcaggtcaaacatacccgaggttaagtctgggtccagccagagaggacctttaaccctgcccactgcgcttcctctccttgagcctcagtttccc

SEQ ID NO: 133494 - DNA, 312 bp, Homo sapiens
attaataattccttcagaagggagaaatagttcttttgttgccaccacagagtagggaaacttttactgagctttatttactctgcctagaatctacccatacactttagatacctttttttttcctcttctattcatggaaactgcttgtttggtgaaagtatatgtaaaatttggttatgggacttgattatgtaataagaaacctctgttagtgcttggttgactgtagcaataagcaaagcaaaataaaatttgaagttggggtgatttggaatgacttaataaaattcatataaaacagaactagag

SEQ ID NO: 133495 - DNA, 433 bp, Homo sapiens
cgaaactctgtctcaaaaaataaataaataaataaatacatgtgaaatattttcactaaagtagtagtctcaatcaagggcaattctgacaatttcttcagacattcctgatcgttacaacctgcagaggatgtgttatgggtatctaatgggtagaggtaggaatgttgctaaatatcctacaatatacaacagagcccccacgataattatctggcccaaagtctcaaagttccaaagctgagaaacctttctctagagccatactgtgccaaatacttacggtcaatttcaaacaaaaagaatgcaccaagttctcaggaaatgtttacctaccttgcctctaatacatactgttttgttttgtttcttttctttttttcttgagtcagagtatcatgagacgcatatcgggatcctctagacagccaca

SEQ ID NO: 133496 - DNA, 718 bp, Homo sapiens
cgaaactctgtctcaaaaaataaataaataaataaatacatgtgaaatattttcactaaagtagtagtctcaatcaagggcaattctgacaatttcttcagacattcctgatcgttacaacctgcagaggatgtgttatgggtatctaatgggtagaggtaggaatgttgctaaatatcctacaatatacaacagagcccccacgataattatctggcccaaagtctcaaagttccaaagctgagaaacctttctctagagccatactgtgccaaatacttacggtcaatttcaaacaaaaagaatgcaccaagttctcaggaaatgtttacctaccttgcctctaatacatactgttttgttttgtttcttttctttttttcttgagtcagagtctcgctgtcgcccaggctggagtgcactgggtgatggagtgagaccctatctcataaataaataaacaaataaatgtcagggaccaaagtatcacataacatataaacagcaggaactatcttatctgggccccatatttcaggagcctctctattgactactgttaggtataactcctccatatttgtctattcattcaagtaaacacacttactgagggcctactatgtggcaagcaactggacaacaaagataagatgaaaatattttaccagcctaattaaaaaaacagctaaaataaaaatgatatgtgctataaata

SEQ ID NO: 133497 - DNA, 368 bp, Homo sapiens
acttacaaggttgccagagatcccaagattcacaattttaagactgtatatcacacaccctttatatgcttgtctgtatagatataccctcatgtcttccacatattcagaaatggaagaaaattcattccaaatactattgattctgatcagtgggaattacagaaattcatatcgcagttcaacaatctgtaaaagaaactacatggcttttggccttcaaaaaattgtaacagaaaatattaactgaaccaaatcagtatttcagaagcttttttttttttgcaacttaaattatccactattaagaaaatgactttttttttgagatggagtctccctctgtcatccaggctggagtgcagtgg

SEQ ID NO: 133498 - DNA, 491 bp, Homo sapiens
ctctgctttttaaatacttcttgaatcataacgaatatcattttccaggtaaactgaaccattcacattaatggtacctacgaagttctttttttcctagaaaatgctatcagtgtatcatattaggctggtcaagggcatacactgggttgctcactgatttgggtaaatgatccaacctctctgctcaggttcctcattgaaaactgggatcacagtaactcctgagtttactgtaaggactaaatgagtaaagagatatgctaaccattattacattcccaggtgatcatatcagttaagcatttgttaagcgcctagcataacgtgaaagcactgttccagcagacaacaggcagagacaacttttctgatggtgacaagtgctacagagagaaagaaagttggggagagggataaggaattaatgtatgtgtgtcacgaggtggtggcgggagttgctattttatacaggagagcttggggtatat

SEQ ID NO: 133499 - DNA, 1166 bp, Homo sapiens
caggcacgggagagaatcaccttgtctgccggttgctaagaccatgggaagagcacagtatttgggtggaagtgtcccgtttatccaggcagtctgtcatggcttcctttggctaagaaagggatatcccctgaccccttgcgcttcctgggtgaggcagtgccccaccctgcttttcctagccctccatgggctgcacccactgcccatccagtcccagtgagatgaactaggtacctcagctggaaatgcagaaatcacccatcttctgcgttgatcatgctgggagctgcagactggagccattcctgttcggccctcttgcagttgtgtgcagatcattattaatagtttttaagttgaattcctgttactgttttctaaagcagtatcaacgtattgatatttgtaactattgattttttaaaatatctctgaacttaacaagagttacatctaactttttaaagcagtgagctccgaacccataaaattacaaaatgctaatttttgctatagtttactagctttctgtgaacttaggaatgtttgcatttatttttaggaatatctatggcttgttcattaagcaaatgtttattgagactttattgtatgccaaggactaaagtagtaaacaagatagacattgtctatgtatactaacgaaccatatattcttgggggatggagtccttctgtcagttcatttatcagttttatcagtgtgtatgactctaaaaattattcacaaacctctatatcaatatttagatatcttgttttgctttgttagaaaagatgatattatgtaattatatatattgaaaacatagagcatatattcactattcttttgaaaagtgctattgggccgggtgtggtgtctcacgcctgtaatcccagcactttggaaggctgaggcgggtggatcacctgaggtcaggagtttgagaccagcctgtccaacatggtgaaaccccatctctactaaatacaaaaaattagccaggggtggtggcgcatgcctgtaatcccagctactcgtgaggctgaggtgagagaatcacttgaatctgggaggcggaggttgcagtgagccgagattgcatcattgcactccagcctgggcaacaacagtgaaatgccatctcaaaaaaaaaaaa

SEQ ID NO: 133500 - DNA, 343 bp, Homo sapiens
ttaaagttaattttctgtcctattttttacttgatgaatctggcaacttcactatgaatcacaggatttacaataatatggtactgacctgggagaaacaatatagaagaacataatcagagagcttatctgtaggtgggtcagagtgcaaaggactattgggtcctacctgatacattaaaaactgatcaatctaaatgcacatctcagccctcactgtgagaagtgacagccatgggtggctggggctgagggtgaagctcccgagccctctcaggaaacagataatgcagatcaagttcatccttatgttggctttcacctcggactattctaaatattg

SEQ ID NO: 133501 - DNA, 531 bp, Homo sapiens
gtgtgtctgtgtacacagagaaagagagagagacagagaaagatggagtcacagccacagaaccagagacccagggagaaagagagagaaatacagggagaagagatacgcacagagacagagacaaagggtgaaaaaataaccttagaaatgataccagtggggcccaggcacagtggctcacgcctgtaatcccagcactttggggggccaaggcgggtggatcacgcagtcaggagttcaagaccagcctagccaagatggtgaaaccgtctctactaaaaatacgaaaattagctgagtgtggtggcgggcacctgtaatcccagctactcgggaggctgaggcagataattgcttgaacctgggaggcagaagttgcagtgaaccgagattgtgccattacactccagcctgtgtgacagagtaagactctgtcaaaaaaaagaaaaagaagaaagaaagagggaaagggagagagagaaagaaaggaaagaaagaaaggaaagaaagaaagaaaagaaagaaaga

SEQ ID NO: 133502 - DNA, 377 bp, Homo sapiens
tgataaggaagatagtcattaaatattattaaagatagtaaaacaggctataaaaccatataaagtataactccattttctgatacagtatatatgttaaatataaaaaactagttcacataccaaaatattaaagtagatattatgtctgctgagactaaagataacttatattttcatcttgaagttttcttatatttttaaacttttctaaaaagtgcttctcaaaaaatgttatatttgtccaaaagaaagagtgacaccgcgctctgctggttttcctgctctcagactctttgccagctcctgtaacactgttaaagtattcacttcatcagtgatctttctcaggccctcttctttcctcctgtctgaac

SEQ ID NO: 133503 - DNA, 142 bp, Homo sapiens
tgtaaacagaaagcacttaggtaagagtttagtaaaacatgtttgctgcccagtaggaaaaagcagcatgtactatagttgaaccttagagaatcatggaaataaattcctcatctcagtgaaatgttctggtgacatattt

SEQ ID NO: 133504 - DNA, 721 bp, Homo sapiens
gcgcttcttgctgccaacatgtgaagaaagacgtgtttgcttccccttccaccatgattgtaaaatcaacaaggaaggcgatgagcacagcagtgtgaagttcctggcaaccatcattctacttttgtctccatgattttgaatactctaagtacctcatattatagccatcctaatgggtgtcattttcatgcgcgtccatgtgaagagaccaccaaacaggcattgtgtgagcaacaaggctgtttatttcacctggctgcagaggtgggaaggccaaaccgaagaattatgtctgacagaagggaagaaatgaccgcggtgaccttctcagaccctgtgggaaagacctctacctatccagtgaaagtgtctacccagactaagagggggcttccgaggcgattgggcaagatcagtcttcagccactaagccgagaagatctgggaaggagtcagagagccttgggcccacagttccagggctctgagagtggctgcagcctactcactgtgaagacaatgagggtgaaaaccttcatgatgatccacttccacttcatgaacaggaaatatgttttttctcttccttatgattttttaaaaacattttcttttctcttgcatgcttgattgtaagagtgcagtacatattatatatatataatatacaaaatatgtgttaatcagctatgtgttagccaactatgttattaatgta

SEQ ID NO: 133505 - DNA, 314 bp, Homo sapiens
ttctaggagacagggaaaacagatattaggacactaaatctaaactaaataataaactaaatcccactaaacaatatgctgcttaaccttggaagaaaacaaaacaataattctcataatcaagtttctctgtagaacaacatttcttttgtgtacatacagcatactccttactacagagaaaggcaatctctagttttcaagagttctcatattggtgtcacttgtaaatgggtaagttcatagtaataactgcagactaattcaggcacagggttttcaacaacaaatggggtaggtatacagatacagaa

SEQ ID NO: 133506 - DNA, 652 bp, Homo sapiens
gaaatcttgtctgttggagaagcaatttttttcaactttgtaacagagacttgacatttttaaattttaaaagatgatggactagactcaagtattttttaggactgtcccaatcataagtctgaaggatttcagtgcttatcataacatttgacatacagttggcacttggtaggtactgaatcaatgaataggagttattggttgcctattcagaggcttgtgggagttgtcatccccattgcagagagccagttggtgaatcagcaaggtttccatttatgctgctcccctccacccagtcccctggagggactactctctgagcagaaggaccattggtgttagcagaagacctcatatgtgttggagaacatgttgccttgtgcagcacaattgaaagtgtcagggaattggaagcagaaaaaaaatcataacctggatgagtgacttcagtttgatccagagataataggttgggtattagcctacatgctgtgagaaatttttattttcacttcatttcatgtcatgtcatgtcatgtcatttcatgtcatctcattgcaggttcaataatccttggttcataacacacttgcattattggtctatgcttggtccacttttatctgtgtttttttttctttctat

SEQ ID NO: 133507 - DNA, 1536 bp, Homo sapiens
cctcaagtgatcatcccacctaggtctcccaaagtgctgagatgacaggcgtgagccaccatgcctggcaaagagagtcttgatacaacatattcttttgaatcctcattgtgtaaattgcctcgttgtaaatagacactcagtaaacattttcctcaccaaaatatttttaaggatttttctacccttctccttttctctttgctttccttttcttgcctgttctttccactccccccaaaatgatcagatagcaaatgtcttgataacatgaggtgccctcacattaaaaaacaaaatattgagccgggcgcggtggctcatgcctgtaatcccagcactttgggaggctgaggtgggcagatcgccttaggtcaggagttggagaccaggctgaccaatatgatgaaactctgtctctactaaaaattcaaaaatgtgccagacctggcctggtggcatgtgcctgtaatcccagctacttgggaggctgagtcataagcctgcaatgggaaaatggatcgaatctggggtgagggggaagtgatgtgggggttatggtacctcttttctcttccaaagatgctgttcttactgcatcacttgtggctggccaggaaaagccatgcaggagttttgtttgtggccactaggtgacgatcgtgttctgtacgggacctcttattaatagttcaccactagccgccactccagaagagcggaggaacccaggataatattttgtcaaccaagaaacaagaagtccctcccaggaactggaaatgaatggggaaaatgctgaaatctcatttgcactattcatttctcttctctctggaaagctcggcaatcatcaggtcatttcatttggcttaaattccatgtgtctttccaaacttttaaaagctggtgaaaattgttccacccatatgtaaaagaacataggttaagttgtctaattcttgcaggaatgtggatatagcattaaaaatatgtctttgtatacttatcttacccatgtaagaaaagagtggccaactttcatataaatagaaagagaacatttaagctatatgcagtttgcatttttgtctactattatgaaattattatctatgaaattcaagctgtaactcaacatatgtataattttaatttctaatttattgttagatctcagcacttaaaaaattacatcttgtatttgaattgttaaatctgttccctgcaaagaacagtaatacaatcatgttctaatttactagcatttgcatattttagaaatataatggcctgtaatttacttttcttttgcctataattttctgaagctctttatgatgcaccggtgcatttttatttaaaaaatagattgtgactcctcaaataatgttacaattcgatgttcaaaaagcaatccaggtacatagccataaagggatgagctagagaggtctccatattatcattcaatgtgagaataaaaattctatattttattctagaataaaattataaatttctttatctaggaaa

SEQ ID NO: 133508 - DNA, 741 bp, Homo sapiens
agccactctacagcacaactgcccctttttttttgcaataaggacacgagggaaaaaaagccggtaaggtgggaggagttgctctaaatgaaagcgatttgagacataacaatcagatgtaatcagaggaacttctttgcaatctgaagcaaaccagctgctaaaagaggacagtcaaggaaatgtgattcggggtatgagattacactgtgtgctgttaactatgtgatcatgtcattgtagctatgtaaaccaatgtctacagccttagagatgcacagtgaagaacaggaatgacgggacatgtcgtctgacatgtgtgacttaaaatgcttcagcaaacaaacaaaaaaagggaaagtaaaaaagagcagacaaagcaaatgtggtaaaatcattgtaaccattgcatttaggtaagagataatagtctactctaaaagattctattgtaaaatattgtgtatggttgaaattttcatggttaaaaaaaaaaatctgtgaatgctaagatattcctttcctgctcttctggcaatggcaaactaatcccaggaccaccgcatagaggggcaactgtgactgaaacgaatataatccccgaaacggctctcatttccccagtcaatcctgagcacaggagaatgaacacaggaagaggcctctggacagcaggcaaaggcagtggctgcaggcgaaggcagtggctgcagggcagcgacaagcaaaagacaaaggcag

SEQ ID NO: 133509 - DNA, 484 bp, Homo sapiens
catcggaacccaatgagcgaatgtttgctgaggctcctgctggtgttgctatgttgatgaaattgagaggagccaggaaatgaacattataatagtatcttttttatttttatttttgagatggagtctcgctctgtcacccaggctggagtgcagtggcgcaatctcggctcactgcaacctccaccttctgggttcaagcgattctcctgcatcagcctcccgaatagctgggttacaggtgtgcaccaccatgcccagctaatttttgtgtttttagtacagacggaatttcaccatgttggtcaggatggtctccatctcttgaccttgtgatcctcccgcctcggcctcccaaagtgctgggattacaggcatgagccaccgcacccagccatgaatttttatatatgaacaaaggttttcatttcacatgggtatcccactgggagtgggattgttggctcatatggctatagcgctt

SEQ ID NO: 133510 - DNA, 389 bp, Homo sapiens
cgaggtaaatggtctcttcaagagaattttgaacaaggcagaaatcttgctcaaagacactgttcttgtacccaagactgcagaggtgagactaagatagagacctgatgaagatggctaatttgggacacaaggttacggtaattttttaatctgataacctaacaatacaatgcaagtaggactaggaggggacagaatgtgctttataaagactgatatgcctattaaacagtctgtcaaatatcagaaatattaggatagcctttggcgagtgccggggctcagacggtttacgattgaattttctaacaggtacctgtagtgcaggcgttctatgttgctgtgatggccatatgctttagataccagatggaaaggaaggtgtc

SEQ ID NO: 133511 - DNA, 250 bp, Homo sapiens
ctccacacgtctgtcagaaggtggtgggagccactgagggtgggtccctcctcccccggtgcagagctttgtcctttctcactgtccctgtctcgctccctccctccttctctccccgtctccctcccccacttctctctgtccatctctctatctctgtctctccatctgcctctgtctctgcctctctctccatctcccccatgtctctctgtctgtctgtctgtctctccatctgcctctgtctctg

SEQ ID NO: 133512 - DNA, 370 bp, Homo sapiens
aaattttcttcaactattttggactgatgttcatttctcttctagttgagtcacattccccttttgatattctgaaatgtaagtactaaaatatgaaactgactgctattaatacactgtattgtagacagtaaggaaatgggagaagtgaggataaaaaattgctactatatacacaaatctattcatatcaaagtaaggaaagttttgcatgaccaatgcagtgttcatttctacaactggtcatatcaacttaattaggatttataactacctttttccaccagtcattctataacccctttaccctcagcaaatacctcagctgtttatggtttcttgctgtgtaggatgtcccacatcatcattc

SEQ ID NO: 133513 - DNA, 257 bp, Homo sapiens
gggagccgttagacaagtgcaacatctatagggcaagctttcacgcagaactctcaggcacaaactgaagctgctgtccagaggcagagtttctttttcaggggaacttcagctctgtccttgaggccttttgactgattgaatcaggctcacatatattatcttggatggtttccctaaaagccagctaattatgggccttaatcacatctgcaaaatactttcacagcaataccttgattagtgtttggataacc

SEQ ID NO: 133514 - DNA, 528 bp, Homo sapiens
ctgtggggcttcagagaacgtgagcacctgtgtttgcattctccatcaaggttcatgtcctgttggctcataagcatgattatatccattatacaaactggggcacaggcacccagagagaagtcaaaagacttgttcaagatggacaactaggaagtggtggggacagaccagtcctgtctgatgccagatccagcgctgtatctgccagtcagcatgcacactttcatctctccagcctcttcccactcacctttactcaacatttctgggcctccatagtgattgtagtaattcggtaaagatgattcatttctttagtccggtcttcggacttgacttcttagaagcaggtcttgtgcaatagttgcatattaaccacttggtgacacagtgcatgagggtatgccaactctttttgctcatggccgtgcagtgcagaatttccaggcattgtccgctctgtttcctggacttcggagtgatagcaaagttttgtattccctgatcagctgtgtatctctgagc

SEQ ID NO: 133515 - DNA, 430 bp, Homo sapiens
  misc_feature (173)..(173): n is a, c, g, or t
attccaaagggccagtatttccctggtaccaaaaccagacaaagacgcaacaaaaaaagaaaactacaggccagtatctttgaacagagatgcaaaatccttaaaccaaattcaactacatatttaaaagatcattcattgtaatcaagtgggattcatcccagggatgcaanggatggttcaacatactctgatatggtttgtgtttgtgtccctgcccaaatcttacatttaattgtaatccccagtgttggaggaggggcctggtggaacgtgattggatcataggagtggagttctcatgaatggtttagccccatctccccttgctactatatagttagtgagttctcatgagatctgattgtttaaacctccctgctctctgtctctctcctactctggccatgtgtgttcccctgttgccttc

SEQ ID NO: 133516 - DNA, 261 bp, Homo sapiens
ttccccaggggacacattgacatttacaacactcatctttattttttttttaatactgctttctatccagccaattattagtctgtcttttaataattcatccaaatctcttctgaatcattgcataactttgtacagtttccacccacagtgtcttttacttttatttttggaagtaactgtttttaaaagttactgttatttttaaaagtgtgccttccccagaaatcagggagttacccatgtcctagaactccacgg

SEQ ID NO: 133517 - DNA, 790 bp, Homo sapiens
agcggagtcttcggggaggagctgcattacacacaggcttcggaggcttccgtggagaagcttggaggtaatggctgtcgtaaatgctagttattttcagagagttctcgaagatttggaataaagccgagccccagaaagacaggtcaaccacagaagtgctgagccaggtaaagaccctgctggacaagcagctggagtgagaatcaagacagctggaccacaggaccagacccagcagtatccatgtgacacataggttaatatcagagaagcacatgacctgggcaatctgcatgtgatgccaaccaagccttggaaagacagtgcaaccacagaagtgccgagctgggtaaaggccctgctggacaagcagttggagtgagaatcaagacagccggaccacaggaccagacccaccaggatccacatgacagtggtatcttccggtatcatcctattcaaacaacgtgttcaagcatccttggaaaattgaggtggagaacaggccacacaagctgtaaaccctttgtagtcataagacgaaagaggatttgttaagagtattgtattgggtagaacttgcattagcagtgacaaagatagccacctcaagctttggtaataacccttggaacacaaatataaaccataatggagtctgagtatgtcctatgcaactggaaagaaccagttgtggccagcaaaagtttgtccagatctgaaacttcatcaaacagtaagaggaaaaggcattttctctagaagttcaaatactctcactagatga

SEQ ID NO: 133518 - DNA, 786 bp, Homo sapiens
agcggagtcttcggggaggagctgcattacacacaggcttcggaggcttccgtggagaagcttggaggtaatggctgtcgtaaatgctagttattttcagagagttctcgaagatttggaataaaggtgagaaaagaagagagtgctgcttaggaataacgggaaaggagtgtcgttctgtgagggtcgttgtttctgtgagggaattaatatctgtgttttgtgttccttcagattattttaaaagtccacagtcggggaggtggtaatcaacattacacctgtggaaaaatattcttaaagaggtagcaaaagctaactttttaatagagcattttatgtttccatcaaaaggcagtggtggctgagataaatgatgaaacaaaacttgggagtttaatcttccttattttgaaaaaggttgtaatagtcttaaatgaaaaattaagttgttggggatgttggttttttatattactttgaatgtgttgtgtttctaacaaatcttactgttttggtggagtatgttagtaatttaaagtaatgcataactgtgcaaattcgagtatctctgagaattagtttggttatttgtcaagggatacacaatgacttaatataatagctttttaaataatgtgcaaaatatgatctttgtctgtacttctacctatctctcaagagaattgtacattcctatttgtactgcaatggaaaaaatctaaaagatcataacaataacagacgtgcattagtataataaaacacaacaaacaatatacttag

SEQ ID NO: 133519 - DNA, 469 bp, Homo sapiens
gagtgggaatgcacagttagtacagccactgtggaaaacaatatggagatgcctcaaaacactaaaaatagaaatatcatataatccaacaatcccactactgggctgggtatatagaagaaaggaagtcaatatatcaaagagatatctgcacattcatgtttactgcagcactattcccagtagccaagactgtgactttggtgaggatgtatgaccaaaagagagaggaggggggtatatggaagagattgcttgtatggatgaagcatggaataaccgtggcaaggagagaaataacgagatgaggggtgagggacagtgaggtggaggatggatcaatgtgttgtgggtcctgcaatggtagaaagaccatcaaggtgcttgagggagtgaggaggaaaataggaaatagtggctggagagtggttacttgaaactgagtttatggcaaggatgtagaggggtg

SEQ ID NO: 133520 - DNA, 323 bp, Homo sapiens
tatgtacaactgcatggtgaaggcagagagttggatttaaccaagactgtgactttggtgaggatgtatgaccaaaagagagaggaggggggtatatggaagagattgcttgtatggatgaagcatggaataaccgtggcaaggagagaaataacgagatgaggggtgagggacagtgaggtggaggatggatcaatgtgttgtgggtcctgcaatggtagaaagaccatcaaggtgcttgagggagtgaggaggaaaataggaaatagtggctggagagtggttacttgaaactgagtttatggcaaggatgtagaggggtg

SEQ ID NO: 133521 - DNA, 396 bp, Homo sapiens
atttctgtggctcttcagtgacagatgaatgaatgtgctcaattcaggtaactacatttgacctttttcctacagcaattgaagggtgtttgggtagcatctgcgattgtgttgaatgccctggttggttacgggtgtggggaagtggtatacagtactttgatcctcctttggagaaggagatgctaatgtggataatgagaatttggttctttatctttagtttcgatttggccgccttccttcactgagtcacagtgctcacttgtttagtgatgggcatgtcatttaagcctgagactgtccctcagactgtttatgacattggatctgaatttcccattagatgaacagccagcatttgtcatataaattcaagaacacactaaaagtttg

SEQ ID NO: 133522 - DNA, 2158 bp, Homo sapiens
  misc_feature (1299)..(1299): n is a, c, g, or t
agctaatcgttgccagcggggtgtggacttcgccgctgaccccacctccgccgctttgggtaatttagagccgcgcgccgggcgggaatgtaagatggcggagtagcaacgcaaagcgcttggtattgagtctgtggccgacttcggttccggtctctgcagcagccgtgatcgcttagtggagtgcttagggtagttggccaggatgccgaatatcaaaatcttcagcggcagctcccaccaggacttatctcagaaaattgctgaccgcctgggcctggagctaggcaaggtggtgactaagaaattcagcaaccaggagacctgtgtggaaattggtgaaagtgtacgtggagaggatgtctacattgttcagagtggttgtggcgaaatcaatgacaatttaatggagcttttgatcatgattaatgcctgcaagattgcttcagccagccgggttactgcagtcatcccatgcttcccttatgcccggcaggataagaaagataagagccgggcgccaatctcagccaagcttgttgcaaatatgctatctgtagcaggtgcagatcatattatcaccatggacctacatgcttctcaaattcagggcttttttgatatcccagtagacaatttgtatgcagagccggctgtcctaaagtggataagggagaatatctctgagtggaggaactgcactattgtctcacctgatgctggtggagctaagagagtgacctccattgcagacaggctgaatgtggactttgccttgattcacaaagaacggaagaaggccaatgaagtggaccgcatggtgcttgtgggagatgtgaaggatcgggtggccatccttgtggatgacatggctgacacttgtggcacaatctgccatgcagctgacaaacttctctcagctggcgccaccagagtttatgccatcttgactcatggaatcttctccggtcctgctatttctcgcatcaacaacgcatgctttgaggcagtagtagtcaccaataccatacctcaggaggacaagatgaagcattgctccaaaatacaggtgattgacatctctatgatccttgcagaagccatcaggagaactcacaatggagaatccgtttcttacctattcagccatgtccctttataatagagtaacttctgaggctttttgagaataaaatccaccccacccttgtttccccttggtatttgatgacaaattcagcagaagacccggcttgctccagtgtagctttctacatcccacatcaggtatattagagnttatccgaactggggaaagacggattgagattaactgctgggacctcctacctgcattatctcattctggcttccttgataattctgtgggccttgcagctttaactatagctcagctgctgcaagatttcagacttttgaggatgttgtgtgagggtgtttgactgtgactggggaagctcagactactttgtatgtgaatgcttcagggttttctttgttgagaacaactagcaacaaaggcaacccatgtgtgaccagttctccccaaggtctatgctaaattatagcaagagccctgggcaaccccaaacctagtcctggtagctgagcaccctgtaaggcaggagcaggcagctcagcttgagcagacattgggtggggggtggggggtggttgaggggggaggcagcacagtgcagcaaatgtttcttgggaggaagaagcctgatccatcaccatctgcttgactatgtagcttggattctcctttgtacctatccctttcgatttggctttaccttcatctatcttgatcctttcctggccaaatatcctcttgggcccaaatgaacattgtaccatagtcttctggaaagcaaacatgcttcctgctatgtaattgctaacattcatattagatgatgtgctgtagcttgatcttccttagcctactgccactgaggcagtaggttttaggtggtatcgtagtgccttttgattaatttaagtatttaattttcatcttccttctttggatctatttggcctctcaaatgaactgagattcctgttaaaaaagattgatgttattgtctcttgtagaggaaactaataaagtgtgtgtacctgtgtgaat

SEQ ID NO: 133523 - DNA, 828 bp, Homo sapiens
  misc_feature (552)..(552): n is a, c, g, or t
  misc_feature (575)..(575): n is a, c, g, or t
  misc_feature (583)..(584): n is a, c, g, or t
  misc_feature (587)..(587): n is a, c, g, or t
  misc_feature (597)..(597): n is a, c, g, or t
  misc_feature (623)..(624): n is a, c, g, or t
  misc_feature (633)..(633): n is a, c, g, or t
  misc_feature (648)..(649): n is a, c, g, or t
agctaatcgttgccagcggggtgtggacttcgccgctgaccccacctccgccgctttgggtaatttagagccgcgcgccgggcgggaatgtaagatggcggagtagcaacgcaaagcgcttggtattgagtctgtggccgacttcggttccggtctctgcagcagccgtgatcgcttagtggagtgcttagggtagttggccaggatgccgaatatcaaaatcttcagcggcagctcccaccaggacttatctcagaaaattgctgaccgcctgggcctggagctaggcaaggtggtgactaagaaattcagcaaccaggagacctgacccagctgataaagtaatgtcaccgataatggacagcttcttcccgaattattgtgctactgattgtgatgcaaatgatagtgtaaacattgccatctgtaaccaggcaataccttagttaaaagaggcttacaaactgctgtctttagatttttccaaaccattatggctcatgggccttaataaagaatacaaaacaggaaaaaaaaaaaaaaaaaaaaaanaaaaacaaaaaaaaaaaaaaaanaagaaaannaanaaaaaaaaanaaaaaaccaataaaaaatcccccctnnaaaaaaaancaacagaaaaatggnntctttttggcggccccttgcgcacagcgctttttttattgtagaattttttagatgggcccccaaatttggcgctttttgcccattttgccttaaggggggggggattacaaatcacgggcccggggttttaaacgggggggggggaaaacccggggcgcccaaatttaaggtttgagg

SEQ ID NO: 133524 - DNA, 2109 bp, Homo sapiens
  misc_feature (1250)..(1250): n is a, c, g, or t
agctaatcgttgccagcggggtgtggacttcgccgctgaccccacctccgccgctttgggtaatttagagccgcgcgccgggcgggaatgtaagatggcggagtagcaacgcaaagcgcttggtattgagtctgtggccgacttcggttccggtctctgcagcagccgtgatcgcttagtggagtgcttagggtagttggccaggatgccgaatatcaaaatcttcagcggcagctcccaccaggacttatctcagaaaattgctgaccgcctgggcctggagctaggcaaggtggtgactaagaaattcagcaaccaggagacctgtgtggaaattggtgaaagtgtacgtggagaggatgtctacattgttcagagtggttgtggcgaaatcaatgacaatttaatggagcttttgatcatgattaatgcctgcaagattgcttcagccagccgggttactgcagtcatcccatgcttcccttatgcccggcaggataagaaagataagagccgggcgccaatctcagccaagcttgttgcaaatatgctatctgtagcaggtgcagatcatattatcaccatggacctacatgcttctcaaattcagggcttttttgatatcccagtagacaatttgtatgcagagccggctgtcctaaagtggataagggagaatatctctgagtggaggaactgcactattgtctcacctgatgctggtggagctaagagagtgacctccattgcagacaggctgaatgtggactttgccttgattcacaaagaacggaagaaggccaatgaagtggaccgcatggtgcttgtgggagatgtgaaggatcgggtggccatccttgtggatgacatggctgacacttgtggcacaatctgccatgcagctgacaaacttctctcagctggcgccaccagagtttatgccatcttgactcatggaatcttctccggtcctgctatttctcgcatcaacaacgcatgctttgaggcagtagtagtcaccaataccatacctcaggaggacaagatgaagcattgctccaaaatacaggtgattgacatctctatgatccttgcagaagccatcaggagaactcacaatggagaatccgtttcttacctattcagccatgtccctttataatagagtaaggtatttgatgacaaattcagcagaagacccggcttgctccagtgtagctttctacatcccacatcaggtatattagagnttatccgaactggggaaagacggattgagattaactgctgggacctcctacctgcattatctcattctggcttccttgataattctgtgggccttgcagctttaactatagctcagctgctgcaagatttcagacttttgaggatgttgtgtgagggtgtttgactgtgactggggaagctcagactactttgtatgtgaatgcttcagggttttctttgttgagaacaactagcaacaaaggcaacccatgtgtgaccagttctccccaaggtctatgctaaattatagcaagagccctgggcaaccccaaacctagtcctggtagctgagcaccctgtaaggcaggagcaggcagctcagcttgagcagacattgggtggggggtggggggtggttgaggggggaggcagcacagtgcagcaaatgtttcttgggaggaagaagcctgatccatcaccatctgcttgactatgtagcttggattctcctttgtacctatccctttcgatttggctttaccttcatctatcttgatcctttcctggccaaatatcctcttgggcccaaatgaacattgtaccatagtcttctggaaagcaaacatgcttcctgctatgtaattgctaacattcatattagatgatgtgctgtagcttgatcttccttagcctactgccactgaggcagtaggttttaggtggtatcgtagtgccttttgattaatttaagtatttaattttcatcttccttctttggatctatttggcctctcaaatgaactgagattcctgttaaaaaagattgatgttattgtctcttgtagaggaaactaataaagtgtgtgtacctgtgtgaat

SEQ ID NO: 133525 - DNA, 749 bp, Homo sapiens
  misc_feature (643)..(643): n is a, c, g, or t
agctaatcgttgccagcggggtgtggacttcgccgctgaccccacctccgccgctttgggtaatttagagccgcgcgccgggcgggaatgtaagatggcggagtagcaacgcaaagcgcttggtattgagtctgtggccgacttcggttccggtctctgcagcagccgtgatcgcttagtggagtgcttagggtagttggccaggatgccgaatatcaaaatcttcagcggcagctcccaccaggacttatctcagaaaattgctgaccgcctgggcctggagctaggcaaggtggtgactaagaaattcagcaaccaggagacctgtgtggaaattggtgaaagtgtacgtggagaggatgtctacattgttcagagtggttgtggcgaaatcaatgacaatttaatggagcttttgatcatgattaatgcctgcaagattgcttcagccagccgggttactgcagtcatcccatgcttcccttatgcccggcaggataagaaagataagagccgggcgccaatctcagccaagcttgttgcaaatatgctatctgtagcaggtgcagatcatattatcaccatggacctacatgcttctcaaattcaggtatcagtggaagctaaatattggtgtttgaanggtgggaggaaaggactgatgatgctgaagactgcagagaagccaaaaattatgcccaagtacatctgaaaataaactagatatcaacaacaaaaaaaaaacaaca

SEQ ID NO: 133526 - DNA, 1842 bp, Homo sapiens
  misc_feature (983)..(983): n is a, c, g, or t
agctaatcgttgccagcggggtgtggacttcgccgctgaccccacctccgccgctttgggtaatttagagccgcgcgccgggcgggaatgtaagatggcggagtagcaacgcaaagcgcttggtattgagtctgtggccgacttcggttccggtctctgcagcagccgtgatcgcttagtggagtgcttagggtagttggccaggatgccgaatatcaaaatcttcagcggcagctcccaccaggacttatctcagaaaattgctgaccgcctgggcctggagctaggcaaggtggtgactaagaaattcagcaaccaggagacctgtgtggaaattggtgaaagtgtacgtggagaggatgtctacattgttcagagtggttgtggcgaaatcaatgacaatttaatggagctaagagagtgacctccattgcagacaggctgaatgtggactttgccttgattcacaaagaacggaagaaggccaatgaagtggaccgcatggtgcttgtgggagatgtgaaggatcgggtggccatccttgtggatgacatggctgacacttgtggcacaatctgccatgcagctgacaaacttctctcagctggcgccaccagagtttatgccatcttgactcatggaatcttctccggtcctgctatttctcgcatcaacaacgcatgctttgaggcagtagtagtcaccaataccatacctcaggaggacaagatgaagcattgctccaaaatacaggtgattgacatctctatgatccttgcagaagccatcaggagaactcacaatggagaatccgtttcttacctattcagccatgtccctttataatagagtaacttctgaggctttttgagaataaaatccaccccacccttgtttccccttggtatttgatgacaaattcagcagaagacccggcttgctccagtgtagctttctacatcccacatcaggtatattagagnttatccgaactggggaaagacggattgagattaactgctgggacctcctacctgcattatctcattctggcttccttgataattctgtgggccttgcagctttaactatagctcagctgctgcaagatttcagacttttgaggatgttgtgtgagggtgtttgactgtgactggggaagctcagactactttgtatgtgaatgcttcagggttttctttgttgagaacaactagcaacaaaggcaacccatgtgtgaccagttctccccaaggtctatgctaaattatagcaagagccctgggcaaccccaaacctagtcctggtagctgagcaccctgtaaggcaggagcaggcagctcagcttgagcagacattgggtggggggtggggggtggttgaggggggaggcagcacagtgcagcaaatgtttcttgggaggaagaagcctgatccatcaccatctgcttgactatgtagcttggattctcctttgtacctatccctttcgatttggctttaccttcatctatcttgatcctttcctggccaaatatcctcttgggcccaaatgaacattgtaccatagtcttctggaaagcaaacatgcttcctgctatgtaattgctaacattcatattagatgatgtgctgtagcttgatcttccttagcctactgccactgaggcagtaggttttaggtggtatcgtagtgccttttgattaatttaagtatttaattttcatcttccttctttggatctatttggcctctcaaatgaactgagattcctgttaaaaaagattgatgttattgtctcttgtagaggaaactaataaagtgtgtgtacctgtgtgaat

SEQ ID NO: 133527 - DNA, 367 bp, Homo sapiens
ggggagatccccctgctagctcacacatcaatcagggatgcagagtctcctgttgctaggatcccagaagtctgttgtgagagtgagctgtccctcagttccctcacttacccttttcataggagccattagaggtattcaggtatcattcagggcttccagatttccccctcttcaatctcgactttggtgctgactctctcactattcttgatgttttctcttcaaagatctgcccaaattatggtggtttattccatactttggtctgtcttcttggtagtggtgtttcctggctgccttttatctgccatcctgttctccctcctcctcattctttttaaaatacacttaattttctactgta

SEQ ID NO: 133528 - DNA, 870 bp, Homo sapiens
tgttcttgcacagctattaaggttttagttgtggcatcaatgttgttggctatgtctgttgagagctggtcaaggaggcttctgtgactctggcaattctggttcccatactggatataatgccacatctagcaagaagtggaattaattggatagccctcttcaccctgggcaagatgaaatgcttgggccgggcacagtggctcacgcctgtaatcccagcactttgggaggctgaggtgggtggatcacctgaggtcaggagttcgagaccagcctggccaacatggtgaaactctgtctctactataaatacaaaaattagccgggtgcatgcctgtaatcccagctactagggtgactgaggcaggaggatcgcttgaacctgggaggccgaggttgcaatgagccaagatcgtgccattgcactctagcctgggcaacagagcgagactccatctcaaaaaaaaaaaaaaaaaaaaaaaaaaaaaaacatttgttggcggcggcccggccccaggaaaaaggtttttcaagccccacttcggttgggggcccggcggcccccatatagtgtatggtcacccctgggccttcggtggtcccaagagaaccccgcgcaggactgaggcgggttccccccaataaaaaagcgcgggggaccgggtgttctgacacatcccgtggcttcgcgcctaagggctccccacggcgtccaggagtgctatacccgccgcggcggggcgggcccacgcgccacaaacgctgatgcacacccgccctccacacacaacacgtcaccgacgacgcacacgcccgccgccccacaccaccacaacaccccagccaaacacacacaacacaccacgc

SEQ ID NO: 133529 - DNA, 674 bp, Homo sapiens
cagtgagcaaatcataaaatgtaggcttctttatgtttgtatatctaattgtactaaatgtgtttgaggcaggacaactcccatctcccacaaaatccagggtggatttttaaaaagcattttaggacttgtttttttattgggcatctcccagtttttaaggtgtttctatgctagaaatctcatggatgttttctttattttcatgcctccttgtaccctctgtattgcaacctgccttagtgattccatccataactgtggctttaacttatctgtagggaaggcttccaactcagtttcctatcctgattcctcagggcattctttaccctcacttttcctagatctcaactgttgagaggaaaccatactgtctgtcattagcaattttgcaaaaacagcctgtgaatgcatattagcatcacctgattactgagcgcccagaggctccgtctctctgtacccggatacaacacaggagggaaatgatgtggttcctgtcctcagaaactcctggtcaaagaaggttcctgtgtcaggtatgtgcaagatgtgaaagccatagacataaacaggtgtcactgaaaatagaaagatatttccatgtaaacagtgtataaacttggcctttagaggtatcggtggagccaagaagaaaccgttggcagtac

SEQ ID NO: 133530 - DNA, 222 bp, Homo sapiens
ctgggactgcaggcatccaccaccatgcctggctaatttttttgtgtttttagtagagatggggtttcactgtgttagacagggtgtttgtctagcattttaagagtttgtaatggaagggttttcaagtcatttaatctcagtattgctaaaatgtaagtttatcctaattattcagaattggaaatgtagtctagaaaatccaaaatattaactggtatt

SEQ ID NO: 133531 - DNA, 415 bp, Homo sapiens
atactaatccataatacaactcagatgaatcacaaatgcatgcttgcggaaagaagccagacacgaagggccacatgttatatgattccacacatatgaaatatccaggaaaggagaacccacagagacagaaggtagattcaagtcaccaagggacaggagagagagcaacaggcagtgatctgttaacgacgcattcctctgtggtgcaaaaaagttttgaactagagaggtggaggacacacaacattgtaaatgtgctaaatgtcaccgacttgtagacttaaaaatggttaatagggccaggcgcggtggctcatgcctgtaatcccagcactttgggaggccgaggcaggcgatcaccagaggtcaggagttcaagaccagcctggccaacatggtgaaaccccatctc

SEQ ID NO: 133532 - DNA, 188 bp, Homo sapiens
gcactgagtgtaaaacttgagcttttagaaatccagcagaaagatttcctccctcctaagagattcatccaacattcctgaaattcactctgattgtcccagcttgagtcccagggatgtttccagaaatgaatcactatggccaggggcatatgagaccccatgatcaggcctgggccacctcctca

SEQ ID NO: 133533 - DNA, 393 bp, Homo sapiens
gatttctgggcccttctaacttgtactttggaggaatctctttagtggtgcacaggagcctgcttgttccagctcataagagtctaatgtaattttcaagaattctgtgaactggtggttaaacacagacattattaaaaaataaattacatgaactcacattaaacaaaaaggagataaatactcaaaataactgctttttaattattttactacattttactattatctatgctcttctgaagatttatttctattgtctctgcatagcggaaactatataatgatttgctactgcccatctcttctcagttccatgatcagtgagggtgagttagtagcttgccattggtcatagtgggagtatctataccatggaaattggcaaacact

SEQ ID NO: 133534 - DNA, 726 bp, Homo sapiens
atattatgaagcatttagaaaactgtgaaatcttaaatcaattgaaattctatagtttaaatacaatagtttaatggattttaaaatatcgattttaaaattgatattttatgattgctactattgataagaatactatttgacgtttgtatcaggattcatggccttcaaatcctttacatatatataacttcaattttatttcatctaagaattaattgctgtcaattaaggataaaataaaactttgactttatttggattgttaatgtagccaggctcttctatttaaagaatgaatgttacaattaaacaaataaagcatttatatgcaaagccccactctcacaaactgatgctgagctggacattaacagaaaaaagaaattagtttcacggataagaatgaacacttgtggacaatgatgccaccatgtagataggttttagggtttttttttttcatagaaaaacagagctgctttctaatgtgcccgaatattcagcagagagtgtgtgcatatggttaaaacaatacatgttttaggtaaatacacatgcacccgaagaagcagcactgtgatttgactaataaatcataatattcatttaattttttaatggaatttaaaactaggaatagttttagaggttatttagttcgattccctcattttacacataccatatgtttctatggtgtttatactattgaagttaaatata

SEQ ID NO: 133535 - DNA, 739 bp, Homo sapiens
attgatttaattctttacttaaaatatatagactggttgaatggatgaaaaaaacatgatctagccatatgctgcctacaagaaacataatttacctttaaagatgcatatgaactgaaaataaagggatagaaaaagatattccatgcaaatgttaacaaaaaatgagcaggcatagctatactcagatacaacaatttaaataaaaaacagtaagaaaaagacaaataaggtcattatataatgataatgggatcaatctagcaagaggatgtaacaccaaatccatattggcatccaacactggagcacctagattcataaagcaaatattgccatatctaaataaaaaggtgaactctgatataataaaattgtggcactttaacaccccactgccagcactaaacaggtcattgagacagataatcagaaaagaaacatttgttttaaactggactttagaccgaaaggacttaacagacatttagagaacatcttacccaacaataacagaatacacattcttctcatcagcacaaggaacattctccaagatagaccatatattaagccacaaaacaaatctcaacaaatttttgaaattcaaaatcacatcaagtatattcccagatcacaatggtgtaaaactagaaatcaataccaagagaaacattggaaacgatacaaatacatggaaattaaacaacatgctcctgaacaaccattggttcaatga

SEQ ID NO: 133536 - DNA, 211 bp, Homo sapiens
actatgtaaacacttttaatagcaagtcatatactaaattgtaactattttagttttcctgtacaagtttttgtttttgcagtcttaaagcttaaaaatctttcccccacaattttcacctaatttactgttatttatctttcaaattctagtgtaagtgtcacattttcagagaagccctgaagcatccttttctcctaccccacaattc

SEQ ID NO: 133537 - DNA, 568 bp, Homo sapiens
cagagtccaaacagtgcccagagtccaaacagtgcccagagtccaaacagtgcccagagtccaaacagtgcccagagtccaaacagtgcccagagtccaaacagtgcccccatttaaaaggcacagagtggcaagctggataaaaaagcaagacccagtgatatgctgtcttcaagagacccatcttatatgcaatgacacccataggctcaaaataaatggatggaggaacatctgccaagcaaatggaaatcagaaaaatgccagggttgcaatcctagtttcagacaaaacattttaaaccaacaaaaatcaaaaaagacacgggtttacataatggtaaagggttcaattcaataagaagacgtaactatcctaaatatatatgcacccaacataggagcacccggattcataaagcaagttcttagagacctacaaagagatttatactcccacacaataacagtgggagacttccacattccactgacagtattaaatccttgaggaagaaagttaacaaagatattcaggacgtgaacttaacattggaccagatagatct

SEQ ID NO: 133538 - DNA, 459 bp, Homo sapiens
tttccaaataatactgtttattgtcatttcactttggtttttttggcagccctgttaggggaaacccagcaaatgatccgcagctgcatagcgatatctaagcaaaaatgtcacttcagtcacccacacacccaagcccggaacaagttcttcattgttacgatttcttgagccaactcgtgacacaaaatgtaggtcacaattgtgagcaattctcatcctctttcacttttctatatgtggaaggattttccaaataagaaatgcaaggttaacgtagaatgagcagcgatcctgatgctttttataaaccttttggggtagttaacaggcatatttctcagcagggtcactgttggaatttagagtggtgctgcctatccgtgacaggatgttttgcaaatctagtccctcccactttgcttataatatccttccccagtcgttgttacacattct

SEQ ID NO: 133539 - DNA, 437 bp, Homo sapiens
ccactgtgcctggcctatattcaagctttatacaaacacacatatacccctctgcatatacacatatataccccgtagctatcaaaatacagacccatttttctacaggggaggggaagaaaaaaaggagaaaagacaaagaggaataataaagatcgtggggagagaacaacccatgggaaagccagaaaagagaattgagagacagttagaccagggagaagcctggcaattcctacagagaggacatgcctaggcaggtagtggaggggaagcaatggtgaaatcaggccagcagcagcactgcattaacacttgagtgatcaaacaaagggtaaagccatcaggaaagaaactgacagctgcagtccttaaatgccccaatttagagacacaatgactccttcttccattggccatcctcaaacccaagtcag

SEQ ID NO: 133540 - DNA, 485 bp, Homo sapiens
agatggagtctccctctgttgcccaggctggagtgcaatggtgcaatcttgattcgctgcaacatctgtctctcgggttcgagcgattcttctgcctcagcctcccaagcagctgagattacaggcacatgccaccatgcccagctaatttttgtatttttagtagagacggggtttcactatgttggccaggctggtcttgaactcgtgatctcaagtgatctgcctgcctcaggctcccaaagtgctaggattaaaggtgtgtccagcctatttttttaaaatcatacttttaatttattgtataaccaagatggcaacagcattgcagaatttaaaaagaaaacaaaggaggaaccaccatctcaccaccttaacaagcaaatggttttaatttttctgtggttctttctagaacttgtcctcaaacagacagacattgggcacagctataaccacagtgatgatctgttttgcctccagtg

SEQ ID NO: 133541 - DNA, 300 bp, Homo sapiens
tatggagggggtgctttatacctgcctgtctggtctcacactaggacagcatggcagagcagggacttgaatccaagtggtctgagtttttgctctttacttacacacgaatctgtgtaactatttttacaaaactcttaaatcttcaggagtttattttgggttatgatgtgaggtgaataactcaattatttcctaataagtatctgattgtacaaatgctgtttgttgaatactcttttccattctcgctgattgtgatgccggtttatcacattcaggcataccttggggatagtg

SEQ ID NO: 133542 - DNA, 271 bp, Homo sapiens
tagaaccctcagtctttctctcttcatcatccttaaagtctcagctcaggcagtacttcttggggaagcccttccccctctccttcctaagtcaaactgtgctataattgattctcgctgcaactccagccctttggaatacttatcaaatatgagatcttacatttctttaggtgactattggttaatgtttggttcctgttctaaaaaaaatagaagatactccataaataagtgttgagtaaataaagtataaagatcagttaggagg

SEQ ID NO: 133543 - DNA, 505 bp, Homo sapiens
gaacactggtagtgcatttagggcccactgggataatccaggttaatgaccccatctcaagattcttaatcacatctccaaagtctttaccatagaaggtaatgatataatttggctgtgtccctacccaaatctcatcttcaattgtaatccccacaatccccacatgtctagagagagacctggtgggaggtgattggatcatgggggcggttcccccatgctgttctcgtgttagtgagtgagttctcatgagatctgatggttttataaggggtgcttccccctttgctgctcactcctctctctcctgacaccttgtgaagacggtgcctgcttccccttccaccatgactgtaagtttcctgaggcctccccagtcatgtggaactgtgagtcaattaaacctctttcttttgtaagttacccagtctcaggtattcctttatagcagtgtgaaaacagactaatacagacaacatctacaagatgcagcgattaggac

SEQ ID NO: 133544 - DNA, 284 bp, Homo sapiens
taggtgaccctttagcatgacccccccactcggagaggtcccctgaccccaggaggtctggcaatgagcgtcatcaattgagacaggtgactctgggctcttagcttctggggggcccttgccacccactggggaggtcttttggaaatctcactccctgtccacacatcctcgcgcctcgctcgctctgatcctaagcccggccacacacctgtgaccaggatgaccgtgctcctgggcggcagcactgatttgaaatgggagggtcttggaaacccagacgt

SEQ ID NO: 133545 - DNA, 210 bp, Homo sapiens
aagggcacagagcatgttgctctggctgttgactaagttccttgcagagggcctgagcctggggctggaactttctaaacatgagcctggcttgtgtatttgtttgtttgttttagtactggaggtgtccatggaaggtatatcctcccagccccaaaggaaggcatggtagtagactagtaacaaagcccatctggtaccaagaagaca

SEQ ID NO: 133546 - DNA, 295 bp, Homo sapiens
ggccaggagccccggccccacctttcctccttcccttgtgcctcctggcacttcccgcagccctcccctgttgagtgtaggcgttctgcccggggcagtcgctgtgagagaggccatggcctggactagggtgatgcgaagaacagaacttgctaccagattggatgcagggttggggactccacagtgactccacacttcttaacctgaacaatgaattgccaaaatagataacagaagaaattggggaagaagagttgttctagccaatagagcagctaaagccaaaaaaaaa

SEQ ID NO: 133547 - DNA, 499 bp, Homo sapiens
gacaaaggttatgcaaagtgtcgacagcacagcacacggggcatcagtcctcacataacacaaccatcccatggtgagcccctcccccagctctctcaccactctggacatcagacctcaggtttaggacaggaaggccactgctacctactgcagagtgggagacacattctctttaccagccagaaagactggcttattagttcactaactagctgtgtggccttggctaagttccttaacctctctgggcctgatttgcctcatctccaaaatggtaaaaatacctcccccacaggcttgccacccagtgccaatgaaataacatccatgaaagaactttgtaaaagttctgtataaataaaacaataaaataaaaaaataaataagtgccatataaataaagggcattgtgctgattttccagtatctggcacatgccttctgcatcatctcatgttcagattcagagatgcatcctgggaggacacttccagag

SEQ ID NO: 133548 - DNA, 422 bp, Homo sapiens
tacagattttttgaagcagtcattatggatttggattaatatatttacctaattcgacctgacctccattgtgactagtgatttatgcccaggagtgtgctgaggttttattatgttttccatgcaccaagtaaactggcccatttggagagtgaccttgttttctttatgaaacccatgttctcatcaactgagctgttaaatgcctgtaatataaagtcaaataaatcctgctttctaaggcactgtattatttatatagcatgtgtaaatttagaagcatttggtcttgaggtcaggagttcaagaccagcctggccaacatggtgaaaccccgtctctactaaaaatacaaaaaaaaaattaggcatggtgatgcatgcctgtaatcctagctactagggatgctgaggtgggaggat

SEQ ID NO: 133549 - DNA, 200 bp, Homo sapiens
tcaatgtgtcagcatggttgggttctggtgaagacccttttctgggttgcggactgccgacttcccactgggttttcgcatggtggaaaaggcaggctcctttgggcctcttttataagggtactaatcctattcatgaggactctgtccccatgacctagccacttaccaaaggcccacctcttaataccatcatattg

SEQ ID NO: 133550 - DNA, 322 bp, Homo sapiens
ggtcacaggacagaaccccacatagcgattgtctaaactcttcttgtcttctcctattccagctcccacccttcagtccagcccagaaaaagagtttacctctgtttgtgcccagcatacccttaggatatcacacatacttctccattctatgactttcctttgaaatgtaccatccatgaaattatgcttcatgaattatgctattatggagatggaggaaatgcttatattagaccaacccttatgatgcagaaaacaaagaggaaatctcgataaaatattaagcatacacaatgcgggccgggcacggtgactcatg

SEQ ID NO: 133551 - DNA, 795 bp, Homo sapiens
tccactgccagtgtgtctttggacttgctattccctcaaccagagaggcatttcccacacctctttaacactactcctttagatctcagttcaaatgtcacttcctggagaagcattcttctatttccctcactaggtcaaatctccttttatacgtgctcttgtagtacttctacatcctcacttgccaaagttgaaattttcatttgtgaaattatttgattaattactgcttctcccactagactgtaaattccttgagagtaaagactagatttattttgtttattatgaagggtaccagcatatgccaccccaaaatatacttctttggcatatagattattttgagctaaaggccattgagaacctgcagatacagaccaagctctgaaaacatggcacaagtttttctcttataaagaaaatttacatttataaagcaaatttttgtttgtagacatgtttccctctcccataccaaaaaaaaaaaaaaaaaaaaaaaaaaaaatgttgtggggcggactgggccccggaaaaagtttttagaaacaattcggttgggggcgcggggccccctgggtaggtggaagggggccaaaagggggtcccccagaggagagaaccgggggaccacaagcaagggggtgggggattctcccgccgcaataaaaaagccgccgggggggaacacgcgcggggtcctggaaaaaatctcaagagggagcttcagaggggcaaaacggggctcacatcaacgcgggaatccccagggaatcccgaaaacaattagcg

SEQ ID NO: 133552 - DNA, 292 bp, Homo sapiens
gtgcctacattacagtaggctgcagagcacatttcaaaaccaggcattttgaaaaagtaaggttaagtaagttttgaaaagggaagatcaagccccaaaagtaagatcaaggagtcaacaaaaactttttttaaatgatacattttatctcaattcaaaaggaattctttccataacctacggaaagaataaaagcatgcttttgattattcgaaattctaataattacaagcaatcagttattttctcttgtcagacaatactcttgtcaaatatatcaatgaaagcctaa

SEQ ID NO: 133553 - DNA, 272 bp, Homo sapiens
ctgaagaggaggagggggttagtcttgctgtctctctcaggcattgcagaggtggaggaggttaaaggggaagcaggagagatttattgtaaaaaatccacatatacgtgggcccgttcagttagtccaaactcatgttgttcaagggccaactgtatatatttaatataagaaaaaggggatatctgcgttccaataacactttatttatggacaataaaatttgaatttcatataattttcacgtaacaaaatattttttaaaatttctc

SEQ ID NO: 133554 - DNA, 251 bp, Homo sapiens
ttgcctttattttccttttttaaatgtttattttctatttcattaattcatactccttaccatttaactctttctactttcattagatttatttgctttctttttataacttggaatagttagatcattgcattttagcctttttcccctaatacatacactgaatacatttatctttaatcaggactttagctgtatgccacaatttttactatcattcagataaaaatatgttctaatttctattgtgc

SEQ ID NO: 133555 - DNA, 378 bp, Homo sapiens
caaagtgctggcgcacatttacaggcatgagccaccgcgcccagccgaactaatcattattacagtagccctatgctgatagtcttggcttctgtcctttgttacaacagacccactcgtagggtctctggctctgtgtgtcgcatacctcagatctgtgtggtgcctcattggccctgacgtgtgggaggcattgctcctgctgctcagacctctggtgactccctctcccgcttctcccaactctgaggcccagggactgggaatcagtggcctgtgttgggtttggacccggccctgccacggctggcagcctgaccttgaacacatttcctaacgtagctgagtttcggttttctcttctgtaaaatgtgcgta

SEQ ID NO: 133556 - DNA, 1637 bp, Homo sapiens
aggagtgggactgcctggaccctgttcagagggacttatacagagatgtgatgttggagaactacggcaatctggtttcaatgggactttacactcctaagcctcaagtgatctccttattggaacaagggaaagagccctggatggttggcagagagcttacaagaggcctgtgttcagatctggaatcgatgtgtgaaaccaagttattatctctaaagaaggaagtttatgaaatagaattatgccagagggagataatgggacttacaaagcatggccttgagtactccagttttggagatgttttggaatatagaagccaccttgcaaaacaactgggatatccaaatgggcattttagtcaagaaatattcactcctgaatacatgcccacatttattcaacagacattccttactctccatcaaataattaataatgaagacagaccctatgaatgtaagaaatgtggaaaggcctttagtcagaactcacaatttattcaacatcagagaattcatattggtgaaaaatcttatgaatgtaaagagtgtgggaaattctttagttgtggttcacatgttactcggcatctgaaaattcatactggcgaaaaaccctttgaatgtaaggaatgtggaaaggccttcagttgtagctcatacctttctcaacatcagagaatccataccggtaagaaaccctatgaatgtaaggaatgtgggaaggcctttagttattgctcaaatcttattgaccatcagcgaattcacactggtgaaaaaccttatgaatgtaaagtatgtgggaaagcctttactaagagctcacaactttttcagcatgcacgaattcatacaggtgagaaaccctatgaatgtaaggaatgtggcaaagcctttacccagagctcaaagcttgttcaacatcagagaattcatactggtgagaaaccctatgagtgcaaggaatgtggcaaagcctttagtagtggctcagcacttactaatcatcagagaattcacactggtgagaaaccctatgattgtaaggaatgtggaaaggcttttactcagagctcacagcttcgtcaacatcagagaattcacgctggtgagaaaccctttgaatgtcttgaatgtgggaaggcctttactcagaactcacaacttttccagcatcagagaattcatacagatgaaaaaccatatgaatgtaatgaatgtggaaaggcctttaataaatgctcaaaccttactcgacatctgagaattcacactggtgaaaagccctataactgtaaggaatgtgggaaggcttttagtagtggctcggatctcattcgtcatcagggaattcatactaataaataataaaaattaaagcccctgtcaccttcctcatattttaaaccaaaaatcatgtctaatagttaccctcttccgtagttttttttaaaactttgtatttaaattttgtatccaaatgtatttcattccaggttataaattcggagtctaaagtgacattccctctctcccccagtcatataccgatgccagctgttctataattctttcattcattgttttgttctactttcttggtgacacattatactcatgtttatattt

SEQ ID NO: 133557 - DNA, 396 bp, Homo sapiens
ttgggtctcaggtcctctaatctcctatttggtggtatccttataaaatacaagaagtgttctctgagaaatgtggaaaatttctgacgatcccagatgatactaaatcagttgccccaaatcctttagaagaaggaagaataaggccaggcacggtgtctcacgcctgtaatcccagccctttgggaggccgaggcaggcggatcacgaggtcaggagatcaagaccatcctggctaatatggtgaaaccccgtctctactaaaaatacaaaaaaattagccggccgtggtggcgggtgcctgtagtcccagctacttgggaggctgaggcaggagaatggtgtgaacccaggaggcggagcttgcagtgagctgagatcacaccactacactcc

SEQ ID NO: 133558 - DNA, 515 bp, Homo sapiens
gtttgttcccttcgttacattagcctgggccaaggggtaaagcatatctatccctttattgcccgtaagtgtcccttagttccagtggagattaagaaaactggaatttattgagcacatactatatgccagaatttgttctgagggttttgtagttctccttgaagaagtccttcacctccgttgttagctgtattcctagatattttattctctttgtaacaattgtgaatcggagttaattaatgatttgtctccctgcttgtctattattgatgtataggaatgcttgtgatttttgcacattgactttgtatcctgagacttttactattaaaagaaaagcaaacaaacagcaacaacaaaaacagcatcaagaaaaatgttaccaaaaaaacctcccaaatgtcagcagcctcaaagatcgaacctagataaactcacaaaggtgagaaagaatcaatgaaaaaacactgaaacctcaaaaagccagagtgcctcttctcatactaacg

SEQ ID NO: 133559 - DNA, 173 bp, Homo sapiens
cacgatagtgaataagtctcacaagatctgaaggttatataaagagaagttccctacaccacttctgtctttgcctgctgccatccacgtgatatgtgacttgctgctccttgccttctgccataattgtgaggcctcctcagccacacggaaatgtgagtccattaaaacct

SEQ ID NO: 133560 - DNA, 292 bp, Homo sapiens
tgactcttaatcctactaacaaccctaggagatagattctgttattattaccatttcatgatttaggaagctgagaatcagagaggttagtggctggggttgaaattcaagtagtacagtgtaagagcctttgcttctcctagaggctctgtaaaggtctgttgaataactgagtagacgatagattgattgcaatatagttcctctgttgcctttttgaagtgttagtttagtaagcaaccacagagaaattattatctactagagatgggaataggaacggtttcctaaa

SEQ ID NO: 133561 - DNA, 748 bp, Homo sapiens
atcctgacatcagtagattttgctctcctcttttttctctctctcactctctctttcttcctcactctctctctctctgtccctctctttcataggtaaaaacctaaataattggacaagtacttcctttattccaatttattccaattagttaacataaaagaatccttcattttcactctttcttatttcctcctctatcattttacaaagagttccactgctcagctaccaatccttcatctatgctttcttctcgagaatattaggcctttaattacatcatgacttctgtaggctcacacaattcttcatcattcagatcttttgcaacatttaaatacactcaacacacttgaatctcaaaaatcatcaattcctcacagatacctctcttttctttactcccacataccattactactgtcatcctataactcaactcttttaccctgaacaatcaaacttcttggatttatattgagttgagaaaaatatatttattaatggaatacaaatagccaaatgtcacaaaggaaatgaaaatgttatgtttaaacatatttttactaggaatcaatattattgacagaaatggagccatattggcttggttttaaaaatgtgttagtcctatattcagaatagaagaaattaaaaaaattaaaaacactacatggataaaataagatgcatttttctaatataattttctagcttatggaagccaccttagacctatgataaa

SEQ ID NO: 133562 - DNA, 177 bp, Homo sapiens
cccagttctgtccagtttttttttcccttagcataatagaggctgtcggacttttttatactaattactgtgtgagcctcagatgaacccccttcaattcacagggctttgttaagggaggagctgtcaatgtgtctgcccgtttgcagctgtgctgtggctttagcttgcttaaca

SEQ ID NO: 133563 - DNA, 284 bp, Homo sapiens
tgtgtgtttatggacctgctgtgtataatttgatgctacgttacacatttgacactagagtcaacagcaacaatgtaaacaattcaacaacaaaacctcctgtaccaaggtatttaatgttatgcaaacatgattcagctcatctccagactgaggggctaggcactgaaaaagagttggggccaagggagcacgtcctaactcagatttgagctataagccagtgatggcatgagtgtgtgtgttaggagggatgggttgatgcagacagactgaagtgtcac

SEQ ID NO: 133564 - DNA, 456 bp, Homo sapiens
agatgaagttgaaggactaaaacgcctaatgacagagatactgggtcgtcaggatggagtttgcaagactgggtcattgacgatgcatggtaactggtggagaccaaattttgaacctcctgcacccaggcgctcttctcaccacctgccctgctgctaccaggtccaacccactgtcatctcttgcctagattcctgcaattaccttctaatagattcccccactcctaccccacctccagatctactctcaaggcaagagccaacattatcctcagaaaatgttctgcaggttattcagtcttctgctgagcactctcagatggctttctgtggccctctgagcaaaagcagaagtcacccatcccaacctactcagctcccatcattccctctttgacctcacctgacctttctccttagtattgcagcctgtccctactatgaccctccatt

SEQ ID NO: 133565 - DNA, 372 bp, Homo sapiens
gtagtaagatcacttgaggccaagagttcggggccaggctgggcaacatagcaagaccccactgatggcgatggaggcctgtctagagtggctgctgcaaagatgccagccatagtgggggctgtgcggccagggctgcatgttctatggagctggcaggagccctgcccccttatgagttagtggggtgggagcccaccctcatgggtgcagctgccgccacccagccctggctgcagacccaggcatccctgcactcttggaggtccgggaagacccctttcccccatagtctcagaagtgcctgctcccactgcctggactctccaagctcccggctcctgctctgattttggagcaaagtcgaagctg

SEQ ID NO: 133566 - DNA, 513 bp, Homo sapiens
caactgaataaattatagcactagctatgacagacattggtcgttttccacaaatgctggctaacagccaagctctgtaaaacattaccattgacttagcaaacctcaaccagcttagtgcagaaatgcagatactctaattcggtcaaggcaggcaaagcagaaaagcccgagaggcaagtgaattgtctgtaggtttttttaaagctcttctttctccccatcaccagccttttttggagtgtcacagtaatggctaacattgaaaatataactttgtttccatgtattatatgaagcgaacatctttcttacatgaacaatgctgctcccagtaacagactgttttatatacaaaattatatcaatgtaattgcaattgaaaacccaatgacgactttttacattattatggtttccagcaagcatatggttagaatgcccaagttttactccagaagggcagtccagaaaccaccctgttataaataacattctttcaaggacagagag

SEQ ID NO: 133567 - DNA, 606 bp, Homo sapiens
ggtaagtggtgaggcacagggaggtggcactggtcaccagcagacgtgtgcaggagcgcctgtctacagctctgggggtgatggcagcagctcttcacgcccaccccaggacccactccacttggcactggctggtggtcatgcttccatcagaagaaccttgggccatgctgcaaagcgacaacaggacaaatccggggacccaggcaggtgctccctagagaacagggtggtgggtcagaggcttgaccccacttaagctcttcctcaggggtgagattggttgagtgctcaggaagccaatacctggcttgttatgggatgaagctcttggccagaggggacccaggtgtgtgctggtgagaggccccatctccaggttggaatcgttgcttgggctctggggagcactaattaacaaacgtgtggttagggtgaacccgcaggcacgctggctcaaacggagaggcacagagtgcagagtactttttcaaggtggagccaggggaaggacccagagcagggaaagctcagaaacaggactgcacccaaacagcccggcagcccaggccgcctctgccgcattcacaatgacggctttgccgg

SEQ ID NO: 133568 - DNA, 127 bp, Homo sapiens
caaaatgtttaatgagcaaaataattgtgttacagtgaaatgaatatggacatattcactgaattaataaatgaattaaatgatgacttcatggaaacctcctgagaaagtagttatggaccatctt

SEQ ID NO: 133569 - DNA, 963 bp, Homo sapiens
caaccatcatgggcagcacaggcacaaattccaggaccaaagaggaaagcgtcacctcaaattactagaagggtgagaggagtaagaggagagggtctagaaacccaagaaggacttcccaaaatgaggaggtggccacgtcgagaggttcaactccagaagcaagcgctgaccgcagggctgagcagcctagagccaccgcagcgctgccaggcacaggcctcgctcagggcgggtcagagacacacggggccacagcaaaccattgtgatgaatggcagcctgcaaggaggggactgccaagtgccttctggcagaggcgggagtcacgggagaggatggagcatgatggacggagcagatctgaagcaggaagcaggtcaactggccaggaagggcctgggctctgagtgcaggggaggggaagacaacagggcgggtgaggacagaaactcaagatggccagagaggaaaagcgtgggctccccagcaggcctggcctgccttaggcaggcaggagggagaccaatggcagagcacgcggctgtagaggtggggtcagaggcatggaatggccaccaagaagactgacacggaactaagaaaaaggagctgatcaaagcctgctgggcagtggtccacttcatttctaatcgtgaggatcctctaggtgggaatctaaagacctattctgtatgtgagcagggtccaaacgtgttaattccttttgtgtatggagcagaactgcaatcaatgctgaaactctcccgatgctttttatttgcctttacagtaaacaggacccgccaacattctcgagggtgcactctcaggaacagtgtccagcaagcaagtggtcgctgaggcggggagcagcaggcgccagggaggagactgagacctcctcaaaagagagtgctcgctctgtccggggggcagggaggcccagggctgtggggtggc

SEQ ID NO: 133570 - DNA, 110 bp, Homo sapiens
catctcacactctttaaagatatatcaaaactgaaagaattaatcagcaaagacctgcactacaaaaaatattaaaggattcctttcaggagaaggaaaatgataccaga

SEQ ID NO: 133571 - DNA, 790 bp, Homo sapiens
aataatacagtgtggcagctctggaaatcagattctcccttctctgcagggtttattgttgttgctttttgttatttgcttagttccttttcgaactaattctgtgaagttaatttttgccatatgttgtcactgaaatctctgcttggttatcttagtggtcacttgtgagtgggcctttagggactaccagacacatcaaataatgacagcagtttgagagtgaggctttgaaagcattccatgattgttctgtttttttccagttgccactaggctgctggtttttactgtgattgtgtgctgatggttttcaaggctactgtagaggtagagagatgacaatgggcaagttaaaatgcaagagctgctgtttttaccaaggctcagccccttgtcttgaatcagcattacctggattcctgcaagcttttagttaatttccagaattttaagttaagttgatttgaacagtttgtgtcagttttctccttgcttttaatgaagcagaattttctgaagtatttactccaccaatttctttgatgttctcctgtgacaagtgtttaagaatgtttttctagtcaatatatcattatctgtccatgcatatttttctaaaaccttacttttaatggctgcctggtattttaatacatggaggtactgtaatacaattttagtttcacttgtctttagaactcatcaaaaattgttacaattttttactattatgagcagtgctttgttgaatattcttttatcttaatcatgtatgattctcaagact

SEQ ID NO: 133572 - DNA, 734 bp, Homo sapiens
gtgagatgatatctcattgtggttttgatttgtatttctctgataattcgtgatactaagcattttgtcatatactttttaattatttctatgtcttcttttgataaatgtgtattcagatccttagatgacaggatctcctatatagaaaaacctaagtactccaccaaaagactcttagaactgataagtaaattcagtaaagttgcagataaaaaaatcattatacaaaaaaaaccagcatctctatacacctgtaataaactagctaaaaagcaatcccatttgaaatagttacaaataaataaataaaatatctagaaatacatttaacaaatgaaagatctctacaatggaaattataaaacactgatgaaagaatggaaaggacatagaaaaatggaaagatgtccaatatttataattggaagaatattgtgaaaatgaccacacttcccaaatccgatctacagatttaatgtggtcattatcaaaataccagtggcattcttcaaataatagaaaaagtaatcataaaatttgaatgaaaccacaaaagaccctaaatatctaaagcaatcttgagcaaaaagaacaaaattggagacatcacattacttgacctcaaactatactacaaagctataataaccaaaacagaatggtactggtatgaaagcagactatagaccaatggaacagaatagataattcagaaataaatccacatattt

SEQ ID NO: 133573 - DNA, 391 bp, Homo sapiens
tttttcaatttactttcctgcccttgcttcctgtcttccacagaggagtctggccctggtgtcaccattacttgctgtttgccctggacagacagttcacagggatgtgtgtgctcactgagcctgcatgtagagccagtatgggttgcttgcagatgttggttgtttggaaatgggacccactcagctgtggatataactgaggccatcatttcctgcctccaaatagaggcctgcatctaatcctagtaaacagttgtatggggctccagggcaagggatcaaaattagaaccttagtctagcagaggtgacaaaggccaaagaagaaaaacgtcagaataatctgtcagcccagtagtagaggttagttcatcttggttgagtagtag

SEQ ID NO: 133574 - DNA, 467 bp, Homo sapiens
agaataataatgtttgtcagggctgagggtagagattgggaaattactatttaatagacttcaatttgggataacggagaagttccggagatggaaggtcatgatactgcacaacaatgtgaatatacttaatgccactgaattgtacactcaaaaaggattaaaatgataaattgtatgttatacatattttacaattacaaagtcaggtatgttgattttaatttttgctaagcaaaaatattccacaatacccctctaataagaaggccaaaaaaaaaaatgtgaccaacagggaacaaaatgaaaactataaaaggataaacaaaggaaagaataaattccatttccttccctgaaaatggagagaattgaaccaggttttcttccaaatgtaaactctgaaaattttatgtttgtaagggaagggggatgaaggattcttctataatgacataccatgtttc

SEQ ID NO: 133575 - DNA, 425 bp, Homo sapiens
cctcttgctgactgtattctaggatgaagatatccatgcaaacgtaaatatggtacctgggagctgtcagacatgctggagttactttagacttaagtggaaattagttcaaacacatggttattttaaagcgaggtagtggagttgggagctctggtgaaggaagcagaaagaacacagggcttcgcaccagaggactgggtgctaattgcctggattgtgattaagtccaccaatctctctaattctccatttcattatctgtcaaatagtgatagtaataccaccaggttgatatgggggcaagtgagatacgcattgagacgctttttaataaactgaaaagcactgtgcaagcattcattcaataaattagtgaataaaggcatattgggacagcactttgctgcttttattaaagggca

SEQ ID NO: 133576 - DNA, 835 bp, Homo sapiens
cttcagccatcaggctgatattccaggcagcagaaaggaagaaagaagaagggcacctggtttcccttttaggatgcttttgtgaggtacaattagcattcttgtctttaacttcttaaagctcatgcgaaaacagcttactgcaaggtgagcacatgactgcctagcttaacacagaatttccttatgaaggaggactagaacagtggatgttggtgtaggcactgcttagtctgtgtcacatatagcgcataacacatcaatagtgagaatgcttcagttcaaccagttcatggctttgggggctgtaccaattggtttataatggttatgattttgtgaccaattattctttatgtggagatatatataagaggaactgctttattcatttagaccaataaaagcgatacctgaagtgatttgtggacaagtggctacaagaggatattggtgagcatatttgttcccatgagtcattttctaaccagttatcctaacactgggtttctgtactgtctttaattttcacattatctctaaagtcttcaggaggaaatataagcagtgtggtgctagaatagctttctatgtgaattcttttcccccttattcattactggaaccagtaattgcctagagaatgatgggcaaaatgccagctcatcatttctttaagggtctaagaattggctttggagaatggaagaaaattccagaaacactgtcaagaaagttattatttatttcaaatgttatttggaacagcaaaggacaatatgttttatagcacaacttttaagatgactgaattggcaataaattcacatgatga

SEQ ID NO: 133577 - DNA, 453 bp, Homo sapiens
cacagctcataactgacagagatgagaggcaaagcaaggagttctgaccccccagcccagagttctttcctttgcaatgagccatttccctgtttggaatggattcacgagaaattatggaatttcttcccatgaagatctttaagagcccttagtaacaccaccaacagtcctatgcttgataaattttaggtatcactcttccaaagagatgaaaatcattcttggtatcattttgaaaaatctttgagcttaagaagtcttcggccttttgggcctgtctgcaaaataattatcagccctgcccaatacactagaggaggttagagagaggcagttttttgctatgagtcataatttcaatttctattaaaattcttacatggccacatatgctacctctcaggctttgggcctctgggcctgtgctaatttgcatgtctggtttagata

SEQ ID NO: 133578 - DNA, 676 bp, Homo sapiens
aaatttcaggcaactccttttccaagttgttgctcacagattataatagatgaattcagcagaatgttctgacctcctagactaggtcagataactgagttcttgtcctaactcaaatcctaagtagctgtttcttaaagctctgttctgcctctgcagaatgaaggcttggcctatatagtgtatgagattccttctagcttcagggttttgtaactatcagaataggtaatgaggaaggagactatgccctggtagcctttagccatatcacaaatatttaacatactcccaaaatagcacatacaagacagaaattctttgtacttgaagggaataataaatacagaaagcatttgagaagtacacatttaatttctgttaactctttttttcttatttatgtttattattagatgataaatgacttccttttttttagtattaaaacaaggtgatcaggatagtgagaggattgggtcaggtgaaacacatgactcacctgcgtgcttatgattccccttggaagatggttttgggtaacattctgggaaaactatggataaagtcataggcttccatatttaattaattctaagacttttttttcacatttcaacatctcagaaatttatggtatgccaattcaattggcaacttttttcctctcttggta

SEQ ID NO: 133579 - DNA, 756 bp, Homo sapiens
ggaaatgaagaaacagcaagtaacctctaggtctcatgatttccccttcaagtaatgtccaaagcacaccttccctagcattactcctctcacatcagtatctgagcttttatttaattcttgccctaacctcagtgagctgatcctggctccactagggtcagtttcagtttttcaatctcctctaatcttatacccttcttcagaggacgtaggtagtagatccttccctaagaggtaggaaagcttttcctccaatatactccagcttaccctgcaccctaggccagaaaggagacctgagagacaagcggagagacaaaatcatcagtgttactagggtttctgacacagtacaagacaccgtgggagaaggaataaggtcagggagaggctagaatttcgtctcatggagaccaagactgtgccattcatatttagggcaatctgatgaccctttgctgatttttctaatccctacagtttcactgctctgtgtccttttagagaaaaaataaagtcccaggataagatatcacctccagagacaagtgtagataagttacttttttcattcacttattcatttatttagcatctatattgtacctagattagagaaagaatataaaagaggcataaattgtggtctataaaaaccaaatgagagaaaacatcaataaccactgtaggcatttaggagaagaagaaattctcaccagtcaggatggtctaaaaatgccttgtagagagggg

SEQ ID NO: 133580 - DNA, 225 bp, Homo sapiens
tgtactctgaggatcttcccgactagcccgacagggagtgtttcagggtggaggaggagggtgatagtggctgttttctaagacagcaagggatgtgaagggacagccaggcatcaggcaagaagcatgcagtagacaaagggaagggcaaacacaaggcccagaggctgtcgggctagtcggggctgtcgggctagtcggggctgtcgggctagtcgggggggt

SEQ ID NO: 133581 - DNA, 198 bp, Homo sapiens
ttagaagccggggaattgggaaaataaagtttctagattatttatccatttttaaaacagccagtggcctagagagaggccccatagcaattgaatttgctgacactcttaagatctttgttgactaaatagcagcttctacagttgtagcaagtaaatttattccttttacatgtaaaatctgcttaccagagtttg

SEQ ID NO: 133582 - DNA, 160 bp, Homo sapiens
tcctcgcggccgggaggcccgaatacctggcctcagttttcccgtccgaaccccaagaatcgatgcctgggaatggaaagagaagccccggagccgcgagtcagatggagccgcgtagtcagatcgagccgcgtagtcagatcgagccgggtagtcagat

SEQ ID NO: 133583 - DNA, 480 bp, Homo sapiens
tcttcagctttccttgtggttgcaaaatggctgccactgtttctgacatcatatgtagccatgacaacatccagctgaagaagaatagtgtttcttccttgcatctgttcccaggagcatctgcctcatcccaaaatcatgtgaagtacttaccttaatctatccttaggtagataatacgttgcatgtagctgaaacatcttacctgatccatttcaagaggggcaggctccaaatatttacatttgtccatttattctacatatatttattgaaagcctattatgagtaggtgtcggactaggtgctggaggtttaatggggaacagggaacaagacagttcctgccttcagggagctcatggtcaagtgacagaggcagctttgcacagaccactttactcaattcggtttaattgaattatttcagtcatagttctatagtgtgctagtggtaagcctggggcgtcaagctctgca

SEQ ID NO: 133584 - DNA, 625 bp, Homo sapiens
tcatgggaacgtctatactcagaccagcggcgtatgcagaccaatatggcaaagacaggcttttctctcacatccaactgtagcaaaacccaccagcacaaacaaagaacacacacatttaacagcaaaggagaaggaccaaagactgtcaaatcagcaataaacagatagagaaagcctgacagaaaaagcattaaaccatgctgctgattttttaaaaaaaggaactgataaacatgaaaggctattctactaatgttttacctttttatcaaaccaccctgcactgaattgctgctttaggaaaacaaaacaagatcaatacttagcaattcaagatgaagcaataaagtcattttctcttctcagaaatgcaatccttttatcatatccattatgtttctgtactatccggccacacttcccacctcttccgactccttccttcccagcttttacttacttcaaagatggatataaacataatgctttttatcttccctgaagcttctagatttatatctaatctacagcttgcttcaggcatgattaaacatccataaggaaagatactctttcaagcacaacgttgatggatccaacagttaaagcgagcataacattt

SEQ ID NO: 133585 - DNA, 475 bp, Homo sapiens
tgatggccgattcctagagtatccccgagagatcagatggagcacatgagattttttagaaaaaagctgttctcacaggagatttagtaagggcagtttataggtttagattctgctgttccttattttcattgttcttccttacccctcaaaaatataggttaatgagacattagctcatttcacatcctaaatccaaaccctcttcccttggctaacacggggctgggttgggatgttcacattgaccataatcattgggaaaagaaacttagggacttctatcaaacatgagagtttgggaatgatatctgaatttcacaaattaaaaggattctgagctgctggttataagtaaggagggggacaaaggagcatcaggaagcagggtctgagggggtctctgctccttttgagctgggtttctttgggtaaatcacttcatctctctctgggcttcagtttcctcatctgt

SEQ ID NO: 133586 - DNA, 432 bp, Homo sapiens
gaaaacagagatttcatggagcttcctcattccgtcagcctagagtgggattttggctgtcacccttcaaggatgaaaaggtgcagaggacattgggctgcagacagggcgctcgtttaaatgatttaaaagttttggtcagtcgtggtggctcatgcctgtaatcccagcactttggggcgccgaggcgggtggatcacctgaggccaggagttcgagaccagcctgactaacatggagaaaccccatctctactaaaaatacaaaattagtcgggcgtgatgccacatgcctgtaatcccaactactctggaggctgaggcaggagaattgcttgagcctgggaggcggaggttgcggtgagccgagatcgtgctattgcactccagcctgggccacaagagcaaaactccatctcaaaaaaaaaaaaaa

SEQ ID NO: 133587 - DNA, 235 bp, Homo sapiens
gagagtcccagtcagaattaatccatccttcgctgggctctcatagttcttggcttgtattgctattagcacacttaacacttcctacctcgtgttagaattaactatgtctgatcctcccttcacactacacctaaagcaagctgcttagacgtttgttatggcactcagcatcttgcatcaatgctagcctgcctgggtttgcctcccatcttatccagtgagtccttcctgt

SEQ ID NO: 133588 - DNA, 520 bp, Homo sapiens
tagcaatacctttgtctgcttttataatctcctagaattagaattgctggattaagagtattcatgtgcttaacacttttcgtactcatttgtcttagtccattgaggttgctataacaaaataccatagactaagtgacttataaagaataaaaaattgtccctctcagttctggagtctggaaaatccaaaataaaggtgctggcagattcggtgtatcatgaaggcctatttctttgttcctagacaatgtcttctcgctgtgtcctcacatgatgaaaagtaagaatgctggtctcttcggactgttttaagagcactaatccgattcatgggtgctccgccctcacaacctaatcatctcccacaggccttacccaaaaccatcacagtgggaatcaggtttcaacatatgaattttggagcatggtgacacatgcctgtaatcccagctactccacaaactgaggtgtgagaaatgcttgggcccaggagtttgagtccagcctggacaacaca

SEQ ID NO: 133589 - DNA, 266 bp, Homo sapiens
tcatggctttcttctcacctgggctaccctgagtctcctccttggtctacagtctgacttgttcagtctcccatctgttctcaccagacacaggtgacatggtctctaaatgcagatctcaacatgtcatctctgtcccaaaaccctcgatggccctgtcctgagggtgtagtcagtgaggcttgttaggaaccctcggcacctttgttgtcctccacacagtgctcgtgtgggacatccctgctcccttccgcccaccccaccca

SEQ ID NO: 133590 - DNA, 246 bp, Homo sapiens
ttaatgtgagttatagatgtgtagtataattaggaatgtatctggtctttgcactggttcttggcatagagcttcaaaaacccttggaatttcctgagtgataggagtgactttgtgatgcaattggggtgactcatggtagacccttagatagccttagaatgatggctggtctccagaaagattagccctgtgatcacagggttgcaactctggtcagccagacctctgaggaggaaagagggg

SEQ ID NO: 133591 - DNA, 545 bp, Homo sapiens
ataaacaatgtaactcaattgtatctaatttagtaattttagcaggggagggtggctgtaatcctagctactcaggagaatgagaaaggaaaatagtttgagcccaggagttgaaaaccagcctgggcagcacggcaagacctcagctcaacaaacaaacaaacaacaaacaacaaacataaccagagtataatttagtccttttaaaccagcactggtctagtatatataaaaataatttatgggctaggcgtggttgctcacacctgtaatcccagcattttgggaggctgcagtgggcagatcacttgaggccaggagtttgagaccagactggccagcatggcaaaacctcgtctctactaaaaatacaaaaaaattagctgggcgtggtggcacatgtgtgtaatcccagttcttagtaggctgaggcaggagaatcatttgaacccaggtggcagaggttgcagtgagccaagactgcaccactgcactccagccttagtgacagagtgagactctgtctcaaataaataagtaaataa

SEQ ID NO: 133592 - DNA, 309 bp, Homo sapiens
tagctgggactacaggcgcacaccaccacgcccagctaattttgtatttttagtagagacgggatttcaccatgttggccaggctggtctcgaactcctgacctcagatgatccacctgctttagcctcccaaagtgctggtattacagacgtgagccaccacgcctggccagttttctgtagactttagctgttgaggcatgagagaagctaggatgctctggctgtttttatctgtgagccctcatgtttcctgtgattgtatctcttacagaactttatattcaaaaacaaaatagcaggaatacc

SEQ ID NO: 133593 - DNA, 324 bp, Homo sapiens
gtagctaatgttaaatggctgcagggatttatgtttttatgtactttccaagataaactctctgcaaaatgctcagtaacggaatgagagaagtctggtagctaagagtgaattaaaagtggagagatacctatagaaaatgatgactgccattttttagaaaatctaatatgtaacatcttctgacaaaaattaggtgacagggttaaatcatttattaacacaacaactatgatagtaatagtgacagtaacagcaacaatttgggtaataaaagctttacatgcattattttctatcatccttacaacagccatttaggta

SEQ ID NO: 133594 - DNA, 740 bp, Homo sapiens
gcctgggatgcctgattttcacatggccgactcttatcactcaactctttctagaaggattcttccagcagcaggccgggcttggtggctcacgcctgtaatcccagcattttgggaggccgaggagggcgaatcacgaagtcaggagatcgagaccatcctggctaacatggtgaaaccccgtctctactaaaaaatacaaaaaattagccaggcgtggtggcgggcgcctgtagtcccagctactcgggaggctgaggcaggagaatggcgtgaacccgggaggcagagcttgcagtgagccgagatcgcgccactgcactccggcctgggcgacagagcgagactccgtctcaaaaaaaaaaaaaagaaagaaagattcttccagctgccgcgccccgcctttccgcagtcatcttctgcacggcatttacgactctgttaggttgcttggttggtttttactgtctcccccactagaatggaggttccatgagagcagggagcaccctcttgctcagcatggtgccctcagcacacagaacagtgcttggcataaatagatgagcccaatggctctcattttctgcctttgcttccccgccacccatgcttcctgtcatactctgcaggacttgaagttgcttttcagtcattctgtctcacacattgttccttctcctagaatcccttttctccttctcttcttcagttgttgagatgattgagacctacatatc

SEQ ID NO: 133595 - DNA, 301 bp, Homo sapiens
tcaggctttttattgttgagttttaagagttattcatatattctggatactagacctttatcaggtagataattgcaaatattttttcacattttgttagttgtcttttttctttcctgatgtcctttgaagcataaatgattttgaatttggtaaagttcaatttatattttattttgttgcttctttgatgtcataaagataatgcaaactcctgaaggtttacaccaaagttttcttctagttttagctctgttatttgaatccttaataaattagagttaatttttgtatgtggtgt

SEQ ID NO: 133596 - DNA, 272 bp, Homo sapiens
ttgtcctgctttggactatgggagcaaactggctcctgtatcctttattttgatcccagcagtcttcgacagatagcttcatgcttttgcccaccttcccaaagtccatttttagcctatactgaagttggttgtttcttcaaaaagctttggtttcttccagttagaactgtagagactacagtctaagttttaggagagataagatagacagatcctctagaaagaggaatgtaaagaattaattcataatagtccaaaggcaggacaag

SEQ ID NO: 133597 - DNA, 703 bp, Homo sapiens
ttggttattaagataagagagagagtaatctgggttatgaggaaaatctaatgagttttctatttgctgtgtgggtggaggaggtgggaatatgctttaaaaacccaactttagaaaaatctgaggcaaaatcaaatgcttataaatagggacaaggttaagtagatggtgggagggctatatcatgacatattatgtaacctatacaataataatttagccaaacatacattatgtagaaaaatggtcacaatgtatggctaagtgaaaaaatgcaggctataaaatatgcataatataatagtattttattaaaacaaaaaatattctcactgtataattcctattgctatagatatttcagttgtacgacaaaggatgtgttaataagacaggccaggaaatagaactctgaaaataagaccaaacagttataagaaaagtttgtcccatttgatgcagctataaggaaattattttcccaataattttgactttttattttctacatcatttaatctatgtggctcacagaagcttttgccataattatttggccaaattagatgtgaagtataagccctatgaccctgaggtataaaccctatgacaccaagccctattgagtaacctgcaacaactgcctctggcatgaactgaggaaattcaagagccctggggccagtggggacatgtaacatga

SEQ ID NO: 133598 - DNA, 406 bp, Homo sapiens
tcaggtagatttgtacttttagtagagatgggatttcaccatgttggccaggatggtctcgatctcctgaccttgtgatccacccacctcagccttccaaagtactgagattacaagcgtgagccaccattgcccagccccgtatcaaatctttatagataattcagatttatcacagttttcctcttatattgtcgttcctgatataagactttcttatgctttatcatgcaaaagtttttttaattaaaaataattttttgtttgggtaagttacacgtaaaattcaccaaaatgtacaattcagtggcatttagtgcattcacaaagttgtacaaactatcaccactctagttccaaaatgctgggattacaagcgtgagccaccattgcccagccccgtatc

SEQ ID NO: 133599 - DNA, 713 bp, Homo sapiens
tgagacaccttaaggagcgtgtgaggtggtcatgaggatgggcataatgaccctgcagggcctagtcaaggatgggtcatctgaggttttcttctgctaactttcatcatgacccaaagaaggtccagggaaacggatgttatgggaggatcttgctgctaaggaggtgagatccagagggtcactgtgaagttgtgtttttgtatcaacactcgaagtgagagaaccagagaataccttcattccagcttattcctttttgtgattgacttccagtatgttccttgtgaattggtttccttgttgaactgttagcttaattctcatccgagctggtggcactccattttatcccaaatactgtgatgggcaacttctcataatttacgatctaatttttcaaaccttcactattttgaaaatataaccaaggccggttgcggtggctcacgcctgttaatcccagcactttggggggccgaggtgggtgtatcgcctgagttcaggagttcaagaccaccccgggcaacatggtgaaaccccatctctgctaaaatacacaaaattagccgggcatggtggcgcgcacctgtagtcccagctacttgggaggctgaggcacgagaatcacttaagccccagtggtggaggttgcagtgagccgagatcgcaccactacacttcagcttggactacagagtgagaatctgtct

SEQ ID NO: 133600 - DNA, 486 bp, Homo sapiens
  misc_feature (135)..(135): n is a, c, g, or t
  misc_feature (148)..(148): n is a, c, g, or t
  misc_feature (377)..(377): n is a, c, g, or t
gctgtctcatgccaattgtgtggccataattaggtcttgtaattatgtatccttgatgatcgcataactgtggtggtggagtggtggatggatttttagagtttgcttctgatactgagtctgggttatgctatntggaactgtcatngatggtgagatagagatgatggaagaaaacccaaatataccagaaatgggtagtacacctccattgtctatttatattttattctcatcaagatttccaccaaggtgactcacaccactaatcttatcactttggggggccgagtgggaggattgcttgaggccaagagtttgagacaagcctgggcaacatagcgagattctgtctctacagaatttttttttttttntttttgggagaaaaggattttaagggggatccttaaaagtcagaccggaaggcttgaaggttgggcaggggccggtggttaaaaacgggaaacagctttgaaggggagt

SEQ ID NO: 133601 - DNA, 213 bp, Homo sapiens
tgcgtcctgacacacctctccaaagcttgatatgtgtctctggcttgggctctgcatggtccattttgcataatgacatagacactgcctagtccttcgtacagcagagggctcttctgattttctttggtctcaaaggaacaggcagtaggtggaaggcatgaggcaggtgtctgggatgtactcagctgtgtaggtgggaaggagcccatc

SEQ ID NO: 133602 - DNA, 820 bp, Homo sapiens
atatgaaatagtcttaaaggtagggtgcatttcaattctttgctttcctaaacatccaggcttagaaatatttaagttaatggatgagcatagtcctagtaaacttctcactcggaaaccctgtgccagactgtgtgcagatggggcagcagtcatgactggcaggcccagcaagtggaatcacatttgcacattgttttattcactgtgaacatttttgcaggaaaaaaaggaaaaactgtctccctgcttaatgcaattctgacgcgatcagtacaaattataaattacatttaaagtgatggtacaaattagtgaacatttccagctttgtgtgacagtttggggttgagcatcagcgtttaatacttggtgttgccgtcacttggttgtattgaccaacatttctcaaagtatagccctaaatgacatctgccagaaatgcaaattccagggcccccttggaacttcagaatcagcatatctggctgcagaacttgtaatccgcattttaaataagtgcctccccaggtgatccatgtaaagcagttttgttgaggccctctagtacatacagtgggaacgtttgcaaagattatttgttatctcaatttaagatacttatttttaaatccagagaatacaaatgtataatgaaagtttgagagcaaagctgactgattttgggtccatatttttacttatgagtgagatttgagacttcaaggcactgtgggtagtgtcttcaatttgtgcaataaaattaattttcaaagtacaagttagaaatttagttgaagggcacatgtgagaataattt

SEQ ID NO: 133603 - DNA, 497 bp, Homo sapiens
ttctcctccctcaggctcccaagtagctgggactacatgtgtccaccaccacacccagctgattttttgtatttttagtagagacggggtttcactgtgttagccaggatggtctcgatctcctgacctcgtgatccgcccgcctcggcctcccaaagcgctgggattataggcgtgagccaccgcgcccggccgcaggcaggcttttttaaggatagcggtcacaggcctgctggttcatcttttctgcacaatgtatttcataatccagggtagtgcttaactgtagtctcatgacaagcatggaacatttaaatatcatagaaattttaatacatattattgaatattgaaatgaactcaatatgttggatgttgatctgttatgtgataaaatcaaaactcactgtgtctaaactataaatgtgatacattaatgtaagaggtacaatcttacccctcttatctgtggttttgctttctgcggtttcagttac

SEQ ID NO: 133604 - DNA, 457 bp, Homo sapiens
gtgttgtggatgtaataccccctgcgtcaaacatatataaaaagtgctcagattcagagccatactatcacttatgccatccaaaaaattgtttttaatgaagacagggaaaaaagaaaatctaaatgccgtatatactgtgttggccacaggaaacttttaacaaattcagtatttgaattctgtccagaaatgtgtttctctaatgcttcatttctgtcacacttgaagagatgggtatcactgtcatcctgcacatactgtttgctcattcttcatccagcagcgtttcttgagcacctcatgtggcggacatttttttctaggatatgagaatagatcagtggtcaaatggatattatccctgatctcacagattttatattcaataaaggagagacagataatagacaataaaatgtaggcaaccacttaccactgaggaaaagaaaactta

SEQ ID NO: 133605 - DNA, 682 bp, Homo sapiens
atctgaacggacttcctcctaggccagggcagtctaaaatgtaaccaacctgagagactggttcaggccatgacgggaagcaggacatgagacatgcctcattacatccttcagcattgacatcaacacaacagaccttaagactggtaagaaacatttacaatctgttctctctggagcccacctgccacttggaggcttcacgtgcgtgataaaactttggtgtccacaatcccttatcataacccagacattcatttctattgataataacttttttttttttgagacagggtctaactctgttgcccaggctggagtccagtgatgagttcttggttcgctgcaacctctgtctttcaggctcaagctatcctcctaccttagcctcctgagtaactgggactacaggcgggcaccaccatgcctggctaatttttccattttttttgtagacacagggtttcgccatgttgtccactctcatctcaaactcctgagctcaagtaatccacttgcctcggcctcccaaaatgcttggattacaggcgtgtgccaccgcaccaggcctattgataataactatttcaactcattgccaatcagaaaatgtttaaatctgcctataatgtggaagcccccacttcaagtttccggtctttctgcaccgaaccaatgtagt

SEQ ID NO: 133606 - DNA, 345 bp, Homo sapiens
tgtcttgccccaagtgccctctttgctttctttttagagagttctgagactcattagagagtttagagattttagcattcttgaagttctttctgtggtcagtttggtgaaccacttcatttctaaagtttctcagttgaccccattcttccccagctttgcattctccatgaagccacctgtgtttggtgtgtatgggttttctgcaacctaggttgaacaagtcctctagaatcctgaacaattggtgattcatgctggcctggtttttctaattggcctggaaatgtggctgtagtggacacaagtggacttggcctcctctttgatgcgggtaaactttag

SEQ ID NO: 133607 - DNA, 715 bp, Homo sapiens
acctattttcatttcttaattgacttgatttttcttcaaagattaaatgcatttgtttcttgttgaactcagaattttcagttattgtgcttgtttcaaaatgctttaaaattagttcctgcattgtattgagagacatatcaactgaactctaaggactggtgaggtcttgcaagcccaccactgctttcatttgtttgcaaaccccatgggactcctatttccaagtgctggcagtagacagagctggcaaaattttgttctgacagactactttattcttgtcaaggaaagtttgtcagtggaaactatgtcagtagaggagcttctggagaattccagcatcaggggcactgggttgttatttctggcttggctgtagaatgaaccctgggactataggcaagtcacttaatcttttaaagtctcacctgaaaataagaataataccatgattctgtgactcaaagatacacattttccctgcattttattattcctgaaatggaatgtgtctaaataaacttgccagcttccaggcccagtatggataccccagtatgagatataagtaacatttgtgaatgtaggtgaacttggagggctacatagaaggtatctgcttatttgatatcacatgggatgagtgatttgcattgatagcagcacacatgtttatttgcatttcatgttaaataaatcaaaatttacattt

SEQ ID NO: 133608 - DNA, 445 bp, Homo sapiens
gtgagtcactttttcctatttcagtcaatttggctgtaaaataattacaataacgaggtcttgtttactgagactgaagtccgtgctgcccggcctcatttaacggctagaaagaaaaaaaaaaaaaaaaaaaaaaattgtgggcgccatccgggcccgcaaaagagacgtttctaaaaacccaattcgggttgggggggagcacggaccgcccagataggggaagcgaaacattggggacaaggtgggtccctaaagagagactccgggcgcaggaacttcaggtggggggttcccaccaaataaaaaaaacgcgccggggggcaaccacgaggcgtatggaagaaaaaacccagtaggaggttcggagggccacatacaggggggattaacaaacgaggtcccaagcagagagctagtattaaaaattaaccccgcggcacgg

SEQ ID NO: 133609 - DNA, 678 bp, Homo sapiens
aacttggctcaaaacaacacaaatttatcttagttttgtacatcacaaatgtgaagtgggtctcacctaaaatcaaggtgtgagcagggctgcattccttcctggaggccataggggagaatctgtcccctgtgtcttccaggttttagaggccgcccttggtcctgctccaggcccctggttggtgagtgtttctcattctgcattactgtgatgctcttctgcctacctgtcccatatttaaaggatcctgtgatcattctgagcccactggataacccagaataatcttcttatttaaagtgagatgattagcaacctttattctgtttgcaaccttaattcttccttgccatgtaacaaaacaacattcataggttctgtagattgggatttagacatctttggggaaagggggtcattatccagcctatcagaaataatccaaacttttcccctgaaaattacacaaatatacattctatcagtactaagtcaatatcataagtctatatatttctgaatttttttttttttggagacggagtcttgctctgtcacccagcctggagtgcagtggctctatctcggctcactgcaagctccacctcctgggttcacgccattctcctgccttagcctcctgagtagctgggactacaggtgcccaccaccacg

SEQ ID NO: 133610 - DNA, 520 bp, Homo sapiens
gaaattataaaaactactctctcagaccacagtggaatgaaattagaaatcaagattaagaaattcactcaaaaccatacaattccatggaaatcaaataacctgctcctgaatgacttttgagtaaataatgaaattaaggcagaaatcaataagttctttcaaactaataagaacaaagatgcaacataccagaatctttgggacacagctaaggcaatgttaaaatgaaaacatacagcactaaatgcccacaccaagaagttagaagaatctcatttttctatcattatgtaaactatcattacaactgataggttacaaatgataggttatataatgtaacctatcattacaactaaaagaactagagaaccaagataaaacaaatcctaaagctagcagaagacaagaaatattcaaaatcagagttgaattgaaggagattgagacatgaaaaacatttcaaaaggtcaagaaatccaggagttgattttttgaaaaaattaataaaataggt

SEQ ID NO: 133611 - DNA, 126 bp, Homo sapiens
aatgtgccttttacttcctgggattccaaagtaagggatactgtataaaaggatcaccattgctgaagtttaaaaccactgctctaaaagagttttctgccttaatgtgctccttttccaaaattt

SEQ ID NO: 133612 - DNA, 340 bp, Homo sapiens
atgttaggagcttatggggaggcattggaaaaggagaggctgagaaccccgaactagtccctaccttcaggcctgcaccctacttttaggcctcaacaccctccctactcagaccttgccagtagccggctcccatccccagccctgaccttagctcctcctcccagggaatgcaggtgccaggagaccccagggttccgtctctgactcacagaactcagcaggaggtggggacggctagggcacatccaggaaaagcgctgccaagtcagggcggcaccagaccctctcccggacagcacccggggcagcagtctaattggggagaggaggttcaggg

SEQ ID NO: 133613 - DNA, 763 bp, Homo sapiens
ggagaagtccatgggggtggagaggaagaggaagaggaagaaggattctcaagaagctctgcaagatggttgcagttgctggcttaagctgcaaagtaaggaagagaatccagcacacgtggtgctggtacataatttaagctgcaactgaataatagatctttccatcactttatgagcaaaacaactaccagccactcttggactctgtctttttaaaaaatgcttttcagagataatccactggatctctaaaaaaaaaagaaagcaagcaagcaaacacaaacgtagtttaaggagcacaaaaacattttaagatgagaagaaccaatggaaataatttagaatgttctctaggctttatactcaaacttcaaaaccttcagaatcttaagcacaaaagactttgagatgatcaactgtaactactcattttctgataaagaaactgagaactaggccaggcgaggtggctcatgcctataatcccagcacttcgggaggccaaggcaggcggatcacgagctcaggagttcgagaccagcctggccaacatggtgaagccccgtctctaccaaagatacaaaaaattagcagggtgtggtggcgtgtgcctgtaatcccagctacttgggaggctgaggcaggagaatcgcttgaacctaggaggcagacgttgcagtgagctgagatcgggccattgcactccagcctcagcgatagggctagactccacctcaaaaaaaaaaaaaaaaaaaaaaaa

SEQ ID NO: 133614 - DNA, 243 bp, Homo sapiens
aagtcctagttcttggccctgcttttcccagacactgactgtgtggctggagcaaataccttcttcctgttgggcttccactgcccatttgtgcaatgatgaggttgccctggatgcccccagaagacccttctattttgggcaatactttgatgttcatattggaaatgatagaactggctcgaaagttttatgtatagtcattctcccttgcatttgtttagtcaataaatacttactggg

SEQ ID NO: 133615 - DNA, 367 bp, Homo sapiens
ccagattccctgccctttcaccagcctcaaggctggagatgctgagaaggtggaaggtcaagcaagaccttctgagtcttctctgggtggcagcagctttctaactttttttgcggcaaatcagaaagccagcggtgggcttccattttttgcgcatctcgccttttctttgtcctgaaggcaactaatactctgtattgaatccccttctccttgaaatagctagaatgacatgtcttcttgactgaaccatgactgatagggtaggcctattttacaactgagaaaactgaacatgagaaaaaggtaaattgctcaaagtcaagcaagcaagtggcaggacaaaagaattcacacccaggtttat

SEQ ID NO: 133616 - DNA, 347 bp, Homo sapiens
tgtttgcagcccccagaggggcattgagggccccagtaccagccagtgcactggggagtgcatggctctgctgccccgtcctaggaatccgtactggagagcctggtgatcatcaccgctatttctatggacactgcctctcaagagtgctggctgggatacctgcaaacctgcaagtttaatagccccaattctcttcttcttaggcagtaatgggtctgccttaggcagctcttaggcatcaagagctctgggttcatgacagaatgccatgaaaacaaaagccaccatttgaaccacgagaatatatgttgtcagcctggccaacatggtgaaaccccgtctcc

SEQ ID NO: 133617 - DNA, 148 bp, Homo sapiens
ctcatggaaaacaggtactggacccgtctcaagcactgagcacacagctatgccccaggcagaagacttctgatgaagggaggcaggggccacacttactcagccagcctatgcaagagaagttctaatagcaacaacaacaaagggc

SEQ ID NO: 133618 - DNA, 179 bp, Homo sapiens
tcttcttggtagagatagagtcattgagcacgataatacagaagctgttgtgttgcagattaccatggcaataacgacaacaaaaaaaagtgcagtcttttttttttaggctccaatttgaagactgcaagaatctatcgatagagacaagaacaggtctcaaccacaagaagctgcag

SEQ ID NO: 133619 - DNA, 496 bp, Homo sapiens
ggtgagaggatcattggagcctggaagtcgaggctgcagtgggccatgattgcatcactgcactccagcctgggagacagagtaagaccctgtctcaaaaaaaaagtaacagataattatgaacatgtacttgcaccctgtgtgaataaccaaataagcaaaggcagaatgaggtcaaagagcacgcaaattagaaatttttatgtcatactgctctctaaaactattttaagtcctactgatcatgaagaaaaacgtctttcaaaacctcatcaaatactgggtagcactggtcttgttaatttggtagtccaaaaatactaagttgctttaatttgcatttctttaacaactagtgagattgaacatagtttcacaggataattggccattagtatttcttccgtaaactatgtttatgatccataaatctattggttcctctccttcctacagacttgtaagagctcattttatgttaggatatcagccctct

SEQ ID NO: 133620 - DNA, 561 bp, Homo sapiens
agcagccagcttattaggtttaatcatcaactgtgcttatcagatccttcatttgtaagtcccttgaagaaaaaaagtgcaaaatgattccttttgtgctttggagattgatatcaaagcaggccttgaggtcaactacagaggtgctttaagtggaaattataagcaggaaacaaaatgcactcattcaatttcttcaagttgagtggagacctcctggatgccacgtgtcagctttacctgctagaaacacacgctcacctcgctgtccaagaccctggaaaggggaaccccttgaattgattggattttgctccccttggccaattcttcactatggtttagagatttgtggtcttccagtggcattctactcaatcaaggtgaccagccatctgttgaactgtcttttccaacctgatatacccaagtgttgtggttccaatttcaatattccctcctagggagagcaaatgagaagatctatgggtgaataatacaagaatatggtaaatggttgacaatattacccacgaacctgcattaagtcaggttggttcg

SEQ ID NO: 133621 - DNA, 458 bp, Homo sapiens
agagctgtggaaccatcaccaaatagcatgcctccttcgctttctcttcatcttgatcctcccctcctccagtagttccctgttcttttcaaatagaacaccacacaaggaaactcaatgaaggaaagtgtgtgtgtgtgtgtctgcatgtgagtatctgtcttgcgtgtggacatgtgggcgtgtttgagcatgtgtaagaaaaagtgcatgtgaagaaagcaaacagtaaagcaaatggggcagctgttaataggcgaatctgtgtaaagattatatgagtgttctatgtactgttcttattcttgcatctataaatttgaagttatttccaaagaagatacttaacacatggatatatgtgagactaatttgactgcactaggagttctctggaatggaaattttcttctacatcctgataacatatcttactcttcccatttaacagatggaac

SEQ ID NO: 133622 - DNA, 347 bp, Homo sapiens
atgaattccaaacattggcttaacttttaaaaggtttttagaacacagccaaaataacatcatatagcaagccaaaccagaaactggcttgggtatagcctggctatattgtcagtgacataaggaatccagacctgctaactgtgtcacacctgagtctttaaatgatctcatcactgttattatgtcatacctgcagcagcttctgacctcattaacactatgttctatgataactgacagaagaacacttcatggcaatgcaatttgaactcagggcctggcacagtggtaacactaaccagggaaataaatactcaacaagagtgagcagagctatatctgta

SEQ ID NO: 133623 - DNA, 417 bp, Homo sapiens
tgaatgttcacccttcttttcctattataattcattcagatatatgttgctggattaacctaagcacaaatctgctcatctcttcattgctcaaaattgatctccatttccttccaaatgaagcactaagtcctcaaactagtatttaaaaatcattcctactacacctgaaggatgcttttataatcatatcacacctactcattaagtttcacccaagcatgacaattttgtgaattccctattccaggccttcgcattcctgctagtttcatgccctccacctgaaacactccattctagttcacccctttgaaaaccttaatcatcctttaagacctagcccaaaggagccttcattcataaatgtgtcctttccctccttgtaagaggccatttgatgaccctcttccttga

SEQ ID NO: 133624 - DNA, 538 bp, Homo sapiens
aaggatctaaaagcagaaatagcatttgacccagacaatcccattaactgtgtatatatccaaaggattataaattattctgctatgaagacacatgcatacttatgtttattgcagcacctttcacaatagcaaagacttggaaccaacccaaatgcccatcaatgatagactggataaagaaaatgtcgtgcatatataccatggaatactatgtagccataaaaaggaatgagttcatgtcctttgcagggcacatagatgaagctggaaaccatctatgtggaaaccatcattctcagcaagctaacacaggaacagaaaaccaaacaccgcctgtcctcataacgtgggagttgaacaatgagaacatatgggcacagggagggaaacacaataatagagggatactttcaaatataacaaacaagggttccttaatctcagtttgggaagcactgctatccaggatatggcagggaggggaacatcacacaccagggctaatgtgtgtattttagtagagagaagatttcac

SEQ ID NO: 133625 - DNA, 457 bp, Homo sapiens
tattaaaaatcataacagcagttggcaaatgggcaagatataagatgaatacaaaaatattaattgcaaaatgtacactagcaaacaaaaatcgtatttaagcatgccttcacaaataatagacatatatttctatctctgaggtagcaaagtagagatacaaagacttgtgaatgagctaaatacttccctaaaagtaagaacataaaggaccacttggtatccgcagccactcagaagaggtggcaaagagaaggctttacactttgcctggaggtgacggattaaccagagcctgagggtggcctgctcaggttcaggtctcctctcccggagaatgaaacccaggctaattggctaattaccatgaaacaccaacaaggcccaacagagtaaagaggaaacagatgcaagacaccctgtgacccaggctgatgggcaccagcttcaggtaaag

SEQ ID NO: 133626 - DNA, 543 bp, Homo sapiens
atacagatcagaaacagacaaaggaagatattcataggtggaatctgggactggagggtcccagatggaaagttttcttctcctcagggacatgttgtcctcccagtattgacatgtagcaatatgtggagagtaatgccaactcaggaagctcaccaaagcatcagtgttcagagtttttattggggtttcattgcataggcatgattgagcaaattaccgcccatgtaattgaattcagtctccaatgctacctctaccttccctggatccggctgattttgtgcgggccaaagccccaaccctctaatcacaatggtggttctttctgcatggccagcctccatcctgagttatctcattagcaaaaactatctaggggctcaccatgagtcacctggttagcataaactatccaaaggacccacagtgaatagtaaagacactgctatcactcagaacattccagaggtttagaggttaacttccaggagctgggacaaaagccagacctctctttgggtaaagttaattattcactac

SEQ ID NO: 133627 - DNA, 1191 bp, Homo sapiens
gcacagaaggagttaagtttcattagaacaagaggtgtcactgtgcctgagggctactgtggaccactgtagccctcaggcacagaaggagttaagtttcattagaacaagaggtgtcactgtgactccaacatgcagttcgctcagttcgctctgaagagtaagagtctggaagataaagacatgtttttgaggagtaattaacaaaaatcatctgtgtaatttgcttaagatgcttacctgcatttgggaaatattttcttaaatagagtgttaaattctactaggtggtattaaatgtctcctaggtagatatttaaaagtcaaaagcagaatagcacatccaggaaccttaatattttaggatggatttggttttggttcttcttcaccactgatttactttgtgacattgggtaaattagttttcctctctactttttaactttcctattaatatcctaaggaaaaaaatgaatgagactattaaaacgtcattaaaatgatccaaggtaaggtctgaaaagtgctttcattctttagagaaagatatgagggttgatgattattaatgagctaagattctgttagatttatgttttacagaatttaaggtttttcttataagatattactcctgtcagtttctaatttcatctgtatattttctaaacatgctgccatatgagttctcacactgtgcctgttggtaggtagcaagccctattgaatcccccgttctgtctttggaacagttggttaaggaggggaggtgaagtagtagagagcccattccgggtatctggttggttccaggagctagtgcctggctctggtggcctgagaagaaccatcttattctgagcactccaatggaggatagggcttcatggtagaaaatgacattatttgaacgtaacggagtgggtgatagtgttggctgaggtaggaaataggaggagacatggaattggatggagctcagagggaaggatgatcatgagtttggttttccatgcagcgagtctgagctttctggaaagagatggaggcagatttaataataaaacactttgtttttggctatctcaagactggcgtgtagaagtgacagctgtgagctcacatagctctgctgttgatactctgtattcatcctttccgatagcaacttacctggtgagtagacgt

SEQ ID NO: 133628 - DNA, 574 bp, Homo sapiens
gctaaggagcagctagatgtttctgcaataatatcacccagctgggtctcattgttggtacccacttgcagcttttctttttccatttaaaaatatttaaaattatttagctttaaaactcctttagaaaacagggagtgctttagtaaaattaccagtgaaatgtcattggcataatttctataactgagatcataaggcctaaagatactgatttaaattttatctcacgcaagtttttgggatttcaaggtgccctctagtatgtctttttccactgtttgtttgaacatgactagtcatattttctttttccaataaaaaatctctaaacaattatttaatcttaagtgttgttcgaagttatgtttttaaagagaatataaagaattatgaaattcatgatcatttggttactcatagagctgaattatccaatacttaccctaggagaattttacctggaaattaccagatatgctctcaaccccattttttttctaacaaataaatgaaacctagttggggcgcagtggctgaggccggcagaggttgaggcctccaacacagaggt

SEQ ID NO: 133629 - DNA, 237 bp, Homo sapiens
aagactaagaaagggttacatacatctgccatatcctttcattctctcagtgctaaggaactaaatgtgtgatcgtttatctgtaaatgttttccttgttgtctttagtatcctatgttttggctcccatgaacctagttaattcttagcaactttcaagatcaagattagccatgggaataggcaaccagctgttacatctttttggtttagtaacttactgacatgcatttcaaa

SEQ ID NO: 133630 - DNA, 603 bp, Homo sapiens
ggtcaatcttcttatcataatgttgagtggaagaagccaggtccaccagacacatgctgctcatttatgcaaagtttggacacaggcaaaacaaaactagtttgatcgtgatgggaaacattagagaaatgcaaagacatgaccatcataattgtcaggagaaggcattggttaggattgggaagcggcaagcagaagcatttagggattggctggcaatgttttacttctcggctgagtgagggttgcatcggtgtttatttgataacacgttctaggggctgggcaagatggctcatgtttgtagtctcagtactttgggaggccaaagatgggaggattgcttgagcccgtgagtttgagaccagcgtgggtgacatagcgagaccctgtctctacaaaaaattaaaaaaaaaaaaaaaaacccagctgcgtgtggtggcacagcctcaaactcctgggctcaagcgatcctcccttcgccttccagccactcaggaggctggggtgggaggatcgcttgaacccaggagtttgaggctgcagtgagctatgaatgagccactgcactccagcctgggcaacagggcaagaccctgtctc

SEQ ID NO: 133631 - DNA, 641 bp, Homo sapiens
gttccttgggcagcaaccactagaaaccccacaaagaccagctggggccagaggcaggatgtgtggtcctgggcaggtctgagacagatcaaacacaaggtaatcagtctgcagaaccacagacaacacagacctacgccatggaattccagatcattccagatctacaagtcattggttcattccataagtatttatcatagcacatagcacgcgccaagcaccgtgctaggctgtcttgagaatggaggtgtggggaaagagggatgaggtacaaagatgcatacccagagaaggaatctcctcccttaaggaagcagtgaggggaacagacgagctccacacacaaagggacgggaggagagggatagacacaaagcctgctagaggtgatcagggaaggcttcacagaggaggcagtatcagtcccagcaactgtagcccagttgctccccgtcacccaaagacagccacacctgatcccctggctcaggcagctggaaagaggagctgagaaaaaggagagtcatgctctcagcaaacatcaagtgctgtaagcatcataaaatcatcatcatcatcatcaccatcagacactgatggcccagtgggaggcctgggaccctgaagagagcccaggt

SEQ ID NO: 133632 - DNA, 1311 bp, Homo sapiens
ggagagccaatcaatatacacaaagagggaggagaagagagagtgccaataaggacacaaggaaagtggtagcgtacccttgtcacttcccaaagtctcccagcgggataccggtgccctctgcccttaatcaagatggccgccttgggggggctctagcgcacagtggaatatggcggtgcttccggtcccgctgccctcagcgaagatggcggcagtggagaagcggcggcaagcggtaccaccgccggccggtttcacggacagcggccgccagtcggtatcccgggcggcgggggcggccgagagcgaggaggacttcctgcggcaggtcggcgtgacggaaatgctacgtgcggccctgctgaaggtgctggaggcgcggcccgaggagccgatcgccttcctggctcactacttcgagaacatgggcctgcgctcgcctgtaaacggcggcgccggggagcccccgggccagctcctgctgcagcagcagcgcctgggccgcgcgctatggcaccttcgcctggcccaccactcccagagggccgccttcaacaacaacgtgagcgtggcctacgagtgcctgagcgccggcgggcgcaggaagaggccggggctggacgggcgcacctacagcgagctgctcaggcgcatctgccgggacggccaagcccccgaggaggtggtggcgccgctgctgcgcaaggtgcagtgccgtgaccacgaggcggtgccgctgagcgtcttccgcgcgggcacactcacctgcttcgtgctgctggagttcgtggcgcgcgccggcgcgctcttccagctgctggaggactcggccgccgccgtggccgaccgccgcgtgggccaggccgtgctggacaccctggagggcgcgctgcaggccagcgacgccgccgcgcccgcgcgcttcctggaggccggctcgcgcttggggcccgacagcctggcgctggcgctggaccgcgccgtcggggggcggcggcccagcgcgcccatgacccgcgaggagtttctggagagggccgccgcgctcttcatcgcgaaggtcaagccggtgggctgaggcccgtgggccgcgcggatccgggatctgcgctggggggtccccgcgtgcggggcgcgcggagccttcccttcgccctggtgaggccctgccataaccaggcgcccagccctgcggaggaggccggggctcccaggaagcggacgcccggtccccacacagcgccgcggccgcccctccacccccgcgggagcccctgccccacgctaataaaatgtgttgcgaggctg

SEQ ID NO: 133633 - DNA, 1756 bp, Homo sapiens
ggagagccaatcaatatacacaaagagggaggagaagagagagtgccaataaggacacaaggaaagtggtagcgtacccttgtcacttcccaaagtctcccagcgggataccggtgccctctgcccttaatcaagatggccgccttgggggggctctagcgcacagtggaatatggcggtgcttccggtcccgctgccctcagcgaagatggcggcagtggagaagcggcggcaagcggtaccaccgccggccggtttcacggacagcggccgccagtcggtatcccgggcggcgggggcggccgagagcgaggaggacttcctgcggcaggtcggcgtgacggaaatgctacgtgcggccctgctgaaggtgctggaggcgcggcccgaggagccgatcgccttcctggctcactacttcgagaacatgggcctgcgctcgcctgtaaacggcggcgccggggagcccccgggccagctcctgctgcagcagcagcgcctgggccgcgcgctatggcaccttcgcctggcccaccactcccagagggccgccttcaacaacaacgtgagcgtggcctacgagtgcctgagcgccggcgggcgcaggaagaggccggggctggacgggcgcacctacagcgagctgctcaggcgcatctgccgggacggccaagcccccgaggaggtggtggcgccgctgctgcgcaaggtgcagtgccgtgaccacgaggcggtgccgctgagcgtcttccgcgcgggcacactcacctgcttcgtgctgctggagttcgtggcgcgcgccggcgcgctcttccagctgctggaggactcggccgccgccgtggccgaccgccgcgtgggccaggccgtgctggacaccctggagggcgcgctgcaggccagcgacgccgccgcgcccgcgcgcttcctggaggccggctcgcgcttggggcccgacagcctggcgctggcgctggaccgcgccgtcggggggcggcggcccagcgcgcccatgacccgcgaggagtttctggagagggccgccgcgctcttcatcgcgaaggtcaagccggtgggctgaggcccgtgggccgcgcggatccgggatctgcgctggggggtccccgcgtgcggggcgcgcggagccttcccttcgccctggtgaggccctgccataaccaggcgcccagccctgcggaggaggccggggctcccaggaagcggacgcccggtccccacacagcgccgcggccgcccctccacccccgcgggagcccctgccccacgctaataaaatgtgttgcgaggctgacgctggtgtgtatgcgagcgcccgcctcccagccccggtgcccgcagaagacgcttttccccagcaggtcacccacggccccggaaccgcggcgactggaggctggattcgaggccggaaacgccgggacccctggacccggcctggtgggagcagcggagggggacgccccacggggccctgcggagcctgaagccggagagcaggcggctcttctggaacgcagggcccgggccctccagccccgcccggcccaggtatcctccctgagcctcagtctccccagatgtcaaatgaagaggccagctgggcagatggtagtgacattggtgagacaacagccctaacacttcccaggaactgaagtgcctcatgtgattgattcccaggcccaggcagcggaggttacaccctcagcaagggctcagctgggatctgcgcccg

SEQ ID NO: 133634 - DNA, 729 bp, Homo sapiens
  misc_feature (672)..(672): n is a, c, g, or t
  misc_feature (708)..(708): n is a, c, g, or t
ggagagccaatcaatatacacaaagagggaggagaagagagagtgccaataaggacacaaggaaagtggtagcgtacccttgtcacttcccaaagtctcccagcgggataccggtgccctctgcccttaatcaagatggccgccttgggggggctctagcgcacagtggaatatggcggtgcttccggtcccgctgccctcagcgaagatggcggcagtggagaagcggcggcaagcggtaccaccgccggccggtttcacggacagcggccgccagtcggtatcccgggcggcgggggcggccgagagcgaggaggacttcctgcggcaggtcggcgtgacggaaatgctacgtgcggccctgctgaaggtgctggaggcgcggcccgaggagccgatcgccttcctggctcactacttcgagaacatgggcctgcgctcgcctgtaaacggcggcgccggggagcccccgggccagctcctgctgcagcagcagcgcctgggccgcgcgctatggcaccttcgcctggcccaccactcccagagggccgccttcaacaacaacgtgagcgtggcctacgagtgcctgagcgccggcgggcgcaggaagaggccggggctggacgggcttttttttttttttttttttttttttttttttttttttttttntttttttttttttttttttttttttttttttttttntttttttttttttttcttttt

SEQ ID NO: 133635 - DNA, 1875 bp, Homo sapiens
ggagagccaatcaatatacacaaagagggaggagaagagagagtgccaataaggacacaaggaaagtggtagcgtacccttgtcacttcccaaagtctcccagcgggataccggtgccctctgcccttaatcaagatggccgccttgggggggctctagcgcacagtggaatatggcggtgcttccggtcccgctgccctcagcgaagatggcggcagtggagaagcggcggcaagcggtaccaccgccggccggtttcacggacagcggccgccagtcggtatcccgggcggcgggggcggccgagagcgaggaggacttcctgcggcaggtcggcgtgacggaaatgctacgtgcggccctgctgaaggtgctggaggcgcggcccgaggagccgatcgccttcctggctcactacttcgagaacatgggcctgcgctcgcctgtaaacggcggcgccggggagcccccgggccagctcctgctgcagcagcagcgcctgggccgcgcgctatggcaccttcgcctggcccaccactcccagagatgccccagacagatgcctgccgttgattcaagacatttactgagcacctactgtgggcagggcagtgttctgggcaccagggctataaccaagacgaacttccggccctggagggcagggccgccttcaacaacaacgtgagcgtggcctacgagtgcctgagcgccggcgggcgcaggaagaggccggggctggacgggcgcacctacagcgagctgctcaggcgcatctgccgggacggccaagcccccgaggaggtggtggcgccgctgctgcgcaaggtgcagtgccgtgaccacgaggcggtgccgctgagcgtcttccgcgcgggcacactcacctgcttcgtgctgctggagttcgtggcgcgcgccggcgcgctcttccagctgctggaggactcggccgccgccgtggccgaccgccgcgtgggccaggccgtgctggacaccctggagggcgcgctgcaggccagcgacgccgccgcgcccgcgcgcttcctggaggccggctcgcgcttggggcccgacagcctggcgctggcgctggaccgcgccgtcggggggcggcggcccagcgcgcccatgacccgcgaggagtttctggagagggccgccgcgctcttcatcgcgaaggtcaagccggtgggctgaggcccgtgggccgcgcggatccgggatctgcgctggggggtccccgcgtgcggggcgcgcggagccttcccttcgccctggtgaggccctgccataaccaggcgcccagccctgcggaggaggccggggctcccaggaagcggacgcccggtccccacacagcgccgcggccgcccctccacccccgcgggagcccctgccccacgctaataaaatgtgttgcgaggctgacgctggtgtgtatgcgagcgcccgcctcccagccccggtgcccgcagaagacgcttttccccagcaggtcacccacggccccggaaccgcggcgactggaggctggattcgaggccggaaacgccgggacccctggacccggcctggtgggagcagcggagggggacgccccacggggccctgcggagcctgaagccggagagcaggcggctcttctggaacgcagggcccgggccctccagccccgcccggcccaggtatcctccctgagcctcagtctccccagatgtcaaatgaagaggccagctgggcagatggtagtgacattggtgagacaacagccctaacacttcccaggaactgaagtgcctcatgtgattgattcccaggcccaggcagcggaggttacaccctcagcaagggctcagctgggatctgcgcccg

SEQ ID NO: 133636 - DNA, 454 bp, Homo sapiens
catgcaatcttgtcataccagtgtgtaactctataggaaaggcaagtaatggttacattttatcagaataaactcatgacaagaacatttgaattctttatatggtgaagttcttcaaaggctcttttataattgagttttgctataggaattgttaagaaacaaggtttttgttttttgtgtgctgcattttttggcactcatctaactttatttctttattttttcattgatacgtaatattttgtacatgtttatgagggtacttgtgatattttttacatgcatagaatgtgtaatgatcaagtcagagtatttgggggttatcccatcaccttgagcatttatcatttcttctggctattttgtttttgtttttggttttttgtttgtttgtttgtttgtttgagacagggcctctctcttgcccaggctggaatgcagcgatgcatag

SEQ ID NO: 133637 - DNA, 341 bp, Homo sapiens
atttcctctaggtgtgatgttcggttgttaacttaagatctttctaactttttgatgtaggcattcagctctataaacttccctcttaatattgctttagctgtgtcccagagattctggtatgtagtatctttgttctaattagtttcaaataatttctgaatttctaccttaatttcattgtttacccaaaagtcattcagaagcaggttaatttccattaatttctatttttattgcactgtagtctgagagtgtggttggtatgatttttttttatttgctaaggattgttttatggctgattagtcaattttagattatgggccatgtgcagatga

SEQ ID NO: 133638 - DNA, 1346 bp, Homo sapiens
acatagaaaaggcgtagcaaaaatacagtattgtggaaccactgccatatacgtggtccatccttgactgaacatcatgcggcatgtggctgtatgtatacacatagtttttgctgtgagtttgcatccatctcataggaagacatatatcaaaataaggaccagactggagagtgtgtaaattacttttcaatactaatggcttattaatttgatattgtcagcaagtatgttgcaaaaacaaattccaccagaatgtgagttccatgagagcaggaactgggttgttcaccttgttggcacttggagtagagccactgagcttcgtgctgcataaaattgcttggaagaaagaagggagggcattccaggtaactgaagcattgctatgcaaagtaagcatttgccctctgaaatattttaacaatgtttatagaaacctttctcaattgtattaaactttgtaaattgtaaaaattattctgttataccttttctatttactaggcacaggcagccataggtgctaggtatgttttgaaaacatattgaacctacagtgtacatatcattccatgccattaaatattcttatttaatcatagatgtgttcaggtgtgtttggtttcctatttgtggatgtactagattgttttctttttttaacaaaacctgtgaacttgctttaagtattatcatttggtgacatgcccgccatttcagaaataaatgtttgagcaaagaggaaagccaccgggtctgattcagctctctggaggctccagagcttacctcgctgatgggaaaaagagcatcgatttaattgcccttggtaccgacttctagtatctagtattttgccagactcaggtatttcttaaagccattattcagagtcttcagcaaggacattgtattttacttgtgtctccttagttttacctagtttatttcatggttttaaagtattgtacatttttataatcctttaacaagacaaaaggttgagatgttggacatttaaatgccaaaggtgttttattatgagacttagcatttcatatttggggatggtaccttatcgaaaatcagataaactttggttggatgggtatttggaggaatcttttaagtcttttcttaagcaaagtttggacactctaaaataaggttgccaactggcatgtagagagaaaaggatgtgtcatacatttagaccaggtggcctgtcctgtaaatttttttgaggggaggggtgggcttgtttttttctgtgtttcggttttttccaatttttgttttgtgataaaatatgcataataaaacttattttatcaatttttaat

SEQ ID NO: 133639 - DNA, 541 bp, Homo sapiens
atatatggttagggcttgggaggggcccatgcaaggggtggctccaaaggggaagcacccctagctccacagtacatctgcctttgcctctgcccataagatatctctgcttcttgccaaactgggtattggagttcatttagacagaagagttttccttttcattcccaaacacgaggccctcggaagttaccagtcaacagctatttaactgatactttattctggttatgtccttgcaaccataaccatctctattctgggactgaaaacattagagacagtgtaacatgtcatgtgatcagattcggcatgttctctaaaatctcaacagtgctaaattgcctccccatgttacgaaagttgcccaaggaaatgaaatcccaggatggatgctcgccataaaaataaccccctcgtttctctgtccccttccctgatagtcacggaaaagccaaggattaatagactcctttaatttaactcagttttgtctctgatgagggtctagtgaaagcaactgcccaatctgtcgcttgaa

SEQ ID NO: 133640 - DNA, 546 bp, Homo sapiens
gccgtgggctgaaccaaagagcaggctctgatgtcagcgacaaaggctctcaaataacaatcttttcagaagatcaacagggagagagaccaggccccggatgataaagctactggtgcagccactgaaccacagggctttctcttccttcactctgcctctttctgattgggaacacacaacagttgttttaaagctttccctggagggtgagtgataagaaacctattacctggaagtatcgcctttctaaagtaggagaacaaaaggccacactttccccagatggtgagtctcttggggcttcagggtttggaaaaggctcttgcttggacatcctgatccgtcttccattatgacactggcccgacgtttaagctctgactcgggatacagttcctgccccatcctctccatttgtgcttttccttgtgttgtggttgctgggcaatatgacaaaattatgtttggattcctgcgtgggaggaaaactttaatactgctttgatctgcaaatcaaaggacaaagtcactttcacaggattt

SEQ ID NO: 133641 - DNA, 404 bp, Homo sapiens
tttaaatataatctattttaacaatacccagaggtatatgtccagcagatccttctctcctgaattccagattcataaacccaactgtttactcaacatccctaagtcttttttttttttttttttttgagacagagagtctcactctatgacccaggctggagtgcagtggcgcaatcttggctcattgcaacctccacctcccaggttcaagcaattttcctgcctcagcctcccaagtagctggaaatacaggaatgtgccaccacgcacaactaattttttgtatttttaatagacatgcggtttcaccatgttagccagggtgatgggtaccgcactcaaattcgggatcacggacgtaacagcatgctgtctgaaagtgatctccaggcccagaaccg

SEQ ID NO: 133642 - DNA, 408 bp, Homo sapiens
tctctgatcatttgaatgtgtacgttttaccctcggaatctttgtcatctttcttttccttatattgagatgctcaaatttccttttcataatgatgtgccatggtgtgttctgtctattcatttattccttcactcactcactcacaagtagacaactgatgaaccctttcaatctaaagactaacagtcttctgggaaattttcttatagcatttctctgataatttcccattgctcctttttcctttttcccacattctggaactccagtgattcagatgttgaatctcctagaacggcttctaattttaaaaatattttattctctattatctagcttcttgtctttttattctactgcctgagacatttgacatattctttggatccttccagtgagtatact

SEQ ID NO: 133643 - DNA, 495 bp, Homo sapiens
tcagtgtaatttctcatggctgattttgacaggagatgtcaggttagtcttagttatcctggagcctaactggatcttgggaataaatctcttattttggtagcactttcaaataagtggcagcagttcatgcataattacttctgaattatctaggggatttatcaggtttgattatagatgcataatgaatttaccaaatttgtgggtattatggagatattaattccatatgaaacctcacaattcattcatgtgccatttgttttcattccttttttataataagctaattagtttaaattatttgtacttgtacaaggtcttgaaacacatattaggaatgattatacagagaacccaataaatgagaagttttggagacagcattaattgtgatgaagggttcataaagcagtggatgttcaattttcccatttggggtggtaataacaggtctaatcatgacacctccataaagtcatgggaagtccc

SEQ ID NO: 133644 - DNA, 387 bp, Homo sapiens
gcttgaattcgaattcaatttactgcttccaggctccaaatgcgcctttcaataaagtagttcctcattatccttgggagatacattgcaagacccctagtagataattgaaaccacagatagaactaaacccactatacactatgttttttcctatatatatatatgataaagtttataagttagccacagagattaataataaaatacagcaattataacaatatactgtaataagatgaatgtgaactctcaatacatcttattgtactgtactaacccttcttgtgattatatgagataaaatgcctaaatgaagtgaatgacataagcatgatgacataaatgaataattccagaaataaacaattcatgttttaaattgca

SEQ ID NO: 133645 - DNA, 384 bp, Homo sapiens
tctgggaggggtggtgaggctgtgctgggcccaggcctgcccatgccaagctgttagaaggcagggacatgtgtcctccatgcctcctctcctgcttttagctcctttctcttgctttcccatgccagctcctctgactttacttgggatcctccgagacagcccatttagggcatgtgaatccgtaaaggccacctgcgttcagatgtctaattccagctgtctggaattagatttggactggcctgcgtttgaatccaagccccactgtcactagctgcgtggttggtcttcagcaagtcacttctctctgggcctcaggggcaggagtcttgttttgcctgtgttacagttttatgtaattcaggcatcaaaatgtacctg

SEQ ID NO: 133646 - DNA, 893 bp, Homo sapiens
aactttaaaaaatagaaagtaaaaattgacagacatatgaagagaaattgtcaatgattaatcacagtgccagtgacagactttggcatatttctttcagaaagcaatagatcaaataaacaaataggatatacattattttcaaacacttttggaacatttaccaagaatgatcagatattaaggccacaaagaaaatttcaacaaaatccatcaagtagagtacacataggccacattcaccaactacaatgcaatataattagaaattaacagcagaaaaaaaaaatctacacatctggaaattaaaagatacttttctaagatattttttgggttaaagaactcaaaatgggaatctcaagctatttagaaatgaacaatgacaagatatgtcagttatgaagcttttgtctattggccccaaaccccatcctctgctttgtgatgctggggataaaactctgtaaaactttctgctgggcagcagctccctgctcagctctgccagcagggggcacgagagggaggctgcagggatggagaaggaagacacttgcttcttcctatttgctttcatcaccccagcaacggtccctcaccctggcagtaacagttggttctagcatctttttttccccctcagagcccacctccctgtgcagcttcagagcagaagcaccaaatggatagcatcttttcctcaaaatctgagccccagccctgcagggcctctcctccatcatctgctgggtagtatgccttccttacagttggagtcccatttctaccagggtttgtctctcctgcttcttggttctgataccctaacctctctttgttctcctagacccagtgggtacaagctgcttcctacagttatcacattacct

SEQ ID NO: 133647 - DNA, 469 bp, Homo sapiens
aaaaaaaacacttatttcatgccctgccaaattcaagttacactagacttccattttcttaagataatcaatcatgaagaaatcctttatcaatcattcaaaagtaattttaagtgtaacataactgtgtttacttcccatgcacttaatacccttatgcgctaattttgtgaattaagtttactgattatagaagtatgtgctgcatagaagtctgtgcttagagggtgaagttcctaagcttaccttgaattacagctacatttcagtgttaaatgtgcatattaagaataattcttttggggaaagaaattatgaatcttcaggacagtctacaatggtttagagttacattctgcctagacttttatgacttgctgctattgttttaaaaaccccacttagtctctctcttcctttctgatttctaaagtaagcctcagaatttccaaaccaattcatccacagc

SEQ ID NO: 133648 - DNA, 526 bp, Homo sapiens
catttttcaattgggttgtttagtgttttgttgttgagttgtaggaattcttatatattttagctattaaccccttatcagatatatggtttgcaaatattttctcccatcccattggcagccttttcactctattgattctgtcctttgatacacagaatttttcaattttgatgtagttcaatctgttttttcttttgttgtctgtgcttttggtgtcatattctgaacatacttatatgtgatcgtaatacaataaatgctatttgtagtgtgccatgattaatacttttttcctgcatgcctttgtgttttccctggaattaataattgttaccttttgctttattgctttatttctttcttagctttctatgtatttatctctctttcctccctaaactctccctcatttgtgtaaatctcctcttactacaatcacccacattcaatacagtaatccccacttatccgaagtttcactttccgcagattaatttacccgaggtcaaccacggtccaaaga

SEQ ID NO: 133649 - DNA, 911 bp, Homo sapiens
gagaagagccagatagtgttccagctggaaaggagtattagcaagacagagtcacagcttttgtaacctaattgcagaagtgacatctcatccctttttcagtattctgtttattagaagcaagtcacttggtccaccccacactcaaggggaaggggctacacaagggtacaaatagcaggagttcatgaatcattggatggccatcttacaaatccacctatcacctacctactgaaagccttcagtaagctttaagagcatacaggagccctgacacccaaaaattagagaactgctgatctaaatgtatgttacattggtggaacatgtatgggagatataataccttccttaaaaagttcttctctaggataagatcttgggccttggaagcctgtatatggggagtgcaggtaaaatcaggaaagcctcccctttttgtcaacttcagtttctggagagagggatcttaatactacatagctgtcttctaacatcttttaggaagtaacacaactatgacaggaacagtagtgaatgttagaaaaaataaaaggtctgagagaggagaataggagcatattcttgcaaagcagaaataaaactttttaaaaaaatccgtgcccttcagtgaaacttttttttaaaggatctttgtatgttaccttatgggaaactctagaaatcaactctaaaaatgaaattttgagtaacaatttttagaatggttgttaaaatggctaaaagctattatgtgactcaaatttctttttttttttttgtttgagacagggtctcattctgtcacccagctggaatgcaagtggcatgatcgtggctcagtgcagcctttacctccttgggctcaagtgatcctcccaactcaacctcccgagtagctgggacca

SEQ ID NO: 133650 - DNA, 721 bp, Homo sapiens
aggttaatgtcacttttccatatctaccaattcacttaagtagctttaacccaaataaaacaaagggtcttgactcttgattctgatcagaaaatgtcatccttttgtccatttactttaaataagtagttatttgtggtacaacttgcatatttctgattgtttctgtagttacctttgatttttttcatataattgcaaggctgatgatactttgaaaatttttggacttccttacctttgacagagaagagaatagttttgtatctttaaatgcatggacatttaactatttgaaataagttctatttagtattcagagccctattcagacaaaactagggactgtagctgaggcttatgggaagctttcaatttcctaagttatattgctacagccactgtactgagaaagaactacagtactgtctaactatggcatttggtcagatcaaggtgagttatatagaaaggaaaagggaatcaataaaatataggattaataattttttagattttgtaacagatacgatttgtcaacaaagttggaggattaaagacaacaattcctggggctgtttgattttaagtaatccaatctggatagattataataaattcacgttttttgaaatatatagtttactagtgagactatttcagtgttaagaccaatgagtttccgtctgtgtggctataatgggggtttctgacctttttt

SEQ ID NO: 133651 - DNA, 755 bp, Homo sapiens
gtaggaaaaaaaataacttaggcaaacgtaaatgataatgttaaataaaagaatacaaaaaagctctccttccaacctgcacctgcattttaggtggactttagaagactgtggtgtttctgtaactgttaataagcattcataagaccccagaacagagcttcacagccaagcagaaatacatgatgcgtaactctaatgcttttgacagaattggagcaaaagaaataaataatttcactcattcttaatttgtacacagaccatctagaaagctcctagttttgcttttagtagcatctgtacactcggttttttcagacaagacgtcagctagggtaaaataaaatgtattcctacatgagcaattttatttgagaatctgcagaaacaggaatgatctctatggcatttttaaattgtaacattaagtgctaatgtgtatgacttccagacatctgaagccataaacttctttgcaagttacatgccgacacttcatttgggcagtaaatcagctgtcacagtgacttactgcaatgacagcaaaagctccagcactccagacagtgggatttttatgctgccagcagaaaggtcttttcatagacactcttacaagaaatcaaaattctattctattagtatccagcattcggccaatttttgaccttaaaaattggtaatgtcatatgattcaacctaatatttgatacatatgaacttttaaaaggttgttttggaataaaaacatg

SEQ ID NO: 133652 - DNA, 412 bp, Homo sapiens
aaaaaaaagagaaacctactctgaaaaagcacactaatgtggaacttcaaaacaataataagagaaatgtttactcataaaatctggtatgcaacattgatgtatcatttaaacaaacattgttaggccagccaggcgcagtggctcacatctgtaatctcagcactatgggaggccgaggcgggcagatcacctgaggtcaggagttcaaagaccagcctgaccaacatggtgaaaccccatctctactaaaaacagaaaaattagccgcgcatggtgacacatgcctgtaattgcagctacttgggaggctgaggcatgagaactgcttgaagccaggaggtggaggttgaggtgagccaagatcgcaccactgcactccagtctgggtgacagagagtgactctatctc

SEQ ID NO: 133653 - DNA, 179 bp, Homo sapiens
tgcagggattacagatgtgagccaccacacccggcagaagaatttttatactgtatttcggtagcagtagtgtggtagttacaacctcacagttcagaaatatgacctttttgatgtatttcctacaaagcagtttataaacattagtgccactttcattacatgtggataccataact

SEQ ID NO: 133654 - DNA, 328 bp, Homo sapiens
gaggtggggaaacagggagggatgggaagagaaagatagggagagtgagagaggcgaagagcgacagacagagatggggcctagaagggggagagacaaggactgagagatgagaggggaaatgagagggcgatgggaagcatgggaagcaggaagagcccagagaggaaggagggagggcagctctgactcagagagggcctgcgcagccccaggagggaaccccagaagtggggagtgcaactgagagggagcaatgacgtctcagactgagagatgagggggcacgagggagccctcgggcatcagtggcgggtgacaaagacag

SEQ ID NO: 133655 - DNA, 768 bp, Homo sapiens
gcgcaaattaattgctggtagttcttaacaaaggagcatttaggctcataaatacgtgtttttagtgaaaaataattttgggaagatttagaaaataatgaagagtatgtgtcctattatatacttattattaataaggaaagaaaaagttgaaacacccacagcattgaaacctgaaacctggtttatttcgttaggtaaacattagtacttaagctgtttagaagtaacagtatcgccaattttagtcaaggtgcatatatgtgtaggggttagaagaggcagagaaagagccaactatgtgtgttggacaatgtgtttttttggatttattttttccaaaatctttctgtaacagcccttcctagttttctgcctcctatttttagtgatgcttgtttggtgtaacagttttgggcaggcaaattgatttgatctttattgttgatatttcttaggaaactggagcattatcaaatattctgtttggggacagttgttcctaagagaagttgctctgtgcttaaagaatgagaattgggtttttcttagagatacagcagaaaggtactgtgttaggtgatactgcattccttcaacattatttcagggaatgtaggcatttacatcccagatagaccttcagaagggcaaaatctgtatttgggtgtttttacctattggacaattacccataccaattcatgattttaagcttttttttttaaatcttcgatttggtgacggtgattttaagcttttctacca

SEQ ID NO: 133656 - DNA, 836 bp, Homo sapiens
gggcctgataggaggagagaaacccaaccaaaatgtgatcacgttagatgggaattttgttcaggtcaaggaagacgaggaattcagtccatccctgaaggggcaaataaacgaacgaaaaacggacgacggaacgacacgaaccgaacggacacgacacggggaaccgaaccgaacggacggacggacgacaaccggacacgacaaccgaaacccgaacggacgacacgacacgacacagacaaagacgaaacgaacggacgaccgcgacggaaagaacgaacgacaaccggacacgacaacaacgaacaaccagcgacgaagacaagaaccgaaaggaccgacccagacacggacggacggacgacacggacgaaagacagacgacgggacacggaagcacacggacagaacgaacagctaacgaagaacgcgagacaagacggtgacgaaggacaggaccgacacggaacgaacggacacgacgggagaagaactaagaagacagcaaaaggaggggaggacgaacgaaacgaacctaacgcgagaagaagaaagcaacggacggacacgacacgacaacagcgaacacgacggaagaagaaaagccagaaggaggaaagcaacctaagaaagaagaacggaagaacagacagacacgagaccccacacgacaacacagacaccgacacggaaggagcgagaggcaacggagcacacgacagaagaaaaaacgaaagcgcaaaagcgacagcaagcggagcaccgacttaccgaacggaaaacaagcgagcgagaaacgacgaaaaaaggaaacaagaccgaaagaaaaacga

SEQ ID NO: 133657 - DNA, 585 bp, Homo sapiens
gaatactacctcattttcatcactttcctagaacctattagaaatatgttttcttctatgaccctaatagtaactcaggaatacttatatgttttgacataatctggaatttgtgtttagagattaaaatctaagataatccaattctgttatattattttagtgctgaattatgttttttaaaattgtagacaaagtcttcagtaatctctatgctgatgattaaagaaaacattgctattttcataggtcatagagaggataactgaggaattcattggcaagcttgtgggtgttgctttttacagtaatttattgtgaaatataggtgagtcattaccatattactgctacaaaactgcaataacctcaaaaaatttttataaaacatttcaaattggggtagaaaaagaacttctgaagaagaaaagagacatataaatcaaacgtgtccacgtgtagtactatgtggtggcggggggatcctgatatatctttaatccctcttggaatgtattgagtgtatagaatgtagaatatctttgttttagtctgtgtattcttaacataccactaccacctgac

SEQ ID NO: 133658 - DNA, 470 bp, Homo sapiens
agtgtggcacccatgcacactgagcccacaccaagactattctggaactgctgctgggattcatgaggcacgaggagctaaattcactgaggacgctactggcggctttcctcctcagcatctgtccccttcccccttccttcctgacatcagtgaattccataccagggaggccagttccccagccggcttctggaagaggcatgtccagcacccaggctgagccactcggtgcgctctgcaccccggtcacagtgactggttcagagttcaatacgtggctggagccagaccgaaggagagtgaatccaagacttgctaagacaaagatgctgtccttcctgatgggtgtgaaccagccagtgtatataaccctgggagcagcgggcagggcctgtgtatcccatgaagctgactctccccaggtagggcaaagaaacaagccccagatgacactgtggaggagctgg

SEQ ID NO: 133659 - DNA, 335 bp, Homo sapiens
ggagtttaagaccagcttgggcagcattgtgagactctttatctctacacaaaataaaaaagctagctgtgcatggtggtgcatgcctgtagtaccagttattcaggaggctgaggtaggaggatcgcttaagcaaaggaggtagaggctgcagtgaactgtgatcgcaccaccgcactctagcctgggcaatagagggagatcttgtcataaacggagcatcttcttggctcttaaagactgccaggttggaggaaatgtccttttgaaaattacgactaacctggctgggtgcggtggctcatgcctgtaatcctggtactttgggaggccaa

SEQ ID NO: 133660 - DNA, 377 bp, Homo sapiens
tacataataaataagaagaaatcacaaaggaagcagatattatattgtttttaatataacatgaaattgtttgactttattttgatgacctcacaaaagtataaacatggcagtggtgtgtatgatcaaagtaagaaattaaagagttaccggttctttataaaccagaagtccattgacttttaataatgctgtctcaaatatttgatagtaaattgtggaaataatcaaagctgagcctatgggactgtactttgtagtactgtttaatttaataactctaataatcccttaagaatattaggaaaaataggccgggtgcagtgactcacgcctgtaatcccagcactttgggaggccgaggagggcggatcacc

SEQ ID NO: 133661 - DNA, 157 bp, Homo sapiens
tacccagcttctttctggggtggagggcttcttgattaaagtcggatcattttaggactttaggaatcttctggaaaaattggccttcccatgaccatctgggtgattttatgtggatactgctctggcttttttctgtgcgaagaggagaggggtg

SEQ ID NO: 133662 - DNA, 727 bp, Homo sapiens
gggtggtggtgtttaggattggctagagatggctgttgcttggtacccagtaggtgctctatgttagtaactcttaaatgtcgtggaagtccaaaagagaaccagagttgagacagatactgctggagaaatttaaaggaagatatagatattttatgaaaaatgaaccaaaaaatatttctgaagaatgaatgatggctccaagaatgatgtttgaaatgtgctctctatatgtagaaatgaaattgtataagggcgtcaaacttttctgtactgtttttcatttgagttgcttatgagatatcgaggtaaaataattggcaatatatcattgctatggttatttatcaagacatcaaactttctgactaagcatgtgtaatatttatatttatgttaaatgctttaatacaactagtagattttaaccatctagtttttttctttgaagatagcattctgtttgtctgaaattagaatccatttcagtttcatggaggagcaaaggtgaggcactcatctgtctctatgtcctttttgcctgacacagtgttagcccaatgcttggcaccagtaggtgttctatgtataagtgtttttcagtaaatgaattaataatatatcagtttttctctaaatgaattaataacatctcagttttaaaaacttcacagattagatggattgatttcatgaaacatttcctttgtgtttaagattcttgcca

SEQ ID NO: 133663 - DNA, 276 bp, Homo sapiens
tatgggcaagccaggctctttcccgctgccaggacgttgtgtgtgctgttcctgttacctgggccgctctttcctgcttactttgccaagctagttacctcctatccttcaggaatctgctgaagcatcatgtccttagaggtctggttacttcctgctctgctccagttgttctctactctgtgctcggaaatatcgttcctcttcagcctgctctctctttccgaaggccccaccggcttcccggatggagcccgcgccccagtcgacattctc

SEQ ID NO: 133664 - DNA, 832 bp, Homo sapiens
ggatagaaagatagaaagaaaaggagaaggaaagtgatgatatgaacaacagagaatggaggaccaacagataggtattcttacttaagaaagatcaagtacaaataaaataaaagtgatagtcaagagtataagagggaaaaaaatcacaaattctctcaactgaagaaaaataatagaaaagttcaattaaactaagggtaggttttttgaaaaggaacaaaattgacaaaccttcagctagactaagaaaagactcaagtaaataaaattataagtgaaagaggagacattgcaactgataccacagaaatacaaaagattataagagactgctatgagcaattttgtgccaataaattaaataacctaaaagaaagagatgaattcctagaaacatataacctaccaagagtgaaccatgaagaggtagaaaacctgaacagacaaataaccggtaaggagattgaatcagtcattaaaaacttctgaacaagaaaagtctaggacctaagggcttcactggtgaattctagtaaacacttaaggaagaattaacaccagtccttctcaaacttttgcaaaaaatggaagagaagggaacacttccaaactcatcttatgaagtcaacattaccctgataccaaagccagacaaggaaattgcaagaaaaaaattacaagctaatatgcctggtgaacacagatgcaaaaatccctcagtaaaatacaaatagtctaaattgaacagcacattgaaaggatcacatcctgatcaagtgggatttatccttggcatgcaaggatggttcaacacatgtaaatcaataaa

SEQ ID NO: 133665 - DNA, 357 bp, Homo sapiens
agaaaacttgccataaataaataaatttaaccgtttataacatagatgttttggagctcctgcccacccagattttttttttaataaaacatctattaaaccagaattatagttgggaaatactgccgtatacataaatgttcttggaaaagcccagtagtttaattgctgctttgagccttccactaaagacacattatactcataataaaattctcctatttgcccatgataatgaataaaattcttgtttagacaaccacctttaggccgtcttttttgttctttttttcccccttcaacttttaaatttaggggtacatgtgcaggatgcataggtttgttacatattacggg

SEQ ID NO: 133666 - DNA, 788 bp, Homo sapiens
ctttctgaagcgcattctcgcccttggaatccccagcccagctttttgaggcaggcaggcggggccccacttgctcgccttcaggacttgggctctgtgaaggagaaatgcccgaagctacacagcggacctgtcagagccagcccacaactagggctttctggtacacagtaggtgctcagtaaatacattttgaataaatgcccgctttctccccatcatcctaggctcgcgttttcctacctaaacctgtgtcggggtaggaaagctgtagattccttgcactctgtacctgaacttgccatgatggggcaagtgcgttcctttgctcaaggaagatacagtactaagacactgtagagacgtggctctcatgatttgggtcatttgtgaagtccccaggctagactacagcctttttcttggctgattaaatatttattgtatggctttgctttaaagggaactttccaaaatcgtatctatttaaaactttgtcttgtcagtacacaagtccgccatcaaaagaaaaaatgtgcacagttccaccatgaggtgacatagttaatgtaattcttaccccaccaagcctctcggttgctagttgtttactcagttgttcattcattcattctctcattcggcgtatatttgttgagcacttgctatgttccaaatgcaggagtaaccatgctgagcaaaaccagctaatggcactgttttcattgagcctgggacttaatggttcaactagatagtagatagccttactaaataatgcataaaat

SEQ ID NO: 133667 - DNA, 347 bp, Homo sapiens
tgaggcacacggagtgtcaggactgtgccatgtggtacaaccctcttcccagtcaagatgcaggaccaagatcagcaggagaccatcccctggtccaatggtgacaccagtaagagcagttaacagttatgtgccaggtattatgctaagcactacattaatgtatttaatcttggcggggtgtggtggctcacacctgtaatcccagcactttgggaggccagggcgggcagatcacttgaggtcaggagttcaagaccagcctagccaacacagtgaaaccccgtgtctactaaaaatacaaaaatagccgagtgtggtggcgcatgcctatcatgccagctatt

SEQ ID NO: 133668 - DNA, 393 bp, Homo sapiens
ttatagatctctgccttcatcttcacatggtgttctccctatgtatgtgtctctgtgtccaaattttccctttttataaggacatcattcatattggaattggggcccacctaaatgacctcatcttaactaattacatctgcaatgacattatttctgaatacgatcacattctgtggtactggaggttaagagtgtaacatatgaatttttgagggacacagttcaacctgtaacaggtggaaagccgtcaatgggttttgagcagaggaatgatgcaatccaacttaggtttataaaggatcactgttttgtggagaatagaatgaaaggaggaagcagagtcattgtaaaaagccaggcgagacaatggtgattgctgggccagggtgc

SEQ ID NO: 133669 - DNA, 330 bp, Homo sapiens
ggactgaactctgtccttctgtgggtcagctacttggctttcttccagcccctcttccaaagcctcacacatccgggagctgaattgtggctctctggttgtcctttccagaacacttccacctgcacccgggaacgctgctgcgcctgagaggctggaggctctgaaataccaacggataaagaagcccaaaaagtcatccaagggctcttcgaagtcaaagaaacgatccgacgattctgcctcccagactcagcagcttcccaactctcaggttctgtggcccgatgaagctgtctgcctccgaaagaagaagagacattctcgtcc

SEQ ID NO: 133670 - DNA, 988 bp, Homo sapiens
ttctgtcctgatacaaggaaagaggcagagcaggagccggcaatgttaaggacaactttttataactgcccagtatttcctgacccctgtcaaaggttggggagaatacaaggtttcttgaagctttttgactggggtgtcacattaggcacacaggtgtctataatggaatctccccttcagtttggtcatagaagtgcttggacaagtcagaaaaatagctagctgtgggtatccctttaagatattcccaagtctaccctgtgtcatagcagtagttctcagagtgtttgtttaaaggatcccactttgaactttgccaagtactaccaactaccttgtctggtgttcagcaactgcccctactgaacagccctttggaactctgaatgatttgggcctcacagaagctccctaaagcctaggaacttggtgactatcatttgaacaactaggcagccatactgcagtcagttgtcatggggtcattccctaggcccccttcctatcagcctctacctaaagaagctagataggaagctaagcacagccatggttgggaggctatatctaaagctcatgaggggtgatcccggggttaccagccttcagcactccctctagcaacaccccattctcttacctagcggggatttgtacctttccactgaggcctctccatgctccttccctacctttcatggcaatactttggcctgcctcttatcctggtactaagttgaagtaaagctcaccctttacttccctacttgaaagttctactctgagccttgactcttagccacagtgaggcatgttgaaggttcctgctggtttattctttttttttttttttttttttagacagagtctcactctgttgcccaggctggagtgcagtggcacgatctcggttcactgcaagctccgcctcccgggttcatgccattctcctgcctcagcctcccaagtagctgggactacaggc

SEQ ID NO: 133671 - DNA, 375 bp, Homo sapiens
tgaaaaatgacctaacatgtactatgcttattacctgggtgacgaaataatctgtgcaccaagctcccacaacatgcaatttacctgtataacaaacttgcatgtgtacccctgaacctaaagtaaaagttaagaaaaagaaatgggctctggagccagaactgggtgcctacctcggtgtctcacatgcccatacctgatgtctagggcaaggtttgtaactctttgtgcctcagtttcctcatctgtaacactgaaatgatgatagcacctaccttgtcaggttattgtagtgattaagtaacttaatacttaggaaattcttggaacaatgtctggcacacagcaagtgcccaataaatgcaggtgatggtg

SEQ ID NO: 133672 - DNA, 255 bp, Homo sapiens
ccatgccactgctccccacctatactcctgcataccctgcccatagttcctccctgccctcctgttcttgagaccaagcaatccccttctaagacaatctgcattcatgattctgttaatttccaaagcttccaggtatcaagctcttactctatgccagatgcagaaacctaattgaattatctcatttacctgcacaatcctgtgactaagtactatgacccccatatgcttatatgaagaaacagaggcctg

SEQ ID NO: 133673 - DNA, 611 bp, Homo sapiens
cccaaagtgctgggattacaggcatgagccaccgcgcccggcctagaaatttcaatagaatagagcagatcaacaaaacaaaaaactccactataacaacaaccataaaaagaacaaggggaggtacaatatgcagtattaggaataaaaatataaatgtgttccaactaaaggaagagaacatgcatttttaaaaacaagaagccactgtgaagaacttttgcctgtaaatttaaaacttggatgataaagacagtttcctaggaaaacatagtttaacaaaaattacttaggaataaatagatttgaatggactcataaataaaataattgggccaatagactaaaaatctctcccatcacttctaaagaaaatgctgagaggaatgttctattcagtaaatggcactaggactgttagttctccatgtggagaccagcctctgtaaaggtagctatggggttcatacacttctggtctaatcttcaagggaaacttgtctccaaaggccactcttctgtgatgaggaaatcatgcttctgtgattcactattccctcagcaaggtggtgagcagcatacctccctattatacatacctgctacaagca

SEQ ID NO: 133674 - DNA, 710 bp, Homo sapiens
aacatatgatacataggtaccaaattacctttttgaattaaaaaaaaataaactgaattccaaaatatatcttcttccagagatttctggataagtacttgtggatctctatgagcacatgatattatttctctaaagtgaaaatcataaatcatattttaggaatatcctagtttgttttacagtcatttgcaggtttctctctgtgtcagctagcctgatcttaggtcttcttttcatccaatctgcttagttaagcccatggacctaaactgatttatttctcatctgttcagcctgtgtcagtggaaggtgcactaggcttttctgatcagccaaggctaatcagagttggagtacagaccagaattcaacaaaggatacagtcataaattagggttaggtttgcaaatacttttataatgtggaaattagagtttaaggcataactaatgaagcaaacagaaaataacatgggaaaacaaagttatcaaagtcaggaaagacgaaaatcattgttcccgtctcataaggtaggactggagaggcaaatcaccagtgttaaatctttgtgcacattttaatttacttataataaatttctgaagttggaattgacctgtcaaaaggcacagacattttatagcttttgatatgcattaaccaaatttcccaacagagatttataccaatttacattctcccaggaa

SEQ ID NO: 133675 - DNA, 533 bp, Homo sapiens
aaataaagatttaaaaacatctttttgaggtactcaatattttttaaaactaaaaggaatcttgagatcagtttgagagctgttgatctgaaaatcattgataatccttttatgctcctttcccctgctctttgaatccagcttgctttaagttaggttcagattctttatttcaagatcatagctggaagtccctgctagtatagtccatgtgtgggagaatcattctctcactctccagaatgcttgattagaaggcaatgggaagtagagaaaaagaactgatgggataagaggagcagagaggggagcaaacggagaagattggcacagtaagcatactctccttcttaccctgattctctcctccacaatccagacacaatagggctagtatctgccatggcacagagcttccaggacccagacccagcactaaggcaacatttattttcacccattgatgctatctatgttctacttgctcttaaatattttaaatgttattctgacatgtggcatcattaggagga

SEQ ID NO: 133676 - DNA, 564 bp, Homo sapiens
tcaatagagatgggattttcctatgttgcccaggatggtctcccaacttctggcctcgagcaatcctccagccttggccttccaaagtgctgggattaaaggcaggagacactatgtccagccttggtttgctttttcaacaatattaattctacgtccccactttcaaacaggtataaagttcaggaaggcccatttatttcctttcttcctccctactctccccatctcacctctacatacgctcttgtgctccaactataccatcttgcaagcttcctaaacttcagaacctctctgatccccactcttaccacatctgttcttcaatactgtggggactttctccttactcgttggcaccagcctatccacgctttccttacttaggcagttagggtcaatgtggttcaatctctcacttccccaaaccctacatttatttcctctttgttcttttaccccatttgcccaagaaaacaccaatcctgttcttttttcaccccgtccccgcagctggtccactccacatcacctccctgcttaagaactattctctctttt

SEQ ID NO: 133677 - DNA, 232 bp, Homo sapiens
agctcctcaccgagtcttagaagacagagatagtcacaacactgttgcaaatattatcaccactaaaatcaacaccattagcactggaagtctctgggtgacaccttccttagcccagttagttagaaaactgctgctgtgtcagaggaatgtagttataaaagttccacattttggttagttgataaaggagacttcagtaatgtaaagggcctttctcagaagacggtag

SEQ ID NO: 133678 - DNA, 614 bp, Homo sapiens
actctattgccaatttaaatgccgctgtatactctgtgtatcatggctactttcccagtattttgaaaatttgcgcagggtaaggggattttacaagttctcaaaaacatgaaatattcctctacagtagccataccacatgatggctaagtgaaatgataggtatccatataaagaggtgcacctgtgtatgacctctgttcctgctgctggcattaaggtaatagttggattccatttgaaggctgagcctcttcctgggaatggttagggaaggctcaggcttattagcattaaatatcagcctagactgagacaacaatttctggcaactttgtgagaatatatgtatttgttgttgcagcccacttttttttggttaacgttttcaacaactgaagaagaacataactgctaccatttgctggcaccataatgagaacttatatacataatctcatttgaaccttacagtggttttgagggagtagatattactcttcccatctttacagcagcgagtcctttgccaaagttactacttgacctaggtattttctaccacagtgggctacctgccagttttaaaggtctggtttttctagaaaaaaaaa

SEQ ID NO: 133679 - DNA, 331 bp, Homo sapiens
gctgatgctgggcgggcaggcaaggaggctggtgctggcagggctgcgcttccccgtggcctggtgcagtcccagcaggacctgctgttgggggctcctggccgtggtcacggtgggcagggagccacatccctctgtccggcctggctctgcaccacggtttggcttcctctttgtgtgttcacctggcccagctgcccttcgccactgcagaaacagcacggagggaagggggcggcagattcagacttgaggtcagttggtcttttgggagctgggagcacagccagggattccctccggcagcaccggcatcttctctggtttcttt

SEQ ID NO: 133680 - DNA, 683 bp, Homo sapiens
ctttgagcctctgtaagatttctacctttaccacacagccctccgtgtgcatggatccttcttcagtgggtaacactttgagggcagtggctatttttttcctaaactttataatcttcctaggacctcacagaatatacctcttattcaaattatgcaattaatctgaacacatctggacaaatggactagatcagtctgaattcacggaaattctggagtctagggtaaatttttttaaatgcagttatattctttcctagggtatatatcctagataagctaactaaacattagcaagtggagccgtttcttgatttaattcaatgaatgggtaataagcgctttagtttagataaaagttacttaaaagtaaaatggatgactaaatgtaatggggtaatctagatgagatcttgaatgagaaaggacattcttagataaaaacaaagaaaatgtaagtaaagtacgaactttagcttataattatattatcagtattggttcattagttgtgacaaatgtatggaactaacgtaagatgttaacaataggataaaatgggtgcgggtaggagccctcagtacaatctttgcaacttttctataaatctaaaactatcctaaaacaaaaagggtaataaaatatgttcagatagagtatatgttttcaagtgaaaatgg

SEQ ID NO: 133681 - DNA, 234 bp, Homo sapiens
ggtgtaattgtgtctccaagtgtccagtacagtgctcaggagggtaaatatcaaaatgcaccacccaggcacgttcagagtgttgggatacagtcagtgcaaggaggcatatttcaatgatgactatagtgggttgaaaagcgtcctcccctaccaaagaaaatctgtatccacctggtacttgtgtatgggaccttgtttggaaaaagggtctttgcagatgtattaataatg

SEQ ID NO: 133682 - DNA, 101 bp, Homo sapiens
aagattccacagagctacttgttgcagtgtgcaaaggtgaactaatatgcaaaagaccatttttccaagggtagggaataccacttaaaatacctgtcaaa

SEQ ID NO: 133683 - DNA, 405 bp, Homo sapiens
gccagagcaacatagtgagacccccatctctacaaaaaaaaaaatgttttttaattacccgggcatggtggctcatgcctgtagacccagctagttgggatactgaggcaaaaggatggcttgtacccagagttcagggctgcagtgaattattatcactgcacttctgcctggatgacagacaaagaccctatctcaaaaaaaaaaacacaaaataatgaaatctatgattaaggattctgatgctataagcctttccttaaactgcaaatgtttcatgctaatttgaattgcattttaagaagtaatgattcttggggtaaagaccatagaatacggcacccagaaataaatccacatatttccagccaactgattttggacgaacatgccaagaacatacgc

SEQ ID NO: 133684 - DNA, 809 bp, Homo sapiens
  misc_feature (529)..(529): n is a, c, g, or t
ggtttccactgccaaaaatgttgtactacaaaggtgttaagattaagaatgatagggagaaaaaggggtggctactctaattatcctgtttgcatctgtagaaatttcttaacaagaattccacttcattaaaaatatgtgaaatatatgaaaggtagtgatcaaacacatgaaagtaaatataaaggttttgctgacatccaaactataaaaagtggccagttaaaatatttacttaactatattaaacaaaaaataattctcttatgacttgctataccttaaaaaagcttccattacagctttccaccttttctagcaatgtcctctgaaatgtcatatcaaaatacatttgattcacagggcaagggccagcccatcacttaggtgtatgaactgggcctgggatgagaaagacaatagggagtgctaaagcctgggacaaactggagatttgtccatttcaccatcaagcaatacaattcattgaaaaccccagtgctgcaggtttctgtttgtgcaaatatgnactaaagcatctctctgccatttttacttaattggaaaacaatttttccttacaatcatgcaactaaaataaaataccgaaattatgtggaactgctcgaatagaagacctgtacctgtcatctgtaacctttatgtgttaattttctgtgttacgggaaactttcattctatctaactttttatgtcacccaaccgggtttggtctctcatattggatccggggtagactggtttggccccgcgcggggcctgctggatccccccctggggccgggggc

SEQ ID NO: 133685 - DNA, 257 bp, Homo sapiens
gatccagatcccagactgaacagaaactctgctccccaaccccaggagtaaggcccctctgcacgtttttatcccacctccttggtacacagggccttgctgttccttgaacctgccaggtgagtgggggctttgcaggcatcgggcaggtttgtggcaacctggggtggcatcatgtgcccagctgctcccttcaggtctcaggctccagaactgcagatcctattgtctgcctgcacgcgtgtggggctggcctg

SEQ ID NO: 133686 - DNA, 743 bp, Homo sapiens
tgaactcagtttctttaaagtattaaacaggcaaatataaatagctaagaaaaccgaaatatattttagagcacattcataaaaattaccaatgaatgtccctacttttttcttttataatgtaatataatcatttcttagttttatgtgcagaaacttctcaatattaagcacagaatctacttagtaatatcttacatgtctatcttggagtaagaatttgtcagtgctaatgttgcagccccttggggcttcttaatattggaatttctccaggcttgattatagttgagggaagttcaaagggaatttttttattgtttagcttgtttttaggttgcagtaaattctctaggtcatccagcaggattaggaagagaagcattgtgagaaacaggttttgggttttgctgaaatttgcttgtcagcattgcatcacttttccttaactgttctctaagtactgatgtctttcaaattgactcagatcatactccttatctttgagcagaatattttgaacagaaaattaagccattttcatttatatacctaattcaataggtttataaataaaagggcaaatcctcacgataatacagtacagtaaaaattgctctccccctagaactgagaatagaaaaacaatttcctcttacattgtttatagtaggtagcccttaaaagaaaatcacttatccctgccacccccagtggtcctcataacaagttaggaaactgaa

SEQ ID NO: 133687 - DNA, 442 bp, Homo sapiens
tttctgtcttcttccgaaccctgcaaactgttcaacctctgcctgttacccagttccaaattcacttccacatttttagatatccttatagcaacgccccactacctcagtaccaatttactgtatcagtccattctcatgctgctaataaagacataaccaagcttgggtaatttataaaggaaagaggtttaattgactcacagttcatcatagctggggaggcctcaggaaactttcaagcatggtagaatgtgaaggggaagcaagtcaccttcttcacgaggtggcaggaaggagaagcgcaagcaaagggggaaaagctccttataaaaccatcagatcttgtgagaactcactcactatcatgagaagagcatgggggtaactgcctccatgattcaattacctctccctgggtccccatcatgatatgtgagga

SEQ ID NO: 133688 - DNA, 259 bp, Homo sapiens
gtgactagcaagatattgacagctttagattgggttaaggacaagttatgtttcatattgctgtgtttgaggtcccttcaggatattcttgtagctgtgttcattaaataagttggaaacatatgtctggaactagggagagcagccaggaatagagagagttatgggaatccttctcaaagagatgaagctctgggaatgggtgagattgccaagaaatagtatgtggagagaagaaagaagacaagggcagaatttt

SEQ ID NO: 133689 - DNA, 545 bp, Homo sapiens
tgcagtggctcacacctgtaatcccagcactttgggaggctgaggcgggcagaccacgaggtcaggagaccgagaccatcctggccaacctggtggaatcccatctccactaaaaatacaaaaattagctgggcatggtgtcacgcgcctgtagtccaagctactggggaggctgaggcaggagaattgcttgaacctgggaggtggaggttgcattgagccgagatcctgccactgcactccagcctgggcgacagagtgagactccgtctcaaaaaagaaaaaaaaaaaagttaatagctctgtgctatttcaaaaattcagtccactcatataaaattgttcaagttagtacattactgtagtacatacacctgggtaattctcaattaaatgccaggcaaggcacagcaaatgctttcatcatggcataatagcctgttgtggaatactagtgaatacctaacaaatgcttcaaatagtatcttagcgtaatacatgccgacgggcactgacctccttcccaggcggaatataattttttt

SEQ ID NO: 133690 - DNA, 336 bp, Homo sapiens
acggatatctggggaatccctcctggattcaccgcctcttcagttttacagcttcccacagcccttgtctgcatggatgcaaagtgggatgttgaaccctgggcccttcttatcactgagaaatatgttaatgaagataaacatgttaatgaagataacatgttaatgaagattaaccaggccatctgaaggggctggtgttttgaaaaaatagaatcaatttttgtttacctggactggaactaggggaggaatttagagaggatgttccaaggtcctcctcagctttctatagcttgagtaggagccagtgaatttagttgatggtctatagtc

SEQ ID NO: 133691 - DNA, 386 bp, Homo sapiens
tgctagagcaagtgaactcggttttccctggaggtagatatttgctagtgagctgttctttggccaaatcacaattgtgtttttgcactccacacccaacggcaaacatgtctcctattcccatttttccctcattatcacgcagcagcattcaagcattgagttattaaatcacagggttgacaaacaaaatggcaatttctagaaaagcataaagcataaaatgtttttattttaattacttcactgattcttgctaaaaattatcatgcccattgtaatattttgaaaaaatacaaaaaatgtattccaatccctccagatccattacccagaaacaggcaaagagcgtactttacttaacatccaatgtggcttcatcaaaa

SEQ ID NO: 133692 - DNA, 452 bp, Homo sapiens
ctagtaagcgtcgacagaaagccttacttcttcttacttccttttcacaggggaaacagacacacacaaacaataaaataaaataaaataaaaaacatagctttagatatttttcagaagagagagattgctttacagaagaggcgggacttgatcaagggtagagttaaagtacaacagagagacagtctgagacatgaggcccccagccttgcccatgtcaaggctagcaagcaccttggctgaaagcaagaggagtgagaagtcagggtcctgccctgtcccatcccaggttggattttccaaagaactggaaactgaggtcatatacatcaacttggttgacaaaggcccccagccattacaaaggaaggcaggtgcacttcttctcaagctgcccaccataacttcccatctgcctattgtaggggggaaaaaaaaaaaaagcacag

SEQ ID NO: 133693 - DNA, 501 bp, Homo sapiens
ccagtcggggtgttagggtgcgggatggaattgcttagggacctggcctacgtggccagttcccaagaactttgtcttttccaggtgagtgcagccccttccgctccagtaggttccagattaattttttatccccaagctctttcctgctccttcatgggtctcaggtctcctggaaatccaggaacagcaattagcccactgctatttagggcctttgtaaacattgaaggatgattcggagcttaggctttctctcccgtgtcaggaatcagtcagatgaagcctgctgcacgcgtccctgtctagatcttgattcaagtgattatatgcatttggatctccgtggatgcatctggtggcctgggctaggccagtgtaagttaaatctgctttcttgagccagtcctcagaaatgacttggtggcctagttgttggtagaggtaagtgagtgggagttttagccccgccttccagcctccagatcagactctatctca

SEQ ID NO: 133694 - DNA, 458 bp, Homo sapiens
ccagtcggggtgttagggtgcgggatggaattgcttagggacctggcctacgtggccagttcccaagaactttgtcttttccaggtgagtgcagccccttccgctccagtaggttccagattaattttttatccccaagctctttcctgctccttcatgggtctcaggtctcctggaaatccaggaacagcaattagcccactgctatttagggcctttgtaaacattgaaggatgattcggagcttaggctttctctcccgtgtcaggaatcagtcagatgaagcctgctgcacgcgtccctgtctagatcttgattcaagtgattatatgcatttggatctccgtggatgcatctggtggcctgggctaggccagtgtccactctggcctacatcctctgctcaggactgcaggtcggccatttgctggtccccagttcttccagttttctggggt

SEQ ID NO: 133695 - DNA, 770 bp, Homo sapiens
cttttagccagtagagggggcccacgagccctctctcaccagctagcacttttctcaccaccttcctcgaaatacttgggggcagcaagggtgttggcagatgagagtctcccactcaccatggtgagagtggtggggagtacccagggctgacctgactcacaagggaagcagtaactgtagaacctgccagcctccctggtccctgtgcccatatggcttcggctgatgagggctcagactctaggttgccctgaagatcaaggctttgtctcccattctgcccattcctgggtttcttcccaaaatgactactgtggggccagtcatggcacaagggccaggacctctagaggctggggtggggaaggactgagctagtgattcttagaggccttctggggcctaagagctgaaatctcagcgcccgggtttccctaaagtttgctgaagacagcagccccggccagcaggagaccgaccgggcaccaccccaaaccaggcaaacggtggccacaaccctcatccacccacctggtatgaggtcactgagtggggaaacagacaggagcgggtggccaccatactgacagacccggggctctcccttgcccaagcttcaggttcaaaggctgaaaataacagtggcttccagtttggaagtggccaaaggacaatcatgaccagagactcaggagtatgactgtaataccctcactaggtattgacatgcactaagcaccttgatataggatttcacttccttctga

SEQ ID NO: 133696 - DNA, 319 bp, Homo sapiens
cagcacagcctcagtgctctgtttgttgagaggcagtggctggctaaaaacgaacatgtcaagcctgacagattgcctaggtttgaattctggccacttactaggtatatgatgttgggcaagtttcataatctctctatgcctcagttccctcatctataaaatgggaataataatattacctacttgattgggctgtttgagaattaaatgaggtaatgtatgtgaaacaagtagaatagtgcctgtcattgtaaatgcttattaaatgttaatcattgccattattatcattatttttatttagttgctgggttca

SEQ ID NO: 133697 - DNA, 486 bp, Homo sapiens
gggaaaaaaagaaaggaaggaagttctgtcttttgtttttgcctttatttttattttttttaaggtgaaaaggcctgtttatatggctagatttgcacgcatttgccaggcctttaaacataatatatatctcctttcctccctttttctcttccttccttttttcctttctctgcaactcaatggaaatagaaaaaaagtccaaaacaccagatttttttttctctaaattttaaggaatgttatctttcctaaaaattaaacacatctgtgtgttgctgtttctattaaggtagcagtatctgtgaaaagtcagaataaaatgaacactttgttaaaatatttaagttaagccaaataaaaatgaaagttaatgccagaactttaccattcgtgatttataaataagctgttttctaaataaaaataaccacccacctgcagtcagatctcttagagaaatgggagggatgtgccgtttgagga

SEQ ID NO: 133698 - DNA, 1628 bp, Homo sapiens
gaaaaccgcatccttgcttgattctccatttccaggggagcgggtagcaacatgaaggcagagtagccctttaatcatgggaagagagtgattataagagggacttcccaggagaaaagcagaggccatgatctcactagtggtagaaaactaacaggtttcagtttaagatcataaaacctaaatcatgaaatctaaatctcatggttggaacaaactacttaaaggttgtctagttcaaccatgccagtgttttaaatatttaggaatatccgaggtataatacaattaaaatgtttaaccatggaagagaatcacagaggcttccatcagacccttctggattaatagggccagatcatggcacacacagcttctcaagatcacatccctgctgatctctctggccctcctgatcactgctcccccacttcacaccctgtcctgcagccaggccctactgcttgctgttcacaaattgttccatgtgatgtcacttccttagctctggtctggctggtccctgaacctgacattcccttcctccccttgtgaccctctaatgaacgccaactttcatctttgaagggttagcttctattacctccttcatgaagccttctggataacattggccatatccttctaggcatcttctaagaatagtgtaataggctgaatagtggcccccaggagatacattcactgggaatctccacgtgtgacattatttggaaaaagtttttgcagatgaaatcaaggacctggaaatgagatcaacctgtagtagggtgggccctaaattcaatgactagctcttagaaaagaaggggaaatagacacacagagctgaaggccatgggaagatggaggcagagattagagcaatgcatctatgagccaaagaaccctaagaattggaggaagtcactagaagctaggaaaacaggcatgtcacagattctccctcagagtctcgagaaggaaccaaccctaccaatatcttgatttcagacatctggcctccaggattgtgagggaataaatttctgttgttttaagccatgcagtttgtggtattttggtacagcagccttaagaatctgatacatgtatctcgtaaaacacctctgatacttacctgcgcttgtggctgtgttttctgatactatgagagccgtagtatctggataccggagagtctgcgaacttgagagaagggccgtgtctgattttccttcagtgtcccaaggaaggatcttgcacagtacccagatttggagaggtgccaagtgaatgcttcggtggactgaatgaatacaaatcaaaaataatgatgcagcgggaatggatgcagtaagattgctgtggcctatgcagttcacacagttcacactctgcatgttgaggagtaagtggacagatctcttaagcccaggggctagcaaaccggtctgtgggccaatttactcaccgtctgtttttgtacagcttgtgagctaaaaatggtttttaaaaaggttgaatacaatcaaaagaataatattttgtggcatgagaaaagcatatgaaattcaaattttagtgttcataaataaaattttattggaacctaaaaaaaaaaacat

SEQ ID NO: 133699 - DNA, 998 bp, Homo sapiens
taaatttaagagtaaaggtaaataataattggttttctttagtaaaacagtcgcacttggaaaaaaaatttgtttttgtgcacaaaggaaaataatgccatatatcttcatgttttattttcacgtatattagataatattggccttttcttgataagtgagtgtggtgatgcagtgtgctctggattggctttgtccaaagaaggaagccaagatcacatcccacagaaggagcgagaacttgcgtcatgggtagagaggaaaacacttagcactctttgaatagtacagtacattgctgagtagtgatacttttaactactctgcagtagaaattttactgtgcacattgcttggctctttctactatttagttgtataaagaagtggaggagaaacaaatgaagaattttgagaactacgagacatctgtaggatttcgtgtaattgcgtatactttatctacataaagagaacaaaaaggttaaatccttgtgacatcacttagcatttaatgtcaatattcctttatggatttttttttctttccaacctggctgcttatcttgtcttccttccgcaagtatttattgagcaccatttatgtgccaggcacgctgatacctgcgcttgtggctgtgttttctgatactatgagagccgtagtatctggataccggagagtctgcgaacttgagagaagggccgtgtctgattttccttcagtgtcccaaggaaggatcttgcacagtacccagatttggagaggtgccaagtgaatgcttcggtggactcttcctggcttctggtggatgccggcatccttggtgttcctgggcttgtacgcatcactccaacctctgcctccatctttacatggccttctcttctctgagggtctctgtatttccatctgctcttctgtaagaacaccagtcattggattagggcccactttcactcaggatgtcctgttaaagaaaaatttattcaagacc

SEQ ID NO: 133700 - DNA, 1111 bp, Homo sapiens
taaatttaagagtaaaggtaaataataattggttttctttagtaaaacagtcgcacttggaaaaaaaatttgtttttgtgcacaaaggaaaataatgccatatatcttcatgttttattttcacgtatattagataatattggccttttcttgataagtgagtgtggtgatgcagtgtgctctggattggctttgtccaaagaaggaagccaagatcacatcccacagaaggagcgagaacttgcgtcatgggtagagaggaaaacacttagcactctttgaatagtacagtacattgctgagtagtgatacttttaactactctgcagtagaaattttactgtgcacattgcttggctctttctactatttagttgtataaagaagtggaggagaaacaaatgaagaattttgagaactacgagacatctgtaggatttcgtgtaattgcgtatactttatctacataaagagaacaaaaaggttaaatccttgtgacatcacttagcatttaatgtcaatattcctttatggatttttttttctttccaacctggctgcttatcttgtcttccttccgcaagtatttattgagcaccatttatgtgccaggcacgctgatacctgcgcttgtggctgtgttttctgatactatgagagccgtagtatctggataccggagagtctgcgaacttgagagaagggccgtgtctgattttccttcagtgtcccaaggaaggatcttgcacagtacccagatttggagaggtgccaagtgaatgcttcggtggactgaatgaatacaaatcaaaaataatgatgcagcgggaatggatgcagtaagattgctgtggcctatgcagttcacacagttcacactctgcatgttgaggagtaagtggacagatctcttaagcccaggggctagcaaaccggtctgtgggccaatttactcaccgtctgtttttgtacagcttgtgagctaaaaatggtttttaaaaaggttgaatacaatcaaaagaataatattttgtggcatgagaaaagcatatgaaattcaaattttagtgttcataaataaaattttattggaacctaaaaaaaaaaacat

SEQ ID NO: 133701 - DNA, 1515 bp, Homo sapiens
gaaaaccgcatccttgcttgattctccatttccaggggagcgggtagcaacatgaaggcagagtagccctttaatcatgggaagagagtgattataagagggacttcccaggagaaaagcagaggccatgatctcactagtggtagaaaactaacaggtttcagtttaagatcataaaacctaaatcatgaaatctaaatctcatggttggaacaaactacttaaaggttgtctagttcaaccatgccagtgttttaaatatttaggaatatccgaggtataatacaattaaaatgtttaaccatggaagagaatcacagaggcttccatcagacccttctggattaatagggccagatcatggcacacacagcttctcaagatcacatccctgctgatctctctggccctcctgatcactgctcccccacttcacaccctgtcctgcagccaggccctactgcttgctgttcacaaattgttccatgtgatgtcacttccttagctctggtctggctggtccctgaacctgacattcccttcctccccttgtgaccctctaatgaacgccaactttcatctttgaagggttagcttctattacctccttcatgaagccttctggataacattggccatatccttctaggcatcttctaagaatagtgtaataggctgaatagtggcccccaggagatacattcactgggaatctccacgtgtgacattatttggaaaaagtttttgcagatgaaatcaaggacctggaaatgagatcaacctgtagtagggtgggccctaaattcaatgactagctcttagaaaagaaggggaaatagacacacagagctgaaggccatgggaagatggaggcagagattagagcaatgcatctatgagccaaagaaccctaagaattggaggaagtcactagaagctaggaaaacaggcatgtcacagattctccctcagagtctcgagaaggaaccaaccctaccaatatcttgatttcagacatctggcctccaggattgtgagggaataaatttctgttgttttaagccatgcagtttgtggtattttggtacagcagccttaagaatctgatacatgtatctcgtaaaacacctctgatacttacctgcgcttgtggctgtgttttctgatactatgagagccgtagtatctggataccggagagtctgcgaacttgagagaagggccgtgtctgattttccttcagtgtcccaaggaaggatcttgcacagtacccagatttggagaggtgccaagtgaatgcttcggtggactcttcctggcttctggtggatgccggcatccttggtgttcctgggcttgtacgcatcactccaacctctgcctccatctttacatggccttctcttctctgagggtctctgtatttccatctgctcttctgtaagaacaccagtcattggattagggcccactttcactcaggatgtcctgttaaagaaaaatttattcaagacc

SEQ ID NO: 133702 - DNA, 317 bp, Homo sapiens
gctcaagctggcctgggcccttgtcaccaccatgctgcgcaagccacccaggagagaagtggtgaattgtgggcttgtatttcctttttggctgacacaggcaacctcccttggatatttaaggtgttctgccacagtggactgttcagatatgtgaaagttaaaaaagcatactcaacctgaactgagttgtacccagagtctggtgtgggagtcaaggtccttaggggcagggtattctggagggagccacaatgctccagattccaggaacccgtttgggagctagtcttgggcagagcaaggatcagctccag

SEQ ID NO: 133703 - DNA, 544 bp, Homo sapiens
caaatagatccggtgtctgttgaggtttcgctttctgggtcatagacagtgcattcttgctgtatccttacatggtggaaaatactagctagctctctggggtctctttcataaggacactaatcccaatcacctctgttttcatgacctaatcacctctcaaaggccccatctcctaataccatctccttggggttaggacttcaacataagaatttggagggaacacaaaattcagaacatagtctggggctacttatatcggttttaccaggttaaatactcctaaagatttaatttcccatcttggtaactgctgcagccattgagaagcaagacagaacagcaccacagaattaaacatttctgaatattctcttattcatctcatttgtaaggtatttgattccacaaatctgttatgctaatttctatttctcttcactttgattgttactgttactattccttggaattcttatccatatacttacctggaattcaaaccatatcaatattttaaggctctatttaggtccaatat

SEQ ID NO: 133704 - DNA, 472 bp, Homo sapiens
caaaggctgagagaagctgcagaaggcctccgggtagcaaccaacgcagctgcccagaatgctattaagaaaaaaattgtcaaccgactggaggttgcagccaagcaggccgcagcggcagccacacagaccatcgccgcctcccagaatgcagctgtttccaacaagaaccctgcggcccagcagcagctggtccagagttgcaaggcagtggctgatcacatccctcagctggtccagggagtgagggggagccaagctcaagctgaagacctgagtgcccagctggctctcatcatctccagccagaacttcctccagcctggaagcaagatggtgtcctctgccaaagccgcagtgcccaccgtgagtgaccaggccgcagccatgcagctgagccagtgtgccaagaacctggccaccagcttggcggagctgcgtaccgcctcgcagaaggcaagtggagcgtgtc

SEQ ID NO: 133705 - DNA, 336 bp, Homo sapiens
caggcgctctagaggatctcggacatttaggtccacggaacagaatagagaacccagaaacaaacccaagtacttacagccaactgatctttgacaaagcaaataaaccataaagtggggaaagggcagccttttcaatgaatgatgctggcataattggctagccatatgtaggagaattaaaccggatcctcatctctcacattatacaaaaatcaactcaggatagattaaagacttaaacctaagacctgaaactataaaaattctagaagataataacattggaaaaacccttctagacattgccttagtcaaggatttcatgaccaagga

SEQ ID NO: 133706 - DNA, 463 bp, Homo sapiens
tcactgcaacctctgcctcctgggttcaagcgattctcttgcctcagcatcctgagtagctgggattacaggcatgcaccaccatgcctggttaattttttttatttttagtagagacagggtttctccatgttggccaggctgggtctcgaactcctgacctccagtgatctgcctgtcttggtgttccaaagtgctaggattacaggcatgagccaccacgcccaaccagcttgatagtttttgtttattcaacaaatattgagcacctgctgtatgctaggcattgtgcaaggtgttagggctgatgcttgagcacagtacctccacatctgcagtatggggagagagagatgataccgtgatgagatctgtattagagctgtgacaaggtgctgtgggaacacaggatttgttacatattcttaatttctttggccacttaaacagtttacttttgtgg

SEQ ID NO: 133707 - DNA, 602 bp, Homo sapiens
cgcagtgactcatacctataatcccagcactttgggaggccaaggcaggtggatcacccagggtcaggagttggagaccaaaatggcgaaaccctgtctcgactaaaaatacaaaaattagctgggcatggtggcacatgcctgtagtcccagctacttgggaggctgaggcaggagaattgcttgaacccgggagatggaggttgtagtcagccgagactgtgccactgcaccccagcctcggcaacaaagcaagaccttgtctcaaaaaaaagaaaaaaaaaagaaaaaaggaccttccaaatgtccaaatgtcagaaaggcaagcctatgcaaagagtttttaagagggctattaattcctgttaagtcaactggaatagagaaggatacaggtacttttcctgtgtgtagaacccaaagtttgaaaccacctttgaggcactgcactaagtatttcatagtcaaaaagcacttacctgaaaattaaagctgaaggttttctttactgatttgaagggcatctgggaatttcatttcgtagaaactccacttaaacatggcaagagtttctcaagatataaaaattctccctgattgta

SEQ ID NO: 133708 - DNA, 326 bp, Homo sapiens
gaagacttaaccttagggtgacatttaggaaaaccagaggccatcttcccctgccaaacaccttgcttgcgtcacagggaaaactgagacagtttccttgccctcagctccagagcagcaatgcagaggttttgcccgaggggaaaggcaggctgcaataacagagttctgaaggtatccccaaaataaatgacttaatttggaacacaatggggagaaaaaaaagcctaaggatgttcccaataacaatagagatttgggtggtaagctattaagagaagattagtaactacttgagagcaacaagctatagaaacaccagctag

SEQ ID NO: 133709 - DNA, 682 bp, Homo sapiens
atctgtcatttcgggctgctgtaacaaagtgccaaagactgggtggtttatatacaacagaaacatttctcatagctctggaggttggaagtctgagatcagcgtaccagcatgttcaggttttggtgagagccttcttccaggttgcagactactgttttctcgtatccttatgtggttcaaagagaggagaaagctctctagggtcccttttgtaggtcactgatcccattcatgaagattccaccctcatggcctcatcacctcccaaagcccacctcctaataccatcacattgggggttaggatttcaatgtatgaatttggaggggacataaacatttagttcattgtaagaaataagggtaaaatttagtctttggaagagaggataagaaaggtgatagcagagcaagaagaagattatccttttatcgttgctctgtaaccttggccagggcacttaaccagtctactttattacctttctcttagtctcatcacacaatgagaaactgccattctttggaataagttttgctgcatggcattaatggcattctcatacaaaaaaaaaaaagacaaaagaaggctgggcgtggtggctcacacctgtaatgccagcactttgggaggctgaggcaggtggatcatttgaggtcaggagttcaagaccagcctg

SEQ ID NO: 133710 - DNA, 269 bp, Homo sapiens
aaggtgatgtgaggtgtgagtgtgtccatggacacagggaatgtgagtctcgagggcacactaggaaggagcagggtaatagaagtactggtggttgctaatgtgggtttagagacatagaggcacttcaatgtgtgccatttcgagagtcagctgtgtgaagtctggaatatgctaataagcatcagaaccttgtgaagattgtgcccttgtgtccgcggaggaccagagtatgttgaggttccagggggtgctactcgggggtaggg

SEQ ID NO: 133711 - DNA, 282 bp, Homo sapiens
cggagtcctgggtctgaatagaggccaggccgccctgtgtttctagaaaacgagtacactgtaggcatccttggcaaggggacatactacacttagaaacaaagcctgcttctttattttatttttgtagagacagggtctcactctgttgccctggctgcagtgcagtggtctgatcatggctcactgcagccttgacctccggggctcaagcaatcctcctgcttcagcctccctagtagctgtgattacaggcacccaccaccacacctggctgatttt

SEQ ID NO: 133712 - DNA, 674 bp, Homo sapiens
ggtttccctaatgctgcccccgcccctacagatggatccacccaaggctcccactggcacctgagttcctgggccgatcctgactacagcaacgggcatgtgaatcctcagtatccccactcagtagggcttagaaaggaattgttgcccaagagcgaggagctggtggtttggtatattttgctcccatttagttggccctggagggccctggggataacttccagccatcaacattaccccctatttaaattctcttcttgcttaatctctgcataccctgttttagtgcaggccaaagaaatgccttagtctctggatttaactatatgatgccttgcagacatgcctggagcacaagtttggtgcgtgggagccctgcccagtttccctgcctggcccacaattctcctcttttcctgcccttgtcacccagtatctatgtttctcctgctctagatggatttcccatgaggcaacctccccactggggttcccagattcattgcctaaagtccctggtgtcattcctgcctgccgcaggccaaccctctggcatcacaagtatgccagcaaatcacaatgggtgcttcttaagacacaggcccccatcagtccctggctggagtgcagagcctaagctaagtcccaacatgggtagtcaaatgtcctga

SEQ ID NO: 133713 - DNA, 339 bp, Homo sapiens
ataatttgctgtttcatttctgtgtggctcctgcagccactagctggcatgaaagggtccctctggtattttgaaccaaaaaggaaataaaactcactcacacttcactacagataacctgaatattttgaatttggttcatggcaagagaaatgtgtactttggatttattttaataatagtggtgatatgttggctgagttatctcctttacgatttggaaacttgtgaagtagttgtctgagtttaagaaaagcaatatatgcctacgggaaataatttttatctcatctgaaaataattggaatatatgaacaacacttaaggagaaaatgtctc

SEQ ID NO: 133714 - DNA, 182 bp, Homo sapiens
atcgatgccagttgtactcaatacagcgctggaagacagaataattaggcaagcaaaaaagtaaggatcagtgagtgtgtctagatacagcattttgagttagctcttaatgttcatagcacattctaaagcctgggccagaaataacattgtaatgatgatgttaggatggcaagcagccc

SEQ ID NO: 133715 - DNA, 636 bp, Homo sapiens
aagccaggtgaatgtttgctaaattgtatagccaataagaagtcaataggctccagtccaaagaagactctacctttcctataaagcatatgtgtgtcataaagaaggttgatggtagagagctggctcaaagcctgcatctgtttaatagctgcatgccatttatttattttttgcttttagatccccattgactgcccatctactatctactggttactataataggtgctgggcgtagagcagagaagaaacagacttagacttcgtggagctaccaaactagtatgagaaagacatccagaaacaataaagttattattttaaaaaccagaacaaattatatatctgataagggtttaatatccaaaatacatggaggaattcttacaactcaacaacaacaaaagatcaaataactcaattaaaaatgggcaaagaacctgaataggcatttttctaaagatgatatacaaatggccaatgagcatatgaaaaaaatgcttaacatcactaatcgtcataggaatgaaaatcaaaactatgagatattacctcatatacattaggatggccactatcaaaacaaacagaaaataaatgttggcaagaatgtggagaattccaaacccttgt

SEQ ID NO: 133716 - DNA, 318 bp, Homo sapiens
ctctctctcacacacacacacaatctgtattattagattgcatttctatggcttactcataattttttccactgcttttccatcaatacaatatgaatatatgccaacttggtttttcaaaatgtgactttgcattgtcacggtcattgtcaaattcacatccccaatctcctaccatggtattttcaacgtgggcacatgttgtttctcagatgactgtagtcctagttctgggttttctatggaccaggtcgacaacactggggaaggcacttaacttccttaggacatagtgaaataaaggagttgtggtaaatg

SEQ ID NO: 133717 - DNA, 256 bp, Homo sapiens
ccatgttcggtcactggcaggtgcagcctgtggcacagcctctgtgcatatgtggtgtccttacactccctgaatttggaagcctcatggctcctgcagaatggtggggtaaacaggacatagaatttgaacttcatcactggtaggctgggaaactcctaggaggatttaagcagagggatgacatgacatggctggattgaccatattgaatggtcactctggttgcagaggggagaatggacgtggtggggcc

SEQ ID NO: 133718 - DNA, 476 bp, Homo sapiens
cagtgcttcaagaaggagattgtaatcaacggtgctaaaatgctgctggataattaatataaaggcaaacagaggtaatcagtgaaaacagtggccagtttataaatactcttgtgggataactgacatgacgtatgcaaactactaagcctagtatttcattagaattcagtaagtgtttataaatattaatattttgaggctattattctgttgtgaaagttaattcattagctgtgagtgatcttaatgacattcaattaaataagatccatggaactcaacaactagtggaagagacagaagaaacaaatccagagggtgtgcctgtctcagcctgtcatccaagtgttgcaggtacttcgaaggagaagagaagctatccagtggtcttcgatagagaacagataatgaataaaggcatcaaagataagagaagacatatattaagatctaaatgggttgttacaactaaa

SEQ ID NO: 133719 - DNA, 780 bp, Homo sapiens
gaggcaaagagtcctgcccggcaccggcgccgcgtgggccaacctgcgcccgtggaggggcgcgcagagggcaccgggcgccgggagcaggcggcgcagcaccagcatgtgttagtgccgggaggccactgtgtcagcaagctgagagggaaactgaagcaagatgtcgggccggagtgggaagaagaaaatgtccaagctgtcccgttcagctagggcaggtgtcatctttccagtggggaggctgatgcgttatctgaagaaagggacgttcaagtaccggatcagcgtgggcgcccctgtctacatggcggcagtcattgagtacctggcagcggaaattctagaattggcggcaatgccgcgagggacaacaagaaggcccggatagccccgagacacatcttgctggcagttgccaatgacgaggagctcaaccagctgctaaaaggagtgaccatcgccagtggaggcgtctgcccagaattcaccccgaactgctggcaaaaagcgagggaccaaaggcaagtcggaaacgatcctctccccacccccagagaaaagaggcaggaaggccacgtcaggcaagaagggggggaagaaatccaaggctgccaaaccacggacgtccaaaaaagtccaaaccaaaggacagcgataaagaaggaacttcaaattccacctctgaagatgggccaggggatggattcaccattctgtcttctaagagccttgttctgggacagaaggtaacaaagagaattgccttgtgctatatta

SEQ ID NO: 133720 - DNA, 312 bp, Homo sapiens
agttggctggagtaaatggtgccattgacttcagtgcttcctcaatgagctccaatccctttctcttgggatttgtcatagatataactctctcttctaactgcaacttcgttgttcctagcactttcccctggctttgtccacttcctggaagccccaccacctttgccaatgactggtccctaaagacaatgctttcttccccattggccaaaaatggagtcgtttccatcagcgatactgccatgaaagccagtctctggattgttctgtagagacagtggtctcttccacaaatatttcagccatggt

SEQ ID NO: 133721 - DNA, 879 bp, Homo sapiens
catgtaaaatatgctgttttagtttattcttgcactgctataaagaaataccttagactgggtaatttataaagaaatgaggtttaattggctcacggttctgcaggctgtacgggaagcatagctgcttctgcttctggggaggcctcaggaaacttacaatcatggcagaaagtgaagcagaagcaggcacatcttccatggcagaagcaggagcaggaaagaaaggaggaaggtgctgtacacttttaaacaaccatatctcacaataactcactcagtcacggttatgttatgagaacagcatcaaggggatggtgctaactcattcgtgaggactctggccgctggatccaatcacgtcccaccaggccccacttccagcactgggcattacaactggacctgagatttgggtgaagacacagatccaaaccatattgtatgcctaaataaatttatatctaaaagaaggttcaggagaaaagtacatgttgtcagcattcttttagccttgatcaatcatcaatgagtgtctcaggctctgtctttgaccacagaaaatcagtgagtagctctgtgttctacactgccagttgcacagttccgctgaaacttggtaacacattagtccttctggagctatacttgcaggtaggcgaacacccatggaccaagtgctgtaattcaagctaacaatgcctagctatctccaaaggcaatcgctggagccttttcacgctaaattagaggtaagcattgtaatcaccggctaggaaaataaactcactctggtttcaggagctttgtgtttttaaaccggtcagactccttgaactgctgccagcaaaccatgaatatacatcaatgggagacaga

SEQ ID NO: 133722 - DNA, 807 bp, Homo sapiens
ctgttgaaggaagaagaaagcaacaaaagactggaagctgaaattgaatcatcagtctagactgactgctgctataagtaaacacagtgaaagtgtgaaaacagaaagaaacctaaaacttgcattagagtgaacacaagatgtttccgtacaagtaaaaatgagttctgatatttccgaagtagaagataagaatgagtttcttactgaacaactttctaaaacggaaattaaattcaataccttaaacgataagttccgtaagaaaagagatactctcagaaaaaagtcattggctttagaaactctccaagcgacctaagccaaacacagcagcaaataaaggaaatgaaagagatgtatgaaaatgcagaagctaaagtgaataattccactggaaagtggagctgtgtagaagagaggatatgtcaactccaacatgaaaatccgtgcattgaacagcaactagatgatgttcatcagaaagaggatcataaagagatagtaactaatatccaaagaggctttattgagagtgaaaagaaagacctcatgctagaagagaaaaataagaagctaatgaatgaatgtgatcatttaaaagaaagtctctttcaatatgagagagagaaagcagaaaaagtagtaagtatcaaggaagataaatattttcaaacttttagaaagaaaatttaaacatttggttctggatacatgttgaacttagttgaatataaaaatcaatggataaaaagtgtgtttaccatactgtataattccatttacatgaagcatccagaaaagata

SEQ ID NO: 133723 - DNA, 425 bp, Homo sapiens
cccgctgctccctaaattcttatagttctagtatgttccatgcataagttctgatacacattctcatcttctgaatgctatagtgtgtgctttttcataaagctgatgataattaaatttccaggctatttatttttttagttttgtgtttgttggtgaagtccaactgtttatattcgtcaggactttttagttgcaaataacaaaaagcagcttgaaggagggctctcaagaagtatagtctgcctgatgaatggcttgaaaccagaaggaagggctctcatgacttcccccatcttgtcttggcttctttctgcgcatctgctctctctgtcctcccttcctataccctaccccagcaactttttctacttctctggtccagacttattcattcaacaaatatttattattaaaaaataata

SEQ ID NO: 133724 - DNA, 524 bp, Homo sapiens
ctggaatagggtcctgtggtgtaagaacttgtggccttaaataaaactcttcttaagacctcagtttcaggccaggcatggtggctcacgcctgtaatcccagcactttgggaagctgaggcgggtggatcacctgaggtcaagagttcaagaccagcctggccaacatggtgaaaccctgtctctactaaaagtacaaaaaattagctgggggtggtggtgtgtgcctgtaatcccagctactggggaggttgaggcgtgagaatctcttgaacccgggaggcggaggttgcagtgagccgagattgcatcactgcactccagcttggcaacacagcgagactccgtctcaaaaaaacagacctcagtttcatcatctccccaatcaccacactaatatagactctgcagagttgctgtaggattaaattataagcacgtggccagctcccagtggcacacccagcacatggtggagtgcatgtcctgaatacatgcaacctgaacacaaatccaatgcttga

SEQ ID NO: 133725 - DNA, 184 bp, Homo sapiens
ttcaggggcaatatgtcctgaaccccatcaggatgaagccccagctccatgaagcccctcttgaactggtccatcctactgttccagtctcagctccctctgctccaggccttgaacttcacattccagcctggggactcctggcagttccctaaatatgcaaagagctcagctttctttcctg

SEQ ID NO: 133726 - DNA, 407 bp, Homo sapiens
tgatttcacctagcttgataaccataaacctggggtttatggacttaaggtagtctgtgaactcttccttctctccctgataaattttggagtggttgtgtaagtgcatttatttatttttgtaacttacatacagaagaacatatgaaatttgtaaattataaagtaaaaactcttgtaactcatgctcaagtcaagaaataggatatagtcagttccttagaaatggattcccatccctcctagacttagcctcctctctcccctagatgtaaccatttttttaacctttgtggttattatttccttttcattctgtacagttttaccatacacatatgcatctctataaaatattgtttagttttacctttttaagatcatttaagtggaattgtcctgtattt

SEQ ID NO: 133727 - DNA, 317 bp, Homo sapiens
aacttaaacatacatgaagcaaaaattgagatcatggtagaagattttaacacccccttctcagtaattgatagaacaactaaaaaaaaaatctataaagacatagaagatttgaaccgatttgatctaatggatacatttggaatactatacctaaataactgccaaatacatatttttttatgttcacatagtgtattctcaaagagagaccatgtgatagacaataaaacaaaacaacaaacttaaaaggaatgaaattatgcagtttgttctcttaccacaacagaattaaaattcaatgacagtaagatagg

SEQ ID NO: 133728 - DNA, 694 bp, Homo sapiens
cagcagaaacaatggaggtcaaaagcaatgaggtaacacattcagagtgatcaaagaaaaaagtcacccaagaattttatatccaacaaagctatcattcaaaaaaagaaagcaaataacaacattcccagataaacaaacaaaaactgaagaatttgttgctagcatgtccaccttacaagaaatactgaagttattcagactgaaagcaagtgatctcagatgataattcaaatccacagaaacaaataaagaaccagaacactagtaattatgtaattatagaagactgcataaacgtatatttttcctttttttctattaattgattaacaaagcaattccataacatatgtataaaatgtatttttcagtctataacatagaatgcagtatatttgccaaaagcaacacaaaagaggtggctgagagcaaagctatatttggataaggaaatatagatgataaagcaataattataacaatgcattgataggtttgtaacattaatagacataatatgcataacaatagtactataaaaagacagacaagacaatagaactatacaggagtccgggcagggtggctcatgcctgtaatcccagcactttgggaggcccaggcaagtggatcacttgaggtcaggaattcaagaccagcctggccaacatggtgaagccccatctctact

SEQ ID NO: 133729 - DNA, 781 bp, Homo sapiens
aagaaccataccatttggtcgcatagaaccacctttttgtcatgggtcatgataaagaattgtgctagtgctcatgttttagagttgtcagtagctgtctacgttcttccattcttctaacacatttcatgctgttgtttctaggtacgtatgttgttctgtacaggcagaaggcatgcagccctaaagcgggtagggtggagaaaagatgcataatcaggccagcaaaagagggaaacagatgggttgtgggagatgaccctgcccccatgctgtttttgttctggctgctgttgatcatatgtgaatcagcagcccagaaactggagttactgatcctttgataaaaaaagaaagtatgaacttagactcagtagagttataaattacaactctaaaaagtgattcaggttttacagtaaatacaattacaggagtattcaggaattggtaaaggggacttaattatgatggctatacctcaacatttttgggtcttgtctctagattatcatagtttacgagattttatcctgtgggctctttcaaaatgaatagagagtagtgtgtttgttagagaaataaatccaatgtgtatattttatgccaaattagtcttttgtcagtgcttgtatatgacttctggtctattttctaatctcaaggttaaggaaaccttgctgtgtctcactgagtcttcccatcattctgtggaagaatcttattttttaaaaaatactaggagaatgttatcaaacatatacaaatgtagagataatag

SEQ ID NO: 133730 - DNA, 442 bp, Homo sapiens
tgcttgcagggagtaaattaccaaatttgtataataggcttactgtagtcaatctcactacagagaatattatattaatgttttctcaaactttggtcatttttaaactatgcataggattttgacaatatatctgtgtaccattttattattaagtagttaatactcctattcacttgatattgcctttgtgcaatgcaattctgacactcgctccctagggatggtcaaatttcaaagctcaagggcatactcctccacgagactgccctcacttcagacaccggccacaagttccagggttccaaggtcaccagtacttctgcccaactggctacaaattcaggggttctcattacctcctcaggtttgataatttgctagaatgactcatagaactccaggaaagctatatttatgattctagttttcttatgaatga

SEQ ID NO: 133731 - DNA, 678 bp, Homo sapiens
ctgaacagttatagtgagtacaatggagagaaaagcagcagaagaaaaagtgtaatagctgttggtgttttaaatgatattatttgatttatgtgattatgcattgaatgcttatagatttaggtaataattttctagattttaagctatctgaagtctccagcatttttttcctgtatgctgtttgagtgaccccaagtacctctgaacagcaagatcagtgctaatgctgaccacatatgcagcggcccctggcctgaaggaaacgccgggctcttgctgcactttgtacctttgtcctttctcaccaatcatgcccactttgtctgagtttcccatgatgcaggaagctgcaggcttcaccatggtcacctgcttatttaacaaggaccttttgttctgcactgggttatgaggtttgaagtagaatcctgcagcctgaatcccccattgcgcacagctgccattttcataccttgacgcagtgatgcttctggatgggtgatactggccaggtttggggctggtctaatccagttccaggggaggctgacctcacccagccctgcaagcccactgtgatcttggctccagaaatctcaggaaacacacactgcccctgtccccctgcagtcccttgacacagtacagcttaaagccatgtaaatttttctctat

SEQ ID NO: 133732 - DNA, 410 bp, Homo sapiens
aaatatagagagatcctttgtatactttgcccagtttcctccaatggtaacattctacaaacttacaaggtatcacaaccacgatgtgtgctcacttgtgtgggtgtgtgtactaagttctggacaatttaaccacctgggtgggttcagtcaccaccagtcaatacactacacagtccccacaccacaaggatccctcgtgttgccacctctctcagcaaccctgacccgcaaactctggcaaccactgcagcatcctccatttctaaaattttgtcatttcaaaattatacataatatttcaaaaatggaaccatacagtatgaacctttttgggatcggctttttacattcagcatacaggttgtagttctagcaacagtactgccagggtattccatggtacaagc

SEQ ID NO: 133733 - DNA, 269 bp, Homo sapiens
cagaaattaaaaatagtaagaaacaaatagaatttaaatttcattttctcctaccctgggcatacatgtgacaaaatccaatatatatcactctgaacagcctcagggtacagccactttatattgcacaagctgtaaaagtagtcattttcaaactcaactattatttaaaatgattacaagcatttaaaatgtttaaaataaagatccaaccctgttcacttgggaaacagttgtggcagttccttaaagtgttgaacatagggtta

SEQ ID NO: 133734 - DNA, 277 bp, Homo sapiens
cagaagtctaagaatggagctgaaaggcaagaactgcataggaggagaagaccaggattcggagacttttagagtgagaaagaaacattggtagacagagacaggagagctaaaaggtaagtatgggaaatgaagaattgccagagcagaaaggagcctgggtgggcagagtctaagatatgttacactcagacatattgtattagctcttggagatttctgccttgcaaacttagacttttttcttcctttatgttttgcaagtgttctctttcaa

SEQ ID NO: 133735 - DNA, 480 bp, Homo sapiens
tttggggaaaattttccccacagaggaaggacaaaggggtttaatttctctgttatatgaagaaccagtaaaaggacagttttatagctcttctgagtggaacagaccaggctcaaatcatgcgcttgactgactcattgccatggtttacacaggtccttcaactgccagctttaagtcagatgcctgctcacagggactcatccaacagtaggttggctttagaaaagcgttctgtacctctgagaaacaggacctcgatgaagtcttcactgatgtcaatcaagaatcctttctgggggattcacactgtgttcactacacaagggcataagcacaggcaggaaaccaagactcaggcctgggtacaaatcctgacctccacctgccagctgtatgacttcaagtaagtgatttaaccattctcaagtgttcccatttgtaaaatgggaataatacccccatcttacaaggctccaa

SEQ ID NO: 133736 - DNA, 188 bp, Homo sapiens
ccccacacattgaaggtagagcagcaaacaagatggtggggccctgcctcctggagctcactttctggggtggggagacaggcagtaaatcaatatacacaagacagaaggtcagatggaggtatcaaggtgaggcggtggtgcatgatgggggtgttcttttagaccaggtagttgagcagcggcca

SEQ ID NO: 133737 - DNA, 459 bp, Homo sapiens
ggcctcgctcccactgggcttttctcattttctcaaacatgctacgtttgttctgactcaggcttcagtagacattcccagggcatctccactgctttcatctgcagtcttcctaagctttggctcttcccagaactgtccaaagtcaatgcccctgctctattattttatagcataaccctctcagtctttccttcatagcactcattgcaatgcagttgttttgttgtctaactacttgcttttgtctgtgtcccagcatccagcatccagcttagcacataataggttctcaatcaatgttgattgaatgaatgaacgatttgctcagtcacacagctcgtaagtggcagagctagaattctaacccagtttagtctgactccaaatccagagctcccaacacatgagaagtcatattttatcacccaaacctaaactcttttgagagtgaaagag

SEQ ID NO: 133738 - DNA, 834 bp, Homo sapiens
cttatgacctcattggtatctttttagaccattcattggtgtttactggaataatatgccactgagaaaagaagttatttatttgctgccagtagcgtaacagtcatatttgcttttattcacattcacccaactcacatttcatttttaaagttttaaatgcaaagaataaaggtaataactttttctatttgtcatttgtgatattatcaaattgaattatttcttttgttcttttattttcccttcatttaaaaaacacctttgggtagcacctcaatataaaattaatatctctgatttttctataaattgtttctttgttgctattttctgatttcctatcacaacatatttctgtcttggtattgtattattgaggaagtcccaggttttgttaggaaattgcttgacccagtagatagtagttgcaagcactggccctggcatcttccagactgggtttgagcccttgttcttccacttaccagctctgataccttgctgaagttgtttaaatgtttcctgtcctttaataacagaaataacatttggagcacttagctgagtcgagagagtaggtgcttcatattaactattttgttgtaagtaatatataatctttaattttttgtcttcataggttgtcagattttttgacatgattatgactttttagtttacaaatgagtgaaattatttcagattaaactggtcattgaaaaattttgaggctaggcatggtggctcacacatgtaatcccagcactttgggagggtgtcaggaggattgcttgagcccagtagtttgagaccagcctgggcaacatagtg

SEQ ID NO: 133739 - DNA, 246 bp, Homo sapiens
aagtgacttctcttcacagaatcaaaagccaaggaaaggacattaacagtggaaattgatgttcttgaccagttttgctctgaggtggtcaagaatataacaatggcctgtagtggaatgattttgctttctccctgtgtaaaacagtgatcctgtaaaacccaagtttgtaatttattaacaaggaaatgtacatataatcatttgtagctgcaagagactagcaataaccaaaaggcttgtcat

SEQ ID NO: 133740 - DNA, 192 bp, Homo sapiens
gttgatgactctatctgtgaaaacagcacgtaccctgaaggatgccacctctcacctgtgtacactacctgatataaaacttgcccatggcaggttatgagctcacttggggaacaagacagctaaccgcagttccttagtcacagcttcacacaaagcttagtgtttagtgcctgtttctctctttcacat

SEQ ID NO: 133741 - DNA, 682 bp, Homo sapiens
gaactatccacttctctgtccatcccctggtaccatctcttgcttggactaatacaatttctctgtttctggtctgggccctacccatactgctaaactcacctcatctcactcctccactgctactctacattccagctacactacccttctttgggtttctacaacatcctcagctctttcctgcctcaggatcttcacacgtgctgctctcttgggctgagttcctcttgctcccactgcacttgaatattacctccccatttttcaggtaaaatttgaaaattcttgactctcaatataaattgagtctccattattcttttttttatgacatttggtttttttgtttggttgtttttttctttcagggcacatactttttgtgtttgttttatatacttttgtgtgtttattttttctaagttttctaactcctcacccacttcaagattataagttccatgaggaaaacagccacatctgttcaatttacctttgtacccctggtgcctagcacagagtgttatatacaggggttttttttttttttaaggtagagagatagaaatcatgctatgaacaatattactactattatgaatactactactactaccccctacattcttttaacacatggtttattaaaaatccttgttggcatttcaccagaggtaca

SEQ ID NO: 133742 - DNA, 426 bp, Homo sapiens
taaaagccattctaaaattaataccaacaaaatgttatatactttttatacatttcaaaaggcactctaacttgatgacttaatttgatcttcacaacaaccttgtgagttaggtgatcacatatttgcttatttgagacagacacaaaaagattggtagaaatctcttgcctcccatctagaaccctaaactattactttatttcagtacatacagacaagcattactatcttgatttcaccaaagaagaaacaagtacagagaagaaacttgcctaacgtcacagtgctgctacacagcagaacaagattcaggccaggaccaatccaagcctcacctctaaccacaactgtcataaaaaaaaaatagataaaattaacagttcaaaattatgtagctgactaaaaaccaactgtggtagcagg

SEQ ID NO: 133743 - DNA, 363 bp, Homo sapiens
ccttaacttttgtatattaatttaatgttcttagttttcgttgatagttaaattttatgtagatggttgtcatgcataaggcaggaagaaatattttctgtgcaggagtgaaaataggctagagttccgttgcgtgtgtatgtgtggggttttttttgtgtttttgttcctttgtttctttgttttttgagacagagtctcactctgttgcctaggttgcagtgcattggtgcaatcacggctcactgcaacctccgcctcctgggctcaagtgattctcatgcctcagcctcagctgggattacaggcatgcaccaccatgcccggctaatttttgtatttttagtagacacggggtttcac

SEQ ID NO: 133744 - DNA, 189 bp, Homo sapiens
aatatgcatctgaggaacatattcctttaggttttctatctccattaaatgtgatctaaatgttctggtatatctcaaaattcttctgcttcagttaattatgctctaaattctcagaaatgtacctcagaatactaggaaacaagtttggcaggcaaatggcagaaatggcacagggatgaagatgaa

SEQ ID NO: 133745 - DNA, 446 bp, Homo sapiens
tggattgtacagcgtatacccttgtctgtctatgttcatttaagattcatgcaaattgtttatttaaattttatatctaatgaaaaatatttgtaaaacaatgtaaaacactagttaatgaaatgcaggctgaaagatttaaaagggaatgtcctcatatccttaatgtattttgaaattcatcaaaaagtaagattaattgacagatggacagagggacagatagagggagagacatataataagtcaatcaggatgaaatttaaattatagaatctgatctgtgggtataaggctgttcactgtaacacactttaacctattttttatatctgaaagttcccataataaaatggtgagtaaaaaggaaaacatacttttgaagtaattcatccatagcagcatgaataagtgaggataagatcccagagaaaaagggaagtaca

SEQ ID NO: 133746 - DNA, 216 bp, Homo sapiens
cccctccaaggttatcttttcttttttctttgcatatttcccaggagctctgcactaaagcataaactttcacattagagaagtgaataataaagcagacaccagaggaatacatatgctgtttgaagaggctttctcacccagcctccttcatgcttgcagactcatacccagtgcagttgacaattttaggtcgactcagaatccattgtatat

SEQ ID NO: 133747 - DNA, 337 bp, Homo sapiens
ccatgttgctgggagaagtgggagtctgaaggctggcttggtcattttatggtaaggtgtgagtcatgatggtccttgaaattggggtgaggctgtgctggtcgcccatagcggcataaaatgggttgcctgttggtggttctgactgcagtcggggatgggaggcactagacagcctttggctatagtgggactttgtagacatttattttccttaggaaagctgctcttctctgtctccgcctagatggacagcttcagaattatataccccctccctggttctgtagagtaatacccaataaacagagattctgctcttgtaccctgaagccac

SEQ ID NO: 133748 - DNA, 269 bp, Homo sapiens
ctcctgcctcagcctcctgagtagctgagactacaggtgtgtgtcaccatgcccagctaatttttttttattttttgtagaaacaaggtctcatcattttgcccaggcatgtcttgaactcttaggctcaaggagtcctcccacctcagctgcccaaagtgttgagattacaggcatgaggccctgtgcctggctaagaatccgtttctttgcatttttcagcttctagaggcacccacattccttggctatggccttgtccatcttca

SEQ ID NO: 133749 - DNA, 596 bp, Homo sapiens
atctgccttgtgttaactgggtgtctgtcctttctcttttcagttgactctctgtcttgaaagccaactgatatttcaaaaatgaacatcaatgcatagctccagtttaaagacttcagtgactccctgccacctccaccctgatctaagggattcaggctgtctgccattcaaggctttttgcaatctgctcccgattcccctttccagtcaacttgcatttgatatctctgactcactcgtccctcaaagcaccatgtattttcacagcgctctgcttctgtgctcaggtttttcacttttgtataatgttctcctgttattcccatgacttctaatcaaatctacctctttgaagttttccgggtctcctgccttacctggtgcagaattaaatgctttctccattctgtccctctgacccttccccggcaaatcagggcttgttctaaacttgtctccttctgcctctactgagaagtttccttgtcatatttacaaaaataagggatattgaaatggaataatctctgtaactgactcttcagatgctttctagaggcggtgagatttgaagaaggaataagatttgcata

SEQ ID NO: 133750 - DNA, 404 bp, Homo sapiens
gggaaggataattattaaataaatcatggaacatccattaaaaatgtttataaatcattttaacaatatggaaaaatgggatattaaattagtagaaagaggatacagaagcatatctaaaatacgaccctatatacatgtgtcggtatattacaatgatatttataaaaatgcagatacctaggacatatagcaatggttctcttttggtggtgggcttatggatgatttaatatttctttttatacctttctaatttttccactttttcagtgagcacatattagttttctcagttctctttttttttttttttttgagatgcagtctcactctgtcaccttggctggactgcagtgacacgatctcagctcactgtaacctctgcctcccaggcttaagtg

SEQ ID NO: 133751 - DNA, 688 bp, Homo sapiens
gacttactggattttattttattttattattattgctgttattaaagatatacatacacatacacatatgtgacattgattttgctaagaacctaatatattcagcatgctgtctagtcatctcagatgatccttgctttgaaaaccttaagcacttaaatgacaaaacagtcgcgcacacagagatagatgtaaaggtgatattttacttaacattttttttaacacccaaatttgctagtagagaaaaagagaagagggaagactcccaaatggttatgaagtttgggagaggagctttataggggtaacatgaagatgaggaacctaatatgggattagagcataggaaaagagacacagccttagattctattcaaaatagtcagtgtagaggccaggcacagtggcttatgcctgtaatcccagcactttgggaggccaaggcaggtggatcacctgaggtcgggagttcaagaccagcctgaccaacatgaagaaaccttgtctctactaaaaatacaaaattagccaggcgtggtggcgcatgcctgttatcccagctactagggaggctgagacaggagaatcgcttgaaccccagaggtggaggttgtggtgagccgagattgcaccattgcactccagcctgggcaacaagagcgaaactccgtctcaaaaaaaaaaa

SEQ ID NO: 133752 - DNA, 767 bp, Homo sapiens
  misc_feature (767)..(767): n is a, c, g, or t
ggcccccctgtggaattgtaagtgaacacgataatagtacctgtttacactgtgaaggtggatattgttacagaaaacacaccagtggctttctcactgttgagctaataatgccttgtgaatgtatgatctacggagaaacccctgtagttgtacctgctgatgctgtctgtctgttggaaaataaaatttgaatgtttttttttctaaaaaaaaaaaaaaaaaaaaaaaaaaaaaaaaaacaaaaaaagaaaaacacaaaaaaaaaaaaaaaaaaaaaaaggagggggggcgcagctcatcaataacacctaccaggggcgacgacacgacacagcaagcgccccaacatgattgattagcagaaaggggcccccacaataggagaggagcgcatattaataacaagcagagagaaggagcggcagcttatataacaacaagtgtggcagaggaacaaacagagcgcagaagggagaccaccttgtggagacgagaccacccaacatgcggaggtggcgggaaaacatagaagaggagcaacacccccgcacaagcaaagaactatccagacccgaccagggagaaaaacaaacaaccactcgaccaaggcggacttaacggaggcggtaacaccagcagagagacagtaaacacagacacggacagaagaaaaaagtcgcgacctcccaccggtcaccgacacgtattacacacagaaccaaatgtaagtccaaacacagacgcaccgaacacgataaagaccn

SEQ ID NO: 133753 - DNA, 261 bp, Homo sapiens
ggcccccctgtggaattgtaagtgaacacgataatagtacctgtttacactgtgaaggtggatattgttacagaaaacacaccagtggctttctcactgttgagctaataatgccttgtgaatgtatgatctacggagaaacccctgtagttgtacctgctgatgctgtctgtctgttggaaaataaaatttgaatgtttttttttctttttttttttttttttttttttttttttttttttttttttttttttttttttt

SEQ ID NO: 133754 - DNA, 346 bp, Homo sapiens
taggtgtgagccactgtgttggccatcattttactttattttgactgagttcagcatgctcttttggatagtgtgccttgttattatcttctagttgtaggttggatgagtgttcagtggtgctgggaaacaatggcttctgaagcaattcggatatagagccaatatatgaattcacagattatttggacagctgcctacattttaaaaacatctctagaatctctaaaacttttgaagcaacaagcccttttgaaaagtatattcctggaaatagcttcaccctgtccttttggcctcacaagaatccactttttttttttttttgagagagagtgtctcgctc

SEQ ID NO: 133755 - DNA, 403 bp, Homo sapiens
agttgtacttccctagatccgttctcatagaaattcctcagtgcaagataatcaaccaagagagagctatgtatctccccttcttctatcatttctaattcccttcaatcaccaagactctttctttctcattttctctccaaacctattttgggatattttgtttgcaatctcatctcccttttctgcccagagtcattatccaagagttgtttttcttcttctgtgtcactgtattcctaatgtaggaggtaatacatttagttgattttcattaaatgatttagataactttccttaataaaagcaccaggtaaagaattaatatatcttcattttacaacttcattaggccagcctcaatccagcagtgaggactctaatttgtaaagaaggtaacaca

SEQ ID NO: 133756 - DNA, 250 bp, Homo sapiens
attcctccacctggttaagttcgtatatgtgagattattctcattacttacttgaaaagatccagtgagcaatttttccttaaggcaagcttcctgctctttaggttaccaaccccagagggatgatcaagtgagttcccagattcttttatgtaaggtaacttccagggctattaacctatgataatgtagttccctggacccggtagtcctctgatacgctggtttgcttgtgtctgtactcttttgg

SEQ ID NO: 133757 - DNA, 439 bp, Homo sapiens
tctttatgtattgaattttctaaaagtagggtcgagtggctgggcttagtggctcacacatgtaatcccagcgctttgggaggctgaggcgggaggattacttgagcccaggagtttgagaccagcctgggcaacatggtgagaccccatctctacaaaaaagtacaaaaattagctgggcatggtggtgcatgcctgtggtcccaggtacttgggaggttgaggtaggaggatctcttgaacccaggaggccacagtgagccgtgtttacgccactgcactccagcctgagtgacagtgcagtaccctgtctcaaaaaataaaagatcatctcaaataaatataaggtcaagtaattacctacacaataatcaatgaattcaaagcctctgaaactaaaaatgtagctaaaacttttctggatataaaatatatatgt

SEQ ID NO: 133758 - DNA, 497 bp, Homo sapiens
acccagacagagtccctatacttactgctgatatgggttgcatgtgtcccctatgtcatcttgaattgtaatccctatgaatctccacatgcggaggcagggccccagtcggaggtgattagaccatgggggcagtttcccccacgctgttctcatgatagtgagttctcacgggaatttatgattttaaagtgtggcgcttcacttgttcattctctcgtgttcattgtctgtctgtctctctctctgtcactctctcacctgcctgccaccatgtaagacatgcctgcttccccttctgccatgattgtaagtttcctgaggcctctccagccatgtggagctctgagtcaattaaacctcttttctttataaattacccagtctcaggcagttcttcatagcagtgtgaaaatgaactaatacaattgccgtcttcttttttttccttagtggcattgtcttgctctgttatccaggcttgagtgcagtggcct

SEQ ID NO: 133759 - DNA, 644 bp, Homo sapiens
ggtaactgcatgattttaattgtgtctttttgctttagtagaatgtcctaaaatgacacaagtgagaatagtgtgaaaataaatacattcatttattggttaagctttaaatgtgagtgaaattttcttcaactaattataatactaaattaattctagaatctgtttcaatgtagccatataattatgtagaactataaccctttattgcccagataaatcttgaccctgaaataatgtacgatagaccctcatctgctataattctgaaaactgcagtaagaaagccaaattttaatccaaatgtttcatggttctttgggcttccaagatgacaggctcatcaaaaactattcctgacttggccagaaatggaaagatcttcattttgatgggtacaaatgaagaagccacatagatacatatttggaccaagattccttccttttggcttcgagatctttcactaacaggactgaacgaaccagaatcaacagtattgggaaaagtagataactaaaatataaattttaacatgaacaaatttaccaactgattcagaagaaacagaaatcagagaagagatggaactttaaaataaatttaaattttatcagggagttgtggacagactcctatgaaaa

SEQ ID NO: 133760 - DNA, 642 bp, Homo sapiens
gaggtgaagtgtacctaggtctcaaactcactttaaaatgcataaataagatgtgatgggttgatggataatagatggatatataataaagcaagttgtaagagattaatcatattgatagaatctaggtggtaagtaaatatggttgttgactacacaattttcccaacttttctgtatgtttgaaatttttcaaaatgaaatgttaagaaaaaaaaagtaaactttgatctccaagtcaaattactttttgctcagtctccagatatagtctcattttgtggcaagcaaagtcaatttccctctacttagagcagtaggcaggcgtattctgtgtgctacttagcagtgggggtcaaaagtggtaaattagcaagtttgtccagagggaagattggtcccaaaggatgagccgaaaaggacagtcactgatgcaaagcaatcagagtgactacacttctactgactgtaacagcacctatggtaactgtttttttgatccaaaaaaaacaacagtactttcaaccagtactagatcccctttaggggagtctgccactaccacccaaatactcactaacattcttaggcagcttttctactctaagtacaaccagaagtaccttctaacaaaaacacaca

SEQ ID NO: 133761 - DNA, 293 bp, Homo sapiens
tgatcctccttgatgtcactgaggtcaggggtctgaatccattgtaacactttagtgagagcttctttgtggatctgaccctgtcctattgtagaggactcagtgatgaagacttggacctggctctgatgggttcattcttactgcttgaggtctgttcattcatttgcccatccattcatcaatccatccatccatccatccatccatccatccatctatccatccatccatccatccatctacctacctaccagtccatccatccgtctgttcatctgtctgtccaccca

SEQ ID NO: 133762 - DNA, 414 bp, Homo sapiens
cacagggcacaagggaggttggggggaggaatgtcagggtggggctgtgtgtagtcacacattcaagtgtctgcagatgggcacagtgtgcgcctgtaaaggtgtttgaaggccggtgtatacaggacacctccactctgtctgtatgtctgggcagggtgtgcatgatagtgtctttgtgtgtgggtatgtgagtgtgaggggagggcgtctctgcctctgcgggaggaagtgtggctggagaggattagtcattctgtaggattctgcccaactcagccagatggctgcaccaggctttcctctctgtgctgggtggagggagcagccactgaatcctgctcttatccggaggcaagtggcccagagagaggtggatgagtgtctgtgccagccctgcctggccagggacca

SEQ ID NO: 133763 - DNA, 351 bp, Homo sapiens
agcttcgttcatgcataagttatactgctgttagctgtgagttcagtgttaatgaatcaacaatatattttacataaggtgtctttaaacagaaacacatataaagcaaggctctatgttgatcagttgatgaaaatgttttgaccagaggctcacgggaacctagcctgtatttcttctaggaacaaattaggtattaactaattcagcattcatggctactttatagaacagaactaccaagaacaatgaaaatcaactgtactttgagacctttacccaaaggatagcaatattatgcattttgtttttgccaagagttggtacaggctgaaagcataatgaaggtaa

SEQ ID NO: 133764 - DNA, 735 bp, Homo sapiens
tcagcattctatgatctctgtgatctctgcctgttggtgttacgatgttcctgttctcgggcagtttaatggaggagacaagtaaagaagtagttatagtacagtatgggtacaaaatgtcataggaacaaaaaaaactaaagtaggcttttgtggagctaaaactcctcccaaaaacctaacctgcttctattatttttattttttgaaaaaggagtgtcttgagttggtgtgactaaataggaataacatgattttacacatgatttggaaccttcggcctcccacttgcttgctggatgaccttggttaagttgcttcccttccttggtctcatcatgatacctactgcatggaattatcataacaattaaatgaaatgaaaatctatagaaacacctaacccagttacctgggatgtagtatcagttctcttcttcctcctgggttccaaccaaaataaagacaactttttggagcgcaacattttcttaaattgagtttctccttttctttggaagttcatttttattattcttgactctacgtaatatttcaatccaggctaacaaaatgtggcctcttagagtccttgggaaaacccaccaattaggtacagaatattttctgagtagtaaattagttatgtacgtgtattgggggggttattgaaaatcctttgtctatgaattcctaaataacattattaatttttactatatttggaagataatt

SEQ ID NO: 133765 - DNA, 837 bp, Homo sapiens
tggtatccaagatttattggttggtctgttacatcacttgacgttcagggcaataaatccctgagccatagtagtgggactacaaagaaaacactgatgggagacagatttcaaaggaagaaatgatcaaaccgtttgattaaatgtgtagaagttaatgagaaatcagagggaaatagaaatatattgagcactatctttgttaaaggccttggtgataggttctctggagaaatcttagtagcctggttttcaggagttacaatctagttaaggaaacgtaactaagataaccaagtcctcttttgctttggtcattttgtatggacttacagcccttctagggcaactttacatactttagggttttggataacattttgtgtgtgtttgcacatgagttttacactttgcctgctattacaaaacaccaacaacctttgttttaggtatgtttcatttagttaactaagaatagctacatggagaaggaatgtttaatgtggtacacttcattaagtaacttcatggttactctgtgccaggccttatgcagtgaagagagtagactcagtatcttcaagaagatgagaaaagacaggaaaggaaatgattacagtgcagtgtggtaggatgtgatacagaagcacagtgttcagtgggaacagaagagggatacccacttacgatttggaggctgtgagtttgattcccatcttggccactcgaaaatcttgggtaggttatttaaatcatcttagatgaggatcccagtttcttcctgacaaagttattaatagtgcctaattcaaagggtaagtttaagaaacacatata

SEQ ID NO: 133766 - DNA, 268 bp, Homo sapiens
gtatgaagccacaaaagaccctgaatagctaaagtaatatggagcaagaaggacggaggtatcacactttctgatccaaattatattacacatctataataatcaacacagtatggtactggcatacaaactgacatacaaaccagtagaacagaatagaaaacccagaaataaaccccacacatacgtggtcaactatctttgacaaaggcatcaaggatacagaataaagcaaggatagtctcttgaataaaaggtgttgggaaaa

SEQ ID NO: 133767 - DNA, 450 bp, Homo sapiens
ttagggggtagggagatacaattctacctgtaagagaccctacaccaaagaacggtctggctatgggatcttcagctaatgggggctaagaaagacttacaggccagttgctaacacatcacaaaccaacatctggtgttgctgcatcagggaaggacttgcaaaaacatggactgagctaaaatagactgcctgtggatgacacaaacattctggataacatgtaacaaggagacaatgcagccaagcttcgaggaaaggaagggtcatttctagaggttgtaaatgaagagggaactagaaatgagagtggtaaagaagtaccagaccctggcagagagatgctgggcttcccatccccaagcacggacagaggacgtacttatgagtgagctgggaagctgcaactgaaatgtctgcacaaagctagcaatggctgccctttccaca

SEQ ID NO: 133768 - DNA, 386 bp, Homo sapiens
ctgccatgcagacaggggaaggggaatcttgggcagccccacccagaggcctggtggtcttcatgggtgggaagggggaacatgcacagattgcagagggatagaagaggccgacctggagacagtaactttagaggaggggttcatggggttcatgaactttgggggaagggttcctgccctaggggttcatggctaccacctcctgccttatccttctcatctgtccctctctcctaggaagtgcctaaactgaacacaggtgggtggagagaggagatgggagcagagcccattgcagttgcaggaatccagtgggtggtccctgggttggggtctcagatgtctccttttgcctctctctcagacacagatacacacaaaca

SEQ ID NO: 133769 - DNA, 218 bp, Homo sapiens
cgtcacagccctccctgcttatctcaagacagactctaggttaactggtgaatagagctttactgagctatgtgcagagaaaacacggaagattacagcacaaaaagaaacaacggaagcctgaatatcagacgtcattgttcagaaattcttcaggtttaatgcattctctggggtctcacagactgtcctttggtccttttctgtctttttttttt

SEQ ID NO: 133770 - DNA, 434 bp, Homo sapiens
ggcacctggcgccttgattcaacagtgctattccaagtcccagccaccctccacgcccagggttcccggagccgccgtctgtgttctcttcccttgcaactccacagctgggcatccgggacagagtgtgagccacccctcccctcatttcctttcttcccttcaccccagcatgctgggatcactgcatgctgtgccctcgggctacagtacccactcctgtccctctcccatcctacatccactctcacagagatggcaaaatctagctcagctgcaacccttttcatgaaacttttgtcattcacagctttaaaaaaaattgcttccttcctctggattctcaaagactttacatctttctcatgcaaagttttaactttctactgtggactactgttggacgttagtactgtaagctttagtcctgccca

SEQ ID NO: 133771 - DNA, 738 bp, Homo sapiens
cagagacacagcttcaggaagaagcaccctccatgaaaaaaagtaaattcaaaaatagaaacaacggttacaccagatgtggagatatcaatgtaaagattcaggaaacctaaacctaaaggaacacaataattcttaattattaataattaataataagatagatcttaacaaaaaagaaattatcagaatcccagatgaagaattcaaaatactgattttaaggaagctcggtgagatgcaagagacatctgaaaccaatgtaaagaaatcaggaaaacaattcagaatatgaatgagaaatcaaggagacagatattaaataagaaacagaaattctggaactgaagaatttattgatggaaatagaaaatgtattcaaaagcttccacaatagactagactacgtagaaaaaagaatttgagaactggaagacaaatctttaaaaataatccagtcagacaaaaatatataaaaaatatgaaaaggaatgaacaaagcctttgagaagtttggcacaacataaagtaactgaatttacaaattattggtgttcataagggcaaaaagggatcaaaaggtttagaaagcccatttaatgaaataatagatgaaaacttctcaagtataacaggagatttagatatccagatacaggaagctcagtgatccccaaataaatacaatgcaaaaaggactttgctatggcacattataatcagactgtctaaagccaa

SEQ ID NO: 133772 - DNA, 597 bp, Homo sapiens
cagtccagtccgggtgctttggctcatgcatgtaatcccagcactttgggaggccgaggcgggtggatcacctgaggtcaggagttggagacctgcctgaccaatatggtgaaaccgcatctctattaaaaatacaaaaattagccaggtgtggtggcatgcaactgtagtcccagctactcgggaggctgaggcgggagaatcgcttgaaccctggaggcagaggttgcagtgagccaaaattgcgccactgcactccagcctggaagacagagcaagactctgtctcaaaaaaaaaaaaaaaaaaaaaaaagagcaaatgcccagtctagtgagagagacagatccctccacctttccagacagtgacaacccagagtggtcagggctgtcatgacaaagcccagaggggtgtctgacccaggctggggagtcagggggagcttcttggagaaggggaaccctgagtgctgttgagcaagtcgtgcaaatgctgtgtgatgagagtatacagcttgcgcaggggcctggagtgaaatgaggacatgttctattcaaggaactgcaaatatgtccttaacttgccgggggaagtgg

SEQ ID NO: 133773 - DNA, 412 bp, Homo sapiens
aggctcgctcttcatgggtaggatgactgtacatctcactgtgtcacgctttatgcctgtttatgcctgttatcctggtacaatgatgaacggtgtccctctttcactctcaaaagtgcccaggtttaataagaaatatctttgtcctacttttagatgatgggacctgctgaaggattttaaacaacgaagggacagggtgagatttcaagttagggagatgattcaggaggcaggggagaggatagagggacaggagcatgcctggaggccagcttagagagaaaggcctgagcaaagcagtggtaatacaacggggtaagatagtgctcatgtgaaagctagcaaggaggtacagaccacagccgttggtgaacccatggctgtctggagaggggctagtgaggatagc

SEQ ID NO: 133774 - DNA, 244 bp, Homo sapiens
aagtaccggacacagtcccatgcattctctgactattcaggcagatgaggatttcagggccttgaattagcattctctggagggtgaggtttgcttgccctgaattagagttctcaggagggtgagtctgcaattggagaatattaaagaggcagtggcactaaagtaattttaacctacattccaaaatacctccttagttgttgagttgaaccattctctaatttttactatttgacaagca

SEQ ID NO: 133775 - DNA, 690 bp, Homo sapiens
cgattttggatcacaccagatccttatcacaaagatgacaacatccagattggccgtgaggtgaaaatatcttgccaagtagaagctgttccttctgaggagctaacatttagttggtttaaaaatggtcgtccattaagaagttctgagcggatggtcattacacagactgatcctgatgtctctccgggaacaacaaacttggacatcattgatttaaaattcacggattttgggacgtacacatgtgtagcatctctgaagggaggaggaatatctgatatcagtatcgatgttaatatatccagcagcacagttccacccaatctgactgttccacaggaaaaatcaccattggtcaccagagaaggagacacaatagaactgcaatgtcaagtaactggcaaacctaaaccaatcatcctttggtctagagcggataaagaagttgcaatgcctgatggatcaatgcaaatggagagttatgatggaacactgaggattgtgaatgtatctagggaaatgtcaggaatgtacagatgtcagaccagccaatacaatggatttaacgtgaaaccaagggaagccttggtgcagctcatcgttcagtatccccctgcagtggaaccagcattcttggaaatccggcaaggacaggatcgaagtgtcactatgagttgcagagtactg

SEQ ID NO: 133776 - DNA, 419 bp, Homo sapiens
atgctgtctcaacatgtagctcaggatgcttcaaactcctgggctcaaacaattttccctcctggcctttcagaatgctgggattatagggtcttgtcctctcttgatttccatttgcatggcatatctttttccattccttcaccttcagtctacatgtgtccgtacaggtgaggtgagtcttttattggcagcatatagttgggtcttgttctttttaaccattcagtcactctatgtcttgattaaataatttaattcatttacatttagagtaattattgatagatgagttaatactgccatcctgttaattgtttcctatttgttttgtagctcctttcttcctctcctatggtcttctttggtggttgattttctctagtagtatgtttttgattcctcgcctttttattttt

SEQ ID NO: 133777 - DNA, 335 bp, Homo sapiens
ctcagcatctccaagcaggtatctcaagctcagactccaaaatccaccccaccccactccacccccagctcattccacttcccaccaagctgatccttgctattccagaaagatgccagtgagtcttccaggcctttgcaccagctgtttcctatggccccccaccaggaggggctttccttggaaaatagcacccatcccctcaacacgctgtattcccttaccctatgtcacttctttcacagccctgaagtctacctgatgttagacttgtttttttttttttaatagagacggagtctcactatgttgcccaagccgatcttgaacttctg

SEQ ID NO: 133778 - DNA, 442 bp, Homo sapiens
ttgcataagcaaagtatctgcttcccccactgaagaagaaaaaaagaagctccaggagggcagggaccatgctattttggtggccacttgcatcctcactgtctagcacagcaggcacttaatgcttattaatatagcaatctttatgctactgacatagtaaaataatcatagcatacactaaggactatatatgtattcacttgtgtggatccaatctccctggaagtaagcattttttagaagatacatttactccttcaagttaccagtgggccttcctagccctagtgatctgaagagataatatagtttgccaaagagccaagtaaagtgtggtaatacaactcacagtggataataaacaaagatgctgtaacttgttgtatcacttctttctttctttccttccttccttccttctttctttttctttttcttt

SEQ ID NO: 133779 - DNA, 250 bp, Homo sapiens
cccctctccctggggctctgtccccctctctccctggctctctgtcttcctctctctggggctctgtccccctctctctctggtctctgttcccctctctctgggtctctgtccctctctctctgggtctctgtccctctctctctggatctctgtccccctctctctctgggtctctgttcccctctctctgggtctctgtcccctctcctctctctgtgtctctctcccccctcctctctctgtgtct

SEQ ID NO: 133780 - DNA, 410 bp, Homo sapiens
cacccgaggcttttggagacttctggcgaggctgtttgctctgaggccatgacttgagatatatgaggattttaggtaaaatagacaagtagaggcaaaatccatgttatgggggcagggacaagaaagttacccccaaacttaaaagggccacagggagtgatcagttttaaaagaaagcccctcagctgcctctctcagcttctcccaccaaggcctagaccaaaaaacaacagctttacgccaagtatggtggctcattcctgtaatcccagtagtttgggaggccaaggtgggagggtcgcttcaagctaggagttcgagaccagcctgggcaacatagtgggactctgtctctagaaaataaaaaaagctgccgggtggggtggctcatgcctataatccgagca

SEQ ID NO: 133781 - DNA, 124 bp, Homo sapiens
aaaaatgtaataaacatccaaagccattccattgagagcaaaatgttctttggaacttctgaacatgcctctgcttgaagtgcctcccttttcctccctctctccctatccttccttggtgtag

SEQ ID NO: 133782 - DNA, 178 bp, Homo sapiens
attaccatgttgaaaaaaaattagcagtaaagatatacattgaacatttaacagaattttgctattactttgataatatcttaataaagaacatagaaacatagggctgatagaagaagtgttatatgtaattgtcccactgtactaagtcatatagtacaaaattaacactgaatcc

SEQ ID NO: 133783 - DNA, 590 bp, Homo sapiens
gactacagacgcacaccatcaaatccggctaatttttgaattttcagtagagacggggtttcaccatgttggccaggatggtctcgatctcttgacctcatgatctgcctgccttggcctcccaacatgctgggattacaggcgtgagccaccacgcttggccgttttagactcttgattcttaatgacctttcctttgcctctaatccacgggttctcatggggggttattagaaattccatggagttttaaaaaactgcagatgtccaagtcttacctagaccttcacagcttgagactctgggattagggctgagtatgcatacattttagaaaatatttactgaggattctgaagtgatctcttggttaaaaattccttcctaatctattcatcactgatttttttattttttttttttttttttgagatggagtttcactcttgttgcccaggctggtagtgcaatggctccatctcggctcactgcaatctccacctcttgggttcaagtgattctcctgccttagctgctgagtagctgggattacaggcatgcaaccaaacccggctaatttttgtattttt

SEQ ID NO: 133784 - DNA, 285 bp, Homo sapiens
ttcagagagaaaagcaatccaagcatgcccccagtcactgaggcaccgggggggtttctcccagcttggtaggtgtatgctgtgagccctggactgtccatgaacagagctgtagaagacagtggtcaatctggcagtggtaatgagatcctatagtgcttcctgagtatgagcttcctcagttggatcaaggtcaccatttgaatgaagctggcataacagggcatacaagacaagcagtgctcaagtttgaggggtttgcctggatttgctgctgacttgctg

SEQ ID NO: 133785 - DNA, 276 bp, Homo sapiens
ttgaaggaagtaaaatttctcctctatcttcttagggtttccctttgggactgacataaaatagattactacttgctagaaataaaagactttacgtgattacaactcttctggcactgccttcatttcctggttattacactttaacctttaacataatttagctcctgtcgtactttcatgtatgtgatgacgaggtacttttgtaaacagtgttccacagtactccacccttggtgtacaaaacagaaacgcaacattgctgaagtttcataa

SEQ ID NO: 133786 - DNA, 236 bp, Homo sapiens
ggagaggggaggaaagaaggcaggagagagtcagggcctccattaggaaaactggctgtttgctgaagtgacagaccagaggcagcaaggaaaaaagaagaagaaaagcccataggaggcaatggcaaccttgccgagtgaatcaagacagaaaattaccctagtgtgcagaaccttgttgaagaggtaaccgttgctagctttcaaggtgtttctgaaaaggaagctatcaccct

SEQ ID NO: 133787 - DNA, 310 bp, Homo sapiens
tagtttttgacagggatgacaaataagagggtgaccccggatactgtagtgccaattttatagacatgctggtgaattctagtgcattttatttttatggttagcagaagtgagatgaataggttttatttttcacctgccattcctttaaaaaccagagtataaatttcttagtgtctgagccattccagtttaactactgtagtgttcatgtaacctaaaataatttcaaagcctaatacatcagaagaaaaatgccctaatttattttttgtctgattccccccttcccctgtttatttcttccttt

SEQ ID NO: 133788 - DNA, 388 bp, Homo sapiens
ctgcattcaacgccctcccccagccccttctatttaccaggagacctctctacacacacacattgcttgaaccatctctacctgttcagttgtggactaggtaggtactggggcaacactgtgtgaacatgtgtcacacagcactcatgccctagaaggagcttccatggcttaggaagggatgacaagactcgtacaggaaaatctgaacaccagcccaggcaaggccataaaagggcatatcattactaccaaaacaagggcggaagagaaagtgacctcgtttaattcttgatccttctactttctgctgatgcccttgggctacttatttgctctgggcctcctcagttttttcatttagaaaaatggcttgggctgaggcaca

SEQ ID NO: 133789 - DNA, 547 bp, Homo sapiens
taaaactttttgtggtacagaaaccttttggtatgctagtgcagccagcctttgttagggcatgagcttattaactatttgtttctgggaaatgtcataagaattgatgacgatttggaaagaaggaacaaattcaagttctctacagaaattaattgctgttaaaaatgtgtcacatgctgggcatgatggctcacacctgtgacctcagcactttgggagtccgaggtgggaggattgcttgagcccaggagttcaagactagcctgggcaacatggcgaaaccccatctttataaaaaatacaaaaactagccaggcgtggtggctcatgcctgtaattctagctacttgggaggctgaggtgggaggatagcttgagtctggggaggttgaggctgcagtgagccgtgattatgccgctgtcctgcagcctggccgacagagtaagaccctctctcaaaatcaaaaacaaaaaccatagtgccacataattgttttcaacttcagtttcaatccttgtgttttctacagtaaaattgtaggtg

SEQ ID NO: 133790 - DNA, 275 bp, Homo sapiens
atccatcctcctcggggtattcctttaatcaatgtttattaatatgaatgaatgctttggctaacttgtacaggtcatctgccacttttaagtactccattcccacctcatgggtgtgtttcatctctttggtacagttgcatatttcctgaagagtctcattttgtgtattgcttctccactacccctcaccactggacagacaactggccagctgtcactcaaatgctaattgtgtctatcatctgctttctctaatagccttttccttccgc

SEQ ID NO: 133791 - DNA, 352 bp, Homo sapiens
tgcttcaaaggaagctgatgtatggagcgtgtgtcaccttcctctacaggaatggggtttggcagtgatccaaagactcactgttatgacatgttctcagggaagtaggtcatatgtccccagggtattcagagaggcctgtgagtgtgagatgtttgggctgagcagggctttcttcctctcaaggctccaaagggcgggccaacaggtcatttggtttttctcagtgatatgttttcctcctcaagattcatcacccctctctcctcctctgcttgttctgaggcaaatggacacagaaatacattctctgttttatccttcatcgttgctaacccctgtggggtcgctg

SEQ ID NO: 133792 - DNA, 466 bp, Homo sapiens
atgttgtgcctttataggaaaggaagggtgtactggaactctaaaacactctactgctaccccaccagctgatcggtatgcaaacaaggccagcgggaagctgaagcagatgagatcaggtaagaaaatcacgaagtgctctaagccaaagtgaggtgttgagagcaaggttgtctatactgactctgatgaaagctaactcagactcaaagtttctccttcataaactgcaatcatccttcctcctctattttccctgacaaaatcctcacctttctgccaacccacgaaggggacccccaagcgacactgactctagaagatcatagttaagatcactctaagatgaccttgaaggaccttgctatctgggtaggctcacaggtcagctggtgaccaagcacttgacccttgagattcatgatagagatggcagaaaggaaattgggaggtcgttttgggtcag

SEQ ID NO: 133793 - DNA, 659 bp, Homo sapiens
gagcaaaataaacctaaacagttaagtcgttggtatttggctcactattacataaagccaagcacaatccttactgatcagatgttcttacagtattctaagtctgagatgataaaacccagggaaaatactgagcacacaatggacttcaatgctgaataaatacttgctgagtgaattaataaatggattcctgaattcatagtaattctcatttctgttcctagaagtagaaaaaataagatgtatacaacatatacttcaaaagaattggaagaaattgttggctaactccatgtttgagggagacagataggttaagtacataccatggagtgctttgaatatcagattgaaatgttttgcttaagtcagtgagcaatagagagaagttggtgtttgtgcagctagacaatgacttaaacaggtgtgcctgaaagttcagatccgttttagtctgaagctctcagttgtgctcccacatcgataatagtcatctgtaattatgtgatcttcaaacataaatattatagttacattttacctgttgtattataatgaggacctattatctcattatttagtaaggaaatatctgtactatgtagtatcacccattgttttcagaagctacaattgttattgattatatagaaggg

SEQ ID NO: 133794 - DNA, 319 bp, Homo sapiens
gtgaatttcataagtgaatgtcggttccttttcttgccttttcaggagtgtcctcttagaacccattttccacttttttggttttctttgtatcccgtaaaagagtttatctaatctcaacttctaagaccttttttcttgtgtatttttgcagcttgcctccaaattgatatgtctgacacttttaacctagttgaatattttacttgacaatatagcagtaccagtgagatagttcacttccttctttctcagaatgtctgatgataaactgtgcatgttccaaaatcatgaattctgtctaccttcctcacctccc

SEQ ID NO: 133795 - DNA, 589 bp, Homo sapiens
gatcatcagagagaagtataagtagttattgtttagtgagtacagagtttcagctttggaagatattaaaaagttctgaagatggatggtggttggtgatgattgcacaacacaacattttgaatttagttaatgtcactcaactgtacacaaaatgactaaaacagtaaagttgggctatctatattttatcacaataaaaaatagtttagaaaagtcactaaagaaagaaacaactccaacccacagcaagcagcaaaaataaaccccaagcagtggcaagaatctggtttctggagttaccacataataatattcaaaatgtcttgttctcaacaaaaaattatgagtcatgagaagaaacaaaagagtatcccactcacaggaaaaaaatgaacaactctccttgaaaaagcacagatattggatctactaactaagactttaaatcaactcttacaaaacgggtgattaccagagcctgggaaggataatgggtagggaggtggagggggaagtagtgaggcttaatgagtacaaaaacataggaaaaatgaataagatctagtatatgttagcacaagagggt

SEQ ID NO: 133796 - DNA, 130 bp, Homo sapiens
acaagctggggcacaacagtttgcagactttacaatgaggcagacgtgatgctgactttttatgcatgttacctcattaagtttgttccctgcaacacacttacaccttaggtattgttactttgttatg

SEQ ID NO: 133797 - DNA, 885 bp, Homo sapiens
tgggggcctattctcgccgcgcagggcgctggggggtcctgagagagggagagcctggggctgcgggcgcgcggaagggaatgagccgaggggcgcgcggcggcgacgcgtccggcgaattttgaattgcccccctgggaagtttcgatttatcttttctgtactacaaagaaagaaagcgtcatatccactctaccaaacttctcctctacacacttgaatctattacagcgttttggtgcctaagagaattttctgctcattgggttgtttgagggcagagtctgtgttttatatgtgtatctctagtacccgactaactgcttaacgtggaggaaaaacccccgtgtaaatttgttgaattggggttttgaatggtagaggatacagaaatttggcttcttggtagccaaaaacaaaacaaaaaaacaaacacgtgctttgaagtctctgtccttcctgcagtgttaggcagaacaaacgtgggtgccagattctaatggagttgtctggtccagggagattagcgagaggctggggcacgggctcaggagtctaatcaagataggaaataaatcgtgtgcccgaataattctctgaattcagtaacgggggacagttttgctattaggccgctaatagtgacatactgaatacggagttctacaatatggttcggtaccgggtgtacgggtgcttcccgcattttgagcctaaaacttatggagatcttagggtcccgtcttgaaggttggtcacggactgccaacacacatgtggggactcggcttaccgggattgagactgacgggggccatgagatccggaaagggaggagtggcaaatggcatggggacaccgggtcaccgtcgggggtgtcattgg

SEQ ID NO: 133798 - DNA, 564 bp, Homo sapiens
agatttaattgactcacagttccacgtggctggggaggcctcaggaaacttacaatcatggcagatggcacttcttcacatggcgggaggagagaatgagtgccgagtggagggggaagccccttataaaaccatcagatcttgtaagaacttactattgtgaaaacagcatgagggaaaccgcccccatgattcagttatctccacctggtcccacccttgacatgtggggattattacgattcagggtgagctttgggtggggacacagagccaaactatatcacagtggttgccaggggttagggatattgggggaagagggagagtttgagtgcataaggattacatgagggagatcttcatcatgattgattggttctgtactttgattgcagaggtggttgtgtgaatctacacatgtggtaaagtgatgtagaattatatatgcacattgtaccaatggcagacttttggctttgatattgttctataattatgtaagatgttaccattatgggaaactggaggaagggcatatgggacttctttgtactgcttttt

SEQ ID NO: 133799 - DNA, 666 bp, Homo sapiens
actgtaaaacatttgagtccaggccagaacatcatctgaactgtactaattgagaacagcaaaggagacataaacagagggtaataggcaagtagagttcccaccttctaactttcccactccctcttcactcagcaagaaattatgatttaggaccgagtaaaataagtgtttaaaaataatagagctttaagtgctaaggaacatagaatgagatatattgaagctgaagagttcagatgaggtatcttttaggaagggagcatttaagctccatgaaaaagttaggatttcgacagagattgaacgtgggggcatttgatggtgacaaaggagaaattaagagcaaaaaatacatggcctatttggagaatgaaaagtagtctgtgaaataggagtccagggtctgtagttatgcagagaggcaagggaacgagcagtaagacttttggaatcgattggacaagcaaaaatatacagtattttatttaaagatacatacctatgtgataactattttttaaagcaagggaattatgcatacaaaattcaggatagtggttacctcttgtggaagcatggggataagtcaaggaacacggatagattcaaggcatttagtagtaatctagttcttaagatgggtggtaggttcacgggtgacct

SEQ ID NO: 133800 - DNA, 893 bp, Homo sapiens
gccgaggagcttcgcgcaggctcagaatcgctcagctggttgacgttatccaggagaatcgcgttggactcagggaagacctgcacaggatccggttgttgctgggtccgagggctgtagggagtggagaaagggccgggaatcgttaagcggggtctgggagaacgacttgcagattcacatttcctccgcccgcggatgtcctccggggaattgaggcttccttcctcagctgcccttgtttctctctttgctcccgctgccccttgttctatttcgtttcttactatttatgtagtctcattgcttgcggttataatggccaccactttattgagcattcactgtacaagcatctcgcagcaggcgctcataagcgtctggcaattcttggccactgctggaagcccaatcattcttttaccatggaagggatttgagagcctacataatcctgtactctaatagccacatggtactcttggggctaggaagataaagtagaaattgaaattgctgttgtattagttttctgaagctgccataaccaagtacctcacactggatagcttaaaacaacagatatattttctcgctttctggagtctggaagtcagaaatcaagatgtcagtggggtcttgcttcttctgagactctggatagaatccttcctgcctcttcctagcttctagtgggagccagcaatcattggtgtactttcgcttgtagctgcattactccattctcttcctctgttatcaaatggtatactccctgtgtgtctctgtctctgtgtgttttataaggacaccagtcctgttaggtaaaaggctcaccttactccagtatgacctgatcatgactaatcacatctgcaatgacactctttcca

SEQ ID NO: 133801 - DNA, 122 bp, Homo sapiens
gtaagaatttacattttaggtacgttaggtttattcctttttataaggtttctgtttgaaattttgattttagaagacattcattctcaaggacgtaaaacacacatacatctaattttttt

SEQ ID NO: 133802 - DNA, 192 bp, Homo sapiens
tttcagataatcctcaattgcttcacgatggcccacaggctgcaatttttttagaatcatatttccacaagcaaacttgaggactttttaaaagtaaagtgccattaatcttagcgtttatatacttttgaggaatttaatatgtgtaaaactgtgctaaaatttttattgtgtgtgtgtgtgtgtgtattt

SEQ ID NO: 133803 - DNA, 340 bp, Homo sapiens
caggatgttgctctcaggagtgtcagcaggccatcttaatggggggctgggccagagccttggggtgctccctctgtggggctggggacgtcttgtctccatggacattccctcttgccagccatcgccatctggcacctggctcagcttcccccaagccaaggtaagcccgacagcatttccaccccagtgttggctgggagccttttcctagtttgtcctcatcagacctaagctggggtgcagtttgctagtgatcacattttagcaggacaccgtcaatcgtaagtgtacccagaggagatttataaggacaaagcctgaagccaggtcacatggg

SEQ ID NO: 133804 - DNA, 112 bp, Homo sapiens
gaaaccaagccactgagggtttgttatcttcctcaaagtctgagactgatagtggcagagatgggatgagaagtcaggctttctggctccgggctctggtgtttgtggctgt

SEQ ID NO: 133805 - DNA, 832 bp, Homo sapiens
ggaaggctccgtgggctcagcactggtcacagtctggctcttcaccctgctccatgccaacatctccaacaaacttcctgctagaaagcctgggtgggctgaggggacccagacccaaacaagaaccttcttcccctcgccccttctcatctcttttgcaagggcaacctgagtgacctataaccatgtgtgtcaggtcccaccctttgcttaaaacctccctgcggagggaggggcagcccttggtcttaaagtgcaacccagacttcccctggccggcgagaccctgcagatccccctgccaattcccttctccagccactctggctgtgttctggggattctctcggcctggaacattctcaagtagctggcccctcttatctttaggtctctgctggaatgttctctctctggaagggcctccaggagccccccactccagggggctcactgaaattctccagcaagatagcctgtttattttcttcttggtgcttatgaaactctttgatgtttgttcacgtggaatttttctgactcttctctggaaaatcagctccacaagggtgagagcctcctctgttctgttcaagtgctgtctccttgcatatgttaatattaaataacattaagacagccacatgtggacagcaggaacctatgggatagatcagatataaaatgtttctatcacggcagaaagttctattgggcagcgctgatttgcctcagattcttgaatgaagcaatgactcaacaagtgaccccagcgtccctacaactcatgctcacctgctgggttgagattaggctctgggctgcggacccc

SEQ ID NO: 133806 - DNA, 419 bp, Homo sapiens
gtttttaggattcttctaagaagtctttaaagactaagaagccacagcagatactactgcctgaaaagataaatgaacagctggccttgttggagacacacctactcaaactgacaaagcaatatgttacatctgaactctcaggaggagaggaccctatatttctttatcctgtagttttgaattggtcggtcaaaggtgccgtgaaagaagttatgaaatttaagcaaaaaccaagatttctggaattctttacacaagttatgctaaaatgcatgaatgaggaaaaatttcatcttatggtagaggtaacaactcctgtccatgacttcttgaaaaggagaaatgagtctctacttggactaataaaagtgaaatataaggatagtgctttgaataaaaaagcaaacaaatcttta

SEQ ID NO: 133807 - DNA, 107 bp, Homo sapiens
actgaatgctgttttgattttgttttgttaaaaacaatgtttttgtggtggtggttttcttcgtgtaagttaaacattaaaaaaatactgcttatcatgactttact

SEQ ID NO: 133808 - DNA, 1218 bp, Homo sapiens
atggactctcttgttacagcaaacaccaaattttgctttgatctttttcaagagataggcaaagatgatcgtcataaaaacatatttttctctcccctgagcctctcagctgcccttggtatggtacgcttgggtgctagaagtgacagtgcacatcagattgatgaggtactacacttcaacgaattttcccagaatgaaagcaaagaacctgacccttgtctgaaaagcaacaaacaaaaagctgggtccttaaacaatgagagcggactggtcagctgctactttgggcagcttctctccaaattagacaggatcaagactgattacacactgagtattgccaacaggctttatggagagcaggaattcccaatctgtcaggaatacttagatggtgtgattcaattttaccacacgacgattgaaagtgttgatttccaaaaaaaccctgaaaaatccagacaagagattaacttctgggttgaatgtcaatcccaaggtaaaatcaaggaactcttcagcaaggacgctattaatgctgagactgtgctggtactggtgaatgctgtttacttcaaggccaaatgggaaacatactttgaccatgaaaacacggtggatgcacctttctgtctaaatgcgaatgaaaacaagagtgtgaagatgatgacgcaaaaaggcctctacagaattggcttcatagaggaggtgaaggcacagatcctggaaatgaggtacaccaaggggaagctcagcatgttcgtgctgctgccatctcactctaaagataacctgaagggtctggaagagcttgaaaggaaaatcacctatgaaaaaatggtggcctggagcagctcagaaaacatgtcagaagaatcggtggtcctgtccttcccccggttcaccctggaagacagctatgatctcaattccattttacaagacatgggcattacggatatctttgatgaaacgagggctgatcttactggaatctctccaagtcccaatttgtacttgtcaaaaattatccacaaaacctttgtggaggtggatgaaaacggtacccaggcagctgcagccactggggctgttgtctcggaaaggtcactacgatcttgggtggagtttaatgccaaccacccttttctctttttcattagacacaacaaaacccaaaccattctcttttatggcagggtctgctctccttaa

SEQ ID NO: 133809 - DNA, 1278 bp, Homo sapiens
atggactctcttgttacagcaaacaccaaattttgctttgatctttttcaagagataggcaaagatgatcgtcataaaaacatatttttctctcccctgagcctctcagctgcccttggtatggtacgcttgggtgctagaagtgacagtgcacatcagattgatgaggtactacacttcaacgaattttcccagaatgaaagcaaagaacctgacccttgtctgaaaagcaacaaacaaaaagtgctggctgacagctctctggaggggcagaaaaaaacgacagagcctctggatcagcaggctgggtccttaaacaatgagagcggactggtcagctgctactttgggcagcttctctccaaattagacaggatcaagactgattacacactgagtattgccaacaggctttatggagagcaggaattcccaatctgtcaggaatacttagatggtgtgattcaattttaccacacgacgattgaaagtgttgatttccaaaaaaaccctgaaaaatccagacaagagattaacttctgggttgaatgtcaatcccaaggtaaaatcaaggaactcttcagcaaggacgctattaatgctgagactgtgctggtactggtgaatgctgtttacttcaaggccaaatgggaaacatactttgaccatgaaaacacggtggatgcacctttctgtctaaatgcgaatgaaaacaagagtgtgaagatgatgacgcaaaaaggcctctacagaattggcttcatagaggaggtgaaggcacagatcctggaaatgaggtacaccaaggggaagctcagcatgttcgtgctgctgccatctcactctaaagataacctgaagggtctggaagagcttgaaaggaaaatcacctatgaaaaaatggtggcctggagcagctcagaaaacatgtcagaagaatcggtggtcctgtccttcccccggttcaccctggaagacagctatgatctcaattccattttacaagacatgggcattacggatatctttgatgaaacgagggctgatcttactggaatctctccaagtcccaatttgtacttgtcaaaaattatccacaaaacctttgtggaggtggatgaaaacggtacccaggcagctgcagccactggggctgttgtctcggaaaggtcactacgatcttgggtggagtttaatgccaaccacccttttctctttttcattagacacaacaaaacccaaaccattctcttttatggcagggtctgctctccttaa

SEQ ID NO: 133810 - DNA, 329 bp, Homo sapiens
tgtgatttgttcaggcaaatacccatagccttttatttgataaaaggctgtaaggttaaaagtattggtttagagcaaaatggattagacttctgtctagggtttggctatttgttatatttgttacttgcaagagaagcataactctgtctgttttaaaaagagtgtgtaaacctatggtgtacttaataataattcaactcagctatcccttggacactgtggaggtccactcttttctcctggatgtaacttacagatctgttagaactaggcttcttttagcctgatttctcccccaaataccgggcctcacactttccctccag

SEQ ID NO: 133811 - DNA, 129 bp, Homo sapiens
ctaaggtattaatgatagttgatcacatcaaattcaagagtaaaaagttcatttagacatcagaaaaccttctggtgggaagatacttgaaaagacatcaatagcaggtcactggctgaaaagcagagg

SEQ ID NO: 133812 - DNA, 210 bp, Homo sapiens
ttccttcttctaattcttgatgaaggaaaggaaaaaagtgcatcgcaatactgaaatttaatcactagtctaaaagtctttaacagtcttcacaaaggcattaaatacttttttctatttttagtaattgtatttgagttgctgaaacactgaaagcatttaaacagtttcttcatccttcatttccaaatataagacaattttttatga

SEQ ID NO: 133813 - DNA, 210 bp, Homo sapiens
ccagctttgtttgccttccatctcaaaacttctcactgttatctgttcttctccacatacaattgcaggcaatcatatgcctcttcaaataccacctggatgcagatgcagatgcagatgatgccaaacttttctatctactttgacatctaagtttgatactttgtcatcatttgctgagaggcatctcctgactgtgttgcagttcta

SEQ ID NO: 133814 - DNA, 703 bp, Homo sapiens
gggaatgagcctcattgtgcaagcctctatgtgcggtgtttgctaacatctcattagccaaagcaagttatgtggctgggctcagactctaagttaaaggcattcgagttacatgataatggaacatggatacagagaggggagaaattgctggccttttttatagtcaatttaccataacatccagttgtccaagcaccattcataatatagttcattctcatcccagtgatacataatttcccctctgtggaatgtcaagctcgcatatttatgggagtatttctgtactctctgttcttttcctatcctaacaccaatcccacactatcttaatttctgtgtttttaaaataagtcttgatgttggtaggacaagtagtccctggacttcattcttttgaagccatcttgtttattatattaattttaagcaactagaggggatggaagaggaacctttagattaaaagagatttaaaagatagggtattttttaatggacaagactaaactacagtgtctagggatgcacattgggtgataaagctattttaaaaaacaaagaagtgatgagtataaaagtcagggtcatggttacttgatccctcatgggtaatgttgtcagatttagaaaaaaaaaaaaaaacaggactccaaaactcccagttgaatttgaactttagatgaacaatgcataattt

SEQ ID NO: 133815 - DNA, 327 bp, Homo sapiens
tctaacgatcccttatatgctgctcatgtgcaagccttagctcacaagattgttgtaagaatgattgagaagatgtgtatgaatgtgccctgtaagcggtgaaagtaatgtctctaagcttctttgtgtttaggatgtcacttgtgctgaactgtaacacccaatgttgtattttgggttgtaacttgtgctgaagtacaacatccagtgtttgtattttctataaatgactatgcattcataggaaagagaaacttaatcagtggctttattaagactcatttcgcacatatgtaatttagaaaaagaaaactgactctgtttcac

SEQ ID NO: 133816 - DNA, 368 bp, Homo sapiens
cattgacttccccacccatgggtctggtacataataaggaaaggaaggaaaaataagttgaaggaaggaaaaatgcgtgatcccctgttgggcttctctccctcacagtcatagattttgaacgtcagagcattcctatctattttccaaattgcccgttggattgccttttcacaacaaccttaattttcacactacagggactggaaatgatactttagttgggtcaaacattagactacacaagggttttatagtcaggtttgggatttgaatgtgtttacgtagtctgtctgtattattttccctggcaaggtgtctggtgttgagttccttggggaacgagaatgtggctcaggacagctcac

SEQ ID NO: 133817 - DNA, 482 bp, Homo sapiens
tgcccatcgaccaatgagtggataaagaaaatgtggcatatatacaccatggaatactactcagccatagaaaggaatgaaataatgtcctttgcagcaacttagaaggagctgaaggctcttattctaagtgaagtaactcaggattggaaaactaaatattgtatattctcacttataagtggaagctaagctatgaggacacaaaggcataagaatgatataatggactttggggactcagagttgggggaaagactgcaggggttgagggataaaagtctacatattgggtacagtataaactgctcaggtgacaggtgcacgaaaatctcagaaatcaccactaaagaacttatctatgtaaccaaaaactacctgtaccccaaaaactactgaaataaaatgaatcaatcaatcaataaaaagcagccacaggatactgctatcctattaacgtatccactaaaagagaagtatct

SEQ ID NO: 133818 - DNA, 169 bp, Homo sapiens
aaacaacaacaacaacaacaaaaacagataaggaatgagaacgtgttagatttcttctagttccaaaattctgtgctctgtcttatttagaaaatccaccggtagtacttgcaattttgaactctctggaattttcaattacttggagacagatcaaatttattgagac

SEQ ID NO: 133819 - DNA, 745 bp, Homo sapiens
agctgcaagatctgtggtaactcatttaggagagctctggcatccgacccgggtcccccaatgccactgcacagctattcaccaagcagaagaaagaccttggcaactctcttcatctcaccaagcctcggtttcctcatcagtgcagtgaagatagtaatatttcctagctcatgatgtcacaaaaattaaattagataattcatgaaaagtgcttagcagagtttccaacacatggtaatcactcagaaaacatttgttagtattatgattattacatacaagtaaattaggtggtaatactgtcccaagcaacctacagattcaatgaaatccctaccaaaatcccaatgaaatttttgcagaaatggaaaaatccatgctaaaatttacatggaattttgagggacttcgaatacccaaaacaatcttgaaaaagagcatagctgtagctctcagactttctgatttcaaaacttactataaagctacagtaatgaaaacagcatggtactggcataaagatagtcaaacagacaaatggaatagactatagagcccagaaataaatgctcacatatgtagtcaaatgattttcaacaagagtgccaagaccattcaatggggaaaggacagtcttttcaacaaatggtgctaaggaaactgtaagtctgcatgcaaaagaatggagttgcactcttacctgacaatatatacaaaaattaactcaaaatgaagcaaaggc

SEQ ID NO: 133820 - DNA, 387 bp, Homo sapiens
aaaggacaaaaaccacatgactatctccacaccattaaaaaaaaagtatttgacaaaagtccacatccacacacattcatggtaaaaacattcaacaaactaggaaaagaaagcttccccaacgcgataaaggacatctgtgaaaaactcttggttaccatcgtacttaatgggaaaagattgaatgttttcccccctatgatcaggaacaagaccaagaaatccactatctccacttttatttaacattacagttaaagtgttagcccagaaattagacaagaaaacaaaatcaactggatgcagattggaaagaaagaagtaatagtatttacttgcagatcttgtatacaggaaattctaaggattctgctaaaaaaaaaaaga

SEQ ID NO: 133821 - DNA, 507 bp, Homo sapiens
gtgtgtgtgtgtgtgtgtgtgtgtgtgtagaaatgggatctcactattgttgtccaggctggtcttgcacacctgagctcaagttctcctgcctcggccctccccaatgtgctgggactacaggcatgagccaccatgcctaaccctctaagactttgggatacaaaaacataatttactttccttcatttctggaataaaacatctcttcttcctccccctactttctgttctgtgcccctgtttgatctctgttggtcctgttcaccttcagccttctctgctgaaggaggaaaggcttggttttataaaaagtgacaatattcagaccacataagatccttcttgcttcattttggattaaatattttaagattttctgattttcttgtatgcatatgtatttacctattatttgactttattgaataacttcaaattgagtatatttgaatgggaatgggcattaaaaagtgctaagctttccctgcctttcagaaaaaaaaa

SEQ ID NO: 133822 - DNA, 1042 bp, Homo sapiens
tgcaaggattagcgttgcccgctgaatctagacctgatggattatcataaagaagacaagtttgcatatctgaattcaattaacagtggtacttgtttgtgatggagttggggtttcatttaactccatctcattaatttatgcaaggaccaaatttgtttagtgtagtttatttgttagaagaagctagcgggcagaggattcatcaaaataataaccaaaacactcagaaaaatcaatagctacttttcaactcctgatctttgtcctcacccagagtgagttctaaacaaaattgtgcaggttatcattcctggatttcgcgctccctctcacacacaaatcctgaagagcattatcatacccattggttcgttgtgcagtggatcaccgaggcatttctttatgtgtactctttggcctaccattccgttctaatggacagtcatagttcatagtgagtttgaagtctttcttctagttaatctgtcaatttttctcacacagtgcagctgctgtgaaagaaattggagctgttacactttgtgctttggtacagtttgtaaaatgctaggtaggagacaggaaaccaaacacagcatgctactaatttcttaaacgactgatgtgctggaactcagagtctgtgtcccagagagctggcatccctttttttctgagaagactaacgtcgtttgaaagtgttatcttacttttgcatcaacgatatagatgcctttggtatgacttacaggattcaacagaacacttagtcttttgtctgcattttccccattgctttgtatttctttagatttaagttataattaacttgaatattaatcttagatggcatgatttgatatgttaaaacgaagagtttaagacgccgagctctgtggttctcgcctgtagttccagctacttggaaggctgaggcagcaggactgcttgggcccatgatattgaggccacagtgtgtgatgattgcaactgtgaataacttctctagcctgggcagggtaacgagaacttgtcccta

SEQ ID NO: 133823 - DNA, 199 bp, Homo sapiens
cccgagtagtccgacaggactcttagcggtggatcactcggcccgactagcccgacagtgagtaggggtcagatagaaagggctacattaaggaagaggtgctccgactgggagcctttggggagtcttcagtaggaagcaatgtggctagacattacttaatggaaaagtcactggggctacagttgtcagaatgggg

SEQ ID NO: 133824 - DNA, 680 bp, Homo sapiens
ggtcagttcctttgatttctcatttttcttattcccctagatagaatgatgagaaagtttagtatttttagctttcttttaaacagctttatattctgggtggttttaagccaccccaatttctgatattttaaaagaatcctggtgtttattctagataagacacctactatataaaataatattttatgttgatgttcaacaggaaagggacactaatcagtccacctgatttatttagcaaatattattaccttctactgtgtgccaggcactgtacttgccactgaggataacagcaatgaaatatgttatcagaggagctccactgcctagtgaagaagatgatcaagcacactcagacctgtgttggttagtcaatggaattgcttagtaaattatttcgggtccctgcagtacggtctttttgatcttctagtgaatacatccctggtctgagagttagaaggttttcataccatttctttctgctggcatttcatctttcatcatatatttaatacagtataatcttgagtaagccatacatcatttttataaagttagtaatgtctgttacaacatattatgagatctttgggacagaaatgctgagtcaacagaaacattatcctttcaacaaacatgcactgagtacgtatgattgaagcactatgtgt

SEQ ID NO: 133825 - DNA, 603 bp, Homo sapiens
  misc_feature (584)..(584): n is a, c, g, or t
gacattagctgtataagctgatcagctgtagcacaattgttgggggtggcaggggagagagagagagacagacacagagagcagaaatgtaagtaagttgggcattgttaggaatatagaatgatgtgataaaactatcagatttttttctgtaggtcagaaaaaatctctaaaatgattgagcatgaaaatgacaggctcagaaataattttataaagataactgaaaaggagtggcagaaaataagaaaaaaaaaaaaaaaagttgggggcgcgcccgcgggcccccggaaaggtttttaaaacccttcggttgggggggcgcggggccgccgtgtatgtgttatctgttggaaccgtgtggtcccacaagcgggtccccagagagaagaaccgggcgaccgaggaacatgggtgctgtggcgtttctcctccaccaaatataaaaaaacacggccggggcggaccccgcgggctttctggaaccaactccccaaacatgggagatcccggaggccaatacgggactcctaatacaacggggttcaaggcacgctcaatatcaattcgcgcgcgcggggganaaaaagaaaaaaaaacaga

SEQ ID NO: 133826 - DNA, 375 bp, Homo sapiens
gccggttgacgtggcttactttggaggtccaaggtgggtggatcacgaggtcaggagattgagaccatcctggccaacatggtgaaatcccgtctctacgaaaaatacaaaaattagccaggcattttggtgcatgcccgtactcgggaggctgaggcaggagaatcgcttgaacctgggaggcggaggttgcagtgagccgagatcatgccattgcactccagcctgggcaacaagagtgaaactcttgtctcaaaacagacaaacaaaaaattactcttaaaaagcaaataaataaaaagaagcagattttgtagccaggcccatctgggtttgaatcctagttctgcttattcctaatgtaagccacggtca

SEQ ID NO: 133827 - DNA, 188 bp, Homo sapiens
agataagtaaattggagttacagaaaaagaagagaaagatgaatgacacataaaaagatctgaagaaagaacagctaaaggttttcccctcaaatttggttaaaactataagtttacggattacgtgtttcagtgaaccccaggcagactattaaacacacacgcacacacacacgcacacacgcaaa

SEQ ID NO: 133828 - DNA, 717 bp, Homo sapiens
ctagacctactcgttcacgtgagcggctgatctcatgttaaagtgattatctgtaccttgtgtgctataccactggcttccactagtgagcatccatcggttcatagtagcgtatgtaagctatgtgatttcctactagctaattatatatcgcctagtgtgggtaatcgcaagtcgttcctgaccaagtccagatggactgtctgacgtctatgactagtgtatctaatcagtcgcgtggagtctaagctgagtcttgagatcattattacgcgccacgctgcttcagcacatgctaatttatgcaatcatcatcactaccaggatagagcacagttccatcactccaaaaacctcgctttgaaattgtattctctactgctcttagtccctggaagctgctgatctgttctctatcaatgtagttttattctttaagaatatcttataagtggaatcatacagtatgtaatgttttgagattggcttatttcaatcagtgtaattactttgagattcacccaagtcattgcatgtgtcaatatttcacccctttgtattgctgagtagtattctactgaatgggtatgccacagtttgtttacccattcacctgttgaggaaaaacaaccagttgagggttttggctatttccttgttttggtcattatgaatagaattgccataaacatttgtctagaggttttgtgtgaacac

SEQ ID NO: 133829 - DNA, 202 bp, Homo sapiens
tgctgcgattacaggcatgagcttctgcgcccagccagcttggtattttcctcatttctctggagatacacattatgaaattttatgcatgccactaattctttgtgatagtctgtatgtaaatacatttaaaaatgtgtactggattttaaaggatttctaagcagaaataaactttagcctaggcagacaaatggacaca

SEQ ID NO: 133830 - DNA, 186 bp, Homo sapiens
tgaaaaagggaaaacactgaaataactgttcgattgcaaaggttaaatctctaaatttctgtatgttttcatcttacttgactttaactagaaaacaggtataatagtgatgccacatactgggaagcaatgagtatttgatacaatgccagattaaaaggtgtacttattttttcgttcaatata

SEQ ID NO: 133831 - DNA, 266 bp, Homo sapiens
atcataaccctgatgtgtacacatcatttcagcttgcatatatgctcttagccctttgcctggctcacacccttaggtaccttgttggagatgttcttgtacctgttggatgggaagaataagaattgtaattaataacctcaattcagatcaaagactgcagactttcataaattaatataaaagtttcatttttcagccaagactgctaagaccctttgtttgaagaggtggatgtccttctctctcccctttggttgagcacg

SEQ ID NO: 133832 - DNA, 352 bp, Homo sapiens
ggctgagagggcaaccgcagcactgcagcccctccatgccgggcggcacaccagccaggagatgtggatggccacaggcagtccccggaggagggatgccaagaggacacatctgtttgctcagctggaggtaaaacagccggcgtctgaacgcttctgatgatgtgggttccccttgctgaaagaaatgtgcagctgatttgaacaagccacagcggggcagtgagtgttctccaaagggtcctcctggaaagctacttatcccaagacactgccactgttccaaaggtttccagaacgtgccttagagatgccttcagaagccactagaacatcctttcgagcagctcca

SEQ ID NO: 133833 - DNA, 362 bp, Homo sapiens
ggctgagagggcaaccgcagcactgcagcccctccatgccgggcggcacaccagccaggagatgtggatggccacaggcagtccccggaggagggatgccaagaggacacatctgtttgctcagctggaggtaaaacagccggcgtctgaacgcttctgatgatgtgggttccccttgctgaaagaaatgtgcagctgatttgaacaagccacagcggggcagtgagtgttctccaaagggtcctcctggaaagctacttatcccaagacactgccactgttccaaaggtttccagaacgtgccttagagagaaggtccaggtatgccagaaggtccaggtatgccagaaggtccaggtatg

SEQ ID NO: 133834 - DNA, 120 bp, Homo sapiens
ggttcccacacctagtatcatcagcatcaccaaagaacttgttagaaatgcaaaattggcttggacttcagacctctggaatcagaactctggaggtggggcccatcagtctgtgtttta

SEQ ID NO: 133835 - DNA, 405 bp, Homo sapiens
tcttggattcatttgttcaggaggcaaggtccctttgggcatcaatagtgtgaaaagccctccaagtgattctaatttagagcctttgcaagtcactagttaaggggtggtagggtggctgttgttaaatcatcctaactttttgtcttttcctgattatccctttctctgttggttcctttttcacatttatgggaaaagcaattatgtacctttttggaggtttcactatgttttccttttgctgggggtaccatttctgggaaatatgacacagagaaactttgtagtaagtgaaaggtaaatatagttatatatctatagatatggatctgtatattgaaatttaggaaatgagttatttctactgcagtaagccacattttcatgcatgcatagcctgcc

SEQ ID NO: 133836 - DNA, 510 bp, Homo sapiens
aaagctcagtattagggtggcagtggcccgattttccaggtgccatctgtcacccctttccttgaccaggaaagggaactaacttcctgaccccttgcgcttcccgagtgaggcaatgcctcgccctgctttggctagtgcacagtgcacttcacccactgtcctgcacccactgtctggcactccctagtgagatgaacccagtacctcaaatggaaatgcagaaatcacccatcttctgcatcgctcatgctgggagctgtagaccggagctgttcctattcggccatcttggctcctcctcccattattttttaatattttctgaaaatcttctttaaagagagaaagccaaatgtcacccactttttcataaaaccttacaggcaaatctattattcttttcttttttgagatggattttccctcttgttgcccaggctggagtgcaatggtgcgatctcggtttactgcaaccccctgcctcccaggttcaagtgattctcccgc

SEQ ID NO: 133837 - DNA, 610 bp, Homo sapiens
ctctccaggatcagcaagggcccagatttcaaaacatcagaaataaattaaaaggcataattaatgcaattggtaactgacatttaaaacattattatttacatttgtttcaaaaactaaattacttgctataaatctaaatgtgcagaacatgtgaaaactacaaaagttgatgaaagaagttaaagaagacctaaataaatgaagtgtactgtgttcatggattgatggatttgaagactctgtgtagtaaagatgtcaatttcccccaatttagcactattactttttattgcatctatagagaaattgacattaattttatatggaaaaacaaaataactaaaataaccaaagcaattttgaatgtgattaataaagttggagaagtcacattactcaattttcatacttacttcaaagctatactaataaaatgtggtattagtgaaagacatagagatcagtgaaacagaagagagtttaaaataagactcgtgaatgtttttgttttttgacaaatgtgcaaaggcaattcagggagaagggatggtcttttcgacaaatgataaacaattctacatatattaagaaaaaaaggttgttgatc

SEQ ID NO: 133838 - DNA, 723 bp, Homo sapiens
ggaagaagcgtgagtcacttcctgcctcagtctgactgctggagtattgttctcccaactgtggctggcgctacccagtgtggcccctacaagtcttagttccttggcggaggggaagtccccactttgggacaaggccaactggacttatcttcccgctcaactttgaggacccagcattgttcctccagtttccagttcttgcagtgtttgtaaaggtgcccgaatcgtacctgatcccattcactaaatattatctccattttatagaggggtaaattgaggaagtccctgagaaattaacttgtctaaggtgtcccagcaaaaaatagtgccccagggatttgaaccggtttgctgattgatttttcaccagttgccttaagaattatcatgatttaacctctctgggcctcagtttcctcctctataaaatgcagacagtgatacatcaaaggtacttaaaggaaaatgtactgtacccacctcatggggcatgtggtgaggataaaacgggttgacacaggaaaagagctctcaatggtgcctggctcatagaaaacactcagtggattttttttttcccattacccgggaacctgtgttaaggaggccacaggctgatcctgtgcagccaggttatctcacagggagcgagaagagatgggcacaggctactctgcgaccttggaataacccagcctgggaagctcctggccacat

SEQ ID NO: 133839 - DNA, 277 bp, Homo sapiens
aagtacagacgtaatatgtaacaaacctgcacattctgcacatgtatcccagaacttaaagttaaaaaaaaaggcccttttaagctgagatataatatcaaggattattaagagttcacaaagcaaaaaaagagtaggaagaatatttccagcacagagaacacaatgtgcaaaagtcctgaaatgtgaacaagcttggagtgcctcataaagacagtatggctggaacacgatgagaaaagacagtgcaagataaggttggggtcagatcatttag

SEQ ID NO: 133840 - DNA, 412 bp, Homo sapiens
agtccaagggtcctagaccagaatccctgttccaacaggtactctctagctgggcttaggcaacttccttcacctagcagagcctcagcttcttcatctaaaaaagagaatggtgccctgccccagtggtcgaatcagagcagagacacagtgccccacacagcagcagaggcagatggtcacacagaagaagaggcagcgtcactggggagcccagctggggcaggtgagcttcacaatccctgctgagccaagaactgggattccacggatctctgggaagttctggaggggatggctcagggaagtttggaagtgtgtaaacacaagtatgtaaaactcagcagcctggttaacactgcagtttgctcatccaggcccacctctgggcatgctggagctccccatgggc

SEQ ID NO: 133841 - DNA, 579 bp, Homo sapiens
aaaaaaaagatatgcacatgactcagaggtactgagatatgaaaaaaatttgccaaggtgcttggatgattcttcctctttacaaatgcatcatatttgtgcctggctggtcctctttaaagcacccaaggtattaatctgagaggacagcctctatctggggaacatttttttgttctcagtgaagtggcacattcagttcctggtgcaggctcactcaatttccattagtcatttcacagctgtatcttgggaagagaaaatttcaaatacttttggctgatttcacaagtaaacaaaaaacaaggccttccctcttttctcacagatcttgtttgtttacagttttcaagtcaataaaacacgcctgtctttgtagatgtttctcctaagtgtgttagttgtctgctgacctatctgcctggcttccactctactcttgtacctagatttgttgccctcatgttgcaggtgaatgctggactacccactctagtttgttattaaatcgatggagcaatttttgtttggtagtttagtattctaaggctgttcatggacaccatttagaaacgaggg

SEQ ID NO: 133842 - DNA, 134 bp, Homo sapiens
caattatctactgatttatctatccattatctacctatctgtctatctaatttgtttcctgtcagctacactgtcccactctcaatctgttctccacccagtggacacccgaggggtccttgggcaacgcacat

SEQ ID NO: 133843 - DNA, 674 bp, Homo sapiens
gtctcaaaaaaaaaaaaaaaaacaatgaatagacaaagaaagatggaaagaggatgtgtgtgtaacccagagcagaaggacttgaggctgactgtggagtagaaaggagaagggagacagagacaaggcaggcagcaggaagagctgtaggtgtgggagccagcatcacaaagggtccatcccaggtgaccacatccatgcctgcagcacccgggtggacggcgaagcagttatgctcgttggctcatggtcactgttatctgaagataactgtgagtcacattttctctgggatttcaaaaactaaataaacctatttataatcccctcttaacagtataatttagttcagtgttttgtgagcccttttctgtttcagatccagttctttgagtattgacacaccatcacagtcttactgtgacacgggcctgtcttgtaccagtgtatccagcagatggcattagaattcttaaatgtcagctccatactcttaaaacagcacactccaacagaaataaaaaataaatctgtggcgcatgcctgtaatcccagctacttgggaggctgaggcaggagaatcgctggagcctgggaggtggaggttgccgtgagctgagattgcgccattgcacttcagcctgggcaacgagtgaaactccgtctcaaaatta

SEQ ID NO: 133844 - DNA, 750 bp, Homo sapiens
ggtctttacagttaacacaacctggagtagcccatgccatactgtgtccttttaagtcagtaaattgaactaagtcggttattcggcaagcagttcctataaaaaactacatggctaaggtgagtgatgatcactgaaaggaattcattgacccactgaaaaaatgagagtagatgaaactactgcagtcatcctgcctgcccctgttagctggctgagtgaggtgttttgccccggtgggctgtggacattatcttcatgtttaaagtgtgtgtactgggggcgagaggccaggaatgatatgatgggtgtaggtcattgtctaggaaaactagaaaatccaaatgttcaaaggaagtaaggtgttgtagtgaaaagctgtcaccctggcctatcgatgttctgttatggtgtttcttagtaaatcccaggctgcatctatatagtcactcatagtaagtgtgtgtttgtccagtggtaggagtggccagaaatattgcatctgttccaccctcaattgaaacagcttctttctccactgtatttcttttgtttttgttatttatttatttatttatttatttttggagatggagtcccgctctgctgcctaggctggagtgcagtggctcactgcaacctccactccccaggagaatcgctggagcctgggaggtggaggttgccgtgagctgagattgcgccattgcacttcagcctgggcaacgagtgaaactccgtctcaaaatt

SEQ ID NO: 133845 - DNA, 2151 bp, Homo sapiens
ggtctttacagttaacacaacctggagtagcccatgccatactgtgtccttttaagtcagtaaattgaactaagtcggttattcggcaagcagttcctataaaaaactacatggctaagatgtacacgttggataattccatgcccatcttggcattgcgaccaggagcttctgcatcccttgcttccaaagagaaccagtgaaacatctttttattcttgcaggttcttaatgattgaccacaagcagatctttcaccctcggatctctagctacaaaaggaaccactggctcaatgacctgtaagggccgtttcagcacatccattctgtccatctccaagccttcaccgtagggaagaactttgctctcagtcacctctcagagagctctctttatagctgaaggtccctctcatgagttacatcaagagtaacctagaattatatcagcaatacacagccatggcccccaagctactggcccgcatctccaaactcctcatgatctgccagaatgcaggcatttctgtaccaaaaggcatcagaaacatctttgagttcacttgggaagagctcatcagtgacccttcagtgcctaccccgtccgacatcttgggcctggaggtcagctttggagcccccctggtggtgctcatggaacccacctttgtgcaggtccccacactgaagaagccactacctccaccaccaccagcaccaccacgtccagtgctgctggcaaccactggggcagccaagcgctccaccctctctcccaccatggcccgtcaggtgcgcacccaccaggagaccctgaacaggtttcagcagcagtccatccacctgctgacggagctcctcagactgaagatgaaggccatggtggagtctatgtcggtgggtgccaaccccttggacatcaccaggcgctttgtggaggccagccagctcctccacctcaatgccaaggagatggccttcaactgcctgatcagcacagccgggagaagtggctacagcagcggacagttgtggaaagagtccctcgcaaacatgtccgccattggggtgaactcgccttaccagctgatctaccactcttccacagcctgtctgagcttttctctctctgctggaaaagaagccaagaagaaaataggcaaatctagaactacagaagatgtcagcatgccgcccctgcatcgaggagtgggaacccctgccaacagcctggagttcagcgacccctgccctgaggcccgggagaagctgcaggagttgtgtcgccacatagaagctgaaagggccacatggaaagggaggaatatctcctaccccatgatcttacgaaactacaaggcaaagatgccctctcatctaatgttggcccgcaaaggagactctcagaccccgggtttacattaccctcccactgcaggtgctcagactctcagccccacctctcacccatcttctgccaaccatcatttcagtcagcattgtcaagaggggaaggcacccaagaaggccttcaagtttcattacaccttctatgatggctcctccttcgtttactatccctctggaaacgtcgctgtatgtcagatccccacatgctgcagagggagaaccatcacctgcctctttaatgacatacctggattctccttgctggccctattcaatactgaaggccagggctgtgttcactacaacctaaaaaccagttgcccatatgtcttaatcttggatgaggaaggtgggaccaccaatgaccagcagggctatgtagtccacaagtggagctggacttccaggacagagaccctgctttccctggaatacaaggtgaatgaggaaatgaaactaaaggtactgggacaggactccatcacagtcaccttcacctccctgaatgagacagtaacactcactgtgtcggccaacaattgtccccatggaatggcatatgacaaacggtttcaggcatggctggatccaggccctgaaatgattccaccagatcttcgcatctcttggctctgctttcctctttgttggcttcattctcaaggagtttctctcctgttgatgacaagatgaccatgaacatctctgggctattattataccagctttagtgcccctg

SEQ ID NO: 133846 - DNA, 2304 bp, Homo sapiens
gtctcaaaaaaaaaaaaaaaaacaatgaatagacaaagaaagatggaaagaggatgtgtgtgtaacccagagcagaaggacttgaggctgactgtggagtagaaaggagaagggagacagagacaaggcaggcagcaggaagagctgtaggtgtgggagccagcatcacaaagggtccatcccaggtgaccacatccatgcctgcagcacccgggtggacggcgaagcagttatgctcgttggctcatggtcactgttatctgaagataactatgtacacgttggataattccatgcccatcttggcattgcgaccaggagcttctgcatcccttgcttccaaagagaaccagtgaaacatctttttattcttgcaggttcttaatgattgaccacaagcagatctttcaccctcggatctctagctacaaaaggaaccactggctcaatgacctgtaagggccgtttcagcacatccattctgtccatctccaagccttcaccgtagggaagaactttgctctcagtcacctctcagagagctctctttatagctgaaggtccctctcatgagttacatcaagagtaacctagaattatatcagcaatacacagccatggcccccaagctactggcccgcatctccaaactcctcatgatctgccagaatgcaggcatttctgtaccaaaaggcatcagaaacatctttgagttcacttgggaagagctcatcagtgacccttcagtgcctaccccgtccgacatcttgggcctggaggtcagctttggagcccccctggtggtgctcatggaacccacctttgtgcaggtccccacactgaagaagccactacctccaccaccaccagcaccaccacgtccagtgctgctggcaaccactggggcagccaagcgctccaccctctctcccaccatggcccgtcaggtgcgcacccaccaggagaccctgaacaggtttcagcagcagtccatccacctgctgacggagctcctcagactgaagatgaaggccatggtggagtctatgtcggtgggtgccaaccccttggacatcaccaggcgctttgtggaggccagccagctcctccacctcaatgccaaggagatggccttcaactgcctgatcagcacagccgggagaagtggctacagcagcggacagttgtggaaagagtccctcgcaaacatgtccgccattggggtgaactcgccttaccagctgatctaccactcttccacagcctgtctgagcttttctctctctgctggaaaagaagccaagaagaaaataggcaaatctagaactacagaagatgtcagcatgccgcccctgcatcgaggagtgggaacccctgccaacagcctggagttcagcgacccctgccctgaggcccgggagaagctgcaggagttgtgtcgccacatagaagctgaaagggccacatggaaagggaggaatatctcctaccccatgatcttacgaaactacaaggcaaagatgccctctcatctaatgttggcccgcaaaggagactctcagaccccgggtttacattaccctcccactgcaggtgctcagactctcagccccacctctcacccatcttctgccaaccatcatttcagtcagcattgtcaagaggggaaggcacccaagaaggccttcaagtttcattacaccttctatgatggctcctccttcgtttactatccctctggaaacgtcgctgtatgtcagatccccacatgctgcagagggagaaccatcacctgcctctttaatgacatacctggattctccttgctggccctattcaatactgaaggccagggctgtgttcactacaacctaaaaaccagttgcccatatgtcttaatcttggatgaggaaggtgggaccaccaatgaccagcagggctatgtagtccacaagtggagctggacttccaggacagagaccctgctttccctggaatacaaggtgaatgaggaaatgaaactaaaggtactgggacaggactccatcacagtcaccttcacctccctgaatgagacagtaacactcactgtgtcggccaacaattgtccccatggaatggcatatgacaaacggtttcaggcatggctggatccaggccctgaaatgattccaccagatcttcgcatctcttggctctgctttcctctttgttggcttcattctcaaggagtttctctcctgttgatgacaagatgaccatgaacatctctgggctattattataccagctttagtgcccctg

SEQ ID NO: 133847 - DNA, 2788 bp, Homo sapiens
ggtctttacagttaacacaacctggagtagcccatgccatactgtgtccttttaagtcagtaaattgaactaagtcggttattcggcaagcagttcctataaaaaactacatggctaaggttcttaatgattgaccacaagcagatctttcaccctcggatctctagctacaaaaggtccccacactgaagaagccactacctccaccaccaccagcaccaccacgtccagtgctgctggcaaccactggggcagccaagcgctccaccctctctcccaccatggcccgtcaggtgcgcacccaccaggagaccctgaacaggtttcagcagcagtccatccacctgctgacggagctcctcagactgaagatgaaggccatggtggagtctatgtcggtgggtgccaaccccttggacatcaccaggcgctttgtggaggccagccagctcctccacctcaatgccaaggagatggccttcaactgcctgatcagcacagccgggagaagtggctacagcagcggacagttgtggaaagagtccctcgcaaacatgtccgccattggggtgaactcgccttaccagctgatctaccactcttccacagcctgtctgagcttttctctctctgctggaaaagaagccaagaagaaaataggcaaatctagaactacagaagatgtcagcatgccgcccctgcatcgaggagtgggaacccctgccaacagcctggagttcagcgacccctgccctgaggcccgggagaagctgcaggagttgtgtcgccacatagaagctgaaagggccacatggaaagggaggaatatctcctaccccatgatcttacgaaactacaaggcaaagatgccctctcatctaatgttggcccgcaaaggagactctcagaccccgggtttacattaccctcccactgcaggtgctcagactctcagccccacctctcacccatcttctgccaaccatcatttcagtcagcattgtcaagaggggaaggcacccaagaaggccttcaagtttcattacaccttctatgatggctcctccttcgtttactatccctctggaaacgtcgctgtatgtcagatccccacatgctgcagagggagaaccatcacctgcctctttaatgacatacctggattctccttgctggccctattcaatactgaaggccagggctgtgttcactacaacctaaaaaccagttgcccatatgtcttaatcttggatgaggaaggtgggaccaccaatgaccagcagggctatgtagtccacaagtggagctggacttccaggacagagaccctgctttccctggaatacaaggtgaatgaggaaatgaaactaaaggtactgggacaggactccatcacagtcaccttcacctccctgaatgagacagtaacactcactgtgtcggccaacaattgtccccatggaatggcatatgacaaacggctgaaccgcagaatcagcaacatggacgacaaggtgtataagatgagccgagccctggctgagatcaagaagcggtttcagaagacagtgactcagttcattaattctatcttgctggccgcaggtctgtttaccattgaatatcccaccaaaaaggaggaggaagaatttgttcggttcaagatgagatccagaactcatcccgagcggctccccaagctaagtttatactcaggagaaagtcttttacgatctcagtcaggccacctggaatcctcaattgcagagactttgaaggatgagcctgagtctgctcctgtgagcccagttcggaagaccaccaaaatccacaccaaagccaaggtcacatccagagggaaggcccgcgaggggcgcagccccaccaggtgggcggccttgccctcagactgcccgctggtgctgcggaagctcatgctcaaggaagacacccgtgctggctgcaagtgcctggtgaaggcgcccctggtctctgacgtggagctggagcgcttcctgttggcgccccgagaccccagccaagtgctggtgtttgggatcatctcaagccagaactacaccagcactgggcagctccagtggctgctgaacactctctacaaccaccagcagcggggccgtggctccccctgcatccagtgccggtatgactcctaccgcctgctgcagtatgacctggacagccccctgcaggaggaccctcccctgatggtgaagaagaactctgtggtgcaggggatgattctgatgtttgccggggggaagctcatttttgggggccgtgttttgaatggatatggcctcagcaagcagaatctgctgaaacagatcttccggtctcaacaggattacaagatgggctacttcctgccggatgactacaaattcagtgttcccaactctgtcctgagcctggaggattctgaatcagtcaagaaagccgagtcagaagatatccaaggaagcagctcctcattggccctggaagactatgtggagaaggagttatctctggaggctgagaagacaagagagcctgaagtggagctacatcctctcagcagggacagcaagataactagttggaagaagcaggcctccaagaagtagcgccatcctggcagcagccaagtgagccaggccccggcccggggtgctggggcttcttgccagcccagccctgcctccccggtctcccaccctgtcctccaagcttctataataaaccagcgggcctccagcattggggtgaggctctggggaaggac

SEQ ID NO: 133848 - DNA, 1755 bp, Homo sapiens
ggtctttacagttaacacaacctggagtagcccatgccatactgtgtccttttaagtcagtaaattgaactaagtcggttattcggcaagcagttcctataaaaaactacatggctaagatgtacacgttggataattccatgcccatcttggcattgcgaccaggagcttctgcatcccttgcttccaaagagaaccagtgaaacatctttttattcttgcaggttcttaatgattgaccacaagcagatctttcaccctcggatctctagctacaaaaggtccccacactgaagaagccactacctccaccaccaccagcaccaccacgtccagtgctgctggcaaccactggggcagccaagcgctccaccctctctcccaccatggcccgtcaggtgcgcacccaccaggagaccctgaacaggtttcagcagcagtccatccacctgctgacggagctcctcagactgaagatgaaggccatggtggagtctatgtcggtgggtgccaaccccttggacatcaccaggcgctttgtggaggccagccagctcctccacctcaatgccaaggagatggccttcaactgcctgatcagcacagccgggagaagtggctacagcagcggacagttgtggaaagagtccctcgcaaacatgtccgccattggggtgaactcgccttaccagctgatctaccactcttccacagcctgtctgagcttttctctctctgctggaaaagaagccaagaagaaaataggcaaatctagaactacagaagatgtcagcatgccgcccctgcatcgaggagtgggaacccctgccaacagcctggagttcagcgacccctgccctgaggcccgggagaagctgcaggagttgtgtcgccacatagaagctgaaagggccacatggaaagggaggaatatctcctaccccatgatcttacgaaactacaaggcaaagatgccctctcatctaatgttggcccgcaaaggagactctcagaccccgggtttacattaccctcccactgcaggtgctcagactctcagccccacctctcacccatcttctgccaaccatcatttcagtcagcattgtcaagaggggaaggcacccaagaaggccttcaagtttcattacaccttctatgatggctcctccttcgtttactatccctctggaaacgtcgctgtatgtcagatccccacatgctgcagagggagaaccatcacctgcctctttaatgacatacctggattctccttgctggccctattcaatactgaaggccagggctgtgttcactacaacctaaaaaccagttgcccatatgtcttaatcttggatgaggaaggtgggaccaccaatgaccagcagggctatgtagtccacaagtggagctggacttccaggacagagaccctgctttccctggaatacaaggtgaatgaggaaatgaaactaaaggtactgggacaggactccatcacagtcaccttcacctccctgaatgagacagtaacactcactgtgtcggccaacaattgtccccatggaatggcatatgacaaacggtttcaggcatggctggatccaggccctgaaatgattccaccagatcttcgcatctcttggctctgctttcctctttgttggcttcattctcaaggagtttctctcctgttgatgacaagatgaccatgaacatctctgggctattattataccagctttagtgcccctg

SEQ ID NO: 133849 - DNA, 2331 bp, Homo sapiens
ttttcagttgcatgtaataccaagaaatcgaattgttttccgttcttatgggaattgttagcaatgcccttattggaatttttaacttcacagagcttattcaaatggagagcaccttattttttcgtgatgacatagtgctggatcttggttttatagatgggtccatatttttgttgttgatcacaaactgcatttctccttatattggcataagcagcatcagtgattattaaaaaaagttcaatctcagttatggatttcaggcctctggccttcagcataatggtgtggacaggctctggtggacattccattacacttcttgattctcctttccaatacatttaatttactacttctcatttctgggattccagcttccatgggaactcatgtttgttttggtggtatgcataattggttgtgcagcttctcttgtattcctcatgtacgtgctttcattcatcttttgcaagtggagaaaaaataatggcttttggtcttttggcttttttattgtcttaatatgtgtatccacaattctggtatcaactaagtaagaaaaacccaacttaattttgtgcatgatattcataccttcctttactttcctaggatatgtcgttattgatccagctcaactttatgtatatgagaaacttggacagtctggacaatagaataaatgaagtcaataaaaccattcttttaacaaacttaataccataccttcagagtgttattttcctttttgtcataaggtgtctggaaatgaagtatggaaatgaaatcatgaataaagacccagttttcagaatctctccacgaagtagaggaactcataccaatccagaagagcctgaagaagatgttcaagctgaaagagtccaagcagcaaatgcactcactactccaaacttggaggaggaaccagtcataactgcaagctgtttacacaaggaatattatgagacaaagaaagttgcttttcaacaacaaagaagaaagcagccatcagaaatgtttcgttttgtgttaaaaagtgaagttttgggattactaggacacaatggagctggcaaaagtacttccattaaaatgataactgggtgcacagtgccaactgcaggagtggtggtgttacaaggcaacagagcatcagtaaggcaacagcgtgacaacagcctcaagttcttgggtactgccctcaggagaactcactgtgtcccaaacttacaatgaaagagcatttggagttgtatgcagccgtgaaaggactgggcaaagatgctgctcttagtatttcatgattggtggaagctctcaagctccaggagcaacttaaggctcccgtgaaaactctatcagagggaataaagagaaagctatgcttcgtgctgagcatactggggaacccatcagtggtgcttctagacgagctgttcaccgggatggaccctgaggggcagcagcaaatgtggcagatacttcaggctaccattaaaaaccaggagaggggcgccctcttgaccacccattacatgtcagaggctaagtctctgtgtgaccgtgtggccatcatggtgtcaggaacgctaaggtgtattggttccattcaacagctgaaaagtttggtaaagattatttactagaaataaaaatgaaagaacctactcaggtggaagctctccacacagagattttgaagcttttcccacaggctgcttggcaggaaagatattcctctttaatggcatgtaagttacctgtggaggatgtccaccctctgtctcaggcctttttcaaattaaaggcagtgaaacagaccttcaacctggaggaatacagcctctctcaggctaccttggagcaggtgttcttagaactctgtaaagagcaggcgctgggaaatgttgatgataaaattgatataacagttcgatggaaacttctcccacgggaagattcttaaaacgaagaacctcctaacattcaattttaagtcctactgcattattagtttccataattctacaagaatgtttccttttacttcagttaacaaaagaaaatattcaatagtttaaacatgcaacaatgattaaagttttcatttttaaaaattttaggatgaaggaaacaaggaaatatagggaaaagtagcagacaaaattaacaaactcagacatgttattcatccccaacatgggtctattttgtgcttaaaaataattttaaaatcataaaatattaggtttgtttttggttattatcaataaagttaacactgagcacattttacaaataaaaatgagttttttgcctaaa

SEQ ID NO: 133850 - DNA, 2066 bp, Homo sapiens
gcctgttgcttcagcctgagctcggttagggcctcacttccctgcttccacacctcagggaggcctcggtgattttgccagagcctcagcctccatcgctctgtaacctgcgggtattggatgattcgtagctaagacttcgcgacacccttgaagctgagaaatggaacccttaacattcagggatgtggccatagaattctctccagaagagtggaaatgcctggaccctgcccagcagaatttgtatagagatgtgatgttggagaactacagaaacctggtctccctagagatggggtttcaccatgttagccaggatggtctcgatctcctgacctcatgatccgcctgcctctgcctcccaaagtgctgggattacaggcgggagccaccacacccggccctcttgaaatttttaagagacttaatgaggaaggaacagagccacagagaaaaatgacttgctcacaacagaagagccagtagtaaaacacaggtgtctggaaatgaagtatggaaatgaaatcatgaataaagacccagttttcagaatctctccacgaagtagaggaactcataccaatccagaagagcctgaagaagatgttcaagctgaaagagtccaagcagcaaatgcactcactactccaaacttggaggaggaaccagtcataactgcaagctgtttacacaaggaatattatgagacaaagaaagttgcttttcaacaacaaagaagaaagcagccatcagaaatgtttcgttttgtgttaaaaagtgaagttttgggattactaggacacaatggagctggcaaaagtacttccattaaaatgataactgggtgcacagtgccaactgcaggagtggtggtgttacaaggcaacagagcatcagtaaggcaacagcgtgacaacagcctcaagttcttgggtactgccctcaggagaactcactgtgtcccaaacttacaatgaaagagcatttggagttgtatgcagccgtgaaaggactgggcaaagatgctgctcttagtatttcatgattggtggaagctctcaagctccaggagcaacttaaggctcccgtgaaaactctatcagagggaataaagagaaagctatgcttcgtgctgagcatactggggaacccatcagtggtgcttctagacgagctgttcaccgggatggaccctgaggggcagcagcaaatgtggcagatacttcaggctaccattaaaaaccaggagaggggcgccctcttgaccacccattacatgtcagaggctaagtctctgtgtgaccgtgtggccatcatggtgtcaggaacgctaaggtgtattggttccattcaacagctgaaaagtttggtaaagattatttactagaaataaaaatgaaagaacctactcaggtggaagctctccacacagagattttgaagcttttcccacaggctgcttggcaggaaagatattcctctttaatggcatgtaagttacctgtggaggatgtccaccctctgtctcaggcctttttcaaattaaaggcagtgaaacagaccttcaacctggaggaatacagcctctctcaggctaccttggagcaggtgttcttagaactctgtaaagagcaggcgctgggaaatgttgatgataaaattgatataacagttcgatggaaacttctcccacgggaagattcttaaaacgaagaacctcctaacattcaattttaagtcctactgcattattagtttccataattctacaagaatgtttccttttacttcagttaacaaaagaaaatattcaatagtttaaacatgcaacaatgattaaagttttcatttttaaaaattttaggatgaaggaaacaaggaaatatagggaaaagtagcagacaaaattaacaaactcagacatgttattcatccccaacatgggtctattttgtgcttaaaaataattttaaaatcataaaatattaggtttgtttttggttattatcaataaagttaacactgagcacattttacaaataaaaatgagttttttgcctaaa

SEQ ID NO: 133851 - DNA, 618 bp, Homo sapiens
gcctgttgcttcagcctgagctcggttagggcctcacttccctgcttccacacctcagggaggcctcggtgattttgccagagcctcagcctccatcgctctgtaacctgcgggtattggatgattcgtagctaagacttcgcgacacccttgaagctgagaaatggaacccttaacattcagggatgtggccatagaattctctccagaagagtggaaatgcctggaccctgcccagcagaatttgtatagagatgtgatgttggagaactacagaaacctggtctccctaggccgggcatggtggctcacgcctgtaatcccagcacttcgggaggctgaggcgggtggatcacctgaggtcaggagttcaagaccagcctgaccggcatggagaaaccctgtctccactaaaaatggaaaattagccaggtgtggtggcgcatgcctgtgatcccagctactcgggagactaaggcaggagaatcacttgaacccgggggcggaggttgcagtgagccgacattgtgccactgcactccagcctgggtgacagggcgagactccatctcaataaataaataaataaataaataaataaataaataaaaatttttt

SEQ ID NO: 133852 - DNA, 784 bp, Homo sapiens
gcctgttgcttcagcctgagctcggttagggcctcacttccctgcttccacacctcagggaggcctcggtgattttgccagagcctcagcctccatcgctctgtaacctgcgggtattggatgattcgtagctaagacttcgcgacacccttgaagctgagaaatggaacccttaacattcagggatgtggccatagaattctctccagaagagtggaaatgcctggaccctgcccagcagaatttgtatagagatgtgatgttggagaactacagaaacctggtctccctagttgacttgcagtatccagaggaaatgtggagaaacacagttgtacagaagggaagaaaataggttgatactcctgttgcaggaccatttgaagtctgagagtttccagctatgtgttctcatttcacccaagacttttgccagtgcaggggatagaagattcattccacaaacttatactgagaagatatgagaaatgtgggcatgataatttacaattaaggaaaggctgtaaaagtatgaacgtgtgtaaagtgcagaagggagtttataatggaattaataaatgcttgtcaaatactcagagcaaaatatttcaatgtaatgcacgtgtcaaagtttttagtaaatttgcaaattcaaacaaagataagacaagacatactggagagaaacactttaaatgtaacgaatgtggcagtcatttcagaagttctcagacctaactcaacataaaggaattcatgctggagagaaccctacacttgtgaa

SEQ ID NO: 133853 - DNA, 926 bp, Homo sapiens
gcctgttgcttcagcctgagctcggttagggcctcacttccctgcttccacacctcagggaggcctcggtgattttgccagagcctcagcctccatcgctctgtaacctgcgggtattggatgattcgtagctaagacttcgcgacacccttgaagctgagaaatggaacccttaacattcagggatgtggccatagaattctctccagaagagtggaaatgcctggaccctgcccagcagaatttgtatagagatgtgatgttggagaactacagaaacctggtctccctagctatgtgttctcatttcacccaagacttttgccagtgcaggggatagaagattcattccacaaacttatactgagaagatatgagaaatgtgggcatgataatttacaattaaggaaaggctgtaaaagtatgaacgtgtgtaaagtgcagaagggagtttataatggaattaataaatgcttgtcaaataaaaaaaaaaaaaaaaaaaaaaaaaaaaaaaaaaaaaaaaaaaaaaaaaggggggggggcaaaaaatacccccgggggggcccctttttggcccccgtttttttgttaaggggggcccctaaggggggggcgctatataaagggcaggccggcgccgcgtttaaaaaagaagttggggtgtcgggcaaaaacagcctcatctgcgcgggacccctggtggggaaggggaccccacactgcttgcgccggggcatctggtgcggacccacaccccaagagaattaaaggcaccgggcacaataaacatttcgggttttacgtgtgtaaccagcgcctattgctggcggagaaaatttgtccggattattatacaggctccaaaatatctacaagaatgacaacctgccctcaccccgacccaccagtacaacagtgtcacgccc

SEQ ID NO: 133854 - DNA, 616 bp, Homo sapiens
gcctgttgcttcagcctgagctcggttagggcctcacttccctgcttccacacctcagggaggcctcggtgattttgccagagcctcagcctccatcgctctgtaacctgcgggtattggatgattcgtagctaagacttcgcgacacccttgaagctgagaaatggaacccttaacattcagggatgtggccatagaattctctccagaagagtggaaatgcctggaccctgcccagcagaatttgtatagagatgtgatgttggagaactacagaaacctggtctccctaggtgaggataactttaatgcataattcctaatactccctctgagttttattttctatttttgtagaatgtcttttgagatatatctatataaaaatgtgtgtctcacacacacagctatgtaagttatatatgtgtatagtaaattcttaacattgttgatagattctcagaaactgtaagtgaagcaacatatcatttaggaaaatgaattttagggctgggtgcagtggctcacgcctgtaatcccagcactttgggaggctgaggtgggcagatcaggaggtcaggagtttgagaccagccttgccaacatggcaaaaccc

SEQ ID NO: 133855 - DNA, 2182 bp, Homo sapiens
gcctgttgcttcagcctgagctcggttagggcctcacttccctgcttccacacctcagggaggcctcggtgattttgccagagcctcagcctccatcgctctgtaacctgcgggtattggatgattcgtagctaagacttcgcgacacccttgaagctgagaaatggaacccttaacattcagggatgtggccatagaattctctccagaagagtggaaatgcctggaccctgcccagcagaatttgtatagagatgtgatgttggagaactacagaaacctggtctccctagaggaaggaacagagccacagagaaaaatgacttgctcacaacagaagagccagtagtaaaacacaggtttgacttgcagtatccagaggaaatgtggagaaacacagttgtacagaagggaagaaaataggttgatactcctgttgcaggaccatttgaagtctgagagtttccaggatatgtcgttattgatccagctcaactttatgtatatgagaaacttggacagtctggacaatagaataaatgaagtcaataaaaccattcttttaacaaacttaataccataccttcagagtgttattttcctttttgtcataaggtgtctggaaatgaagtatggaaatgaaatcatgaataaagacccagttttcagaatctctccacgaagtagaggaactcataccaatccagaagagcctgaagaagatgttcaagctgaaagagtccaagcagcaaatgcactcactactccaaacttggaggaggaaccagtcataactgcaagctgtttacacaaggaatattatgagacaaagaaagttgcttttcaacaacaaagaagaaagcagccatcagaaatgtttcgttttgtgttaaaaagtgaagttttgggattactaggacacaatggagctggcaaaagtacttccattaaaatgataactgggtgcacagtgccaactgcaggagtggtggtgttacaaggcaacagagcatcagtaaggcaacagcgtgacaacagcctcaagttcttgggtactgccctcaggagaactcactgtgtcccaaacttacaatgaaagagcatttggagttgtatgcagccgtgaaaggactgggcaaagatgctgctcttagtatttcatgattggtggaagctctcaagctccaggagcaacttaaggctcccgtgaaaactctatcagagggaataaagagaaagctatgcttcgtgctgagcatactggggaacccatcagtggtgcttctagacgagctgttcaccgggatggaccctgaggggcagcagcaaatgtggcagatacttcaggctaccattaaaaaccaggagaggggcgccctcttgaccacccattacatgtcagaggctaagtctctgtgtgaccgtgtggccatcatggtgtcaggaacgctaaggtgtattggttccattcaacagctgaaaagtttggtaaagattatttactagaaataaaaatgaaagaacctactcaggtggaagctctccacacagagattttgaagcttttcccacaggctgcttggcaggaaagatattcctctttaatggcatgtaagttacctgtggaggatgtccaccctctgtctcaggcctttttcaaattaaaggcagtgaaacagaccttcaacctggaggaatacagcctctctcaggctaccttggagcaggtgttcttagaactctgtaaagagcaggcgctgggaaatgttgatgataaaattgatataacagttcgatggaaacttctcccacgggaagattcttaaaacgaagaacctcctaacattcaattttaagtcctactgcattattagtttccataattctacaagaatgtttccttttacttcagttaacaaaagaaaatattcaatagtttaaacatgcaacaatgattaaagttttcatttttaaaaattttaggatgaaggaaacaaggaaatatagggaaaagtagcagacaaaattaacaaactcagacatgttattcatccccaacatgggtctattttgtgcttaaaaataattttaaaatcataaaatattaggtttgtttttggttattatcaataaagttaacactgagcacattttacaaataaaaatgagttttttgcctaaa

SEQ ID NO: 133856 - DNA, 1860 bp, Homo sapiens
gcctgttgcttcagcctgagctcggttagggcctcacttccctgcttccacacctcagggaggcctcggtgattttgccagagcctcagcctccatcgctctgtaacctgcgggtattggatgattcgtagctaagacttcgcgacacccttgaagctgagaaatggaacccttaacattcagggatgtggccatagaattctctccagaagagtggaaatgcctggaccctgcccagcagaatttgtatagagatgtgatgttggagaactacagaaacctggtctccctaggtgtctggaaatgaagtatggaaatgaaatcatgaataaagacccagttttcagaatctctccacgaagtagaggaactcataccaatccagaagagcctgaagaagatgttcaagctgaaagagtccaagcagcaaatgcactcactactccaaacttggaggaggaaccagtcataactgcaagctgtttacacaaggaatattatgagacaaagaaagttgcttttcaacaacaaagaagaaagcagccatcagaaatgtttcgttttgtgttaaaaagtgaagttttgggattactaggacacaatggagctggcaaaagtacttccattaaaatgataactgggtgcacagtgccaactgcaggagtggtggtgttacaaggcaacagagcatcagtaaggcaacagcgtgacaacagcctcaagttcttgggtactgccctcaggagaactcactgtgtcccaaacttacaatgaaagagcatttggagttgtatgcagccgtgaaaggactgggcaaagatgctgctcttagtatttcatgattggtggaagctctcaagctccaggagcaacttaaggctcccgtgaaaactctatcagagggaataaagagaaagctatgcttcgtgctgagcatactggggaacccatcagtggtgcttctagacgagctgttcaccgggatggaccctgaggggcagcagcaaatgtggcagatacttcaggctaccattaaaaaccaggagaggggcgccctcttgaccacccattacatgtcagaggctaagtctctgtgtgaccgtgtggccatcatggtgtcaggaacgctaaggtgtattggttccattcaacagctgaaaagtttggtaaagattatttactagaaataaaaatgaaagaacctactcaggtggaagctctccacacagagattttgaagcttttcccacaggctgcttggcaggaaagatattcctctttaatggcatgtaagttacctgtggaggatgtccaccctctgtctcaggcctttttcaaattaaaggcagtgaaacagaccttcaacctggaggaatacagcctctctcaggctaccttggagcaggtgttcttagaactctgtaaagagcaggcgctgggaaatgttgatgataaaattgatataacagttcgatggaaacttctcccacgggaagattcttaaaacgaagaacctcctaacattcaattttaagtcctactgcattattagtttccataattctacaagaatgtttccttttacttcagttaacaaaagaaaatattcaatagtttaaacatgcaacaatgattaaagttttcatttttaaaaattttaggatgaaggaaacaaggaaatatagggaaaagtagcagacaaaattaacaaactcagacatgttattcatccccaacatgggtctattttgtgcttaaaaataattttaaaatcataaaatattaggtttgtttttggttattatcaataaagttaacactgagcacattttacaaataaaaatgagttttttgcctaaa
